United States Patent 11,931,406 (FLAVIVIRUS VACCINE) - sequence listing, part 39

SEQ ID NO: 14926 - RNA, 9876 nt, Artificial Sequence
  derived and/or modified CDS sequence (opt3) from DENV-2__FM210235__SS-prME
accgccggcgugaucauuaugcugauacccacagcuauggcauuccaccucacuacgagaaacggggagccucauaugaucgucggaaggcaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgcccagaggaucgagaccuggauacugcggcauccuggcuucacaaucauggcagccauuuuggcuuacaccgugggcacgacucacuuucagcgcgcacucaucuucauucugcuggccgcuguugccccauccaugacaaugagaugcaucgggauaucuaacagggauuuuguggaaggagucucggguggcucauggguggacauuguacucgagcacgggagcuguguuaccacuauggcgaagaauaagcccacauuagauuucgaacugaucaaaaccgaggcaaagcagccugccacgcuucggaaauauugcauugaagcuaaguugaccaacacaacuaccgagagucgcuguccaacacaaggagagcccucccugaaugaagagcaggacaaacgauuugugugcagacauucuauggucgauaggggcugggguaacggguguggacuauucggcaagggcgggaucgugacuugcgccauguuuaccugcaagaaaaauauggaaggaaagaucgugcagccugagaaccucgaauacacaauugucauaaccccacacagcggugaggagcaugcaguuggcaaugacacugggaaacacggaaaggaaaucaaaauuacgccgcagucccccaucacagaggcugaacugaccggcuaugguacugugaccauggaguguucaccucggacagggcuugauuucaacgaaaugguacuguugcaaauggaggacaaggccuggcucgugcaccgucagugguuucuggauuuaccacugcccuggcucccuggcgcggacacccagggaaguaauuggauacagaaagagacucuugucacauucaagaacccacaugccaagaaacaagacgugguugugcugggcagccaggaaggggcaaugcacacggcuuugaccggagccacugagauucagaugucuuccgguaaucuacuguuuacaggccaucucaagugccgccugagaauggauaaacuucaacugaaggggaugucauacagcauguguaccggaaaauucaagaucgucaaggaaaucgcugagacacagcacggcacuauugugaucaggguacaguaugagggugacgggagucccugcaaaauuccguucgaaauaauggauuuggagaagcggcauguucucggccgacugaucaccgugaacccuauugucacggaaaaagacucucccgugaacaucgaggccgaaccaccuuuuggagauuccuacaucauuauaggcgucgagcccgggcaguuaaagcugaauugguucaaaaagggaagcucgaucggucaaauguuugagaccacaaugcgcggcgcaaagagaauggccauucuaggggacacugcuugggauuucggaucucucggcgguguguuuaccuccaucgggaaagcgcugcaccagguuuucggcgcaauuuacggagccgcuuuuucaggcgugaguuggacaaugaagauccuuauagggguaaucauuacuuggaucggaaugaacagcagguccaccucuuugagcgucucacuggugcucguuggcgugauuacgcuguaucuuggugccaugguccaggcagacagugggugugugguauccuggaaaaauaaggaacugaaaugcggaagcggcaucuucauaacagauaacgugcacaccuggacugagcaguacaaguuucaaccagaaucucccucaaaguuggccagugcuauucagaaagcccaugaggaagguaucuguggcauucggagcguuacacgccucgagaaucugauguggaagcagaucaccccugaguuaaaccacauacuguccgaaaaugaggucaaacuaacuaucaugaccggggacauuaagggaaucaugcaggcaggcaaaagaucucucaggccacaaccgacagaacugaaguauucguggaaaacgugggggaaggcgaagaugcuuagcaccgagucccauaaccagacuuucuugauugauggacccgaaacagcugagugcccuaauaccaaccgugccuggaauucacuggagguggaagacuacggcuuugguguguucacaacuaacaucuggcucaaacugcgggagaagcaggacgucuuuugugauaguaaauuaaugucugcagccauaaaggacaaucgagcuguucacgccgauaugggguauuggauugaaagcgcacugaacgacaccuggaaaauggagaaggcuuccuucaucgaggugaagucaugccacuggccaaaaagccauacgcuuuggucuaauggaguguuggaauccgagaugaucauucccaagaguuucgccggcccuguaagccagcacaacuacagaccagguuauuacacacaaaccgcgggccccuggcaucucgggaaacuggaaauggauuuugacuucugugagggaacuaccgucgugguuacagaagauugcggcaacagggggccgucucuacgcacuaccacagccuccggaaagcugaucacggaguggugcugucggucaugcacccucccuccacugagauacaggggcgaggacgguuguugguaugggauggaaauucgcccccuuaaagagaaggaagagaauuuggugaacagucuggucacugcuggacacggccagauagauaauuuuagcuuaggugugcucggcauggcacuguuccuugaagagaugcugcgaacacggguugggaccaagcaugccaucuugcucgugacuguaucguuugucacacugauuaccggaaacauguccuuccgugaccuaggcagagugauggugauggucggggcugccaugacggaugacaucggaaugggcguuacuuaccuggcacuccuggcggccuuuaaagugaggccuaccuucgcugccggucuuuugcugcgcaaguuaacaucuaaagagcucaugauggcaaccauugggaucgcucugcuuagccagucaacuauacccgaaacaauccuggagcuaaccgaugcccucgcacugggaaugaugguauugaagauugugcggaauauggaaaaauaucaacuggccgucacaaucauggcuauuaguugcgugccaaacgcgguuaucuuacagaaugccuggaagguguccuguacuauacucgcagcugucucugugagcccucugcuucugaccuccucacagcagaaggccgacuggauucccuuggaguggagcaucaaaggccucaacccaacggccaucuuucugacaacccuaaguagaacuucuaagaaaagguccuggccgcugaaugaagcuauuauggcaguuggcauggugagcauacuugccucgucacuccugaagaacgacaucccuaugaccgggcccuuggucgcgggaggucuguuaacaguaugcuacgugcucacuggccgaucugcugaucuggagcuugagcgcgccaccgacguuaaaugggaagaucaagcagagauuaguggguccagcccaauccugucuauuacgaucgccgaagacggaagcauguccauaaagaaugaggaggaagagcagacauugaccauccucauucggacuggccugcuagugaucucaggucuguuccccgucaguauuccuaucacagcugcagccugguaucuuugggaagugaaaaagcagagagcggggguacucugggaugugccaagccccccuccggucggaaaggcugagcuggaagacggcgccuacaggauaaaacagaagggcauuuugggguauucucaaaucggagcagguguuuacaaagagggcaccuuucacacuauguggcacgugacacguggggccguguuaaugcaucgcggaaagcggaucgagccauccugggcugaugucaaaaaggaccugauuucauacggcgguggguggaagcucgaaggagaguggaaagaaggcgaggaagugcagguucuggcccuugagcccggcaagaacccuagagcaguacagaccaaaccagggcuguucaagacgaauacuggaaccaucggugcugugaguuuggauuuuagccccggcacauccgggucuccuauagucgacaggaaaggaaaggugguuggccuauaugguaacgggguggucacccgaucgggagccuacgugagcgcgauugcccagacagagaagucaaucgaagauaauccggagauugaagacgauaucuuccggaaaaagcgccugacuauaauggaccuccaccccggcgcaggcaaaaccaagagauaucugccagcuauuguaagggaggccaucaaacgggggcuucgaacguuaauccuggcuccuacaagagucguggcagccgaaauggaggaggcccuccgcggauugcccauuagguaccaaacuccagcuauccgugcggaacauaccggucgggagauuguugaccugaugugucacgcaacauucaccaugagacuccuguccccugugaggguccccaacuauaaccuuauaaucauggaugaagcccauuuuacugacccagcuaguauugccgcacgcggcuacaucucuacccgaguggagaugggggaggccgcuggaaucuucaugacagcgacgccgccuggcagcagagaucccuuuccacaguccaaugcccccauuauggacgaagagcgggaaauaccugagaggucauggaacucuggucacgaauggguuacugauuucaaggggaagaccgugugguuugucccaagcaucaaagcaggaaaugacauugcugccugccugcgcaagaacggcaaaaaggugauccaguugagucguaaaacauucgauuccgaguauguaaagaccagaacuaaugacugggauuuugugguuacaaccgacauuagcgagaugggcgcaaacuucaaggccgaacgggucaucgaucccaggcgcuguaugaaaccugugauacuaacggacggggaggaacgagugauccuggcuggaccgaugccagucacucacucuucagccgcgcaaagacgggguaggauuggccgcaaucccaagaacgagaaugaccaguacaucuacaugggggaaccucucgagaacgaugaggacugcgcacauuggaaagaagccaagauguuacuggauaauauuaacacacccgagggaaucauaccauccauguuugaaccugagagagaaaaaguagacgcuauugauggcgaguauaggcuucggggugaggcccguaagaccuucguggaccugaugcgccgaggggaucuccccguuugguuggcuuacagaguggcagccgaaggcaucaauuaugcugacaggcggugguguuuugauggagucaaaaacaaucagauucuggaggaaaacguggagguugagaucuggaccaaggaaggcgagcgcaagaaacucaagccaagauggcuggacgccaggauauacagugauccucuugcacuaaaagaauucaaggaguucgcggccgggcggaaaagccugacuuugaacuuaaucacagaaaugggacgacugccgaccuuuaugacacagaaggcuagagacgcccucgauaaucuggcagugcuucacacugcugaggccgguggccgcgcauauaaccaugcccugucggagcuccccgaaacguuggagacccugcuacugcucacacuucuggcuacugucaccgggggaauuuucuuauuuuugaugucuggcaaggguguggggaaaaugacacugggcaugugcugcaucauuaccgcguccauccuccugugguacgcccaaauacagccacacuggauugcagcuagcaucauccuugaauucuuucugauuguacucuugaucccugagcccgaaaagcagaggacuccacaggacaaucaacugacguaugugguuauagccauuuuaaccgucguggccgcaacaauggcuaacgagaugggauuccuagagaaaacuaagaaagaccugggccucgggucaaucgccacccgggaaccugagaguaauauucuugauaucgaccugcgucccgcgucugcuuggacauuguacgccguggcaaccacuuuugucacaccgaugcugagacacuccauagaaaacagcucaguuaaugugagucucacggccaucgcuaaccaggcaaccguacugaugggacuugguaagggcuggccacucagcaagauggauauuggggugccucuguuggccaucggauguuacucccaggucaaucccauuacucugacagcggcuuuacuacugcucguggcccauuaugcaaucauuggcccaggucuucaggccaaagcuaccagggaggcccaaaagcgcgcagcugccgggaucaugaaaaaccccaccguugacggcgugacagucauagaucuggacccuauuccguacgaucccaaguucgaaaaacaguugggacagguaaugcugcucauccugugcgugacucagguucuuaugaugcggacgaccugggcguuaugugaggcccugacacucgcaacuggcccaaucucuaccuugugggaggggaauccuggacgauuuuggaacacaaccauugcugugagcauggccaauauauucagaggcuccuaucuggcaggugcugggcuacuguuuucaaucaugaagaacacuacgaauacaaggcgcggaaccggcaacauuggugaaacucucggcgagaaguggaaaucucggcuuaaugcccuggggaagagugaauuccaaaucuacaaaaagucgggaauucaggaggucgacagaaccuuggccaaagagggcaucaagcguggggaaacagaucaccaugcggugagcaggggauccgcuaaacugcggugguuugucgagcgcaacauggugacucccgaaggcaagguuguggaccucgguugcgggcgaggaggcuggucuuauuacugugguggccugaagaacguaagagaggugaaaggguuaaccaagggaggcccugggcacgaagagccaauacccaugucaacauauggauggaaucuugucaggcugcagagcggcguugauguguucuucacgccuccagagaaaugcgacacccuccuaugugauaucggugaauccagucccaacccgacuauugaggcagggcggacacugcgcgucuugucucugguggaaaauuggcucaacaaugacacccaauuuugcaucaagguacuuaacccuuacaugccaagcgugauugagaaaauggaaacucugcagagaaaguacggaggcgccuugguuaggaauccccugucacgaaacuccacacaugagauguauugggugaguaaugcuaccggcaacaucgucagcucugugaauaugauaucccggaugcucauuaaccguuucacgaugaagcacaaaaaggccaccuacgagccugacgucgauuuagggucaggaacaagaaauaucgguaucgaaagcgagauuccaaaccuggacauaaucggcaaacgcauugaaaagaucaaacaggagcacgaaacuucguggcauuaugaucaggaccaccccuacaagaccugggcauaucaugggucuuacgagacaaagcaaacuggaagugccuccagcauggugaauggcguuguaaggcuucugaccaaaccgugggauguggucccuauggugacacagauggcuaugaccgacacuacgcccuuuggucagcagcggguuuucaaggagaaaguggauacaagaacccaagaaccaaaggaggggacuaaaaagcuaaugaagauuaccgcggaauggcucuggaaagagcugggaaagaaaaagacaccucgcauguguacgagggaggaauuuacccgaaaaguccggucaaacgccgcauugggcgcuaucuucacugacgagaacaaguggaaauccgccagagaagcaguggaggauucuagguuuugggaacugguagacaaggagcgcaaucuccaccuugagggcaagugcgaaacauguguguauaacaugauggggaaacgugagaagaaacugggagaauucgguaaggccaaaggcagccgggcuauaugguacaugugguuaggggccagauuucuggaguucgaagcguugggauuucucaaugaggaucacugguucaguagggagaacucccugagcggcguugaaggugaggggcuacauaagcuuggauacauccugcgcgacgucucuaagaaagaaggcggcgcaauguaugccgacgauaccgcugggugggacacucgaauuacacucgaggaucugaagaaugaagagauggugaccaaccacauggagggagaacauaaaaaguuggccgaggcaaucuuuaaacugacauaccagaauaaggugguccggguucagagacccacuccaagggguaccgugauggacauuaucucacgcagagaucagcggggcagugggcaaguaggaacguauggccucaacaccuucacaaauauggaagcucagcuuauuaggcagauggagggugaggggguguucaaguccauacaacgucugacugucaccgaagagaucgccgugcagaacugguuagcucgaguuggacgcgaaagacugagccggauggccauuucuggcgacgauugcguggucaaacccuuggacgauagguuugcaucggcgcucacagcccugaaugacaugggcaaggugcgcaaagauauccagcagugggagccuucaagaggguggaacgacuggacucaaguaccauucugcagccaccauuuucacgaacuaaucaugaaggauggacggguucuuguggucccguguaggaaucaggacgagcugauuggucgagcucguauaucccagggcgccggguggagucucaaagagaccgcaugccugggaaagucuuacgcucagauguggagcuugauguauuuccacagacgcgacuuacggcuggccgcaaacgccaucuguuccgcggugcccucacauugggugccuacgaguaggacaaccuggucuauucacgcuaagcaugaauggaugacuacagaggauaugcucaccgucuggaauagaguuuggauccaagaaaacccauggauggaggacaaaacucccguggaaagcugggaggagguaccuuaccuuggcaagcgcgaagaucaguggugcgguucccugauugggcuaaccucacgggccacaugggcaaaaaacauccagacggccauaaaucaggugaggagccugaucggaaacgaggaauauaccgacuacaugccaucuaugaagcgauuuagacgggaggaagaggaggcuggcguccucugguga

SEQ ID NO: 14927 - RNA, 9876 nt, Artificial Sequence
  derived and/or modified CDS sequence (opt3) from DENV-2__FM210205__SS-prME
agcgccggcaugaucauuaugcugauacccaccgugauggcuuuccaccucacaacuagaaacggggagccucauaugaucgucggaauucaggaaaaggguaaaucccuucuguuuaagacggaggacggcguuaauaugugcaccuugauggcaauggauuuaggggaacugugugaggacacaaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcccuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagagcaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggaaaggaaaucaaaguaacgccgcagucaaguauuacagaggcugaacugaccggcuaugguacugugaccauggaguguagccccagaacagggcuugauuucaaugaaaugguccuguugcaaauggagaacaaggccuggcucgugcacaggcagugguuucuggacuuaccucugccauggcuccccggcgcagauaagcaggagucuaauuggauccagaaagaaacccuuguuacuuucaagaacccucaugcuaaaaagcaagacguggucgugcugggaucccaggagggcgccaugcacacagcguugacgggggccaccgaaauacagaugucaagcggaaaucuacuguuuacuggucaucucaaaugccggcugcguauggacaagcuucaacugaagggcaugaguuacucuauguguacagggaaauucaagguaguuaaagagauugcagagacccagcacggaacaaucgugauccgcguccaguaugaaggcgaugguuccccaugcaagauucccuucgagaucauggacuuggaaaaaagauacgugcucgggaggcugauuacugucaacccgauagugaccgagaaggauagcccuguuaacaucgaagcugagcccccauuuggcgacucguacauuaucaucggaguggagccuggccaguuaaagcugaauugguucaaaaaggggucuuccauuggacaaauguuugaaacgaccaugcggggugccaaacgaauggcuauacuaggcgauacagccugggacuucgggucacucggaggcguauuuacuaguaucgguaaggcacugcaucaggucuucggggccauuuauggcgcugcguuuagcggaguguccuggaccaugaaaauccuuauuggcguuaucauaacauggaucgggaugaacucucgcagcacuucauugagugugucccugguccucgugggaauuguaacccuguaccuuggcgugaugguucaggcagauagcgguugugucgugucuuggaagaauaaggagcugaaaugcgggucaggaaucuucauuacggacaacgugcacacauggaccgaacaguauaaguuucaacccgagaguccaagcaaauuggccuccgcuauccagaaggcccaggaagagggcauaugugguauuagaucugucacuaggcucgagaaucugauguggaaacagaucacacccgaauuaaaccacauucuggcagagaaugaaguuaagcuaaccaucaugacuggcgauauaaaagggaucaugcaagccggaaagcggucgcuccgcccucagccaaccgagcugaaguacagcuggaaaacauggggcaaggcuaaaaugcuuuccacggaaucauauaaccagaccuucuugauugacgggccggagacugccgagugccccaauacaaacagagcauggaauagucuggaaguggaggauuacggauuuggcguguucaccacaaacaucuggcucaagcugaaagaaaagcaggacgcguuuugugacucuaaguuaaugagcgcugccauuaaagauaauagggcaguacaugccgacauggguuauuggaucgaguccgcucugaacgauacuuggaagauagagaaagccucauucauugaagucaagaauugccacuggccuaaaagccauacccuuuggucuaacgggguguuggaguccgaaaugaucaucccaaagaaccucgcaggacccguuagucaacacaauuaccguccuggcuaccacacgcagauugcugguccauggcaucugggcaagcuagagauggacuucgauuuuugugacgggacaaccgugaucgucacugaagauugcggaaaccggggccccagccugcgaaccacaacugccucugggaaacucauuaccgaguggugcuguagauccugcacacugccgccucuuagguaucgcggagaggacggcuguugguacgguauggaaauacggccauugaaggagaaagaagagaaucuggugaacucauuaguuacggcggggcacggacagguggauaauuucagucucggcguacuggguauggcccuuuuucuggaagagauguugagaaccagggucggcacuaagcaugcuauccuccugguggcagugagcuucgucacacuaauuaccgggaacaugucguuuaaagaccugggacgcguugugguaauggugggcgccacuauggcugaugacaucgggaugggagucacauaucucgcccugcuugcagcguucaaggugcgacccaccuuugccgcuggcuugcuguuaaagaaacucacguccaaggagcugaugaugacuaccauugguaucguucuucugucucaaagcacaauaccugaaaccgugcuagagcucacugaugcccuggcauuggggaugaugguccugaaaaucgugcggaauauggaaaaguaccaguuagcuguuacaauuauggccauccucugcgugcccaacgcagucauucugcagaaugccuggaaaguaucauguaccauccuugcugugguuaguguguccccacuguugcucacaucuagccagcaaaagacugacuggauaccucuggcgcuaaccauuaaaggacugaaccccacggccaucuuccuuacaacccucucccguacuaauaagaagagaucauggccacugaacgaggcaaucauggcugucggcauggugagcauuuuggccaguucucuguuaaaaaaugacauaccgaugaccggcccucucguagccgggggacugcuuacagugugcuauguccugacugguagguccgcugauuuggaacucgagcgcgcaaccgacguuaagugggaggaucaggccgaaaucagcggcucgucacccauucugucuaucacgauuagugaggacggguccaugagcaucaaaaacgaagaggaggaacagacacuaaccauacugauccggacuggacuucucgugauuucuggccuguuuccaaucagcauucccaucacagcggcugccugguacuugugggaggugaagaaacagagagcaggugucuuaugggaugugccuuccccacccccuauggggaaggccgaacuggaggacggagcuuauaggauaaagcaaaaaggcauucucggcuacucacagaucggggcaggaguuuacaaggaagguaccuuccacacuauguggcauguaacacgaggcgccgugcugaugcacaaagggaagcgcaucgagccgaguugggcggaugucaaaaaggaccuuauuagcuauggaggcgguuggaagcuggagggggaauggaaagagggagaagaggugcagguuuuggcucuagaaccaggcaagaauccccgggccgugcagaccaaaccuggccuguuuaagacgaacacugggaccaucggagcagucucucucgauuucuccccagguacaucaggcagucccauaauugacaaaaaggggaaggugguaggacuguacggcaacggugucgugaccagaagcggggccuauguuuccgcuaucgcccaaacagagaaaucuauugaggauaauccugaaaucgaggacgauauauuuaggaagcgucgccuuacuauuauggacuuacacccgggagcaggcaaaaccaagcgguaccugcccgcuaucgugagagaagccaucaaaaggggccuccgaacguugauucuggcgccaacacgggucguggccgcagagauggaagaggcucuccgcgggcugccuaucagauaucagacucccgccauuagggcugagcauaccggacgggaaauaguugaccuuaugugucacgcaacauucaccaugcgacuguugucgccagugagagucccuaacuacaaucuaaucauuauggaugaggcccauuucacugaccccgccagcaucgcugcgcgcgguuauaucucaaccaggguggaaaugggcgaggcagccgggauuuuuaugacagcuacgccaccgggaucccgugauccuuucccccagaguaacgccccaauaaucgacgaggaacgggagauucccgaaagaucuuggaauagcggccacgaguggguaacugauuuuaaggguaagaccgugugguucguuccuuccaucaaagcagggaacgacauugccgcuugccugaggaagaauggaaaaaaggucauccaacucucacgcaaaacauuugauucugaauacgugaagacccgaacuaacgacugggauuucguggucacaaccgacauaagcgagaugggcgcgaauuuuaaagccgagagaguaaucgauccacggagguguaugaagcccgugauuuuaacggacggcgaagagcgcguuauccuggcagggccuaugccggugacucauaguuccgcugcccagcguagaggacggauugguaggaacccaaagaaugaaaacgaccaguacaucuauaugggcgagccccuugaaaaugaugaggacugcgcacacuggaaagaggccaagaugcugcucgauaacauaaauacaccugaagggauuauccccagcauguucgagccagaacgcgagaaagucgacgcuauugauggagaauaccgauugagaggcgaggcccggaagaccuuuguggaccugaugaggcgcggugaucucccuguuuggcuggcguauaaaguggcagccgaggggaucaacuacgcugacagaaggugguguuucgauggcauaaagaacaaucagauccuugaagagaacgucgaaguggagauuuggaccaaggagggagaacggaaaaagcuaaaaccccguuggcuggacgcccgcaucuauucugauccauuggcuuuaaaggaguuuaaagaauucgcagccggccgaaagucacugacucucaaucugauuacagagauggggagacuuccuaccuucaugacacaaaagacuagggacgcucuggauaaccucgccguauugcacacggcagaagcgggaggucgggccuacaaucaugcucuguccgagcuaccggagacccuggaaacacuccuucuguuaacuuugcuggccaccgugacaggcgggaucuuucucuuccugaugaguggacgcggcauagguaaaaugacccuugggaugugcugcauuaucacugcaagcauccugcucugguaugcucagauucagccccacuggaucgccgcaucgauaauuuuggaguuuuuccugaucguuuuacuaauuccagaaccugagaagcagagaacgccccaagacaaccagcugaccuacgucgugaucgccauacucacaguggucgcugcgacuauggccaaugaaaugggcuuucuugagaaaaccaagaaagacuucggacugggcucuaucgcaacacagcagccagaguccaacauuuuggauaucgaccugaggccugcuagcgccuggacccucuacgccguugcaacuacauuugugacgcccaugcugcggcauucaauugaaaauaguucuguaaacgugucccuuaccgcuaucgccaaucaagcgacuguccucauggggcugggaaaggguuggccguugagcaagauggauauuggcgugccacuguuagcuaucggguguuauucacagguuaacccuauaacacuaaccgccgcacugcuccuucugguggcccacuacgcuauuaucggacccggcuugcaggcaaaagccacccgagaggcgcagaagagagcugccgcagguaucaugaaaaauccaacagucgacgggauuacuguaauagaucuggaccccaucccuuaugauccgaaguucgaaaaacaacucggccaggugaugcugcuuauuuuaugcguuacgcaggugcugaugaugcgcaccacaugggcccucugugaggcuuugacucuggccaccggacccaucaguacacuaugggaaggcaacccagggagguuuuggaauaccacuauugcagucagcauggcuaacaucuuccggggauccuaccuggccggcgcgggucuccuuuuuucuauaaugaagaauacgacaaacacccguagagggacuggaaacaucggcgagacccugggugagaaauggaagagcagguugaaugcccugggcaaguccgaauuccaaauuuauaaaaagucagggauccaggagguggaccgcacacucgcaaaagaaggaauuaagcggggcgagacugaucaccaugcugucucucgagggagugccaaacugagaugguuuguggagaggaacaugguuaccccugaaggaaaggugguagacuuaggcugcggucgcgggggauggucguacuauuguggcggucuuaagaaugugcgggaggucaaaggccugacaaaggggggacccggccacgaagagccuaucccaaugagcacguacggguggaaccucguuagacuacaguccggaguggaugucuucuucauacccccugaaaaaugcgacacccuguugugugauauuggcgagucuucaccaaaucccacuguggaggcaggucguacacugaggguacucaaccuuguggaaaauuggcugaacaauaacacccaguuuugcaucaagguuuugaauccguacaugccuagcgugaucgagaaaauggaagcucugcaacggaaguaugggggagcccucguccgcaacccauuaucccgaaauaguacucaugagauguacugggugucuaacgccagcggcaauauugucucauccgugaacaugauaaguagaaugcugaucaacagguucacaaugcggcacaagaaagcgaccuaugaacccgacguugaccuuggcagcgggacgcgcaauauuggaaucgagucugagauuccuaaccuggauaucauagguaagagaaucgaaaaaauuaagcaggagcaugaaaccuccuggcacuacgaccaggaucacccauauaaaacaugggcuuaccauggcucauaugagacuaagcagaccgggagcgcaucgucuaugguaaauggaguggucaggcuacucacaaagcccugggacgugcugccgacuguuacccaaauggccaugacagauaccacuccuuuuggccagcagcgaguguucaaagaaaaggucgacacgcggacacaggagcccaaagaggguaccaagaaauugaugaagaucacugcugaauggcuguggaaagagcucgggaagaagaaaaccccacguauguguacaagagaagaguuuacgcgcaaggugaggaguaacgccgcacuuggagccauuuucaccgaugagaauaaauggaaguccgcucgggaagcgguagaggacagcagauuuugggaacugguggauaaagagcgcaacuuacaccuggaaggcaagugcgagacuuguguuuacaauaugaugggcaagagggagaaaaaguugggggaauucggaaaagccaaggguucacgagcaaucugguacauguggcucggcgcucgguuucuggaguucgaagcccuaggguuucuuaacgaggaccauugguucuccagagaaaauucucugagcggagucgagggcgagggucuccacaaacugggguauauuuugagggaugugaguaagaaggaaggaggcgcaauguacgccgacgacacagcuggcugggauacccgcauaacucuggaggaccucaaaaacgaagagauggugacaaaucacauggaaggggagcauaagaaacuugccgaggcgaucuuuaagcugaccuaucaaaacaaagucguucgugugcagcggccuacacccagaggaacuguaauggauauuaucuccaggcgcgaccagcgagguagcggccaaguggggaccuacggauuaaauacguucaccaacauggaagcacagcugauccggcagauggagggcgaaggugucuucaagaauauucagcacuugacagugacugaggagguugccgugcaaaacuggcucgcuagagucgggagggaacgccugucuagaauggccauaucaggagaugacugcgugguaaagccacuagaugaccgguuugcaaacgcucuuaccgcccugaaugauaugggcaaaaucaggaaggacauucagcagugggagcccaguaaaggcuggaacgauuggacacagguuccuuucugcucccaucacuuucaugaacucaucaugaaggacgggcgugugcuggucgugccaugucgaaaucaagaugaguugauuggacgcgcuagaaucagccagggugccggcuggucuuuacgggaaacugcaugccuggggaaaucguaugcgcagauguggucacucauguacuuccacaggcgcgaccuuagacuggccgcuaacgccauauguagcgcagugccgucccacuggguccccaccagucggacgacauggucuauccaugcuaagcacgaguggaugaccacugaggacaugcuaacaguuuggaauaggguguggauucgagaaaacccuuggauggaggauaagaccccaguagaaagcugggaggaaauccccuaucugggaaaacgugaggaccaguggugcggcucccucauugguuugacuucaagagccaccugggcaaagaauauccaagccgcgauaaaccaggugcgcagucugauugggaaugaggaauacacagauuacaugccuucuaugaaacgguuuaggagagaggaagaggaagcuggaguccuuugguga

SEQ ID NO: 14928 - RNA, 9876 nt, Artificial Sequence
  derived and/or modified CDS sequence (opt3) from DENV-2__FM210206__SS-prME
agcgcaggaaugaucauuaugcugauacccaccgugauggcuuuccaccucacaacuagaaacggggagccucauaugaucgucggcauucaggaaaaggguaaaucccuucuguuuaagacggaggacggcguuaauaugugcaccuugauggcaauggauuuaggggaacugugugaggacacaaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcacuggugccccaugucgguauggggcuugagacucguaccgaaacauggaugagcuccgagggagcguggaaacacgcucagagaaucgagacuuggauacugaggcauccuggcuucaccuugauggccgcaauccucgccuacacaauuggcaccacgcacuuucagcgggugcugaucuucauucugcucacugcuguugcaccaucuaugacaaugcgcugcaucgggauaucgaacagagauuuuguggaaggagucucagguggcagcuggguggacauuguauuagagcacgggaguuguguuaccacuauggccaagaauaagcccacacuggauuucgaacuuaucaaaaccgaggcuaagcagccugccacguugaggaaauauugcauugaagcgaagcugaccaacacaacuaccgagucccgguguccaacacaaggagagcccucucuaaaagaagaacaggacaagcgcuuugugugcaagcauagcauggucgaucgaggcugggguaauggguguggacucuucggcaaaggcgggaucgugacuugcgcaauguuuaccugcaagaaaaacauggaaggaaagaucgugcagccugagaaucuggaauacacaauugucguuaccccacacuccggugaggagcaugccgugggcaacgacacugggaaacacggaaaggaaauaaaaguaacgccgcagucaaguaucacagaggcugaacuuaccggcuaugguacugugaccauggaguguagccccagaacagggcuggauuucaaugaaauggucuugcuccaaauggagaacaaggccuggcuggugcacaggcagugguuuuuagaccugccucucccauggcuucccggcgcagauaagcaggagucuaauuggauucagaaagaaacccugguuacuuucaagaacccucaugcuaaaaagcaagacguggucguguugggaucccaggagggcgccaugcacacagcgcuaacgggggccaccgaaauccagaugucaagcggaaaucugcucuuuacuggucaucugaaaugccggcuucguauggacaagcugcaauugaagggcaugaguuacucuauguguacagggaaauucaagguaguuaaagagauagcagagacccagcacggaacaauugugauccgcguccaguaugaaggcgaugguuccccaugcaagauccccuucgagauuauggaccucgagaagagauacgugcuggggagguuaaucacugucaacccgauugugaccgagaaggauagcccuguuaacauagaagcugagcccccauuuggcgacucguacaucauuaucggaguggagccuggccagcugaagcuaaauugguucaaaaaggggucuuccaucggacaaauguuugaaacgaccaugcggggugccaaacgaauggcuauucucggcgauacagccugggacuucgggucacugggaggcguauuuacaaguauagguaaggcacuucaucaggucuucggggccaucuauggcgcugcguuuagcggaguguccuggaccaugaaaauuuugaucggcguuauuaucacauggauagggaugaacucucgcagcacuucacugagugugucccucguccuggugggaaucguaacccuuuaccugggcgugaugguucaggcagauagcgguugugucgugucuuggaagaauaaggaguugaaaugcgggucaggaauuuucaucacggacaacgugcacacauggaccgaacaguauaaguuucaacccgagaguccaagcaaacucgccuccgcuauucagaaggcccaggaagagggcaucugugguauaagaucugucacuaggcuggagaauuuaauguggaaacagauuacacccgaacugaaccacauccuagcagagaaugaaguuaagcucaccauuaugacuggcgauaucaaagggauaaugcaagccggaaagcggucgcugcgcccucagccaaccgagcuuaaguacagcuggaaaacauggggcaaggcuaaaauguuguccaucgaaucauauaaccagacguuccugauugacgggccggagaccgccgagugccccaauacuaacagagcauggaauagucucgaaguggaggauuacggauuuggcguguucacaaccaacaucuggcugaaguuaaaagaaaagcaggacgcguuuugugacucuaagcugaugagcgcugccauuaaagauaauagggcaguacaugccgacauggguuauuggaucgaguccgcucuuaacgauacauggaagauagagaaagccucauucauugaagucaagaauugccacuggccuaaaagccauacuuuguggucuaacggggugcucgaguccgaaaugaucaucccaaagaaccuggcaggacccguuagucaacacaauuaccguccuggcuaccacacccagauugcugguccauggcaucuaggcaagcuggagauggacuucgauuuuugugacgggacgacagugaucgucaccgaagauugcggaaaccggggccccagccuccgaacuaccacagccucugggaaacugauuacugaguggugcuguagauccugcacccuuccgccuuugagguaucgcggagaggacggcuguugguacgguauggaaauacggccacugaaggagaaagaagagaauuuagugaacucacucguuacagcggggcacggacagguggauaauuucagucugggcguacuugguauggcccuguuuuuggaagagaugcucagaacgagggucggcaccaagcaugcuauccugcuaguggcagugagcuucgucacucugauuacagggaacaugucguuuaaagaccucggacgcguugugguaauggugggcgccaccauggcugaugacaucgggaugggagucacuuaucuggcccuuuuggcagcguucaaggugcgacccacauuugccgcuggccuguuacuccggaagcugaccuccaaagagcuuaugaugacgacuauugguaucguucugcuaucucaaagcaccauaccugaaacagugcucgagcugaccgaugccuuggcacuggggaugauggucuuaaagaucgugcguaauauggaaaaauaccagcucgcuguuacuauuauggccauccugugcgugcccaacgcagucauucuucagaaugccuggaagguaucauguacaauccuggcugugguuaguguguccccauugcuccugaccucuagccagcagaaaacugacuggauaccucuagcgcugacuauuaagggacuuaaccccaccgccaucuuccucacgacacuguccagaaccaauaaaaagaggucauggccauugaacgaggcaaucauggcugucggcauggugagcauucuggccaguucuuuacucaagaaugacauaccgaugacuggcccucugguagccgggggacuucugaccgugugcuaugucuugacaggucgcuccgcugaucucgaacuggagcgggcaacugacguuaaaugggaggaucaagccgaaaucagcggcucgucacccauucuaucuaucaccauuagugaggacggguccaugagcaucaagaacgaagaggaggaacagacgcugacaauacuuaucagaaccggacuccuggugauuucuggcuuguuuccaaucagcauucccaucacugcggcugccugguacuuaugggaggugaaaaagcagagggccgguguccugugggaugugccuuccccacccccuauggggaaagccgaacucgaggacggagcuuaucgaauaaagcaaaagggcauucugggcuacucacagaucggggcaggaguuuacaaagaagguacauuccacaccauguggcauguaacucgcggcgccgugcuuaugcacaaggggaaacggaucgagccgaguugggcggaugucaagaaagaccugauuagcuauggaggcgguuggaaguuggagggggaauggaaggagggagaagaggugcagguucuagcucuggaaccaggcaaaaaucccagagccgugcagacaaagccuggccucuuuaaaaccaacacggggacuaucggagcagucucucuggauuucuccccagguaccucaggcagucccauaauugacaagaaagggaaggugguaggacuuuacggcaacggugucgugacaaggagcggggccuauguuuccgcuaucgcccaaaccgagaagucuauugaggauaauccugaaaucgaggacgauauauuucguaaacgccgguuaacaauuauggaccugcacccgggagcaggcaagacuaaaagauaccuccccgcuaucgugagggaagccaucaagcgaggcuugcggacccugauucucgcgccaacgcgcgucguggccgcagagauggaagaggcucugagagggcuuccuaucagguaucagacacccgccauucgggcugagcauacuggacgagaaauaguugaccugaugugucacgcaaccuucacaaugagauugcuaucgccagugcgcgucccuaacuacaaucugaucauuauggaugaggcccauuucaccgaccccgccagcaucgcugcgagggguuauaucucaacucguguggaaaugggcgaggcagccgggauuuuuaugaccgcuacaccaccgggaucccgggauccuuucccccagaguaacgccccaauaaucgacgaggaaagagagauucccgaaaggucuuggaauagcggccacgaguggguaacggauuuuaaagguaagacugugugguucguuccuuccaucaaggcagggaacgacauugccgcuugccuccgcaaaaauggaaagaaagucauccaauuaucacgaaagaccuuugauucugaauacgugaaaacaagaaccaacgacugggauuucguggucacuacagacauaagcgagaugggcgcgaauuuuaaggccgagcggguaaucgauccaaggcgcuguaugaaacccgugauucugaccgacggcgaagaacguguuauccuugcagggccuaugccggugacgcauaguuccgcugcccagagacggggaaggauuggucgcaacccaaagaaugaaaacgaccaguacaucuauaugggcgagccccuggaaaaugaugaggacugcgcacacuggaaggaggccaaaaugcucuuggauaacauaaauacuccugaagggauuauccccagcauguucgagccagaacgagagaaggucgacgcuauugauggagaauacagacugcggggcgaggccaggaaaacauuuguggaccucaugcgcagaggugaucugccuguuuggcuugcguauaagguggcagccgaggggaucaacuacgcugacaggcggugguguuucgauggcaucaaaaacaaucagauccuagaagagaacgucgaaguggagauuuggaccaaggagggagaacguaagaaacugaagccccgcugguuggacgcccgaaucuauucugauccauuagcucugaaagaguuuaaggaguucgcagccggcagaaaaucacucacccugaaucuuauuacugagauggggaggcugccuacauucaugacccaaaagacacgggacgcucucgauaacuuggccguacugcacacugcagaagcgggaggucgcgccuacaaucaugcucuauccgagcugccggagacgcucgaaacccuucuguuauugacacugcucgccacugugaccggcgggaucuuucuguuccuuaugaguggaagaggcauagguaagaugacacuggggaugugcugcauuaucaccgcaagcauccucuugugguaugcucagauucagccccacuggaucgccgcaucgauaauucuggaguuuuucuuaaucguucuacugauuccagaaccugagaaacagaggacuccccaagacaaccagcucacguacgucgugaucgccauacuuaccguggucgcugcgacaauggccaaugaaaugggcuuucuggagaagacuaaaaaggacuugggacugggcucuaucgcaacccagcagccagaguccaacauucucgauaucgaccugcggccugcuagcgccuggacacuuuacgccguugcaaccacuuucgugacacccaugcuccgacauucaauugaaaauaguucuguaaacgugucccugacggcuaucgccaaucaagcgaccgucuugauggggcugggaaaagguuggccguuaagcaagauggauauuggcgugccacuacuggcuaucggguguuauucacagguuaacccuauaacucucacagccgcacuucuguugcugguggcccacuacgcuauuaucggacccggccuccaggcaaaggccaccagagaggcgcagaaacgcgcugccgcagguaucaugaagaauccaaccgucgacgggauuacaguaauagaucuggaccccaucccuuaugauccgaaauuugaaaagcaacuuggccaggugauguuacugauucucugcguuacucagguguugaugaugaggacgaccugggcccugugugaggcucuaacacuggccacuggacccaucaguacccucugggaaggcaacccagggcgguucuggaauacaaccauugcagucagcauggcuaacaucuuucguggauccuaccuugccggcgcgggucuguuguucucuauaaugaaaaauacuacgaacacaagaagggggaccggaaacaugggcgagacucugggugagaaguggaaaagccgccucaaugcccugggcaaguccgaauuucaaaucuauaagaaaucagggauucaggagguggaccggaccuuagcaaaggaaggaaucaaacgaggcgagacagaucaccaugcugucucuagagggagugccaaacuuaggugguucguggagcgcaacaugguuacuccugaaggaaaagugguagaccugggcugcgguagagggggauggucguacuauuguggcggucucaagaaugugagagaggucaagggccuaaccaaagggggacccggccacgaagaaccuauuccaaugagcacauacggguggaaccugguucguuugcaguccggaguggaugucuuuuucauacccccugaaaagugcgacacgcugcucugugauauaggcgagucuucaccaaaucccaccguggaggcagguaggacucuucggguacugaacuugguggaaaauuggcugaacaauaacacacaguucugcauuaaaguucucaauccguacaugccuagcgugaucgagaagauggaggcuuuacaacgcaaauaugggggagcccugguccgaaacccacuuuccagaaauaguacccaugagauguacugggugucuaacgccagcggcaauaucgucucauccgugaacaugauuaguaggaugcugauaaaccgguuuacuaugcgccacaagaaggcgacauaugaacccgacguugaccuaggcagcgggaccagaaauaucggaauugagucugagaucccuaaccucgauauuaucgguaaaaggauagaaaagaucaaacaggagcaugaaacguccuggcacuacgaccaggaucacccauauaagaccugggcuuaccauggcucauaugagacaaaacagacugggagcgcaucgucuaugguaaauggagugguccgacuguugaccaagcccugggacgugcugccgacaguuacucaaauggccaugaccgauacaaccccuuucggccagcagcggguguuuaaggaaaaagucgacacucguacgcaggagcccaaggaggguacuaaaaagcucaugaaaauuaccgcugaauggcuuuggaaggagcuggggaaaaagaagacuccaagaauguguacccgcgaagaguucacaaggaaagugcggaguaacgccgcauuaggagccaucuuuacggaugagaauaaguggaaauccgcuagagaagcgguagaggacagccgcuucugggaacugguggauaaggagaggaacuugcaccucgaaggcaaaugcgagaccuguguuuacaauaugaugggcaagcgagagaagaaacugggggaauuuggaaaggccaaagguucacgggcaauuugguacauguggcuaggcgcuagauuccuugaguuugaagcccugggguuccucaacgaggaccauugguuuuccagggaaaauucucugagcggagucgagggcgaggguuugcacaagcugggguauauccuccgcgaugugaguaaaaaggaaggaggcgcaauguacgccgacgacacugcuggcugggauacacguauuacccuugaggaccugaagaacgaagagauggugacuaaucacauggaaggggagcauaaaaaguuagccgaggcgauauucaaacugacauaucaaaacaaggucguucgggugcagagaccuacccccaggggaacaguaauggauaucauuucccgccgagaccagcgggguagcggccaaguggggacuuacggauugaauaccuuuacgaacauggaagcacagcucaucagacagauggagggcgaaggugucuucaaaaauauccagcaccugaccgugacagaggagguugccgugcaaaacuggcuagcuagggucgggcgcgaaagacuuucucggauggccauuucaggagaugacugcgugguaaagccacuggaugacagguucgcaaacgcucucacugcccugaaugauaugggcaagauacguaaagacauccagcagugggagcccaguaagggcuggaacgauuggacccagguuccuuuuugcucccaucacuuccaugaauugauuaugaaagacgggcgaguguuagucgugccaugucgcaaucaagaugagcugaucggacgggcucggauuagccagggugccggcuggucucucagggaaacagcaugccuugggaagucguaugcgcagauguggucacugauguacuuucaccgcagagaccuacggcuggccgcuaacgccaucuguagcgcagugccgucccacuggguccccacaaguaggaccacguggucuauacaugcuaaacacgaguggaugacaaccgaggacaugcucacuguuuggaaucgaguguggauccgugaaaacccuuggauggaggauaagacaccaguagaaagcugggaggaaauucccuauuugggaaagagagaggaccaguggugcggcucccugaucggucuuaccucacgcgccacuugggccaaaaauauucaagccgcgaucaaccaggugcggagucugauagggaaugaggaauacaccgauuacaugccuucuaugaagagguucagacgcgaggaagaggaagcuggaguccucugguga

SEQ ID NO: 14929 - RNA, 9876 nt, Artificial Sequence
  derived and/or modified CDS sequence (opt3) from DENV-2__FM210246__SS-prME
agcgcaggcaugaucauuaugcugauacccaccgugauggcuuuccaccucacuacuagaaacggggaaccucauaugaucgucgguauucaagaaaagggaaaaucccuucuguuuaagacggaggacggcguuaauaugugcaccuugauggcaauggauuuaggggaacugugugaggacacgaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcccuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagaacaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggaaaggaaaucaaaguaacgccgcagucaaguauuacagaggcugaacugaccggcuaugguacugugaccauggaguguagccccagaacagggcuugauuucaaugaaaugguccuguugcaaauggagaacaaggccuggcucgugcacaggcagugguuucuggacuuaccucugccauggcuccccggcgcagauaagcaggagucuaauuggauccagaaagaaacccuuguuacuuucaagaacccucaugcuaaaaagcaagacguggucgugcugggaucccaggagggcgccaugcacacagcguugacgggggccaccgaaauacagaugucaagcggaaaucuacuguuuacuggucaucucaaaugccggcugcguauggacaaacuucaacugaagggcaugaguuacucuauguguacagggaaauucaagguaguuaaagagauugcagagacccagcacggaacaaucgugauccgcguccaguaugaaggcgaugguuccccaugcaagauucccuucgagaucauggacuuggagaagagauacgugcucgggaggcugauuacugucaacccgauagugaccgagaaggauagcccuguuaacaucgaagcugagcccccauuuggcgacucguacauuaucaucggaguggagccuggccaguuaaagcugaauugguucaaaaaggggucuuccauuggacaaauguuugaaacgaccaugcggggugccaaacgaauggcuauacuaggcgauacagccugggacuucgggucacucggaggcguauuuacaaguaucgguaaggcacugcaucaggucuucggggccauuuauggcgcugcguuuagcggaguguccuggaccaugaaaauccuuauuggcguuaucauaacauggaucgggaugaacucucgcagcacuucauugagugugucccugguccucgugggaauuguaacccuguaccuuggcgugaugguucaggcagauagcgguugugucgugucuuggaagaauaaggagcugaaaugcgggucaggaaucuucauuacggacaacgugcacacauggaccgaacaguauaaguuucaacccgagaguccaagcaaauuggccuccgcuauccagaaggcccaggaagagggcauaugugguauuagaucugucacuaggcucgagaaucugauguggaaacagaucacacccgaauuaaaccacauucuggcagagaaugaaguuaagcuaaccaucaugacuggcgauauaaaagggaucaugcaagccggaaagcggucgcuccgcccucagccaaccgagcugaaguacagcuggaaaacauggggcaaggcuaaaaugcuuuccacggaaucauucaaccagaccuuuuugauugacgggccggagacugccgagugccccaauacaaacagagcauggaauagucuggaaguggaggauuauggauucggcguguuuaccacaaacaucuggcucaagcugaaagaaaagcaggacgcguucugugacucuaaguuaaugagcgcugccauuaaagauaauagggcaguacaugccgacauggguuacuggaucgaguccgcucugaacgauacuuggaagauagagaaagccucauucauugaagucaagaauugccacuggccuaaaagccauacccuuuggucuaacgggguguuggaguccgaaaugaucaucccaaagaaccucgcaggacccguuagucaacacaauuaucguccuggcuaccacacgcagauugcugguccauggcaucugggcaagcuagagauggacuuugauuucugugacgggacaaccgugaucgucacugaagauugcggaaaccggggccccagccugcgaaccacaacugccucugggaaacucauuaccgaguggugcuguagauccugcacacugccgccucuuagguaccgcggagaggacggcuguugguaugguauggaaauacggccauugaaggagaaagaagagaaucuggugaacucauuaguuacggcggggcacggacagguggauaauuuuagucucggcguacuggguauggcccuuuuccuggaagagauguugagaaccagggucggcacuaagcaugcuauccuccugguggcagugagcuuugucacacuaauuaccgggaacaugucguucaaagaccugggacgcguugugguaauggugggcgccacuauggcugaugacaucgggaugggagucacauaccucgcccugcuugcagcguuuaaggugcgacccaccuucgccgcuggcuugcuguuacggaagcucacguccaaagagcugaugaugacuaccauugguaucguucuucugucucaaagcacaauaccugaaaccgugcuagagcucacugaugcccuggcauuggggaugaugguccugaagaucgugcguaauauggaaaaauaucaguuagcuguuacaauuauggccauccucugcgugcccaacgcagucauucugcagaaugccuggaagguaucauguaccauccuugcugugguuaguguguccccacuguugcucacaucuagccagcagaaaacugacuggauaccucuggcgcuaaccauuaagggacugaaccccacggccaucuuucuuacaacccucuccagaacuaauaaaaagaggucauggccacugaacgaggcaaucauggcugucggcauggugagcauuuuggccaguucucuguuaaagaaugacauaccgaugaccggcccucucguagccgggggacugcuuacagugugcuacguccugacuggucgcuccgcugauuuggaacucgagcgggcaaccgacguuaaaugggaggaucaggccgaaaucagcggcucgucacccauucugucuaucacgauuagugaggacggguccaugagcaucaagaacgaagaggaggaacagacacuaaccauacugaucagaacuggacuucucgugauuucuggccuguucccaaucagcauucccaucacagcggcugccugguauuugugggaggugaaaaagcagagggccggugucuuaugggaugugccuuccccacccccuauggggaaagccgaacuggaggacggagcuuaccgaauaaagcaaaagggcauucucggcuauucacagaucggggcaggaguuuacaaagaagguaccuuucacacuauguggcauguaacacgcggcgccgugcugaugcacaaggggaaacggaucgagccgaguugggcggaugucaagaaagaccuuauuagcuacggaggcgguuggaagcuggagggggaauggaaggagggagaagaggugcagguuuuggcucuagaaccaggcaaaaaucccagagccgugcagaccaagccuggccuguucaaaacgaacacugggaccaucggagcagucucucucgauuuuuccccagguacaucaggcagucccauaauugacaagaaagggaaggugguaggacuguauggcaacggugucgugaccaggagcggggccuacguuuccgcuaucgcccaaacagagaagucuauugaggauaauccugaaaucgaggacgauauauuccguaaacgccggcuuacuauuauggacuuacacccgggagcaggcaagaccaaaagauaucugcccgcuaucgugagggaagccaucaagcgaggccuccggacguugauucuggcgccaacacgcgucguggccgcagagauggaagaggcucucagagggcugccuaucagguaccagacucccgccauucgggcugagcauaccggacgagaaauaguugaccuuaugugucacgcaacauucaccaugagacuguugucgccagugcgcgucccuaacuauaaucuaaucauuauggaugaggcccauuuuacugaccccgccagcaucgcugcgagggguuacaucucaacccguguggaaaugggcgaggcagccgggauuuucaugacagcuacgccaccgggaucccgggauccuuuuccccagaguaacgccccaauaaucgacgaggaaagagagauucccgaaaggucuuggaauagcggccacgaguggguaacugauuucaaagguaagaccgugugguuuguuccuuccaucaaggcagggaacgacauugccgcuugccugcgcaaaaauggaaagaaagucauccaacucucacgaaagacauucgauucugaauaugugaaaaccagaacuaacgacugggauuuuguggucacaaccgacauaagcgagaugggcgcgaauuucaaggccgagcggguaaucgauccaaggcgcuguaugaaacccgugauuuuaacggacggcgaagaacguguuauccuggcagggccuaugccggugacucauaguuccgcugcccagagacggggaaggauuggucgcaacccaaagaaugaaaacgaccaguacaucuacaugggcgagccccuugaaaaugaugaggacugcgcacacuggaaggaggccaaaaugcugcucgauaacauaaauacaccugaagggauuauccccagcauguuugagccagaacgagagaaggucgacgcuauugauggagaauauagauugcggggcgaggccaggaaaaccuucguggaccugaugcgcagaggugaucucccuguuuggcuggcguacaagguggcagccgaggggaucaacuaugcugacaggcggugguguuuugauggcaucaaaaacaaucagauccuugaagagaacgucgaaguggagauuuggaccaaggagggagaacguaagaaacuaaagccccgcuggcuggacgcccgaaucuacucugauccauuggcuuuaaaagaguucaaggaguucgcagccggcagaaaaucacugacucucaaucugauuacagagauggggaggcuuccuaccuuuaugacacaaaagacucgggacgcucuggauaaccucgccguauugcacacggcagaagcgggaggucgcgccuauaaucaugcucuguccgagcuaccggagacccuggaaacacuccuucuguuaacuuugcuggccaccgugacaggcgggaucuuccucuuucugaugaguggaagaggcauagguaagaugacccuugggaugugcugcauuaucacugcaagcauccugcucugguacgcucagauucagccccacuggaucgccgcaucgauaauuuuggaguucuuucugaucguuuuacuaauuccagaaccugagaaacagaggacgccccaagacaaccagcugaccuaugucgugaucgccauacucacaguggucgcugcgacuauggccaaugaaaugggcuuccuugagaagaccaaaaaggaccugggauugggcucuaucgcaacacagcagccagaguccaacauucuggauaucgaccuccggccugcuagcgccuggacccuguacgccguugcaacuacauuugugacgcccaugcuucgacauucaauugaaaauaguucuguaaacgugucccucaccgcuaucgccaaucaagcgacuguccugaugggguugggaaaagguuggccgcugagcaagauggauauuggcgugccauuacuagcuaucggguguuacucacagguuaacccuauaacacugaccgccgcacuccuucuguugguggcccacuaugcuauuaucggacccggccugcaggcaaaggccaccagagaggcgcagaaacgcgcugccgcagguaucaugaagaauccaacagucgacgggauuacuguaauagaucucgaccccaucccuuacgauccgaaauucgaaaagcaacugggccaggugaugcuuuuaauucugugcguuacacaggugcucaugaugaggaccacaugggccuugugugaggcucugacucuagccaccggacccaucaguacacugugggaaggcaacccagggcgguuuuggaauaccacuauugcagucagcauggcuaacaucuuccguggauccuaucucgccggcgcgggucuucuguuuucuauaaugaaaaauacgacaaacaccagaagggggacuggaaacaugggcgagaccuugggugagaaguggaaaagccgccugaaugcccucggcaaguccgaguuccaaaucuacaagaaaucagggauucaggagguggaccggacacuggcaaaggaaggaaucaaacgaggcgagacugaucaccaugcugucucuagagggagugccaaguuaaggugguuuguggagcgcaacaugguuaccccugaaggaaaagugguagaccuuggcugcgguagagggggauggucguauuacuguggcggucugaagaaugugagagaggucaagggccucacaaaagggggacccggccacgaagaaccuauuccaaugagcacguauggguggaaccuaguucgucugcaguccggaguggaugucuucuucauacccccugaaaagugcgacaccuugcugugugauauaggcgagucuucaccaaaucccacuguggaggcagguaggacacuccggguacuuaaccugguggaaaauugguugaacaauaacacccaguuuugcauuaaaguucugaauccguacaugccuagcgugaucgagaagauggaagcucuccaacgcaaauacgggggagccuuaguccgaaacccacuguccagaaauaguacucaugagauguauugggugucuaacgccagcggcaauaucgucucauccgugaacaugauuaguaggaugcuuauaaaccgguucacaaugcgccacaagaaggcgaccuacgaacccgacguugaccugggcagcgggacgagaaauaucggaauugagucugagaucccuaaccuagauauuaucgguaaaaggauagaaaagaucaaacaggagcaugaaaccuccuggcacuaugaccaggaucacccauacaagacaugggcuuaucauggcucauacgagacuaaacagaccgggagcgcaucgucuaugguaaauggagugguccgacuccugacaaagcccugggacguguugccgacuguuacccaaauggccaugacagauaccacuccuuuuggccagcagcggguguucaaggaaaaagucgacacgcguacacaggagcccaaggaggguaccaaaaagcugaugaaaauuacugcugaauggcucuggaaggagcuugggaaaaagaagaccccaagaauguguacacgcgaagaguuuacgaggaaagugcggaguaacgccgcacugggagccaucuucaccgaugagaauaaguggaaauccgcuagagaagcgguagaggacagccgcuuuugggaauuaguggauaaggagaggaaccugcacuuggaaggcaaaugcgagacuuguguuuauaauaugaugggcaagcgagagaagaaacucggggaguucggaaaggccaaagguucacgggcaauuugguacauguggcugggcgcuagauuucuagaguucgaagcccuuggguuucugaacgaggaccauugguucuccagggaaaauucucucagcggagucgagggcgagggucugcacaaguugggguacauccugcgcgaugugaguaaaaaggaaggaggcgcaauguaugccgacgacacagcuggcugggauacccguauuacucucgaggaccuuaagaacgaagagauggugacaaaucacauggaaggggagcauaaaaagcuggccgaggcgauauuuaaauuaaccuaccaaaacaaggucguucgggugcagagaccuacacccaggggaacuguaauggauaucauuucccgccgagaccagcgggguagcggccaaguggggaccuauggacugaauacguucaccaacauggaagcacaguugaucagacagauggagggcgaaggugucuucaaaaauauccagcaccucacagugacugaggagguugccgugaagaacuggcuggcuagggucgggcgcgaaagacuaucucggauggccauuucaggagaugacugcgugguaaagccacuugaugacagguuugcaaacgcucugaccgcccucaaugauaugggcaaaauacguaaggacauccaacagugggagcccaguaaaggcuggaacgauuggacacagguuccuuucugcucccaucacuuucaugaacugauuaugaaggacgggcgaguguuggucgugccaugucgcaaucaggaugaguuaaucggacgggcucggauuagccaaggugccggcuggucucugagggaaacugcaugccucgggaaaucguacgcgcagauguggucacuuauguauuuccaccgcagagaccugcggcuagccgcuaacgccaucuguagcgcagugccgucccacuggguccccaccaguaggacgacauggucuauacaugcuaagcacgaguggaugaccacugaggacaugcugacaguuuggaaucgaguguggauccgugaaaacccuuggauggaggauaagaccccaguagaaagcugggaggaaauucccuaccucggaaaaagagaggaccaguggugcggcuccuugaucggucugacuucacgcgccaccugggcaaagaauauucaggccgcgaucaaccaagugcggagucuuauagggaaugaggaauauacagauuacaugccuucuaugaaaagguuuagacgcgaggaagaggaagcuggaguccugugguga

SEQ ID NO: 14930 - RNA, 9876 nt, Artificial Sequence
  derived and/or modified CDS sequence (opt3) from DENV-2__FM210207__SS-prME
agcgcaggcaugaucauuaugcugauacccaccgugauggcuuuccaccucacuacuagaaacggggagccucauaugaucgucgguauucaagaaaagggaaaaucccuucuguuuaagacggaggacggcguuaauaugugcaccuugauggcaauggauuuaggggaacugugugaggacacgaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcacuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagaacaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggaaaggaaaucaaaguaacgccgcagucaaguauuacagaggcugaacugaccggcuaugguacugugaccauggaguguagccccagaacagggcuugauuucaaugaaaugguccuguugcaaauggagaacaaggccuggcucgugcacaggcagugguuucuggacuuaccucugccauggcuccccggcgcagauaagcaggagucuaauuggauccagaaagaaacccuuguuacuuucaagaacccucaugcuaaaaagcaagacguggucgugcugggaucccaggagggcgccaugcacacagcguugacgggggccaccgaaauacagaugucaagcggaaaucuacuguuuacuggucaucucaaaugccggcugcguauggacaaacuucaacugaagggcaugaguuacucuauguguacagggaaauucaagguaguuaaagagauugcagagacccagcacggaacaaucgugauccgcguccaguaugaaggcgaugguuccccaugcaagauucccuucgagaucauggacuuggagaagagauacgugcucgggaggcugauuacugucaacccgauagugaccgagaaggauagcccuguuaacaucgaagcugagcccccauuuggcgacucguacauuaucaucggaguggagccuggccaguuaaagcugaauugguucaaaaaggggucuuccauuggacaaauguuugaaacgaccaugcggggugccaaacgaauggcuauacuaggcgauacagccugggacuucgggucacucggaggcguauuuacaaguaucgguaaggcacugcaucaggucuucggggccauuuauggcgcugcguuuagcggaguguccuggaccaugaaaauccuuauuggcguuaucauaacauggaucgggaugaacucucgcagcacuucauugagugugucccugguccucgugggaauuguaacccuguaccuuggcgugaugguucaggcagauagcgguugugucgugucuuggaagaauaaggagcugaaaugcgggucaggaaucuucauuacggacaacgugcacacauggaccgaacaguauaaguuucaacccgagaguccaagcaaauuggccuccgcuauccagaaggcccaggaagagggcauaugugguauuagaucugucacuaggcucgagaaucugauguggaaacagaucacacccgaauuaaaccacauucuggcagagaaugaaguuaagcuaaccaucaugacuggcgauauaaaagggaucaugcaagccggaaagcggucgcuccgcccucagccaaccgagcugaaguacagcuggaaaacauggggcaaggcuaaaaugcuuuccacggaaucauauaaccagaccuucuugauugacgggccggagacugccgagugccccaauacaaacagagcauggaauagucuggaaguggaggauuacggauuuggcguguucaccacaaacaucuggcucaagcugaaagaaaagcaggacgcguuuugugacucuaaguuaaugagcgcugccauuaaagauaauagggcaguacaugccgacauggguuauuggaucgaguccgcucugaacgauacuuggaagauagagaaagccucauucauugaagucaagaauugccacuggccuaaaagccauacccuuuggucuaacgggguguuggaguccgaaaugaucaucccaaagaaccucgcaggacccguuagucaacacaauuaccguccuggcuaccacacgcagauugcugguccauggcaucugggcaagcuagagauggacuucgauuuuugugacgggacaaccgugaucgucacugaagauugcggaaaccggggccccagccugcgaaccacaacugccucugggaaacucauuaccgaguggugcuguagauccugcacacugccgccucuuagguaucgcggagaggacggcuguugguacgguauggaaauacggccauugaaggagaaagaagagaaucuggugaacucauuaguuacggcggggcacggacagguggauaauuucagucucggcguacuggguauggcccuuuuucuggaagagauguugagaaccagggucggcacuaagcaugcuauccuccugguggcagugagcuucgucacacuaauuaccgggaacaugucguuuaaagaccugggacgcguugugguaauggugggcgccacuauggcugaugacaucgggaugggagucacauaucucgcccugcuugcagcguucaaggugcgacccaccuuugccgcuggcuugcuguuacggaagcucacguccaaagagcugaugaugacuaccauugguaucguucuucugucucaaagcacaauaccugaaaccgugcuagagcucacugaugcccuggcauuggggaugaugguccugaagaucgugcguaauauggaaaaauaccaguuagcuguuacaauuauggccauccucugcgugcccaacgcagucauucugcagaaugccuggaagguaucauguaccauccuugcugugguuaguguguccccacuguugcucacaucuagccagcagaaaacugacuggauaccucuggcgcuaaccauuaagggacugaaccccacggccaucuuccuuacaacccucuccagaacuaauaaaaagaggucauggccacugaacgaggcaaucauggcugucggcauggugagcauuuuggccaguucucuguuaaagaaugacauaccgaugaccggcccucucguagccgggggacugcuuacagugugcuauguccugacuggucgcuccgcugauuuggaacucgagcgggcaaccgacguuaaaugggaggaucaggccgaaaucagcggcucgucacccauucugucuaucacgauuagugaggacggguccaugagcaucaagaacgaagaggaggaacagacacuaaccauacugaucagaacuggacuucucgugauuucuggccuguuuccaaucagcauucccaucacagcggcugccugguacuugugggaggugaaaaagcagagggccggugucuuaugggaugugccuuccccacccccuauggggaaagccgaacuggaggacggagcuuaucgaauaaagcaaaagggcauucucggcuacucacagaucggggcaggaguuuacaaagaagguaccuuccacacuauguggcauguaacacgcggcgccgugcugaugcacaaggggaaacggaucgagccgaguugggcggaugucaagaaagaccuuauuagcuauggaggcgguuggaagcuggagggggaauggaaggagggagaagaggugcagguuuuggcucuagaaccaggcaaaaaucccagagccgugcagaccaagccuggccuguuuaaaacgaacacugggaccaucggagcagucucucucgauuucuccccagguacaucaggcagucccauaauugacaagaaagggaaggugguaggacuguacggcaacggugucgugaccaggagcggggccuauguuuccgcuaucgcccaaacagagaagucuauugaggauaauccugaaaucgaggacgauauauuucguaaacgccggcuuacuauuauggacuuacacccgggagcaggcaagaccaaaagauaccugcccgcuaucgugagggaagccaucaagcgaggccuccggacguugauucuggcgccaacacgcgucguggccgcagagauggaagaggcucucagagggcugccuaucagguaucagacucccgccauucgggcugagcauaccggacgagaaauaguugaccuuaugugucacgcaacauucaccaugagacuguugucgccagugcgcgucccuaacuacaaucuaaucauuauggaugaggcccauuucacugaccccgccagcaucgcugcgagggguuauaucucaacccguguggaaaugggcgaggcagccgggauuuuuaugacagcuacgccaccgggaucccgggauccuuucccccagaguaacgccccaauaaucgacgaggaaagagagauucccgaaaggucuuggaauagcggccacgaguggguaacugauuuuaaagguaagaccgugugguucguuccuuccaucaaggcagggaacgacauugccgcuugccugcgcaaaaauggaaagaaagucauccaacucucacgaaagacauuugauucugaauacgugaaaaccagaacuaacgacugggauuucguggucacaaccgacauaagcgagaugggcgcgaauuuuaaggccgagcggguaaucgauccaaggcgcuguaugaaacccgugauuuuaacggacggcgaagaacguguuauccuggcagggccuaugccggugacucauaguuccgcugcccagagacggggaaggauuggucgcaacccaaagaaugaaaacgaccaguacaucuauaugggcgagccccuugaaaaugaugaggacugcgcacacuggaaggaggccaaaaugcugcucgauaacauaaauacaccugaagggauuauccccagcauguucgagccagaacgagagaaggucgacgcuauugauggagaauacagauugcggggcgaggccaggaaaaccuuuguggaccugaugcgcagaggugaucucccuguuuggcuggcguauaagguggcagccgaggggaucaacuacgcugacaggcggugguguuucgauggcaucaaaaacaaucagauccuugaagagaacgucgaaguggagauuuggaccaaggagggagaacguaagaaacuaaagccccgcuggcuggacgcccgaaucuauucugauccauuggcuuuaaaagaguuuaaggaguucgcagccggcagaaaaucacugacucucaaucugauuacagagauggggaggcuuccuaccuucaugacacaaaagacucgggacgcucuggauaaccucgccguauugcacacggcagaagcgggaggucgcgccuacaaucaugcucuguccgagcuaccggagacccuggaaacacuccuucuguuaacuuugcuggccaccgugacaggcgggaucuuucucuuccugaugaguggaagaggcauagguaagaugacccuugggaugugcugcauuaucacugcaagcauccugcucugguaugcucagauucagccccacuggaucgccgcaucgauaauuuuggaguuuuuccugaucguuuuacuaauuccagaaccugagaaacagaggacgccccaagacaaccagcugaccuacgucgugaucgccauacucacaguggucgcugcgacuauggccaaugaaaugggcuuucuugagaagaccaaaaaggaccugggauugggcucuaucgcaacacagcagccagaguccaacauucuggauaucgaccuccggccugcuagcgccuggacccuguacgccguugcaacuacauucgugacgcccaugcuucgacauucaauugaaaauaguucuguaaacgugucccucaccgcuaucgccaaucaagcgacuguccugaugggguugggaaaagguuggccgcugagcaagauggauauuggcgugccauuacuagcuaucggguguuauucacagguuaacccuauaacacugaccgccgcacuccuucuguugguggcccacuacgcuauuaucggacccggccugcaggcaaaggccaccagagaggcgcagaaacgcgcugccgcagguaucaugaagaauccaacagucgacgggauuacuguaauagaucucgaccccaucccuuaugauccgaaauuugaaaagcaacugggccaggugaugcuuuuaauucugugcguuacacaggugcucaugaugaggaccacaugggccuugugugaggcucugacucuagccaccggacccaucaguacacugugggaaggcaacccagggcgguucuggaauaccacuauugcagucagcauggcuaacaucuuucguggauccuaccucgccggcgcgggucuucuguucucuauaaugaaaaauacgacaaacaccagaagggggacuggaaacaugggcgagaccuugggugagaaguggaaaagccgccugaaugcccucggcaagaacgaauuucaaaucuauaagaaauccgggauucaggagguggaccggacacuggcaaaggaaggaaucaaacgaggcgagacugaucaccaugcugucucaagagggucugccaaguuaaggugguucguggagcgcaauaugguuaccccugaaggaaaagugguagaccuuggcugcgguagagggggauggaguuacuauuguggcggucugaagaacgugagagaggucaagggccucacaaaagggggacccggccacgaggaaccuauuccaaugucgacguacggguggaaucuaguucgucugcagagcggaguggaugucuuuuucauacccccugaaaagugcgacaccuugcugugugauauaggcgaguccucuccaaaccccacuguggaggcagguaggacacuccggguacuuaaucugguggaaaacugguugaauaacaauacccaguucugcauuaaaguucugaacccguacaugccuucagugaucgagaagauggaagcucuccaacgcaaauaugggggagccuuaguccgaaauccacugagcagaaacuccacucaugagauguacugggugaguaaugccucuggcaacaucgucagcucagugaacaugauuuccaggaugcuuauaaaucgguuuacaaugcgccacaagaaggcgaccuaugaacccgacguugaccugggcagugggacgagaaacaucggaauugagagcgagaucccuaaucuagauauuaucgguaaaaggauagaaaagaucaaacaggagcaugaaaccucuuggcacuacgaccaggaucacccauauaagacaugggcuuaccauggcuccuaugagacuaaacagaccgggucagcaagcucgaugguaaacggagugguccgacuccugacaaagcccugggacguguugccgacuguuacccaaauggccaugacagauaccacuccuuucggccagcagcggguguuuaaggaaaaagucgacacgcguacacaggagcccaaggaggguaccaaaaagcugaugaaaauuacugcugaauggcucuggaaggagcuugggaaaaagaagaccccaagaauguguacacgcgaagaguucacgaggaaagugcggucuaaugccgcacugggagccaucuuuaccgaugagaacaaguggaaaagugcuagagaagcgguagaggacucccgcuucugggaauuaguggauaaggagaggaaucugcacuuggaaggcaaaugcgagacuuguguuuacaacaugaugggcaagcgagagaagaaacucggggaauuuggaaaggccaaagguagccgggcaauuugguacauguggcugggcgcuagauuccuagaguuugaagcccuuggguuccugaaugaggaccauugguuuucaagggaaaacucccucucuggagucgagggcgagggucugcacaaguugggguauauccugcgcgaugugagcaaaaaggaaggaggcgcaauguacgccgacgacacagcuggcugggauacccguauuacucucgaggaccuuaagaaugaagagauggugacaaaccacauggaaggggagcauaaaaagcuggccgaggcgauauucaaauuaaccuaucaaaauaaggucguucgggugcagagaccuacacccaggggaacuguaauggauaucauuagucgccgagaccagcgggguuccggccaaguggggaccuacggacugaacacguuuaccaauauggaagcacaguugaucagacagauggagggcgaaggugucuucaaaaacauccagcaccucacagugacugaggagguugccgugcaaaacuggcuggcuagggucgggcgcgaaagacuaagccggauggccauuucuggagaugacugcgugguaaagccacuugaugacagguucgcaaaugcucugaccgcccucaacgauaugggcaagauacguaaagacauccagcagugggagcccucaaagggcuggaaugauuggacacagguuccuuuuugcagucaucacuuccaugaacugauuaugaaagacgggcgaguguuggucgugccaugucgcaaccaagaugaguuaaucggacgggcucggauuucccagggugccggcuggagccugagggaaacugcaugccucgggaagucuuaugcgcagauguggucgcuuauguacuuucaccgcagagaccugcggcuagccgcuaaugccaucuguucagcagugccgagccacuggguccccaccuccaggacgacauggaguaugcaugcuaaacacgaguggaugaccacugaggacaugcugacaguuuggaaccgaguguggauacgugaaaauccuuggauggaggauaagaccccaguagaaucuugggaggaaauccccuaucucggaaagagagaggaccaguggugcggcagcuugauuggucugacuucccgcgccaccugggccaaaaacauccaagccgcgauuaaucaggugcggucacuuaucgggaacgaggaauacacagauuacaugccuaguaugaagagguucagacgcgaggaagaggaagcuggaguccugugguga

SEQ ID NO: 14931 - RNA, 9876 nt, Artificial Sequence
  derived and/or modified CDS sequence (opt3) from DENV-2__FM210238__SS-prME
accgccggcaugauaauuaugcugauacccacagcuauggcauuccaccucacuacgaggaacggggagccucauaugaucgugggaaggcaggaaaaggguaaaagccuucuguuuaagaccgaggacggcgucaauaugugcacauugauggccauugauuuaggggaacugugugaggacacuaucaccuacaaaugcccauuacuccggcaaaacgaaccggaggauauugacuguuggugcaauuccacaucuaccuggguuacuuauggaacauguaccacgacuggcgagcaccgccgagaaaagcguucaguggcgcugguaccccauguggguauggggcuugagacccggacagaaacuuggaugaguagcgagggagcuuggaaacacgcccagaggaucgagaccuggauacugcggcauccuggcuucacaaucauggcagccauuuuggcuuacaccgucggcacgacucacuuucagcgcgcacucaucuucauucugcuggccgcuguggccccauccaugacaaugcguugcaucgggauaucuaacagggauuuuguugaaggagugucggguggcucaugggucgacauugugcucgagcacgggagcuguguaaccacuauggcgaagaauaagcccacauuagauuucgaacugaucaaaaccgaggcaaagcagccugccacgcuucggaaauauugcauugaagcuaaguugaccaacacaacuaccgagagucgcuguccaacacaaggagagcccucccugaaugaggaacaggacaaacgauuuguuugcaagcauucuaugguggauagaggcugggguaacggguguggacuauucggcaagggcgggaucgucacuugcgccauguuuaccugcaaaaagaauauggaaggaaaaaucgugcagccugagaaccucgaauacacaauugugauaaccccacacagcggugaggagcaugcagucggcaaugacacugggaagcacggaaaagaaaucaagauuacgccgcagucccccaucacagaggcugaacugaccggcuaugguacuguuaccauggaguguucaccuaggacagggcuugauuucaacgaaauggugcuguugcaaauggaggacaaagccuggcucguacaccggcagugguuucuggauuuaccacugcccuggcucccuggcgcggacacccagggaaguaauuggauacagaaggagacucuugugacauucaagaacccacaugccaaaaagcaagacgucgugguucugggcagccaggaaggggcaaugcacacggcuuugaccggagccacugagauucagaugucuuccgguaaucuacuguuuacaggccaucucaaaugccgucugcgcauggauaaacuucaacugaaagggaugucauacagcauguguaccggaaaguucaagaucgugaaagaaaucgcugagacacagcacggcacuauugucaucagagugcaguaugagggugacgggagucccugcaagauuccguucgaaauaauggauuuggagaaaaggcauguacucggccggcugaucaccguuaacccuauugugacggaaaaggacucucccgucaacaucgaggccgaaccaccuuuuggagauuccuacaucauuauaggcguggagcccgggcaguuaaaacugaauugguucaagaagggaagcucgaucggucaaauguuugagaccacaaugcgaggcgcaaaacgcauggccauucuaggggacacugcuugggauuucggaucucucggcggugucuuuaccuccaucgggaaggcgcugcaccagguguucggcgcaauuuacggagccgcuuuuucaggcguuaguuggacaaugaaaauccuuauaggggugaucauuacuuggaucggaaugaacagcagauccaccucuuugagcguaucacugguccucgugggcguuauuacgcuguaucuuggugccauggugcaggcagacagugggugugucguguccuggaagaauaaagaacugaagugcggaagcggcaucuucauaacagauaacguacacaccuggacugagcaguacaaguuucaaccagaaucucccucaaaauuggccagugcuauucagaaggcccaugaggaagguaucuguggcauuaggagcgugacacggcucgagaaucugauguggaaacagaucaccccugaguuaaaccacauacuguccgaaaaugagguuaagcuaacuaucaugaccggggacauuaaaggaaucaugcaggcaggcaagcgcucucucagaccacaaccgacagaacugaaauauucguggaagacgugggggaaggcgaaaaugcuuagcaccgagucccauaaccagacuuucuugauugauggacccgaaacagcugagugcccuaauaccaacagggccuggaacucacuggaggucgaagacuacggcuuugguguguucacaacuaacaucuggcucaagcugcgugagaaacaggacguguuuugugauaguaaguuaaugucugcagccauaaaagacaaucgggcuguccacgccgauaugggguauuggauugaaagcgcacugaacgacaccuggaagauggagaaggcuuccuucaucgagguuaaaucaugccacuggccaaagagccauacgcuuuggucuaauggaguguuggaauccgagaugaucauucccaaaaguuucgccggcccugugagccagcacaacuaccgaccagguuauuacacacaaaccgcgggccccuggcaucucgggaagcuggaaauggauuuugacuucugugagggaacuaccguagucgugacagaagauugcggcaacagagggccgucucuaaggacuaccacagccuccggaaaacugaucacggaguggugcugucgcucaugcacccucccuccacugcgguacagaggcgaggacgguuguugguaugggauggaaauuaggccccuuaaggagaaggaagagaauuugguuaacagucuggugacugcuggacacggccagauagauaauuuuagcuuagguguccucggcauggcacuguuccuugaagagaugcugcgcacacgaguggggaccaaacaugccaucuugcucguuacugugucguuuguaacacugauuaccggaaacauguccuuccgggaccuaggccgugucauggugauggugggggcugccaugacggaugacaucggaaugggcgucacuuaccuggcacuccuggcggccuuuaagguuagaccuaccuucgcugccggucuuuugcugaggaaauuaacaucuaaggagcucaugauggcaaccauugggaucgcucugcuuagccagucaacuauacccgaaacaauccuggagcuaaccgaugcccucgcacugggaaugaugguguugaaaauuguacgcaauauggaaaaguaucaacuggccgugacaaucauggcuauuaguugcgucccaaacgcggugaucuuacagaaugccuggaagguuuccuguacuauacucgcagcugugucugucagcccucugcuucugaccuccucacagcagaaagccgacuggauucccuuggcccucacgaucaagggccugaacccaacagcuaucuuucuaaccacucugagccggaccaguaaaaagagaucuuggccgcuuaaugaggcaauuauggccgugggcaugguuuccauacucgcgagcucgcuguugaaaaacgacaucccuaugacagggccccugguggcuggagguuuacucacugucugcuacguacugaccggcaggucagccgaucuugaacuggagcgagcaacggacgugaagugggaggaucaagccgaaauuucugggaguuccccaaucuugagcauuacaaucgcugaggacggaucuaugagcaucaagaaugaagaggaggaacagacccucacuauccugauucgcacaggccuacugguuaucuccggucuuuuccccgugucaauuccuaucaccgcagccgcgugguaucucugggaggucaagaagcagcgggcuggggugcugugggauguaccaagucccccuccggugggaaaagccgaauuggaggacggcgcauacagaauaaagcagaaaggcauuuuaggguauagccaaaucggagccggugucuacaaggaaggcacuuuucacacaauguggcacguuaccagaggggcugugcugaugcaucguggaaaacgcaucgagccaucuugggccgaugugaagaaggaccucauuuccuacggcgguggguggaaacuggagggagaauggaaggagggcgaagagguccaggugcuugcacuggaacccggcaaaaacccucgggcuguucagacgaagccaggguuguucaaaacuaauaccggaacaaucggugccguaucacuagauuuuagucccggcaccagcggguccccuauaguggacagaaagggaaaggucgugggccuguaugguaacgggguugugacaaggucuggagcguacgucucggccauugcacagacugagaaaagcaucgaggauaauccggaaauugaggacgauaucuuccgaaagaaacggcucaccauaauggaccugcaccccggcgcuggcaagacgaaacgcuaucuuccagccauugugagagaagcuaucaagaggggguuacggacacugauccucgcaccuacucgaguagucgccgccgagauggaagaggcuuugagaggacugcccauucgcuaccaaaccccagcgaucagggcagagcauacaggucgugaaauuguggaccucaugugucacgccaccuucacuaugcggcugcuuucaccuguuagagugcccaacuauaaccugauaaucauggaugaggcucauuuuaccgacccagccuccauugcagccaggggcuacaucaguacacgcgucgaaaugggggaggcugcgggaaucuucaugacggccacuccgccuggcucucgagaucccuuuccacagagcaaugcacccauuauggacgaggaaagagagauaccugaacgguccuggaacucaggucacgagugggugaccgauuucaaggggaaaacaguuugguuugugccaucuaucaaggcuggaaaugacauugccgcaugcuugaggaaaaacggcaagaaagucauccagcuaagccgcaagaccuucgauagugaauaugugaagacucguacaaaugacugggauuuuguagugaccacggacauuuccgagaugggcgccaacuucaaagcugagagaguuaucgauccccggagguguaugaagccugucauacugacugacggggaagaacgcgugauccucgccggaccgaugccagugacacacagcucugcggcacaacgaagaggucggauuggcaggaaucccaaaaacgaaaaugaccaguacaucuacaugggggagccuuuagaaaacgaugaggacugcgcccauuggaaggaggcuaaaaugcugcuugauaauauuaacacccccgaaggaaucauaccaucaauguuugagccugaacgcgagaaggucgacgccauugauggcgaauauagacugaggggugaggcucggaaaaccuucguagaccucaugcgucgcggggauuugcccguguggcuggcauaccgaguugccgcugagggcaucaauuaugccgacagaaggugguguuuugauggagugaagaacgaccagauucucgaagagaaugucgaaguggagaucuggacuaaggagggcgaacggaaaaagcugaaaccacgcuggcuugaugcaagaauauacuccgacccucuagcgcugaaggaguucaaagaguucgccgcugggaggaagaguuugacauuaaaccugaucaccgagaugggacggcucccgacauuuaugacucagaaggcccgagaugcacuggacaaccuugcuguucugcacacggccgaagcaggagguagagccuauaaucaugcucucagcgaguugcccgagacccuggaaacacuacugcuccuuacucuguuagcgaccgugacagggggaauuuucuuguuucugaugucgggcaaaggugucgggaagaugacccucggcaugugcugcaucauuacugccucuauccugcuuugguacgcacaaauacagccacacuggauugcugccuccaucauccuggaguucuuucucauuguguugcugaucccugaacccgagaaacagcgcacgccacaggacaaccaauuaaccuauguagugauagccauucuaacaguugucgcagcuacuauggccaaugaaaugggauuccuggagaagaccaaaaaggaucucggccuugggagcaucgcgacacaggagccugaaucaaacauucuggacaucgauuugaggcccgcuagugccuggacccuguacgcaguggccacuacauuugugacgccgaugcuccggcacucuauagaaaauuccagcgucaacguuucacugaccgcuaucgcaaaucaggccacugugcuuaugggacucgguaagggcuggccacugaguaaaauggacauugggguaccuuugcuggcgaucggauguuacagccaggugaaccccauuacauuaaccgcugcccuacugcuccuugucgcacauuaugccaucauuggcccaggucugcaagcuaaggccacccgugaagcacagaaaagagcugccgcggggaucaugaagaaucccacaguggauggcauaacuguuauugacuuggauccuaucccguacgaccccaaauucgagaagcagcugggacaggugaugcuccugauccuuugcgucacgcaaguauuaaugaugaggaccacaugggcccugugugaagcacucacuuuggcuaccggcccaauuuccacacugugggaggggaacccuggacgcuuuuggaauaccacuauagccgugucuauggcaaacaucuuccggggcagcuaucuagcuggugccgggcugcucuuuuccauuaugaagaauacgacaaacacccgaagaggaacuggcaauaucggugagacccuuggcgaaaaauggaagucaaggcugaacgccuuggggaaaucugaguuccagauuuacaagaaaaguggaauccaggaaguugaucgcacacuggcgaaggagggcauaaaaagaggggaaacugaccaccaugcugugucgagaggaagcgcaaagcuccguugguuugucgaaaggaauauggugacccccgagggcaaggucguggaucuggguugcgggcggggaggcugguccuauuacugugguggccuuaaaaauguucgcgaagugaaggggcuaacaaaaggaggcccugggcacgaggaaccaauccccaugucuacguauggauggaaccugguacgacuccaaucaggcguggacgucuucuucaccccuccagagaagugcgauacucuacugugugacauuggugagagcucccccaauccgacaaucgaagccgggagaaccuugaggguucugagucucguggagaacuggcuuaauaacgacacucaguuuugcauuaaaguccugaauccuuacaugccaucugugaucgaaaagauggagacauugcagcggaaguacggaggcgcucugguacgcaacccccucagcagaaauucaacccaugaaauguauuggguguccaacgccacgggcaauauaguuaguagcgugaacaugauuucuaggauguuaaucaaucgauucaccaugaaacacaagaaagcaacauacgagccugaugucgaccugggguccggaacucggaacaucgguauugagucagaaauaccaaaucuugauaucauuggcaagcguaucgagaaaauuaagcaggaacacgagaccagcuggcauuaugaccaagaucaccccuacaagacaugggccuaucaugggucguacgaaacuaaacagaccggaucugcuaguuccauggugaacggcgucgugagacugcuaacaaagccgugggacguuguaccuauggugacccagauggcgaugacugauacgacacccuuuggucagcaacgcgucuucaaagagaagguggacaccaggacucaggagccaaaagaagggaccaagaagcucaugaaaaucacagccgaguggcuguggaaggaauugggcaaaaagaaaacgccucggauguguaccagagaggaguuuacucgcaagguuaggagcaaugcagcucugggcgccauauucacagaugaaaacaaauggaagucagcacgagaggccguggaagacucccgguuuugggagcucgucgauaaggaaagaaaccuucaccuggagggcaaaugcgagaccuguguguauaauaugauggggaagagggagaaaaaguuaggagaguucgguaaagcuaagggcucucgcgccaucugguacauguggcugggggcgagauuuuuggaguucgaggcacucggauuucugaacgaagaccacugguucagccgggagaauagucuauccggcguagagggugaagggcuucauaagcugggauacauucucagagacgugagcaaaaaggagggcggcgccauguaugcugaugacacugccgggugggauacaaggaucacccuggaagacuugaaaaacgaggaaaugguuacaaaucacauggagggagagcauaagaaacuggcagaagcuauuuuuaagcucacuuaccagaacaaggucgugcgcgugcagcgacccaccccacgggguacggucauggauaucauuucuagaagggaccaacgcggcucagggcagguuggaaccuauggccuuaauacauucacuaacauggaggcccagcugauaagacaaauggaaggugaggggguguucaaaaguauccagcgguuaaccguaacagaggaaauugcugugcagaauuggcuggccagggucggacgugagcgauugucccgcauggcaaucagcggcgaugacugcgugguuaagccccucgaugacagauuugcgucugcccugacugcucuaaacgauaugggcaaagugcggaaggacauccagcaaugggaaccuucgaggggguggaaugauuggacccaggucccauucugcucacaccauuuucacgagcuuauuaugaaagacggacgcgugcugguaguuccguguagaaaccaggacgaacucauaggucgggccaggaucagccagggcgcaggguggucccugaaggagacggcuugcuugggaaagaguuacgcccaaauguggucuuuaauguauuuccaccgacgugaucugagacucgcagccaaugcgauuuguagcgcugugcccucccauugggucccuacaucacgcaccacuuggaguauccacgccaaacaugaguggaugacaaccgaagacaugcuuacuguguggaaccggguguggauucaggagaauccauggauggaagauaagacccccgucgagucuugggaagagguuccuuaccugggcaaaagggaggaccaguggugcgguagccuaaucgggcugacauccagagcaacgugggccaagaacauacagaccgcuaucaaccaagugcgcucacucauuggaaaugaagaguauacugauuacaugccaagcaugaaacgguuuaggcgagaagaggaagaggccggcguauugugguga

SEQ ID NO: 14932 - RNA, 9876 nt, Artificial Sequence
  derived and/or modified CDS sequence (opt3) from DENV-2__FM210224__SS-prME
accgccggagugaucauuaugcugauacccacagcuauggcauuccaccucacuacgaggaacggggagccucauaugaucgucgggaggcaggaaaaggguaaaagccuucuguuuaagaccgaggacggcguuaauaugugcacauugauggccauugauuuaggggaacugugugaggacacuaucaccuacaaaugcccauuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagacccggacagaaacuuggaugaguagcgagggagcuuggaaacacgcccagaggaucgagaccuggauacugcggcauccuggcuucacaaucauggcagccauuuuggcuuacaccaucggcacgacucacuuucagcgcgcacucauuuucauccugcugacagccguggcuccauccaugaccaugcguugcauagggauuucuaacagggauuuuguugaaggagugucggguggcucaugggucgacaucgugcucgagcacgggagcuguguaacuacaauggccaagaauaagcccaccuuagauuucgaacugauuaaaacggaggcgaagcagccugcaacccuucggaaauauugcaucgaagccaaguugacaaacacuaccacagagagucgcuguccaacucaaggagagcccucccugaaugaagaacaggacaaacgauuuguuugcaagcauucuaugguggauagaggcugggguaacggguguggacuauucggcaagggcgggaucgucacaugcgcuauguuuacaugcaaaaagaauauggaaggaaaaauugugcagccugagaaccucgaauacaccauagugaucacuccacacagcggugaggagcaugccgucggcaaugacacggggaagcacggaaaagaaauuaagaucacaccgcaguccucaauaaccgaggcagaacugacuggcuaugguaccguuacaauggaguguagucccaggaccgggcuugauuucaacgaaauggugcuguugcaaauggaggacaaggcuuggcucguacaccggcagugguuucuggauuuaccucugccauggcuccccggcgccgacacucagggaagcaauuggauucagaaggagacacuugugacguucaagaacccucaugcgaaaaagcaagacgucgugguucugggcucucaggaaggggccaugcacaccgcauugacuggagcuacagagauccagauguccucagguaaucuacuguuuaccggccaucucaaaugccgucugcgcauggauaaacuucaacugaaagggaugagcuacaguauguguacaggaaaguucaagaucgugaaagaaauugccgagacucagcacggcaccaucgucauuagagugcaguaugagggugacgggucuccaugcaagauacccuucgaaaucauggauuuggagaaaaggcauguacucggccggcugauuacgguuaacccgaucgugaccgaaaaggacuccccugucaacaucgaggcugaacccccauuuggagauagcuacauuauaaucggcguggagccugggcaguuaaaacugaauugguucaagaagggaucgucuauuggucaaauguuugagacaacuaugcgaggcgccaaacgcauggcaauccuaggggacaccgccugggauuucggaucccucggcggugucuuuacaucaauugggaaggcucugcaccagguguucggcgcgaucuacggagcagccuuuaguggcguuagcuggacuaugaaaauacuuaucggggcuauuaucaccuggauuggaaugaacuccagaucuacgagcuugucagugagucugguacucgucggcgugaucacacuguaucuuggugccaugguucaggcagacuccggguguguggucagcuggaagaauaaagaacugaagugcggaucuggcauauucauuaccgauaacgugcacacuuggacagagcaguacaaguuucaacccgaaucaccaaguaaauuggccagcgcuauccagaaggcccaugaggaagguauuuguggcaucagguccguaacccggcucgagaaucugauguggaaacagauaacucccgaguuaaaccacauccugucugaaaaugaggugaagcuaaccauuaugacaggggacaucaaaggaauuaugcaggcaggcaagcgcucgcucagaccucaaccaacggaacugaaauauagcuggaagaccugggggaaggcgaaaaugcuuuccacugagucacauaaccagacauucuugaucgauggaccggaaaccgcugagugccccaauacaaacagggccuggaauagucuggagguugaagacuacggcuuuggugucuucacuaccaacauauggcucaagcugcgugagaaacaggacguguuuugugauucuaaguuaaugagcgcagccauuaaagacaaucgggcugugcacgccgauaugggguauuggaucgaauccgcacugaacgacacguggaagauggagaaggcuucauucaucgaggucaaaagcugccacuggccuaagucucauacacuuugguccaauggaguuuuggaaagugagaugauuaucccaaaaucauucgccggccccgugucucagcacaacuaccgaccugguuauuacacccaaacugcgggcccauggcaucucgggaagcuggaaauggauuuugacuucugugagggaaccacagugguagucacugaagauugcggcaacagagggcccucccuaaggaccacaacggccucaggaaaacugauuaccgaguggugcugucgcaguugcacucucccgccucugcgguacagaggcgaggacgguuguugguaugggauggaaauaaggccacuuaaggagaaggaagagaauuuggugaacagccugguuacagcuggacacggccagaucgauaauuuuucguuaggugugcucggcauggcacuguuccuugaagagaugcugcgcacccgagucgggacuaaacaugccauuuugcucguggcuguuuccuuugugacacugaucaccggaaacaugucuuuccgggaccuaggccguguaauggucauggugggggccacgaugacugaugacauuggaaugggcgugaccuaccuggcacuccuggcggccuuuaaggucagacccacauucgcugccggucuuuugcugaggaaauuaaccagcaaggagcucaugauggcaacuaucgggauagcucugcuuucacagaguacaaucccugaaaccauucuggagcuaacagaugcccucgcacugggaaugaugguuuugaaaaucgugcgcaauauggaaaaguaucaacuggccguaacuauuauggcuaucuccugcgugcccaacgcggucauauuacagaaugccuggaaggugucuuguaccauucucgcagcuguuagcguguccccacugcuucugacgucaagccagcagaaagccgacuggaucccuuuggcccucacaaucaagggccugaaccccaccgcuauuuuucuaacuacccugagucggacaucuaaaaagagauccuggccacuuaaugaggcaauaauggccgucggcauggugagcauccucgcgucgucacuguugaaaaacgacauuccgaugacugggccucugguugcuggagguuuacucaccgugugcuacguccugacgggcaggucugccgaucuugaacuggagcgagcaacagacguaaagugggaggaucaagccgaaaucaguggguccagccccauuuugucuaucaccauaagcgaggacggauccaugucaaucaaaaaugaagaggaggaacagacucucacaauucugauccgcaccggccuacuggugauuaguggucuuuucccaguuagcauccccauaacugcugcagccugguaucucugggaggugaagaagcagcgggcggggguccugugggaugugccuucuccacccccuguaggaaaagcugaauuggaggacggcgccuacagaauuaagcagaaaggcaucuuaggguauucccaaaucggagcaggaguguacaaggaaggcacauuucacaccauguggcacgucacgagaggggccguucugaugcaucguggaaaacgcauugagccgucaugggcugaugugaagaaggaccucaucaguuacggcgguggguggaaacuggagggagaauggaaggagggcgaagaggugcagguccuugcccuggaaccaggcaaaaacccccgggcagugcagacuaagccuggguuguucaaaaccaauacaggaaccauaggugcuguuagccuagauuuuuccccaggcacaucugggucgcccauuguagacagaaagggaaagguggucggccuguaugguaacggggugguuacuaggagcggagccuacgugucagcgaucgcccagaccgagaaauccauugaggauaauccugaaaucgaggacgauauauuccgaaagaaacggcucacgauuauggaccugcacccgggcgcaggcaagacaaaacgcuaucuucccgcuaucgucagagaagccaucaagaggggguuacggacucugauucucgcuccaacccgagugguagcagccgagauggaagaggccuugagaggacugccuauccgcuaccaaacacccgcuauuagggcggagcauaccggucgugaaauagucgaccucaugugucacgcaacuuucaccaugcggcugcuuaguccagugagaguuccuaacuauaaccugaucauuauggaugaggcccauuuuacagaccccgcuucuaucgccgcaaggggcuacaucagcacgcgcguggaaaugggggaggccgcuggaauuuucaugacugcgaccccaccgggcucccgagauccuuuuccccagucaaaugccccaauaaucgacgaggaaagagagauucccgaacggucuuggaacagcggucacgagugggucacagauuucaaggggaaaaccgugugguuuguuccuaguaucaaggcaggaaaugacauugcugccugcuugaggaaaaacggcaagaaagugauccagcuaucccgcaagacuuucgauagcgaauaugucaagacacguaccaaugacugggauuuugugguaacgacugacauaucugagaugggcgcaaacuucaaagccgagagagugaucgauccacggagguguaugaagcccguuauucugacagacggggaagaacgcgucauccucgcuggaccuaugccggugacccacucauccgccgcgcaacgaagaggucggauuggcaggaaucccaaaaacgaaaaugaccaguacaucuacaugggggagcccuuagaaaacgaugaggacugcgcacauuggaaggaggccaaaaugcugcuugauaauauaaacaccccugaaggaauuauccccaguauguuugagccagaacgcgagaagguggacgcuauugauggcgaauauagacugaggggugaggcccggaaaacuuucgucgaccucaugcgucgcggggauuugccuguauggcuggcuuaccgaguggcagccgagggcaucaauuaugcugacagaaggugguguuuugauggagccaagaacaaucagauacucgaagagaacguugaaguggagaucuggacaaaggagggcgaacggaaaaagcugaaaccccgcuggcuugacgcaagaauuuacagcgauccacuagcgcugaaggaguucaaagaguucgccgcugggaggaagucguugaccuuaaaccugaucacagagaugggacggcucccuacuuuuaugacgcagaaggcccgagacgcacuggauaaucuugcuguccugcacaccgccgaagccggugguagagcauauaaccaugcucucucugaguugccggagacacuggaaacucuacugcuccuuacccuguuagcgacagugaccgggggaauuuucuuguuucugauguccggcaaagguguugggaagaugacucucggcaugugcugcaucauaacggccagcauucugcuuugguacgcacaaauccagccccacuggaucgcugccucaauuauccuggaguucuuucucauaguguugcugauuccagaaccugagaaacagcgcaccccacaggacaaucaauuaacauaugucgugaucgccauucuaacuguaguggcagcuaccauggccaacgaaaugggauuccuggagaagaccaaaaaggaccucggccuugggaguaucgcgacccaggagccagaaucuaauauacuggauaucgacuugaggccugcuuccgccuggacucuguacgcaguugccacaacguuugucacccccaugcuccggcacagcauugagaacucaagugugaaugugagccugacugcuaucgcaaaccaggccacaguccuuaugggacucgguaagggcuggccgcuguccaaaauggauauugggguuccauugcuggcgaucggauguuacucucaggugaauccuauuaccuuaaccgcugcccuacugcuccuuaucgcacauuaugccauaauuggccccggucugcaagcuaaggccacacgugaagcacagaaaagagcugccgcggggaucaugaagaacccaacuguagacggcaucacggugauugauuuggaccccauaccuuacgauccgaaauucgagaagcagcugggacaggucaugcuccugauccuuugcgugacccaaguuuuaaugaugaggacaacuugggcccugugugaagcacucaccuuggcuacaggccccauuagcacccugugggaggggaauccaggacgcuuuuggaacacuacgaucgccguguccauggcaaauauuuuccggggcucauaucuagcuggugccgggcugcucuuuucuaucaugaagaacacaaccaauacucgaagaggaaccggcaacauaggugagacacuuggcgaaaaauggaagaguaggcugaaugccuuggggaaaucggaguuccagaucuacaagaaaagcggcauucaggaagucgaccgcacucuggcgaaggagggcaucaaaagaggggaaaccgaucaccaugcuguauccagaggaucugcaaagcuccguugguuuguggaaaggaacaugguuacaccugagggcaagguggucgaccuggguugcgggcggggaggcuggucauauuacugugguggccuuaaaaacgugcgcgaagucaaggggcuaacgaaaggaggccccgggcacgaggaaccuauuccaaugagcaccuauggauggaaucuggugcgacuccaauccggcguugauguguucuucacucccccugagaagugcgacacacuacugugugauaucggugagaguucuccaaaccccaccauagaagccgggagaacuuugaggguacugagccucguggagaauuggcuuaacaaugacacacaguuuugcauuaaaguccugaacccguacaugccuucaguuaucgaaaagauggagaccuugcagcggaaguacggaggcgcucuggugcgcaauccacucuccagaaacaguacgcaugaaauguauugggucagcaaugccaccggcaacaucgugucuuccguaaauaugauuucaaggauguuaauaaaccgauucacaaugaaacacaagaaagcaacuuacgagcccgacguggaucuggggagcggaacccggaauaucgguauugagucggaaaucccuaaccuugacauuaucggcaagcguauagagaaaaucaagcaggaacacgagacaucuuggcauuaugaucaagaccacccauacaagacuugggccuaucaugggaguuacgaaaccaaacagacaggauccgcuagcucaaugguuaauggcguggucagacugcuaaccaagcccugggauguggucccgauggugacucagauggcgaugacggacacaaccccuuuuggucagcaacgcguuuucaaagagaagguagauacuaggacccaggagcccaaagaagggacaaagaagcucaugaaaauuacggccgaguggcuguggaaggaauugggcaaaaagaaaaccccacggauguguacuagagaggaguuuacacgcaaggugagguccaacgcagcucugggcgccaucuucaccgacgaaaacaaauggaagucugcacgagaggccgucgaagauagccgguuuugggagcucguggacaaggaaagaaaucuucaccuggagggcaaaugcgagacuuguguuuauaacaugauggggaagagggagaaaaaguuaggagaguucgguaaagcuaagggcagucgcgccauuugguacauguggcugggggcgagauuuuuggaguucgaggcacucggauuucugaaugaagaucacugguucucccgggagaacagccuaucuggcguggagggugaagggcuucauaagcugggauacauccucagagacgucagcaaaaaggagggcggcgccauguaugcugacgauacagccgggugggacaccaggauuacacuggaagauuugaaaaaugaggaaauggugacuaaccacauggagggagagcauaagcgccuggcagaagcuauauuuaaacucaccuaccagaauaagguagugcgaguucagcggccuacgcccagagguaccgucauggacaucauuaguaggcgcgaucaaagaggcuccggacaggugggaacauauggccuuaacacuuucaccaauauggaggcccagcugauccggcaaauggaaggugaggggaucuucaagagcauucagcacuuaacagugacugaggaaauagcuguccagaacuggcuggccaggguuggacgugagcgauugucucgcauggcaaucucgggcgacgauugcgugguaaaaccacucgacgauagauuugcgucagcccugaccgcucuaaaugacaugggcaaggugcggaaagauauucagcaaugggaacccagcaagggguggaacgacuggacgcaggucccuuucugcucccaucacuuucacgagcuuaucaugaaagauggaagggugcugguugugccaugucgcaaucaggacgaacucauugguagagcccggaucagucagggcgcaggguggucucugaaggagacagcuugcuugggaaagagcuacgcccaaaugugguccuuaauguauuuccauaggcgagaccugcgucucgcagccaacgcgauauguucagcugucccgagucacugggugcccaccucuagaacuacauggagcauccaugccaaacacgaguggaugaccacugaagauaugcuuaccguauggaaucgcguuuggauucaggagaacccuuggauggaagacaagacaccaguggaguccugggaagagguccccuaccugggcaaacgggaggaucaguggugcgguucacuaaucgggcugacgagcagggcaaccugggccaagaacauucagacugcuaucaaucaagugagaucucucauaggaaacgaagaguauacagacuacaugccuuccaugaaacgcuuucggagggaagaggaagaggccggcguguugugguga

SEQ ID NO: 14933 - RNA, 9876 nt, Artificial Sequence
  derived and/or modified CDS sequence (opt3) from DENV-2__FM210225__SS-prME
accgccggagugaucauuaugcugauacccacggcuauggcauuccaccucacuacgaggaacggggagccucauaugaucgucgggaggcaggaaaaggguaaaagccuucuguuuaagaccgaggacggaguuaauaugugcacauugauggccauugauuuaggggaacugugugaggacacuaucaccuacaaaugcccauuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagacccggacagaaacuuggaugaguagcgagggagcuuggaaacacgcccagaggaucgagaccuggauacugcggcauccuggcuucacaaucauggcagccauuuuggcuuacaccaucggcacgacucacuuucagcgcgcacucauuuucauccugcugacagccguggcuccauccaugaccaugcguugcauagggauuucuaacagggauuuuguugaaggagugucggguggcucaugggucgacaucgugcucgagcacgggagcuguguaacuacaauggccaagaauaagcccaccuuagauuucgaacugauuaaaacggaggcgaagcagccugcaacccuucggaaauauugcaucgaagccaaguugacaaacacuaccacagagagucgcuguccaacucaaggagagcccucccugaaugaagaacaggacaaacgauuuguuugcaagcauucuaugguggauagaggcugggguaacggguguggacuauucggcaagggcgggaucgucacaugcgcuauguuuacaugcaaaaagaauauggaaggaaaaauugugcagccugagaaccucgaauacaccauagugaucacuccacacagcggugaggagcaugccgucggcaaugacacggggaagcacggaaaagaaauuaagaucacaccgcaguccucaauaaccgaggcagaacugacuggcuaugguaccguuacaauggaguguagucccaggaccgggcuugauuucaacgaaauggugcuguugcaaauggaggacaaggcuuggcucguacaccggcagugguuucuggauuuaccucugccauggcuccccggcgccgacacucagggaagcaauuggauucagaaggagacacuugugacguucaagaacccucaugcgaaaaagcaagacgucgugguucugggcucucaggaaggggccaugcacaccgcauugacuggagcuacagagauccagauguccucagguaaucuacuguuuaccggccaucucaaaugccgucugcgcauggauaaacuucaacugaaagggaugagcuacaguauguguacaggaaaguucaagaucgugaaagaaauugccgagacucagcacggcaccaucgucauuagagugcaguaugagggugacgggucuccaugcaagauacccuucgaaaucauggauuuggagaaaaggcauguacucggccggcugauuacgguuaacccgaucgugaccgaaaaggacuccccugucaacaucgaggcugaacccccauuuggagauagcuacauuauaaucggcguggagccugggcaguuaaaacugaauugguucaagaagggaucgucuauuggucaaauguuugagacaacuaugcgaggcgccaaacgcauggcaauccuaggggacaccgccugggauuucggaucccucggcggugucuuuacaucaauugggaaggcucugcaccagguguucggcgcgaucuacggagcagccuuuaguggcguuagcuggacuaugaaaauacuuaucggggcuauuaucaccuggauuggaaugaacuccagaucuacgagcuugucagugagucugguacucgucggcgugaucacacuguaucuuggugccaugguucaggcagacuccggguguguggucagcuggaagaauaaagaacugaagugcggaucuggcauauucauuaccgauaacgugcacacuuggacagagcaguacaaguuucaacccgaaucaccaaguaaauuggccagcgcuauccagaaggcccaugaggaagguauuuguggcaucagguccguaacccggcucgagaaucugauguggaaacagauaacucccgaguuaaaccacauccugucugaaaaugaggugaagcuaaccauuaugacaggggacaucaaaggaauuaugcaggcaggcaagcgcucgcucagaccucaaccaacggaacugaaauauagcuggaagaccugggggaaggcgaaaaugcuuuccacugagucacauaaccagacauucuugaucgauggaccggaaaccgcugagugccccaauacaaacagggccuggaauagucuggagguugaagacuacggcuuuggugucuucacuaccaacauauggcucaagcugcgugagaaacaggacguguuuugugauucuaaguuaaugagcgcagccauuaaagacaaucgggcugugcacgccgauaugggguauuggaucgaauccgcacugaacgacacguggaagauggagaaggcuucauucaucgaggucaaaagcugccacuggccuaagucucauacacuuugguccaauggaguuuuggaaagugagaugauuaucccaaaaucauucgccggccccgugucucagcacaacuaccgaccugguuauuacacccaaacugcgggcccauggcaucucgggaagcuggaaauggauuuugacuucugugagggaaccacagugguagucacugaagauugcggcaacagagggcccucccuaaggaccacaacggccucaggaaaacugauuaccgaguggugcugucgcaguugcacucucccgccucugcgguacagaggcgaggacgguuguugguaugggauggaaauaaggccacuuaaggagaaggaagagaauuuggugaacagccugguuacagcuggacacggccagaucgauaauuuuucguuaggugugcucggcauggcacuguuccuugaagagaugcugcgcacccgagucgggacuaaacaugccauuuugcucguggcuguuuccuuugugacacugaucaccggaaacaugucuuuccgggaccuaggccguguaauggucauggugggggccacgaugacugaugacauuggaaugggcgugaccuaccuggcacuccuggcggccuuuaaggucagacccacauucgcugccggucuuuugcugaggaaauuaaccagcaaggagcucaugauggcaacuaucgggauagcucugcuuucacagaguacaaucccugaaaccauucuggagcuaacagaugcccucgcacugggaaugaugguuuugaaaaucgugcgcaauauggaaaaguaucaacuggccguaacuauuauggcuaucuccugcgugcccaacgcggucauauuacagaaugccuggaaggugucuuguaccauucucgcagcuguuagcguguccccacugcuucugacgucaagccagcagaaagccgacuggaucccuuuggcccucacaaucaagggccugaaccccaccgcuauuuuucuaacuacccugagucggacaucuaaaaagagauccuggccacuuaaugaggcaauaauggccgucggcauggugagcauccucgcgucgucacuguugaaaaacgacauuccgaugacugggccucugguugcuggagguuuacucaccgugugcuacguccugacgggcaggucugccgaucuugaacuggagcgagcaacagacguaaagugggaggaucaagccgaaaucaguggguccagccccauuuugucuaucaccauaagcgaggacggauccaugucaaucaaaaaugaagaggaggaacagacucucacaauucugauccgcaccggccuacuggugauuaguggucuuuucccaguuagcauccccauaacugcugcagccugguaucucugggaggugaagaagcagcgggcggggguccugugggaugugccuucuccacccccuguaggaaaagcugaauuggaggacggcgccuacagaauuaagcagaaaggcaucuuaggguauucccaaaucggagcugguguguacaaggaaggcacauuucacaccauguggcacgucacgagaggggcaguucugaugcaucguggaaaacgcauugagccgucaugggcagaugugaagaaggaccucaucaguuacggcgguggguggaaacuggagggagaauggaaggagggcgaagaggugcagguccuugcccuggaaccaggcaaaaacccccgggcagugcagacuaagccuggguuguucaaaaccaauacaggaaccauaggugcuguuagccuagauuuuuccccaggcacaucugggucgcccauuguagacagaaagggaaagguggucggccuguaugguaacggggugguuacuaggagcggagccuacgugucagcgaucgcccagaccgagaaauccauugaggauaauccugaaaucgaggacgauauauuccgaaagaaacggcucacgauuauggaccugcacccgggcgcaggcaagacaaaacgcuaucuucccgcuaucgucagagaagccaucaagaggggguuacggacucugauucucgcuccaacccgagugguagcagccgagauggaagaggccuugagaggacugccuauccgcuaccaaacacccgcuauuagggcggagcauaccggucgugaaauagucgaccucaugugucacgcaacuuucaccaugcggcugcuuaguccagugagaguuccuaacuauaaccugaucauuauggaugaggcccauuuuacagaccccgcuucuaucgccgcaaggggcuacaucagcacgcgcguggaaaugggggaggccgcuggaauuuucaugacugcgaccccaccgggcucccgagauccuuuuccccagucaaaugccccaauaaucgacgaggaaagagagauucccgaacggucuuggaacagcggucacgagugggucacagauuucaaggggaaaaccgugugguuuguuccuaguaucaaggcaggaaaugacauugcugccugcuugaggaaaaacggcaagaaagugauccagcuaucccgcaagacuuucgauagcgaauaugucaagacacguaccaaugacugggauuuugugguaacgacugacauaucugagaugggcgcaaacuucaaagccgagagagugaucgauccacggagguguaugaagcccguuauucugacagacggggaagaacgcgucauccucgcuggaccuaugccggugacccacucauccgccgcgcaacgaagaggucggauuggcaggaaucccaaaaacgaaaaugaccaguacaucuacaugggggagcccuuagaaaacgaugaggacugcgcacauuggaaggaggccaaaaugcugcuugauaauauaaacaccccugaaggaauuauccccaguauguuugagccagaacgcgagaagguggacgcuauugauggcgaauauagacugaggggugaggcccggaaaacuuucgucgaccucaugcgucgcggggauuugccuguauggcuggcuuaccgaguggcagccgagggcaucaauuaugcugacagaaggugguguuuugauggaguuaagaacaaucagauacucgaagagaacguggaagucgagaucuggacaaaggagggcgaacggaaaaagcugaaaccccgcuggcuugacgccagaauuuacagcgauccacuagcacugaaggaguucaaagaguucgcggccgggaggaagucguugaccuuaaaccugaucacagagaugggacggcucccuacuuuuaugacgcagaaggcucgagacgcccuggauaaucuugcagugcugcacaccgcugaagccgguggcagagcauauaaccaugcccucucugaguugccggagacacuggaaacucuacugcuccuuacccuguuagcuacaguuaccgggggaauuuucuuguuucugauguccggcaaagguguggggaagaugacucucggcaugugcugcaucauaacggcgagcauucugcuuugguacgcccaaauccagccccacuggaucgcagcuucaauuauccuggaguucuuucucauagucuugcugauuccagaaccugagaaacagcgcaccccacaggacaaucaauuaacauaugugguaaucgccauucuaacugugguugccgcaaccauggcuaacgaaaugggauuccuggagaagaccaaaaaggaccucggccuugggaguaucgccacccaggagccagaaucuaauauacuggauaucgacuugaggccugcguccgcuuggacucuguacgccgucgcaacaacguuugugacccccaugcuccggcacagcauugagaacucaagugugaaugucagccugacugccaucgcuaaccaggcaacaguucuuaugggacucgguaagggcuggccgcuguccaaaauggauauuggggugccauugcuggccaucggauguuacucucagguaaauccuauuaccuuaaccgcggcucuacugcuccuuaucgcccauuaugcaauaauuggccccggucugcaagccaaggcuacacgugaagcccagaaaagagcagcugccgggaucaugaagaacccaacuguggacggcaucacggucauugauuuggaccccauaccuuacgauccgaaauucgagaagcagcugggacaggugaugcuccugauccuuugcguuacccaaguguuaaugaugaggacaacuugggcgcugugugaagcccucaccuuggcaacaggccccauuagcacccugugggaggggaauccaggacgcuuuuggaacacuacgaucgcugucuccauggccaauauuuuccggggcucauaucuagccggugcugggcugcucuuuucuaucaugaagaacacaaccaauacucgaagaggaaccggcaacauaggugagacacuuggcgaaaaauggaagaguaggcugaaugccuuggggaaaucggaguuccagaucuacaagaaaagcggcauucaggaaguagaccgcacucuggccaaggagggcaucaaaagaggggaaaccgaucaccaugcgguguccagaggaucugcuaagcuccguugguuuguugaaaggaacauggugacaccugagggcaaggucguggaccuggguugcgggcggggaggcuggucauauuacugugguggccuuaaaaacguccgcgaagugaaggggcuaacgaaaggaggccccgggcacgaggaaccuauuccaaugagcaccuauggauggaaucugguucgacuccaauccggcguggauguauucuucacucccccugagaagugcgacacacuacugugugauaucggugagaguucuccaaaccccaccauagaagcagggagaacuuugagggugcugagccucgucgagaauuggcuuaacaaugacacacaguuuugcauuaaaguucugaacccguacaugccuucagugaucgaaaagauggagaccuugcagcggaaguacggaggcgcccugguccgcaauccacucuccagaaacaguacgcaugaaauguauugggugagcaaugcuaccggcaacaucguaucuuccgugaauaugauuucaaggauguuaauaaaccgauucacaaugaaacacaagaaagccacuuacgagcccgacguugaucuggggagcggaacccggaauaucgguauugagucggaaaucccuaaccuugacauuaucggcaagcguauagagaaaaucaagcaggaacacgagacaucuuggcauuaugaucaagaccacccauacaagacuugggcauaucaugggaguuacgaaaccaaacagacaggauccgccagcucaauggugaauggcgucgugagacugcuaaccaagcccugggaugucgugccgaugguuacucagauggcuaugacggacacaaccccuuuuggucagcaacgcguauucaaagagaagguggauacuaggacccaggagcccaaagaagggacaaagaagcucaugaaaauuacggcggaguggcuguggaaggaauugggcaaaaagaaaaccccacggauguguacuagagaggaguuuacacgcaaggucagguccaacgccgcacugggcgcuaucuucaccgacgaaaacaaauggaagucugcccgagaggcaguggaagauagccgguuuugggagcucguugacaaggaaagaaaucuucaccuggagggcaaaugcgagacuuguguguauaacaugauggggaagagggagaaaaaguuaggagaguucgguaaagccaagggcagucgcgcuauuugguacauguggcugggggccagauuuuuggaguucgaggcgcucggauuucugaaugaagaucacugguucucccgggagaacagccuaucuggcgucgagggugaagggcuucauaagcugggauacauccucagagacgugagcaaaaaggagggcggcgcaauguaugccgacgauacagcugggugggacaccaggauuacacuggaagauuugaaaaaugaggaaaugguaacuaaccacauggagggagagcauaagcgccuggccgaagcaauauuuaaacucaccuaccagaauaaggugguucgaguccagcggccuacgcccagagguaccgugauggacaucauuaguaggcgcgaucaaagaggcuccggacaggugggaacauauggccuuaacacuuucaccaauauggaggcucagcugauccggcaaauggaaggugaggggaucuucaagagcauucagcacuuaacagucacugaggaaauagccguucagaacuggcuggcuagggugggacgugagcgauugucucgcauggccaucucgggcgacgauugcguagugaaaccacucgacgauagauuugcaucagcgcugaccgcccuaaaugacaugggcaagguccggaaagauauucagcaaugggaacccagcaagggguggaacgacuggacacaggugccuuucugcucccaucacuuucacgagcuuaucaugaaagauggaaggguucugguggucccaugucgcaaucaggacgaacucauugguagagcucggaucagucagggcgccggguggucucugaaggagacagcaugcuugggaaagagcuacgcucaaaugugguccuuaauguauuuccauaggcgagaccugcgucucgccgcaaacgccauauguucagcggugccgagucacuggguacccaccucuagaacuacauggagcauccaugcuaaacacgaguggaugaccacugaagauaugcuuaccguuuggaaucgcguguggauucaggagaacccuuggauggaagacaagacaccagucgaguccugggaagaggugcccuaccugggcaaacgggaggaucaguggugcgguucacuaaucgggcugacgagcagggccaccugggcaaagaacauucagacugccaucaaucaagugagaucucucauaggaaacgaagaguauacagacuacaugccuuccaugaaacgcuuucggagggaagaggaagaggcuggcgucuugugguga

SEQ ID NO: 14934 - RNA, 9876 nt, Artificial Sequence
  derived and/or modified CDS sequence (opt3) from DENV-2__FM210226__SS-prME
accgccggcgugaucauuaugcugauacccacagcuauggcauuccaccucacuacgaggaacggggagccucauaugaucgucggaaggcaggaaaaggguaaaagccuucuguuuaagaccgaggacggcguuaauaugugcacauugauggccauugauuuaggggaacugugugaggacacuaucaccuacaaaugcccauuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagacccggacagaaacuuggaugaguagcgagggagcuuggaaacacgcccagaggaucgagaccuggauacugcggcauccuggcuucacaaucauggcagccauuuuggcuuacaccgugggcacgacucacuuucagcgcgcacucaucuucauucugcuggccgcuguugccccauccaugacaaugcguugcaucgggauaucuaacagggauuuuguggaaggagucucggguggcucauggguggacauuguacucgagcacgggagcuguguuaccacuauggcgaagaauaagcccacauuagauuucgaacugaucaaaaccgaggcaaagcagccugccacgcuucggaaauauugcauugaagcuaaguugaccaacacaacuaccgagagucgcuguccaacacaaggagagcccucccugaaugaagaacaggacaaacgauuugugugcaagcauucuauggucgauagaggcugggguaacggguguggacuauucggcaagggcgggaucgugacuugcgccauguuuaccugcaaaaagaauauggaaggaaaaaucgugcagccugagaaccucgaauacacaauugucauaaccccacacagcggugaggagcaugcaguuggcaaugacacugggaagcacggaaaagaaaucaagauuacgccgcagucccccaucacagaggcugaacugaccggcuaugguacugugaccauggaguguucaccuaggacagggcuugauuucaacgaaaugguacuguugcaaauggaggacaaagccuggcucgugcaccggcagugguuucuggauuuaccacugcccuggcucccuggcgcggacacccagggaaguaauuggauacagaaggagacucuugucacauucaagaacccacaugccaaaaagcaagacgugguugugcugggcagccaggaaggggcaaugcacacggcuuugaccggagccacugagauucagaugucuuccgguaaucuacuguuuacaggccaucucaaaugccgucugcgcauggauaaacuucaacugaaagggaugucauacagcauguguaccggaaaguucaagaucgucaaagaaaucgcugagacacagcacggcacuauugugaucagaguacaguaugagggugacgggagucccugcaagauuccguucgaaauaauggauuuggagaaaaggcauguucucggccggcugaucaccgugaacccuauugucacggaaaaggacucucccgugaacaucgaggccgaaccaccuuuuggagauuccuacaucauuauaggcgucgagcccgggcaguuaaaacugaauugguucaagaagggaagcucgaucggucaaauguuugagaccacaaugcgaggcgcaaaacgcauggccauucuaggggacacugcuugggauuucggaucucucggcgguguguuuaccuccaucgggaaggcgcugcaccagguuuucggcgcaauuuacggagccgcuuuuucaggcgugaguuggacaaugaaaauccuuauagggguaaucauuacuuggaucggaaugaacagcagauccaccucuuugagcgucucacuggugcucguuggcgugauuacgcuguaucuuggugccaugguccaggcagacagugggugugugguauccuggaagaauaaagaacugaagugcggaagcggcaucuucauaacagauaacgugcacaccuggacugagcaguacaaguuucaaccagaaucucccucaaaauuggccagugcuauucagaaggcccaugaggaagguaucuguggcauuaggagcguuacacggcucgagaaucugauguggaaacagaucaccccugaguuaaaccacauacuguccgaaaaugaggucaagcuaacuaucaugaccggggacauuaaaggaaucaugcaggcaggcaagcgcucucucagaccacaaccgacagaacugaaauauucguggaagacgugggggaaggcgaaaaugcuuagcaccgagucccauaaccagacuuucuugauugauggacccgaaacagcugagugcccuaauaccaacagggccuggaacucacuggagguggaagacuacggcuuugguguguucacaacuaacaucuggcucaagcugcgugagaaacaggacgucuuuugugauaguaaguuaaugucugcagccauaaaagacaaucgggcuguucacgccgauaugggguauuggauugaaagcgcacugaacgacaccuggaagauggagaaggcuuccuucaucgaggugaaaucaugccacuggccaaagagccauacgcuuuggucuaauggaguguuggaauccgagaugaucauucccaaaaguuucgccggcccuguaagccagcacaacuaccgaccagguuauuacacacaaaccgcgggccccuggcaucucgggaagcuggaaauggauuuugacuucugugagggaacuaccgucgugguuacagaagauugcggcaacagagggccgucucuaaggacuaccacagccuccggaaaacugaucacggaguggugcugucgcucaugcacccucccuccacugcgguacagaggcgaggacgguuguugguaugggauggaaauuaggccccuuaaggagaaggaagagaauuuggugaacagucuggucacugcuggacacggccagauagauaauuuuagcuuaggugugcucggcauggcacuguuccuugaagagaugcugcgcacacgaguugggaccaaacaugccaucuugcucguggcuguaucguuugucacucugauuacaggaaacauguccuuccgggaccuaggccgugugauggugauggucggggccgcaaugaccgaugacaucggaauuggcguuacguaccuggcgcuccuggccgcuuuuaaggugagaccuacuuucgccgcaggucuuuugcugaggaaauuaaccucuaaggagcucaugauggcuacaaucgggauagcccugcuuagccagucaaccauccccgaaacuauucuggagcuaacagaugcacucgcccugggaaugaugguauugaaaaucgugcgcaauauggaaaaguaucaacuggcugucaccauuauggcgaucaguugcgugccaaacgccguuauauuacagaaugcauggaagguguccuguacaauucucgcuacugucucugugagcccucugcuucugaccuccucacagcagaaagccgacuggauccccuuggcccucacgaucaagggccugaacccaacagcuauuuuucuaaccacucugagccggaccaguaaaaagagaucuuggccgcuuaaugaggcaauaauggccguuggcaugguguccauccucgcgagcucgcuguugaaaaacgacauuccuaugacagggccccuggucgcuggagguuuacucacuguaugcuacgugcugaccggcaggucagccgaucuugaacuggagcgagcaacggacguuaagugggaggaucaagccgaaaucucugggaguuccccaauuuugagcaucacaauagcugaggacggaucuaugagcaucaaaaaugaagaggaggaacagacccucacuauucugauccgcacaggccuacuggugauuuccggucuuuuccccgucucaaucccuauaaccgcagccgcgugguaucucugggaggugaagaagcagcgggcugggguacugugggaugugccaagucccccuccggucggaaaagccgaauuggaggacggcgcauacagaauuaagcagaaaggcaucuuaggguauagccaaaucggagccgguguuuacaaggaaggcacuuuucacacaauguggcacgugaccagaggggcugugcugaugcaucguggaaaacgcauugagccaucuugggccgaugucaagaaggaccucaucuccuacggcgguggguggaaacuggagggagaauggaaggagggcgaagaggugcagguucuugcacuggaacccggcaaaaacccucgggcuguacagacgaagccaggguuguucaaaacuaauaccggaacaauaggugccgugucacuagauuuuagucccggcaccagcggguccccuauugucgacagaaagggaaaggugguuggccuguaugguaacgggguggucacaaggucuggagcguacgugucggccaucgcacagacugagaaaagcauugaggauaauccggaaaucgaggacgauauauuccgaaagaaacggcucaccauuauggaccugcaccccggcgcuggcaagacgaaacgcuaucuuccagccaucguaagagaagcuaucaagaggggguuacggacacugauucucgcaccuacucgagucguggccgccgagauggaagaggcuuugagaggacugcccauccgcuaccaaaccccagcgauuagggcagagcauacaggucgugaaauaguugaccucaugugucacgccaccuucacuaugcggcugcuuucaccugugagaguccccaacuauaaccugaucauuauggaugaggcucauuuuaccgacccagccuccaucgcagccaggggcuacaucaguacacgcguggaaaugggggaggcugcgggaauuuucaugacggccacuccgccuggcucucgagaucccuuuccacagagcaaugcacccauaauggacgaggaaagagagaucccugaacgguccuggaacucaggucacgaguggguuaccgauuucaaggggaaaacagugugguuugucccaucuauuaaggcuggaaaugacaucgccgcaugcuugaggaaaaacggcaagaaagugauucagcuaagccgcaagaccuucgauagugaauauguaaagacucguacaaaugacugggauuuugugguuaccacggacaucuccgagaugggcgccaacuucaaagcugagagagucauagauccccggagguguaugaagccugugauccugacugacggggaagaacgcgugauucucgccggaccgaugccagucacacacagcucugcggcacaacgaagaggucggaucggcaggaaucccaaaaacgaaaaugaccaguacauuuacaugggggagccuuuagaaaacgaugaggacugcgcccauuggaaggaggcuaaaaugcugcuugauaauaucaacacccccgaaggaauaauuccaucaauguuugagccugaacgcgagaagguagacgccaucgauggcgaauauagacugaggggugaggcucggaaaaccuucguggaccucaugcgucgcggggauuugcccguuuggcuggcauaccgaguggccgcugagggcauuaauuaugccgacagaaggugguguuuugauggagucaagaacaaucagauccucgaagagaacguggaaguugagauauggacuaaggagggcgaacggaaaaagcugaaaccacgcuggcuugacgcaagaaucuacuccgauccucuagcgcugaaggaguucaaagaguucgccgcugggaggaagaguuugacauuaaaccugauuaccgagaugggacggcucccgacauuuaugacucagaaggcccgagacgcacuggauaaucuugcugugcugcacacggccgaagcaggagguagagccuauaaccaugcucucagcgaguugcccgagacccuggaaacacuacugcuccuuacucuguuagcgaccgucacagggggaaucuucuuguuucugaugucgggcaaagguguggggaagaugacccucggcaugugcugcauuaucacugccucuauacugcuuuggcacgcacaaauucagccacacuggaucgcugccuccaucauucuggaguucuuucucaucguauugcugauaccugaacccgagaaacagcgcacgccacaggacaaucaauuaaccuacgugguuauugccauccuaacagucguggcagcuacuauggccaacgaaaugggauuccuggagaagaccaaaaaggaccucggccuugggagcauugcgacacaggagccugaaucaaauauccuggauauagacuugaggcccgcuagugccuggacccuguaugcaguggccacuacauuugucacgccgaugcuccggcauucuaucgagaacuccagcguuaaugugucacugaccgcuauugcaaaccaggccacuguacuuaugggacucgguaagggcuggccacugaguaaaauggauaucggggugccuuugcuggcgauuggauguuacagccaggucaaucccaucacauuaaccgcugcccuacugcuccuuguggcacacuacgccauuaucggcccaggucugcaagcuaaggccacccgugaagcacagaaaagagcugccgcggggauaaugaagaaccccacaguugacggcauuacugugaucgauuuggacccuaucccguaugaucccaaauucgagaagcagcugggacaggucaugcuccugauucuuugcguaacgcaaguguuaaugaugaggaccacaugggcccugugugaagcacucacuuuggcuaccggcccaauauccacacugugggaggggaauccuggacgcuuuuggaacaccacuaucgccguuucuauggcaaauauuuuccggggcagcuaccuagcuggugccgggcugcucuuuuccaucaugaagaacacgacaaauacccgaagaggaacuggcaacauuggugagacccuuggcgaaaaauggaagucaaggcugaaugccuuggggaaaucugaguuccagaucuauaagaaaaguggaauacaggaaguggaccgcacacuggcgaaggagggcaucaaaagaggggaaacugaucaucacgcugucucgagaggaagcgcaaagcuccguugguuuguggaaaggaacauggucacccccgagggcaaggugguugaccuggguugcgggcggggaggcugguccuacuauugugguggccuaaagaaugugcgcgaaguaaaggggcuuacaaaaggaggcccugggcaugaggaaccagugcccaugucuacguacggauggaaucugguccgacuccaaucaggcguugauguguucuucaccccuccagagaagugcgacacucuacugugugauauuggugagagcucccccaacccgacaaucgaagccgggagaaccuugaggguccugagucucguggagaauuggcuuaacaaugacacucaguuuugcauuaaaguacugaacccuuauaugccaucugugaucgaaaagauggagacauugcagcggaaguacggaggcgcucugguucgcaauccccucagcagaaacucaacccacgaaauguacuggguguccaaugccacgggcaacauagucaguagcgugaauaugauuucuaggauguuaaucaaccgauucaccaugaaacacaagaaagcaacauaugagccugacgucgaucugggguccggaacucggaauaucgguauugagucagaaauaccaaaccuugacaucauuggcaagcguaucgagaaaauuaagcaggaacaugagaccagcuggcacuacgaucaagaccaucccuauaagacaugggccuaccacgggucguaugaaacuaaacagaccggaucugcuaguuccauggugaauggcguuguaagacugcuaacaaagccgugggauguggucccuauggugacccagauggcgaugacugacacgacacccuuuggucagcaacgcguuuucaaagagaagguggauaccaggacucaggagccaaaagaagggaccaagaagcucaugaaaaucacagccgaguggcuguggaaggaauugggcaaaaagaaaacgccucggauguguaccagagaggaguuuacucgcaaggucaggagcaacgcagcucugggcgccauauucacagacgaaaacaaauggaagucagcacgagaggccguggaagauucccgguuuugggagcucguagacaaggaaagaaaucuucaccuggagggcaaaugcgagaccuguguguacaacaugauggggaagagggagaaaaaguuaggagaguucgguaaagcuaagggcucucgcgccaucugguauauguggcugggggcgagauuuuuggaguucgaggcacucggauuucugaaugaagaucauugguucagccgggagaacagucuauccggcguugagggugaagggcuucacaagcugggauacauucucagagacgucagcaaaaaggagggcggcgccauguacgcugacgauacugccgggugggacacaaggaucacccuggaagauuugaaaaaugaggaaauggugacaaaccauauggagggagagcacaagaaacuggcagaagcuauuuuuaagcucacuuaucagaauaaggugguccgcguucagcgacccaccccacgggguacggugauggacaucauuucuagaagggaucaacgcggcucagggcagguaggaaccuacggccuuaacacauucacuaauauggaggcccagcugauaagacaaauggaaggugaggggaucuucaaaaguauucagcauuuaaccgugacagaggaaaucgcuguccagaacuggcuggcccgggugggaagggagcguuugucccgaauggcaaucagcggcgacgauugcguugugaagccccucgacgaucgcuuugcgucugcccugacugcucuaaaugacaugggcaaagucagaaaggauauucagcaaugggaaccuucgcggggguggaacgacuggacccaggugccauucugcucacaccacuuucaugagcuuauaaugaaagauggaaggguacugguugugccgugucgcaaucaggacgaacucaucgguagagcccggauuagccagggcgcaggguggucccugaaggagacggcuugcuugggaaagaguuaugcccaaauguggucuuuaauguacuuccacaggcgagaccugcgucucgcagccaacgcgaucuguagcgcuguccccucccauugggugccuacaucaagaaccacuuggaguauucacgccaaacacgaguggaugacaaccgaagauaugcuuacuguguggaaucgcgucuggauccaggagaacccauggauggaagacaagacccccguugagucuugggaagaggugccuuaucugggcaaacgggaggaucaguggugcgguagccuaauagggcugacauccagggcaacgugggccaagaacauccagaccgcuauuaaucaaguaagaucacucaucggaaacgaagaguacacugacuauaugccaagcaugaaacgcuuucggagggaagaggaagaggccggcguguugugguga

SEQ ID NO: 14935 - RNA, 9876 nt, Artificial Sequence
  derived and/or modified CDS sequence (opt3) from DENV-2__FM210227__SS-prME
accgccggagugaucauuaugcugauaccaacugcuauggcauuccaccucacuacgaggaacggggagccucauaugaucgucggaaggcaggaaaaggguaaaagccuucuguuuaagaccgaggacggcguuaauaugugcacauugauggccauugauuuaggggaacugugugaggacacuaucaccuacaaaugcccauuacuccggcaaaacgaaccggaggauauugacuguuggugcaauuccacaucuaccugggugacuuauggaacauguaccacgacuggcgagcaccgccgagaaaagcguucagucgcgcuggugccccaugucgguauggggcuugagacccggacagaaacuuggaugaguagcgagggagcuuggaaacacgcccagaggaucgagaccuggauacugcggcauccuggcuucacaaucauggcagccauuuuggcuuacaccaucggcacgacucacuuucagcgcgcacucauuuucauccugcugacagccguggcuccauccaugaccaugagaugcauagggauuucuaacagggauuuuguugaaggagugucggguggcucaugggucgacaucgugcucgagcacgggagcuguguaacuacaauggccaagaauaagcccaccuuagauuucgaacugauuaaaacggaggcgaagcagccugcaacccuucggaaauauugcaucgaagccaaguugacaaacacuaccacagagagucgcuguccaacucaaggagagcccucccugaaugaggaacaggacaaacgauuuguuugcaagcauucuaugguggauagaggcugggguaacggguguggacuguucggcaagggcgggaucguaaccugcgcuauguuuacaugcaaaaagaauauggaaggaaaaauugugcagccugagaaccucgaauacaccauagugaucacuccacacagcggugaggagcaugccgucggcaaugacacggggaagcacggaaaagaaauuaagaucacaccgcaguccucaguuaccgaggcagaacugacuggcuaugguaccgugacaauggaguguagucccaggaccgggcuugauuucaacgaaaugguacuguugcaaauggaggacaaggcuuggcucgugcaccggcagugguuucuggauuuaccucugccauggcuccccggcgccgacacucagggaagcaauuggauacagaaggagacacuugucacguucaagaacccucaugcgaaaaagcaagacgugguugugcugggcucucaggaaggggccaugcacaccgcauugacuggagcuacagagauucagauguccucagguaaucuacuguuuaccggccaucucaaaugccgucugcgcauggauaaacuucaacugaaagggaugagcuacaguauguguacaggaaaguucaagaucgucaaagaaaucgccgagacucagcacggcaccauugugaucagaguacaguaugagggugacgggucuccaugcaagauucccuucgaaauaauggauuuggagaaaaggcauguucucggccggcugaucacggugaacccgauugucaccgaaaaggacuccccugugaacaucgaggcugaacccccauuuggagauagcuacaucauuauaggcgucgagccugggcaguuaaaacugaauugguucaagaagggaucgucuaucggucaaauguuugagacaacuaugcgaggcgccaaacgcauggcaauucuaggggacaccgccugggauuucggaucccucggcgguguguuuacaucaaucgggaaggcucugcaccagguuuucggcgcgauuuacggagcagccuuuaguggcgugagcuggacuaugaaaauccuuauaggggcuaucauuaccuggaucggaaugaacuccagaucuacgagcuugucaguaagucugguccucgugggcguuauuacacuguaucuuggugccauggugcaggcagacuccgggugugucgugagcuggaagaauaaagaacugaagugcggaucuggcaucuucauaaccgauaacguacacacuuggacagagcaguacaaguuucaacccgaaucaccaaguaaauuggccagcgcuauucagaaggcccaugaggaagguaucuguggcauuagguccgugacccggcucgagaaucugauguggaaacagaucacucccgaguuaaaccacauacugucugaaaaugagguuaagcuaaccaucaugacaggggacauuaaaggaaucaugcaggcaggcaagcgcucgcucagaccucaaccaacggaacugaaauauagcuggaagaccugggggaaggcgaaaaugcuuuccacugagucacauaaccagacauucuugauugauggaccggaaaccgcugagugccccaauacaaacagggccuggaauagucuggaggucgaagacuacggcuuugguguguucacuaccaacaucuggcucaagcugcgugagaaacaggacguguuuugugauucuaaguuaaugagcgcagccauaaaagacaaucgggcuguccacgccgauaugggguauuggauugaauccacgcugaacgacacauggaagauggagaaggcaucauucaucgagguuaaaagcugccacuggccuaagucucauacccuuugguccaauggaguguuggaaagugagaugaucauuccaaagagcuucgcuggccccgugucucagcacaacuaccgaccugguuaucauacucaaaccgccggcccauggcaccucgggaagcuggaaauggauuuugacuucugugagggaacaacuguagucgugaccgaagauugcggcaacagagggcccucccuaaggacaacgaccgcgucaggaaaacugaucacugaguggugcugucgcaguugcacacucccgccucugcgguacagaggcgaggacgguuguugguacgggauggaaauuaggccacuuaaggagaaggaagagaauuugguuaacagccuggugaccgccggacauggccagauagauaauuuuucguuagguguccucggcauggcucuguuccuugaagagaugcugcgcacucgaguggggacaaaacacgcaaucuugcucguugccguguccuuuguaacccugauuacgggaaacaugucuuuccgggaccuaggccgugucauggugauggugggggcuacuaugaccgaugacaucggaaugggcgucacauaucuggcccuccuggcagcguuuaagguuagacccaccuucgccgcuggucuuuugcugaggaaauuaacuagcaaggagcucaugauggccacaauugggaucgcacugcuuucacagaguaccauaccugaaacaauccuggagcuaacugaugcucucgcccugggaaugaugauuuugaaaaucgugcgcaauauggaaaaguaccaacuggcaguaaccauuauggccaucuccugcgugcccaacgcugucauauuacagaaugcguggaaggugucuuguacgauucucgccgcaguuagcguguccccacugcuucugacaucaagccagcagaaagcugacuggaucccuuuggcccucaccaucaagggccugaaccccacugccauuuuucuaaccacacugagucggacuucuaaaaagagauccuggccacuuaaugaggcuauaauggcagucggcauggugagcauccucgccucgucacuguugaaaaacgacauuccgaugaccgggccucugguugcgggagguuuacucacggugugcuauguccugacaggcaggucugcugaucuugaacuggagcgagccaccgacguaaagugggaggaucaagcagaaaucaguggguccagccccauuuugucuaucacuauaagcgaggacggauccaugucaaucaaaaaugaagaggaggaacagacacucaccauucugauccgcacuggccuacuggugauuaguggucuuuucccaguuagcauccccauaacagccgcugcaugguaccucugggaggugaagaagcagcgggccgggguccugugggaugugccuucuccacccccuguaggaaaagcggaauuggaggacggcgcuuauagaauuaagcagaaaggcaucuuaggguacucccaaaucggagccgguguguauaaggaaggcaccuuucacacgauguggcaugucacuagaggggcaguucugaugcaccguggaaaacgcauugagccgucaugggccgaugugaagaaggaccucaucaguuacggcgguggguggaaacuggagggagaauggaaggagggcgaagaggugcagguccuugcucuggaaccaggcaaaaacccccgggccgugcagaccaagccuggguuguucaaaacaaauaccggaacaauaggugcaguuagccuagauuuuuccccaggcacuucugggucgcccauuguagacagaaagggaaagguggucggccuguacgguaacggggugguuaccaggagcggagcuuaugugucagccaucgcgcagacggagaaauccauugaggauaauccugaaaucgaggacgauauauuccgaaagaaacggcucacaauuauggaccugcauccgggcgccggcaagacuaaacgcuaccuucccgcaaucgucagagaagcuaucaagaggggguuacggacccugauucucgccccaacacgagugguagcugcagagauggaagaggccuugagaggacugccuauccgcuaucaaacccccgccauuagggcugagcacacuggucgugaaauagucgaccucaugugucaugcgaccuucacaaugcggcugcuuaguccagugagaguuccuaacuacaaccugaucauuauggaugaggcacacuuuacggaccccgccucuaucgcugccaggggcuauaucagcacucgcguggaaaugggggaggcagccggaauuuucaugaccgcuacaccaccgggcucccgagauccuuuuccccagucaaaugcgccaauaauggacgaggaaagagagauccccgaacggucuuggaacuucggucacgagugggucaccgauuuuaaggggaaaacugugugguucguuccuagcauuaaggccggaaaugacaucgcagcuugcuugaggaaaaacggcaagaaagugauucagcuaagucgcaagacauuugauuccgaauacgucaagacccguacgaaugacugggauuucgugguaacuacagacaucagcgagaugggcgccaacuuuaaagcagagagagugauagauccacggagguguaugaagcccguuauccugaccgacggggaagaacgcgucauucucgccggaccuaugccggugacccauucuucagcugcccaacgaagaggucggaucggcaggaaucccaaaaacgaaaaugaccaguauauuuacaugggggagcccuuagaaaacgaugaggacugcgcgcacuggaaggaggcaaaaaugcugcuugauaauaucaacacuccugaaggaauaauucccuccauguucgagccagaacgcgagaagguggacgccaucgauggcgaauacagacugaggggugaggcucggaaaacauuugucgaccucaugcgucgcggggauuugccuguauggcuggccuaucgaguggcugcagagggcauuaauuacgccgacagaaggugguguuucgauggaguuaagaacaaucagauccucgaagagaacguggaagucgagauauggaccaaggagggcgaacggaaaaagcugaaaccccgcuggcuugacgcuagaaucuauagugauccacuagcccugaaggaguucaaagaauuugcagcggggaggaaaagccuaacauuaaaccugauuacugagaugggacggcucccuacguucaugacccagaaggcccgagacgcucuggauaaucuugccgugcugcauacagcagaagcugguggcagagccuacaaccacgcacucucggaguugccggagacucuggaaacccuacugcuccuuacacuguuagccaccguuacugggggaaucuuuuuguuccugaugucuggcaaagguguggggaagaugacgcucggcaugugcugcauuaucaccgcuuccauacugcuuugguaugcgcaaauucagccccacuggaucgccgcaagcaucauucuggaguuuuuccucaucgucuugcugauaccagaaccugagaaacagcgcacaccccaggacaaucaauuaacuuacgugguaauugcuauccuaaccgugguugccgccacaauggcaaacgaaaugggauuucuggagaagaccaaaaaggaccucggccuugggucagucgcuacucaggagccagaaaguaauauucuggauaucgacuugaggccugccucugcguggacacuguaugcuguggccacgaccuucgugacucccaugcuccggcauuccauagagaacagcucagucaauguuagucugacagcaaucgccaaccaggcuaccgugcuuaugggacucgguaagggcuggccgcugagcaaaauggauauugggguaccauugcuggcaaucggauguuacucccaggugaauccuauuaccuuaacagccgcgcuacugcuccuugucgcucacuacgccaucauuggccccggucugcaagcaaaggccacucgugaagcucagaaaagagccgcagcugggaucaugaagaacccaacgguggacggcauaaccguuauugauuuggaccccaucccuuaugauccgaaauuugagaagcagcugggacaggugaugcuccugauccuuugcgucacacaaguauuaaugaugaggacuaccugggcccugugugaagcgcucacauuggccaccggccccauuucuacucugugggaggggaauccaggacgcuucuggaacacgacaauagcagugagcauggcuaauaucuuucggggcuccuaccuagccggugcagggcuacucuucucaauuaugaagaacaccacuaauacccgaagaggaacaggcaacaucggugagacucuuggcgaaaaauggaagucuaggcugaaugcuuuggggaaaagugaguuucagauuuauaagaaaucgggaauccaggaaguugaccgcacccuggccaaggagggcauaaaaagaggggagacagaucaucacgccgugagcagaggauccgcgaagcuccguugguucgucgaaaggaacauggugacgccugagggcaaggucguggaccuggguugcgggcggggaggcuggucuuacuauugugguggcuugaaaaacguucgcgaagugaaggggcuuaccaaaggaggccccgggcaugaggaaccuaucccaaugucaacuuacggauggaaucugguacgacuccaaagcggcguggaugucuucuuuacacccccugagaagugcgacacccuacugugugauauuggugaguccaguccaaaccccacuaucgaagcugggagaacauugaggguucugucucucguggagaauuggcuuaacaaugacacccaguucugcauuaaaguccugaacccguauaugccuagcgugaucgaaaagauggagacguugcagcggaaguacggaggcgcacugguacgcaauccacucucaagaaacuccacccacgaaauguacugggugaguaaugccacaggcaacauaguuagcucugugaauaugauuuccaggauguuaaucaaccgauuuacuaugaaacacaagaaagcuaccuaugagcccgacgucgaucuggggucaggaacacggaauaucgguauugagagcgaaauaccuaaccuugacaucauuggcaagcguaucgagaaaauuaagcaggaacaugagacuucguggcacuacgaucaagaccauccauauaagaccugggccuaccacgggucuuaugaaacaaaacagaccggaagugcauccagcauggugaauggcgucgugagacugcuaacuaagcccugggauguuguaccgauggugacgcagauggccaugacagacaccacuccuuucggucagcaacgcgucuuuaaagagaagguggauaccaggacacaggagcccaaagaagggacgaagaagcucaugaaaaucaccgcugaguggcuguggaaggaauugggcaaaaagaaaacuccacggauguguacaagagaggaguucacccgcaagguuaggucaaacgcggcccugggcgcaauauuuacugacgaaaacaaauggaaguccgcucgagaggccguggaagauucucgguucugggagcucgucgacaaggaaagaaaucuucaccuggagggcaaaugcgagacauguguguacaacaugauggggaagagggagaaaaaguuaggagaguuugguaaagcaaagggcagccgcgccaucugguauauguggcugggggcucguuucuuggaauuugaggcccucggauuccugaaugaagaucauugguuuagucgggagaacucccuaagcggcguagagggugaagggcuucacaagcugggauacauucucagagacgugucuaaaaaggagggcggcgcgauguacgcagacgauaccgccgggugggacacaaggaucacucuggaagauuugaaaaaugaggaaaugguuaccaaccauaugggaggugagcacaagcgccuggcugaggccauuuucaaacucacguaucagaauaaggucgugcgagugcagcggccuacccccagaggcacagucauggacaucauuucaaggcgcgaucaaagagggaguggacagguuggcacuuacggucuuaacaccuucacaaauauggaagcacagcugauacggcaaauggagggggaaggaaucuuuaaguccauucagcauuuaacugugaccgaggagaucgcuguacagaacuggcuggccagggugggccgugaacgauugagccgcauggcuaucucuggcgacgauugcgucgugaaaccacucgacgauagauucgccucggcacugacggcgcuaaaugacauggggaagguucggaaagauauucagcaaugggagcccucaaagggauggaacgacuggacacaggugccuuuuugcagccaccacuuccaugaucuuauaaugaaagacgguaggguccuggugguaccaugucgcaaucaggacgaacucaucggcagagcccggauuucccagggggcuggauggagucugaaggagaccgccugcuugggcaagucuuaugcacaaauguggagcuuaauguacuuucacaggcgagaucugcgucucgcugccaacgcaaucuguuccgccguuccgucacauugggugcccacaaguagaacaaccuggucuauucacgcgaaacacgaauggaugacuaccgaggacaugcuuacagucuggaaucgcguguggauccaggagaacccuuggauggaagauaagacgccaguggagagcugggaagagguccccuaucuggguaaacgggaagaccaguggugcgggucccuaauaggacugaccucaagggcuacuugggccaagaacauccagacagcaauuaaucaaguuagaagccucaucggcaacgaggaguacaccgauuauaugccuucuaugaaacgcuuccggagggaagaggaagaggccggcguguugugguga

SEQ ID NO: 14936 - RNA, 9876 nt, Artificial Sequence
  derived and/or modified CDS sequence (opt3) from DENV-2__FM210204__SS-prME
accgcaggagugaucauuaugcugauacccaccgcuauggcauuccaccucacuacgagaaacggggaaccucauaugaucgucgggaggcaggaaaaggguaaaagccuucuguuuaagaccgaggacggcguuaauaugugcacauugauggccauugauuuaggggaacugugugaggacacuaucaccuacaaaugcccacuucuccggcaaaacgaaccggaggauauugacuguuggugcaauuccacaucuaccugggugacuuauggaacauguaccacgacuggcgagcaccgccgagaaaagcguucagucgcgcuggugccccaugucgguauggggcuugagaccagaacagaaacuuggaugaguagcgagggagcuuggaaacacgcccagaggaucgagaccuggauacugcggcauccuggcuucacaaucauggcagccauuuuggcuuacaccaucggcacgacucacuuucagcgcgcacucauuuucauccugcugacagccguggcuccauccaugaccaugagaugcauagggauuucuaacagggauuuuguugaaggagugucggguggcucaugggucgacaucgugcucgagcacgggagcuguguaacuacaauggccaagaauaagcccaccuuagauuucgaacugauuaaaacggaggcgaagcagccugcaacccuucggaaauauugcaucgaagccaaguugacaaacacuaccacagagagucgcuguccaacucaaggagagcccucccugaaugaagaacaggacaaacgauuuguuugcaagcauucuaugguggauagaggcugggguaacggguguggacuauucggcaagggcgggaucguaaccugcgcuauguuuacaugcaaaaagaauauggaaggaaaaauugugcagccugagaaccucgaauacaccauagugaucacuccacacagcggugaggagcaugccgucggcaaugacacggggaagcacggaaaagaaauuaagaucacaccgcaguccucaguuaccgaggcagaacugacuggcuaugguaccgugacaauggaguguagucccaggaccgggcuugauuucaacgaaaugguacuguugcaaauggaggacaaggcuuggcucgugcaccggcagugguuucuggauuuaccucugccauggcuccccggcgccgacacucagggaagcaauuggauacagaaggagacacuugucacguucaagaacccucaugcgaaaaagcaagacgugguugugcugggcucucaggaaggggccaugcacaccgcauugacuggagcuacagagauucagauguccucagguaaucuacuguuuaccggccaucucaaaugccgucugcgcauggauaaacuucaacugaaagggaugagcuacaguauguguacaggaaaguucaagaucgucaaagaaaucgccgagacucagcacggcaccauugugaucagaguacaguaugagggugacgggucuccaugcaagauucccuucgaaauaauggauuuggagaaaaggcauguucucggccggcugaucacggugaacccgauugucaccgaaaaggacuccccugugaacaucgaggcugaacccccauuuggagauagcuacaucauuauaggcgucgagccugggcaguuaaaacugaauugguucaagaagggaucgucuaucggucaaauguuugagacaacuaugcgaggcgccaaacgcauggcaauucuaggggacaccgccugggauuucggaucccucggcgguguguuuacaucaaucgggaaggcucugcaccagguuuucggcgcgauuuacggagcagccuuuaguggcgugagcuggacuaugaaaauccuuauaggggcuaucauuaccuggaucggaaugaacuccagaucuacgagcuugucaguaagucugguccucgugggcguuauuacacuguaucuuggugccauggugcaggcagacuccgggugugucgugagcuggaagaauaaagaacugaagugcggaucuggcaucuucauaaccgauaacguacacacuuggacagagcaguacaaguuucaacccgaaucaccaaguaaauuggccagcgcuauucagaaggccuaugaggaagguaucuguggcauuagguccgugacccggcucgagaaucugauguggaaacagaucacucccgaguuaaaccauauacugucugaaaaugagguuaagcuaaccaucaugacaggggacauuaaaggaaucaugcaggcaggcaagcgcucgcucagaccucaaccaacggaacugaaauacagcuggaagaccugggggaaggcgaaaaugcuuuccacugagucacacaaccagacauucuugauugauggacuggaaaccgcugagugcccgaauacaaacagggccuggaauagucucgaggucgaagacuauggcuuugguguguucacuaccaacaucuggcugaaguuacgugagaaacaggacguguuuugugauucuaagcugaugagcgcagccauaaaagacaaucgggcuguccaugccgauaugggguacuggauugaauccgcacuuaacgacacguggaagauggagaaggcuucauucaucgagguuaaaagcugccacuggcccaagucucacacauugugguccaauggagugcucgaaagugagaugaucauuccuaaguccuucgccggcccagugucucagcauaacuaucgacccgguuaccacacccaaacugcgggcccuuggcaucuggggaagcuagaaauggauuuugacuucugugagggaaccacaguagucgugacugaagauugcggcaacagagggccaucccugaggaccacaacggccucaggaaaacucaucaccgaguggugcugucgcaguugcacucugcccccgcuucgguacagaggcgaggacgguuguugguaugggauggaaauuaggccuuugaaggagaaggaagagaaucugguuaacagcuuagugacagcuggacacggccagauagauaauuuuucgcucgguguccugggcauggcacuuuuccuggaagagauguugcgcacccgaguggggacuaaacaugccauccuccugguugcuguguccuuuguaacacuaauuaccggaaacaugucuuucaaggaccugggccgggucauggugauggugggggccacgaugacugaugacaucggaaugggcgucaccuaccucgcacugcuugcggccuuuaaaguucguccaacauucgcugccgguuugcuguuaagaaagcucaccagcaaagagcugaugauggcaacuauugggaucgcacuucugucacagaguacaauacccgaaaccauccuagagcucacagaugcccuggcauugggaaugauggugcugaagauuguaaggaauauggaaaaguaucaauuagccgugacuaucauggcuauuuccugcgucccuaacgcggugauccuccagaaugccuggaaaguuucuuguaccauacuggcagcugugagcgucagcccccuucuguugacgucaagccagcagaaggccgacuggauuccacucgcccugacaaucaaaggccuaaacccuaccgcuaucuuucugacuacccuuagucgcacaucuaagaaacgguccuggccccucaaugaggcaauuauggccgugggcaugguuagcauacuggcgucgucauugcugaagaacgacaucccaaugacugggccguuaguggcuggaggucuccugaccgucugcuacguacuuacgggcagaucugccgaucuggaauuggagagggcaacagacgugaaaugggaggaucaagccgaaauuaguggguccagcccuauccucucuauuaccaucagcgaggacggauccaugucaauaaagaaugaagaggaggaacagacucugacaauccuaauucgaaccggccugcuuguuaucaguggucucuuccccgugagcauuccaaucacugcugcagccugguaucugugggaggucaagaaacagcgcgcggggguguugugggauguacccucuccuccacccgugggaaaggcugaauuagaggacggcgccuaccggauaaaacagaagggcauucugggguauucccaaaucggagccggugucuacaaagaaggcacauuucacaccauguggcacguuacgagaggggcagugcucaugcauaggggaaagcguaucgagccuucaugggcugaugugaagaaagaccugauuaguuacggcgguggguggaaacuugagggagaauggaaagagggcgaagagguccaggugcuggccuuggaaccgggcaagaacccacgcgcaguucagacuaaacccgggcuauucaagaccaauacaggaaccaucggugcuguaagccuggauuuuuccccuggcacaucugggucgccaauaguggaccggaagggaaaagucgugggccucuaugguaacgggguugugacuagaagcggagccuacgucucagcgauugcccagaccgagaaguccaucgaggauaaucccgaaauugaggacgauaucuucaggaaaaagcgacugacgauaauggaccuucacccuggcgcaggcaaaacaaagcgguauuuaccggcuauugugcgcgaagccaucaagagagggcugaggacucucaucuuggcucccacccggguagucgcagccgagauggaagaggcccugcgaggacucccaauuagauaccaaaccccugcuauccgcgcggagcauacagguagggaaauuguggaccugaugugucacgcaacuuucaccaugcgucuucugagucccguucgggugccaaacuauaacuugauaaucauggaugaggcccauuuuacagacccugcuucuauugccgcaagaggcuacaucagcacgagggucgaaaugggggaggccgcuggaaucuucaugacugcgacacccccaggcucccgcgauccguuuccucagucaaaugcccccauuauggacgaggaacgagagauaccagaaagaucuuggaacagcggucacgagugggugacagauuucaaagggaagaccguuugguuugugcccaguaucaaagcaggaaaugacauugcugccugccuacggaagaacggcaaaaaggucauccagcuguccaggaagacuuucgauagcgaauaugugaaaacacgcaccaaugacugggauuuuguagugacgacugacauuucugagaugggcgcaaacuucaaggccgagcguguuaucgauccuagacgguguaugaaaccagucauacucacagacggggaagagagggugaucuuagcuggacccaugccugugacccacucauccgccgcgcaacgccgagguagaauuggccggaauccgaagaacgaaaaugaccaguacaucuacaugggggagccacuggaaaacgaugaggacugcgcacauuggaaagaggccaagaugcuucuggauaauauuaacacccccgaaggaaucauaccuaguauguuugagcccgaaagggagaaagucgacgcuauugauggcgaauaucgccucagaggugaggccaggaagacuuucguagacuugaugcggcguggggaucugccaguguggcucgcuuaccgcguugcagccgagggcaucaauuaugcugaccgaagaugguguuuugauggagugaagaacaaucagauucuggaagagaacgucgaaguggagaucuggacaaaagagggcgaaaggaagaaacuuaagccucgguggcuagacgcccgcauauacagcgauccccuggcauugaaagaguucaaggaguucgcggccgggagaaagucguuaacccugaaccucaucacagagaugggaaggcugccaacuuuuaugacgcagaaagcucgggacgcccuugauaaucuggcaguucuccacaccgcugaagccgguggccgagcauauaaccaugccuugucugagcugccugagacacuagaaacucugcuccuucugaccuuauuggcuacagugaccgggggaauuuuccuguuucucauguccggcaagggugucgggaaaaugacucugggcaugugcugcaucauuacggcgagcauccuucugugguacgcccaaauacagccgcacuggauugcagcuucaaucauccucgaguucuuuuugauugugcuguuaauccccgaaccagagaagcagagaaccccucaggacaaucaacuaacauauguagugauagccauucugacuguugucgccgcaaccauggcuaacgaaaugggauuccucgagaaaacaaagaaggaccuuggccuggggaguguggccacccaggagcccgaaucuaauaucuuggauauugaccugcgcccagcguccgcuuggacucucuacgccguggcaacaacguuugucaccccuaugcugaggcacagcaucgagaacucaaguguuaaugugagccuuacugccauagcuaaccaggcaacaguacucaugggacuggguaaaggcuggcccuuguccaagauggauaucggggugccgcuguuagccauuggauguuacucucaggucaauccaaucacccuaaccgcggcucugcuccuucugguggcccauuaugcaauuaucggcccugguuugcaagccaaagcuacacgggaagcccagaagcgugcagcugccgggauuaugaaaaaccccacuguugacggcaucacggugauagaucuggacccaauucccuacgauccuaaguucgagaagcagcucggacaggucaugcugcuuaucuuaugcguaacccaagugcugaugaugagaacaacuugggcgcucugugaagccuugacccuggcaacaggcccgaucagcacccuaugggaggggaaucccggaagguuuuggaacacuacgauugcuguuuccauggccaauauauuccgcggcucauaucuggcuggugcugggcuccuauuuucuaucaugaaaaacacaaccaauacucggcgaggaaccggcaacauuggugagacacugggcgaaaaguggaaaaguagauugaaugcccuggggaagucggaguuccagaucuacaaaaagagcggcauucaggaaguggacaggacucucgccaaagagggcaucaagcgcggggagaccgaucaccaugcggucucccggggaucugcuaagcugagaugguuuguggaacguaacauggucacaccagagggcaaagugguugacuuagguugcgggaggggaggcuggucauauuacugugguggccuuaagaacgugcgggaaguaaaagggcugacgaagggaggcccugggcacgaggaacccauaccuaugagcaccuauggauggaaucucgugcgccuacaauccggcgucgauguuuucuucacuccacccgagaaaugcgacacacuguugugugauaucggugagaguucuccuaacccaaccauugaagcagggcgaacucugagagugcucagccuugucgagaauuggcugaacaaugacacacaguuuugcaucaagguguugaaccccuacaugccgccuguaauugaaaagauggagacccugcagaggaaauacggaggcgcccucgugcggaauccauuaucacgcaacuccacgcaugaaauguauuggguuaguaaugcuaccggcaacaucgugagcucugucaauaugauauccagaaugcugauuaacagguucacaaugaagcacaaaaaggccacuuacgagcccgacguggaucuugggucaggaacccgaaauaucgguaucgagagcgaaauuccuaaccuggacauaaucggcaaacggauugagaagaucaagcaggaacacgagacaucguggcauuaugaucaagaccacccauacaaaacuugggcauaucaugggucuuacgaaaccaagcagacaggaagugccuccagcauggucaauggcgugguucgucuacucaccaaacccugggauguagugccgauggucacucagauggcuaugacggacacaaccccuuuuggucagcaaagaguguucaaggagaaaguugauacucgcacccaggagcccaaggaagggacaaagaaacugaugaagauuacggcggagugguuguggaaagaacugggaaagaaaaagaccccaaggauguguacucgggaggaguuuacaagaaaagugcgcucaaacgccgcacucggcgcuaucuucaccgacgaaaacaaguggaaguccgccagggaggcagucgaagauucucgauuuugggagcuuguggacaaagaacggaaucugcacuuagagggcaagugcgagacuuguguauauaacaugauggggaaaagagaaaagaaacugggagaguucgguaaggccaagggcagcagggcuauaugguacaugugguugggggcccgcuuucucgaguucgaggcgcugggauuucuaaaugaagaucacugguucagucgugagaacucccuuagcggcguggagggugaagggcugcauaaacucggauacauccugcgggacguuucuaagaaagagggcggcgcaauguaugccgacgauacagcugggugggacaccagaauuacauuggaagaucugaagaaugaggaaauggucacuaaccacauggagggagagcauaaaaggcucgccgaagcaaucuuuaaacuuaccuaccagaauaagguggugcgcguccagcgaccuacgccccgggguaccguuauggacauuaucucaagaagggaucaacgcggcaguggacaggugggaacauauggccugaacacuuucaccaauauggaggcucaguuaauuagacaaauggaaggugaggggauauucaaauccauccagcaccugacaguaacugaggaaauugccgugcagaacugguuggcucgggucggaagggagcgucucagccgaauggccaucucuggcgacgauugcgugguuaagccacuggacgaucgcuuugcaucggcgcuaaccgcccuuaaugacaugggcaaagugagaaaggauauccagcaaugggaacccucaaaaggguggaacgacuggacgcaggucccuuucugcagccaucacuuucacgaucugauuaugaaggacggacgggugcucguaguuccauguaggaaucaggacgagcugauaggucgcgcuagaaucucccagggcgccggguggaguuugaaggaaacagcaugcuuaggaaaaucuuacgcucaaauguggagccugauguauuuccaucggagggaucuccgacuugccgcaaacgccauuuguuccgcggugccgucacacuggguccccaccagucguacuacauggucuauccaugcuaagcacgaguggaugaccacugaggacaugcugaccguguggaauagaguguggauucaggaaaacccuuggauggaggauaaaacaccagucgaaagcugggaggaaguucccuaccuaggcaagcgcgaggaccaguggugcgguucccugaucgggcucacgucacgggccaccugggccaagaacauacagacugccaucaaucaagugaggagcuugauuggaaacgaggaauauacagauuacaugccuucuaugaagagauuucgccgggaggaagaggaagcuggcguacugugguga

SEQ ID NO: 14937 - RNA, 9876 nt, Artificial Sequence
  derived and/or modified CDS sequence (opt3) from DENV-2__FM210230__SS-prME
accgccggagugauaauuaugcugauacccacagcuauggcauuccaccucacuacgaggaauggggagccucauaugaucgucggaaggcaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagacccggacagaaacuuggaugaguagcgagggagcuuggaaacacgcccagaggaucgagaccuggauacugcggcauccuggcuucacaaucauggcagccauuuuggcuuacaccgugggcacgacucacuuucagcgcgcacucaucuucauucugcuggccgcuguugccccauccaugacaaugagaugcaucgggauaucuaacagggauuuuguggaaggagucucggguggcucauggguggacauuguacucgagcacgggagcuguguuaccacuauggcgaagaauaagcccacauuagauuucgaacugaucaaaaccgaggcaaagcagccugccacgcuucggaaauauugcauugaagcuaaguugaccaacacaacuaccgagagucgcuguccaacacaaggagagcccucccugaaugaagaacaggacaaacgauuugugugcaagcauucuauggucgauagaggcugggguaacggguguggacuauucggcaagggcgggaucgugacuugcgccauguuuaccugcaaaaagaauauggaaggaaaaaucgugcagccugagaaccucgaauacacaauugucauaaccccacacagcggugaggagcaugcaguuggcaaugacacugggaagcacggaaaagaaaucaagauuacgccgcagucccccaucacagaggcugaacugaccggcuaugguacugugaccauggaguguucaccuaggacagggcuugauuucaacgaaaugguacuguugcaaauggaggacaaagccuggcucgugcaccggcagugguuucuggauuuaccacugcccuggcucccuggcgcggacacccagggaaguaauuggauacagaaggagacucuugucacauucaagaacccacaugccaaaaagcaagacgugguugugcugggcagccaggaaggggcaaugcacacggcuuugaccggagccacugagauucagaugucuuccgguaaucuacuguuuacaggccaucucaaaugccgucugcgcauggauaaacuucaacugaaagggaugucauacagcauguguaccggaaaguucaagaucgucaaagaaaucgcugagacacagcacggcacuauugugaucagaguacaguaugagggugacgggagucccugcaagauuccguucgaaauaauggauuuggagaaaaggcauguucucggccggcugaucaccgugaacccuauugucacggaaaaggacucucccgugaacaucgaggccgaaccaccuuuuggagauuccuacaucauuauaggcgucgagcccgggcaguuaaaacugaauugguucaagaagggaagcucgaucggucaaauguuugagaccacaaugcgaggcgcaaaacgcauggccauucuaggggacacugcuugggauuucggaucucucggcgguguguuuaccuccaucgggaaggcgcugcaccagguuuucggcgcaauuuacggagccgcuuuuucaggcgugaguuggacaaugaaaauccuuauagggguaaucauuacuuggaucggaaugaacagcagauccaccucuuugagcgucucacuggugcucguuggcgugauuacgcuguaucuuggugccaugguccaggcagacagugggugugugguauccuggaagaauaaagaacugaagugcggaagcggcaucuucauaacagauaacgugcacaccuggacugagcaguacaaguuucaaccagaaucucccucaaaauuggccagugcuauucagaaggcccaugaggaagguaucuguggcauuaggagcguuacacggcucgagaaucugauguggaaacagaucaccccugaguuaaaccacauacuguccgaaaaugaggucaagcuaacuaucaugaccggggacauuaaaggaaucaugcaggcaggcaagcgcucucucagaccacaaccgacagaacugaaauauucguggaagacgugggggaaggcgaaaaugcuuagcaccgagucccauaaccagacuuucuugauugauggacccgaaacagcugagugcccuaauaccaacagggccuggaacucacuggagguggaagacuacggcuuugguguguucacaacuaacaucuggcucaagcugcgugagaaacaggacgucuuuugugauaguaaguuaaugucugcagccauaaaagacaaucgggcuguucacgccgauaugggguauuggauugaaagcgcacugaacgacaccuggaagauggagaaggcuuccuucaucgaggugaaaucaugccacuggccaaagagccauacgcuuuggucuaauggaguguuggaauccgagaugaucauucccaaaaguuucgccggcccuguaagccagcacaacuaccgaccagguuauuacacacaaaccgcgggccccuggcaucucgggaagcuggaaauggauuuugacuucugugagggaacuaccgucgugguuacagaagauugcggcaacagagggccgucucuaaggacuaccacagccuccggaaaacugaucacggaguggugcugucgcucaugcacccucccuccacugcgguacagaggcgaggacgguuguugguaugggauggaaauuaggccccuuaaggagaaggaagagaauuuggugaacagucuggucacugcuggacacggccagauagauaauuuuagcuuaggugugcucggcauggcacuguuccuugaagagaugcugcgcacacgaguugggaccaaacaugccaucuugcucgugacuguaucguuugucacacugauuaccggaaacauguccuuccgggaccuaggccgugugauggugauggucggggcugccaugacggaugacaucggaaugggcguuacuuaccuggcacuccuggcggccuuuaaggugagaccuaccuucgcugccggucuuuugcugaggaaauuaacaucuaaggagcucaugauggcaaccauugggaucgcucugcuuagccagucaacuauacccgaaacaauccuggagcuaaccgaugcccucgcacugggaaugaugguauugaaaauugugcgcaauauggaaaaguaucaacuggccgucacaaucauggcuauuaguugcgugccaaacgcgguuaucuuacagaaugccuggaagguguccuguacuauacucgcagcugucucugugagcccuaugcugcuuaccuccucacagcagaaagccgacuggauuccccuggccuugacgaucaagggccucaacccaacagcuaucuuucugaccacucuaagccggaccaguaaaaagagaucuuggccgcugaaugaggcaauuauggccguuggcaugguguccauacuugcgagcucgcuccugaaaaacgacaucccuaugacagggcccuuggucgcuggaggucuguuaacuguaugcuacgugcucaccggcaggucagccgaucuggaacuugagcgagcaacggacguuaagugggaggaucaagccgaaauuucugggaguuccccaauccugagcauuacaaucgcugaggacggaucuaugagcaucaagaaugaagaggaggaacagaccuugacuauccucauucgcacaggccugcuagugaucuccggucuguuccccgucucaauuccuaucaccgcagccgcgugguaucuuugggaggugaagaagcagcgggcugggguacucugggaugugccaagucccccuccggucggaaaagccgaacuggaggacggcgcauacagaauaaagcagaaaggcauuuugggguauagccaaaucggagccgguguuuacaaggaaggcacuuuucacacaauguggcacgugaccagaggggcuguguuaaugcaucguggaaaacgcaucgagccaucuugggccgaugucaagaaggaccugauuuccuacggcgguggguggaaacucgagggagaauggaaggagggcgaagaggugcagguucuggcacuugaacccggcaaaaacccucgggcuguacagacgaagccagggcuguucaaaacuaauaccggaacaaucggugccgugucauuggauuuuagucccggcaccagcggguccccuauagucgacagaaagggaaaggugguuggccuauaugguaacgggguggucacaaggucuggagcguacgugucggccauugcacagacugagaaaagcaucgaggauaauccggaaauugaggacgauaucuuccgaaagaaacggcugaccauaauggaccuccaccccggcgcuggcaagacgaaacgcuaucugccagccauuguaagagaagcuaucaagagggggcuucggacauuaauccuggcaccuacucgagucguggccgccgagauggaagaggcucucagaggauugcccauucgcuaccaaaccccagcgaucagggcagagcauacaggucgugaaauuguugaccugaugugucacgccaccuucacuaugcggcuccugucaccugugagaguccccaacuauaaccuuauaaucauggaugaggcucauuuuaccgacccagccuccauugcagccaggggcuacaucaguacacgcguggaaaugggggaggcugcgggaaucuucaugacggccacuccgccuggcucucgagaucccuuuccacagagcaaugcacccauuauggacgaggaaagagagauaccugaacgguccuggaacucaggucacgaguggguuaccgauuucaaggggaaaacagugugguuugucccaucuaucaaggcuggaaaugacauugccgcaugccugaggaaaaacggcaagaaagugauccaguugagccgcaagaccuucgauagugaauauguaaagacucguacaaaugacugggauuuugugguuaccacggacauuuccgagaugggcgccaacuucaaagcugagagagucaucgauccccggagguguaugaagccugugauacuaacugacggggaagaacgcgugauccuggccggaccgaugccagucacacacagcucugcggcacaacgaagaggucggauuggcaggaaucccaaaaacgaaaaugaccaguacaucuacaugggggagccucucgaaaacgaugaggacugcgcccauuggaaggaggcuaaaauguuacuggauaauauuaacacccccgaaggaaucauaccaucaauguuugagccugaacgcgagaagguagacgccauugauggcgaauauagacuuaggggugaggcucggaaaaccuucguggaccugaugcgucgcggggaucuccccguuugguuggcauaccgaguggccgcugagggcaucaauuaugccgacagaaggugguguuuugauggagucaagaacaaucagauucuggaagagaacguggaaguugagaucuggacuaaggagggcgaacggaaaaagcucaaaccacgcuggcuggacgcaagaauauacuccgauccucuugcgcuaaaggaguucaaagaguucgccgcugggaggaagagucugacauugaacuuaaucaccgagaugggacggcugccgacauuuaugacucagaaggcccgagacgcacucgauaaucuggcugugcuucacacggccgaagcaggagguagagccuauaaccaugcucugagcgagcuccccgagaccuuggaaacacugcuacugcucacucuucuggcgaccgucacagggggaauuuucuuauuuuugaugucgggcaaagguguggggaagaugacccugggcaugugcugcaucauuacugccucuauccuccugugguacgcacaaauacagccacacuggauugcugccuccaucauccuugaguucuuucugauuguacucuugaucccugaacccgagaaacagcgcacgccacaggacaaucaacugaccuaugugguuauagccauuuuaacagucguggcagcuacuauggccaacgaaaugggauuccuagagaagaccaaaaaggaccugggccucgggagcaucgcgacacaggagccugaaucaaauauucuugauaucgaccugaggcccgcuagugccuggaccuuguacgcaguggccacuacauuugucacgccgaugcugcggcacucuauagagaacuccagcguuaaugugucacucaccgcuaucgcaaaccaggccacuguacugaugggacuugguaagggcuggccacucaguaaaauggauauuggggugccucuguuggcgaucggauguuacagccaggucaaucccauuacacugaccgcugccuuacuacugcucguggcacauuaugccaucauuggcccaggucuucaagcuaaggccacccgugaagcacagaaaagagcugccgcggggaucaugaagaaccccacaguugacggcgugacugucauagaucuggacccuauuccguacgaucccaaauucgagaagcaguugggacagguaaugcugcucauccugugcgugacgcaaguucuuaugaugaggaccacaugggccuuaugugaagcacugacucucgcuaccggcccaaucuccacauugugggaggggaauccuggacgcuuuuggaacaccacuauugccgugucuauggcaaauauauuccggggcagcuaucuggcuggugccgggcuacuguuuuccaucaugaagaacacgacaaauacccgaagaggaacuggcaacauuggugagacccucggcgaaaaauggaagucaaggcuuaaugcccuggggaaaucugaguuccagaucuacaagaaaaguggcauucaggaagucgaccgcacauuggcgaaggagggcaucaaaagaggggaaacugaucaccaugcugugucgagaggaagcgcaaagcugcguugguuugucgaaaggaacauggugacccccgagggcaagguuguggaccucgguugcgggcggggaggcugguccuauuacugugguggccugaaagauguacgcgaagugaagggguuaacaaaaggaggcccugggcacgaggaaccaauacccaugucuacguauggauggaaccuuguccgacugcaaucaggcguugacguguucuucaccccuccagagaagugcgauacucuccuaugugacaucggugagagcucccccaauccgacaauugaagccgggagaacccugagggucuugagucugguggagaacuggcucaauaacgacacucaguuuugcaucaaaguacuuaauccuuacaugccaucugugauugaaaagauggagacacugcagcggaaguacggaggcgcuuugguucgcaacccccugagcagaaauucaacccaugaaauguauuggguguccaacgccacgggcaauaucgucaguagcgugaacaugauaucuaggaugcucauuaaucgauucaccaugaaacacaagaaagcaacauacgagccugaugucgacuuaggguccggaacucggaacaucgguaucgagucagaaauuccaaaucuggauauaaucggcaagcguauugagaaaaucaagcaggaacacgagaccagcuggcauuaugaccaagaucaccccuacaagacaugggccuaucaugggucguacgaaacuaaacagaccggaucugcuaguuccauggugaacggcguuguaagacuucugacaaagccgugggacguggucccuauggugacccagauggcgaugacugauacgacacccuuuggucagcaacgcguuuucaaagagaagguggacaccaggacucaggagccaaaagaagggaccaagaagcuaaugaaaauuacagccgaguggcucuggaaggaacugggcaagaagaaaacgccucggaucuguaccagagaggaguuuacucgcaaggucaggagcaaugcagcuuugggcgccauauucacagaugaaaacaaauggaagucagcacgagaggccguggaagacucccgguuuugggagcugguagauaaggaaagaaaccuccaccuugagggcaaaugcgagaccuguguguauaauaugauggggaagagggagaaaaagcugggagaguucgguaaagcuaagggcucucgcgccaucugguacaugugguuaggggcgcguuuucuggaguucgaggcauugggauuucucaacgaagaccacugguucagccgggagaauagucuguccggcguugagggugaagggcuacauaaacuuggauacauucugagagacgucagcaaaaagggcggcggggccauguaugcugaugacacugccggaugggauacaaggaucacccucgaggaccugaaaaacgaagagauggugacaaaucacauggaaggugagcauaagaaauuggcagaggcuauuuuuaagcugacuuaccagaacaaggugguccgcguucagcgacccaccccacggggcacggugauggauaucauuucuagaagggaccaacgcgggucaggacagguaggcaccuauggucucaauacauucacuaacauggaagcccagcuuauaagacaaauggagggggaaggaguguucaaaaguauccagcggcugaccgucacagaggagauugcugugcagaauugguuagccaggguuggccgugaacgacugucccgcauggcaaucagcggcgaugacugcguggucaagcccuuggaugacagauuugcgucugcccucacugcucugaacgauauggggaaagugcggaaggacauccagcaaugggagccuucgaggggauggaaugauuggacccagguaccauucugcucacaccauuuucacgaacuaauuaugaaagacggucgcguucuuguggucccguguagaaaccaggacgagcugauaggccgggccaggaucagccagggggcaggauggucccucaaggaaacggcuugccugggcaagaguuacgcccaaauguggucuuugauguauuuccaccgacgugauuuaagacuggcagccaaugcgauuuguagcgcugugcccucccauugggugccuacaucacgcaccacuuggaguauccacgccaaacaugaguggaugacaaccgaggacaugcucacugucuggaaccggguuuggauucaggaaaauccauggauggaggauaagacccccguggaaucuugggaggaaguaccuuaccuugguaaaagggaggaccaguggugcgggagccugaucggacuaacauccagagcaacgugggccaagaacauacagaccgcuaucaaccaagugcgcucacugauuggcaaugaggaauauacugauuacaugccaagcaugaaacgguuuaggcgagaggaagaggaagccggcguccucugguga

SEQ ID NO: 14938 - RNA, 9876 nt, Artificial Sequence
  derived and/or modified CDS sequence (opt3) from DENV-2__KC762665__SS-prME
accgcaggaaucauuauaaugaugauccccaccgugauggcuuuccaccugacuacgcgaaacggggagccucauaugauugucagcaggcaggaaaagggaaaaucccuccuuuuuaagaccgagaaugguguuaacaugugcacccugauggcaauggacuugggcgaauuaugugaggauacuaucaccuacaauugcccacugcuacggcaaaacgaaccggaggacauugauuguuggugcaauucuacaucaaccugggugacuuaugggacauguaccgccacgggagagcaccgccgagaaaaacguaguguagcgcucgugccccaugucggcaugggucuggagacuagaaccgaaacauggaugagcuccgagggggcuuggaagcacgcccagaggaucgagacuugggugcuucggcauccuggauucaccauaauggcagccauccuggcuuacacaauuggcaccacguauuuucagcgcguuuugaucuucauucuccugacugcagugacaccaucuaugaccaugcggugcaucggcauaucgaacagggacuuugucgaaggggugucaggagguagcuggguagauauuguucuggagcacggcaguugugugacuacaauggccaaaaauaagcccacccucgacuucgaauuaaucaagacggaggcuaaacacccugccacccugcggaaguacugcauugaagcgaaacuuacaaacacuaccacagcaucccgcuguccaacucagggggagcccucuuugaaugaggaacaagauaagcgauuugucugcaaacauagcaugguggacagaggauggggcaacgguugugggcuguucggaaagggcggcaucgugaccugcgccauguuuacaugcaagaaaaauauggaggggaagaucguccagccugaaaaccuagaguauaccauuguuauaacuccacacuccggagaagagaaugcuguggguaacgauacgggcaaacaugggaaggagaucaaaguaacaccgcagucaaguauuaccgaagccgagcucacuggauacggcaccgugacaauggaauguagccccaggaccggucuggacuucaaugagaugguccuucugcagauggaaaacaaggcaugguuggugcaccggcaaugguuucucgaucugccuuuaccauggcugcccggggcugacacucagggcucuaacuggauccagaaagagacacucguuacguucaagaauccucacgccaagaaacaggauguggucgugcuuggaucccaagagggcgcgaugcauaccgcccugacuggggcaacagaaauacagaugucaagcggaaacuugcuauuuaccggucaccugaagugccgucuccgcauggacaaacugcagcuuaagggcaugaguuauucuauguguacagggaaauucaagguaguuaaggagauugcugaaacucaacauggaaccaucgugaucagaguccaguacgagggcgacgguuccccaugcaaaauucccuucgagaucauggaucuggaaaagaggcacguguuggggcggcucauuacggucaauccgauagugaccgagaaagacagcccuguuaacaucgaagccgagcccccauuuggcgauucguacauuaucaucggaguggaaccuggccagcugaaguuaucuugguucaaaaagggguccucaauuggacagauguuugagacaacuaugcgaggugcuaagcgcauggccauacugggcgacaccgcaugggauuucgggagucuaggaggcguauuuacaagcaucgguaaagcccuccaucaagucuucggggcuauuuauggcgcggcauuuuccggagugucuuggacuaugaagauccugauuggcguugugaucaccuggauagggaugaauagcagaucaacgagucuuuccgucagcuuggugcugguaggagugguuacacucuaccugggcgucauggugcaggccgacucugguuguguggucucauggaaaaacaaggagcuuaaaugcgggaguggaaucuucauuaccgauaauguucacacuuggacagaacaguauaaguuucagcccgagagcccauccaagcuggcuucugccauccaaaaagcacacgaagagggcauuugugguaucaggucggugacccgguuggaaaaccucauguggaagcagauaacucccgagcugaaucauauuuuaagcgagaacgaagugaaacugaccaucaugacaggcgacauuaaggggaucaugcaggccggaaaacgcucccuaagaccucagccaacggagcucaaguacucauggaaaaccuggggcaaggcuaagaugcugaguacugaacuucacaaucauacauucuugauagaugggccggagaccgccgaaugccccaacgcaaauagggcguggaacucucuggagguagaggacuauggauuuggcgucuucacaacuaauaucuggcucaaacugaaggaacgucaagaugcuuuuugugacagcaaauuaauguccgccgcaauuaaggacaaccgggccgugcacgcugauauggguuacuggaucgagucagcccugaacgacaccuggaaaauugaaaaggccagcuucaucgagguuaagucuugccacuggccuaaaucccauacgcuuuggaguaaugggguguuggagagcgaaaugauaauuccaaagaacuucgcuggacccgucucucagcacaauuaucgaccuggcuaccauacacagaccgccgguccauggcaccucggcagacuggagauggauuuugacuucugugaagggacuaccgugguugugacagaggauugcggaaacaggggccccucccuacgcacuaccacagcgucagggaaacugaucacggaauggugcugucggaguugcacccucccgccucugagauacaggggagaggacggcuguugguaugguauggagauccgcccacuuaaggaaaaagaggaaaauuugguaaacagccuggucacugccgggcauggacagauugauaauuuuucguuaggcgugcucgguauggcucuguuccuugaggaaaugcugcgaacacgggugggcaccaagcacgcaaucuugcucgucgccguuuccuuugugacucugauuacagggaacaugucuuuccgugaccuaggaagaguaauggugauggucggcgcuaccaugacggaugacauagggaugggagugacuuaccuggcccuccuggcagcguuuaagguuaggcccaccuucgccgcuggccuuuugcugcgcaaauuaacaagcaaggagcucaugaugaccacuaucgguauuacacugcuuucacaaaguaccaucccugagacaauucuggaacuaacugaugcccucgcacuggggaugaugguguugaaaaucguccggaauauggagaaguaucagcuggcugugaccauaauggccaucuuaugcguucccaacgcagugauucuccagaaugccuggaaagucuccuguacgacacuggcuguagugucuguuagcccacuucuguugaccuccucacaacagaaggcggacuggaucccucucgcccugacuauuaagggacuaaaccccaccgcaaucuuucugacaacucuuagcagaaccaguaaaaagaggucuuggccacucaaugaagcuauaauggccgugggcauggucuccauucuggccagcucguugcugaaaaacgauaucccgaugacgggcccuuuaguggcugggggacuccugacaguaugcuacgugcuuaccggucgaucagcagaccuggaguuggaacgcgccgcggacguccggugggaggagcaggcugaaaucucuggcaguucccccauucucagcauaacuaucucugaggaugggagcauguccauuaagaaugaagaggaggaacagacacugaccauccuaauuagaacuggacugcuuguuaucucaggccucuucccagugaguauacccaucacagccgcagccugguaucugugggaggugaaaaagcaaagggcuggugucuugugggacgugccuagcccacccccuguugggaaagcagaauuagaggauggagccuaccguauuaagcagaagggcauccugggcuauucucagauuggggcgggaguauacaaagaagguaccuuucacacgauguggcaugugacucgcggcgcuguccucaugcacaaggggaaacggaucgagccguccugggccgacgugaagaaagaucugauaucauacggaggcgguuggaaacuugagggggaauggaaggagggagaagagguucaggugcuggcauuggaaccaggcaaaaaccccagagccguccaaaccaagccuggccuauucaaaacaaguaccgggacaauuggagcugugagccuggacuuuuccccagguacuucuggcucgcccaucguagauaagaaagggaaggucgugggacucuauggcaacgguguugugaccaggagcgggacguacgucucagccaucgcacagacagagaaguccauugaggacaauccugaaaucgaggaugacauauucagaaagaaacggcugacuauuauggaucuucauccgggagcuggcaaaaccaagcgcuauuuacccgccaucgugagagaagcgauuaaaaggggccugcggacacucaucuuggccccaacccgaguuguggcagcugagauggaagaggcccugagagggcucccuauacgcuaccagacucccgcuauuagggcagagcacaccggacgugaaaucgucgaccugaugugucaugccacauucacgaugcggcuucugaguccaaucagagugccuaacuauaauuugauuaucauggaugaggcccacuuuacugaccccgcuucuauugcggcaagggguuacauaagcacccgcguagaaaugggcgaggccgcugggaucuucaugacagccaccccaccgggaucccgagacccuuuuccccagucaaacgcaccaauuauggaugaggaaagagagauccccgaacggucuuggaauagcggccacgagugggugacugacuucaaggguaagacaguuugguuugucccuaguaucaaagccgggaacgauauugcugcgugccuaaggaagaauggcaaaaaggugauacaacugucccgcaaaaccuucgacuuugaauauaucaagacgcguacuaacgauugggacuucguggucacaaccgauauuagcgagaugggcgccaauuuuaaggcagagagaguaaucgacccacggagguguaugaaacccgugauucucaccgauggcgaagaacgcguuaucuuagcugggccuaugccggugacucauucuucagccgcacagcgaagaggacgggucgguaggaacccaaagaaugaaaacgaccaguacauauacaugggcgagccccuggaaaaugaugaggacugcgcccacuggaaagaggcuaagaugcuucuggacaacaucaauacaccugaagggauuauccccuccauguucgagccagaacgcgagaaaguggaugccauugacggagaauauagacucaggggcgaggcgcggaagaccuuuguugauuugaugcgucgcggugaccugccuguguggcucgcauaccgagucgccgcugaggggaucaacuaugccgauagaaggugguguuucgacggcgugaaaaacaaucaaauacuggaagagaacguagaaguggagauuuggacaaaggagggagaacggaagaaacuuaagccccgcuggcuagaugcuagaaucuacagugacccacuggcauugaaagaguucaaggaauuugccgcuggcaggaagucguuaacucugaaucucauuacggagauggggcggcugccuaccuucaugacacagaaggcccgaaacgcacuugauaaucuggcgguucuccauacugccgaagcuggagguagagccuauaaccacgcauugagcgagcugccggagacccuagaaacacugcuccuucugaccuuauuggcuacugucacgggcgggaucuuucuguuccucaugucuggaaagggcauagguaaaaugacccuggggaugugcugcaucauuacagccuccauccuucugugguacgcacagauucagccccacuggaucgccgcuagcauaauucucgaguuuuucuugaucgugcuguuaaucccagaaccugagaagcaacgcacuccccaggacaaucagcuaaccuauguggucauugcgauccugacaguuguggccgcaaccauggcuaacgaaaugggcuuucucgagaaaacuaagaaagauuucggacuuggcucaauaacaacgcagcaaccagagaguaauauucuggacaucgauuugaggccugccucugccuggacccuguacgcaguagcuacuacauuuauuacccccaugcuccggcauuccaucgaaaacagcucagugaaugucagucugaccgccauagcgaaccaggcuacagugcuuauggggcucggaaaggguuggccgcugagcaagauggacaucggcguuccauugcuggccauuggguguuacucccaggugaauccuaucacuuuaacggcagcccuacugcuccuugucgcucacuaugcaauuaucggacccggccugcaggccaaagcgacccgugaggcucaaaagagagccgcagccgguauuaugaaaaacccaacaguagacgggaucacugugauagauuuggaccccauuccuuacgauccgaaguucgaaaaacagcugggccagguuaugcuccuggugcuuugcgucacccagguguuaaugaugaggacaaccugggcucugugugaggcccucacuuuggcaacgggacccaucucuacacugugggaaggcaauccagggcgcuuuuggaacaccacuaucgcugucagcauggccaauauuuuccggggauccuaucuagcgggcgccggucugcucuuuucaauaaugaagaacaccgcaaacacacgaagagggacuggaaauaccggcgagacacuuggugagaaguggaaaaacaggcugaaugcuuugggcaagucugaguuccaaaucuacaaaaagagugggauucaggagguggaccgcacgcuggccaaagaaggaaucaagcggggcgagaccgaucaucacgcaguuucgagagggagcgcuaaacuccguugguucguggagaggaaccugguagccccugaaggaaagguggucgacuuaggcugcgguagagggggaugguccuauuacuguggcggucuuaagaauguuaaagaggugaagggccugacuaaagggggacccggccaugaagaaccuauuccaaugucuacauauggguggaaccucguccgccuacagucaggaguggauguauuuuucacacccccugaaaagugcgacacucuguugugugauaucggcgagagcuccccaaaucccacaguggaggccggucgaacccugagaguucucaaccuuguggaaaauuggcugaacaauaacacgcaauuuugcauaaaagucuugaauccguacaugccuagugugaucgagaagauggaagcgcugcagaggaaguacgggggagcucucguccggaacccauuaucucgcaauagcacccacgagauguauugggugucaaacgcauccggcaacauuguuaguagcguaaauaugaucucuagaaugcugauuaacagguucacaaugcgacacaaaaaggccacuuacgaacccgacguggaucuuggcuccgggacccggaauaucggaauagagucagagacaccuaaccuggacauuaucgguaaacguaucgaaaagauuaaacaggagcaugaaacuagcuggcacuaugaucaggaccauccauacaagaccugggcuuaucacggcucguacgagacaaagcaaaccgggucugccaguuccauggucaauggagugguuagacuacucacuaaacccugggacgugauaccgauggucacgcagauggcaaugacagauaccacuccuuuuggccagcagcgcguguucaaggaaaaaguagacaccaggacacaagagcccaaggaggguacgaaaaagcugaugaagaucaccgccgaaugguuguggaaagagcuggggaagaaaaagacuccacggauguguacaagagaagaguuuacccgcaaagugaggagcaacgcugcgcucggagccauuuucacugaugagaauaaguggaaaucagcacgagaagcuguugaggacuccggcuuuugggaacuugucgauaaggagcggaaccugcacuuagaaggcaagugcgagacauguguguauaauaugauggggaaaagagagaagaaacugggagaguucgguaaggccaaaggcucuagggcaaucugguacaugugguugggggcccgcuuucucgaguucgaagcucugggauuucuaaacgaggaccauugguucagccgugaaaauagucuuuccggcguggagggugaggggcugcacaagcucggauacauucugcgggaugucagcaagaaagaaggcggcgccauguaugcggacgauaccgcagggugggacacaagaaucacuuuggaggaucugaagaacgaagagaugguuaccaaucauauggaaggagagcacaaaaagcucgccgaggcuauauucaaacuuacguaccagaacaaggugguaagggugcagcgcccuacaccccgagguacagucauggacaucauuucucggagagaccagaggggcucagggcaagugguuacuuauggacugaauaccuuuacaaacauggaagcccaguuaauccgccagauggagggcgaagguguguucaagaguauucaacagcugacugucaccgaggagaucgcagugaaaaacugguugguaagaguugggcgggaaaggcucucccguauggcuauuagcggagaugacugcguggucaagccacuggaugaccgauuugccucugcucuaacggcccuuaaugauaugggcaaagugcgcaaggacauacagcagugggagcccucgagaggcuggaacgauuggacacaagugccuuucugcucacaucacuuucacgaacugaucaugaaagacgggcggguccucguugugccauguaggaaucaggaugagcugauuggacgcgcaagaaucagccagggugcgggcugguccuugcgggaaaccgccugcuuagggaagaguuacgcucagauguggucucugauguauuuccauaggcgagaccuccgucuugccgcaaacgcuaucuguagcgccguaccgucccacugggugcccacuucaagaacaaccuggaguauucaugcaacucacgaguggaugaccacagaggauaugcugacggucuggaaucgcguguggauacaagaaaacccuuggauggaggacaagaccccaguugaaucuugggaggaaauccccuaccuaggaaaacgggaggaucaguggugcggcagccugauuggucucacuuccagggccacaugggcgaagaauauccagaccgcuauuaaccaggugagaucauugaucgggaaugaggaauauacugacuacaugccuagcaugaaacgcuuucggagggaggaagaggaagccggaguccugugguga

SEQ ID NO: 14939 - RNA, 9876 nt, Artificial Sequence
  derived and/or modified CDS sequence (opt3) from DENV-2__KC762669__SS-prME
accgccggcaucauuauaauggugauccccacagucauggcuuuccaccugacuacgagaaacggggagccucauaugauuguuagcaggcaggaaaagggaaaaucccuccuuuuuaagaccgagaauggugugaacaugugcacacugauggcaauggacuugggcgaauuaugugaggauacuaucaccuacaauugcccacugcuacggcaaaacgaaccggaggacauugauuguuggugcaauucuacaucaaccuggguaacuuaugggacauguaccgccacgggagagcaccgccgagaaaaacguaguguggcgcucgucccccaugugggcaugggucuggagacuagaaccgaaacauggaugagcuccgagggggcuuggaagcacgcccagaggaucgagacuuggguucuucggcauccuggauucaccauaauggcagccauccuggcuuacacaauuggcaccacguauuuucagcgcguguugaucuucauucuccugacugcagucgccccaucuaugacaaugagaugcaucggcauaucgaacagggacuuuguggaagggguaucaggagguagcuggguugauauugugcuggagcacggcaguugugucaccacuauggcuaaaaauaagcccacacucgacuucgaauuaaucaagaccgaggccaaacacccugcgacgcugcggaaguacugcauugaagcaaaacuuaccaacacaacuaccgccucccgcuguccaacacagggggagcccucuuugaaugaggaacaagauaagcgauuugugugcaaacauagcaugguggacagaggauggggcaacgguugugggcuguucggaaagggcggcaucgucacuugcgcuauguuuaccugcaagaaaaauauggaggggaagaucguucagccugaaaaccuagaguauacaauugugauaaccccacacuccggagaagagaaugccguagguaacgauacuggcaaacaugggaaggagaucaaagugacgccgcagucaaguauuacagaagcagagcucaccggauacggcacugucaccauggaauguagccccaggacaggucuggacuucaaugagauggugcuucugcagauggaaaacaaggcuugguugguucaccggcaaugguuucucgaucugccuuuaccauggcugcccggggccgacacccagggcucuaacuggauccagaaagagacucucgugacauucaagaauccucacgcgaagaaacaggaugucgugguacuuggaucccaagagggcgccaugcauacggcacugaccggggcuacugaaauacagaugucaagcggaaacuugcuauuuacaggucaccugaagugccgucuccgcauggacaaacugcagcuuaagggcaugaguuauucuauguguaccgggaaauucaagguugugaaggagauugccgaaacacaacauggaacuaucgucaucagagugcaguacgagggcgacgguuccccaugcaaaauucccuucgagaucauggaucuggaaaagaggcacgucuuggggcggcucauuaccgugaauccgauaguuacggagaaagacagcccugugaacaucgaagcugagcccccauuuggcgauucguacauuaucaucggaguagaaccuggccagcugaaguuaucuugguucaaaaagggguccucaauuggacagauguuugagaccacaaugcgaggugccaagcgcauggcaauacugggcgacacugccugggauuucgggagucuaggaggcgucuuuaccagcaucgguaaagcucuccaucaaguguucggggcgauuuauggcgcagccuuuuccggaguuucuuggacaaugaagauccugauuggcguggucaucacuuggauagggaugaauagcagaucaaccagucuuuccgugagcuugguacuggugggaguugucacgcucuaccugggcgugauggugcaggcugacucugguugugucguuucauggaaaaacaaggagcuuaaaugcgggaguggaaucuucauuacagauaaugugcacaccuggacugaacaguauaaguuucagcccgagagcccauccaagcuggccucugcaauccaaaaagcccacgaagagggcauuugugguaucaggucggugacacgguuggaaaaccucauguggaagcagauaacccccgagcugaaucauauuuuaagcgagaacgaaguaaaacugacuaucaugaccggcgacauuaaggggaucaugcaggcuggaaaacgcucccuaagaccucagccaacagagcucaaguacucauggaaagccuggggcaaggcaaagaugcugaguacggaacuucacaaucauaccuucuugauagaugggccggagacugcggaaugccccaacacaaauagggcuuggaacucucuggaggucgaggacuauggauuuggcguguucaccacaaauaucuggcucaaacugaaggaacgucaagauguuuuuugugacagcaaauuaauguccgccgcaauuaaggacaaccgggccgugcacgcugauauggguuacuggaucgagucagcccugaacgacacuuggaaaauugaaaaggcaagcuucaucgaggucaagucuugccacuggccuaaaucccauacccuuuggaguaaugggguguuggagagcgaaaugauaauuccaaagaacuucgcuggacccguuucucagcacaauuaucgaccuggcuaccauacgcagacagccgguccauggcaccucggcagacuggagauggauuuugacuucugugaagggaccacugugguagucaccgaggauugcggaaacaggggccccucccuacgcacaacuaccgcgucagggaaacugaucacagaauggugcugucggaguugcacgcucccgccucugagauacaggggagaggacggcuguugguaugguauggagauccgcccacuuaaggaaaaagaggaaaauuuggugaacagccuggugaccgccgggcauggacagauugauaauuuuucguuaggcguccucgguauggcucuguuccuugaggaaaugcugcgaacucggguuggcacaaagcacgcaaucuugcucguggccguauccuuugugacccugauuacugggaacaugucuuuccgugaccuaggaagagucauggugaugguuggcgcuacaaugaccgaugacauagggaugggagugacguaccuggcccuccuggcagcguuuaaggucaggcccacuuucgccgcuggccuuuugcugcgcaaauuaaccagcaaggagcucaugaugacaaccaucgguauugugcugcuuucacaaaguacuaucccugagacaauucuggaacuaaccgaugcccucgcacuggggaugaugguuuugaaaaucgugcggaauauggagaaguaucagcuggcugucacaauaauggccaucuuaugcguacccaacgcagugauucuccagaaugccuggaaaguuuccuguacuacccuggcuguggucucugugagcccacuucuguugacguccucacaacagaaggcggacuggaucccucucgcccugacaauuaagggacuaaaccccaccgcaaucuuucugacuacccuuagcagaacaaguaaaaagaggucuuggccacucaaugaagcuauaauggccguaggcaugguguccauucuggccagcucguugcugaaaaacgauaucccgaugacuggcccuuuagucgcugggggacuccugaccguuugcuacgugcuuacgggucgaucagcagaccuggaguuggaacgcgccgcggacgugcggugggaggagcaggcugaaaucucuggcaguucccccauucucagcauaacaaucucugaggaugggagcauguccauuaagaaugaagaggaggaacagacccugacuauccuaauuagaacaggacugcuugucaucucaggccucuucccagugaguauacccaucaccgccgcagccugguaucugugggagguuaaaaagcaaagggcugguguauugugggacgugccuagcccacccccugucgggaaagcagaauuagaggauggagccuaccguauuaagcagaagggcauccugggcuauucucagauuggggcgggaguguacaaagaagguacuuuucacacaauguggcauguuacccgcggcgcugugcucaugcacaaggggaaacggaucgagccguccugggccgacgucaagaaagaucugauaucauacggaggcgguuggaagcuugagggggaauggaaggagggagaagaggugcagguacuggcauuggaaccaggcaaaaaccccagagccguccaaacgaagccuggccuauucaaaacuaacaccgggauuaucggagcugugagucuggacuuuagcccagguacauccggcucucccaucguugauaagaaagggaagguggucggacucuauggcaauggugugguuaccaggucggggacauacgugagcgccauugcacagacugagaagucaaucgaggacaacccugaaauagaggaugacauuuuccgaaaaaagcggcugaccaucauggaucuucauccgggagcuggcaaaacgaagcgcuauuuacccgccauugucagagaagcgaucaaaaggggccugcggacacucauauuggccccaacucgagugguagcagcugagauggaagaggcccugagagggcucccuauucgcuaccagacccccgcuaucagggcagagcacacaggacgugaaaucguggaccugaugugucaugccaccuucacuaugcggcuucuguccccaauuagaguuccuaauuauaacuugaucauuauggaugaggcccacuuuaccgaccccgcuaguauagcggcaagggguuacaucucuacacgcgucgaaaugggcgaggccgcugggauuuucaugacggccacuccaccgggaagccgagacccuuuuccccaguccaaugcaccaaucauggaugaggaaagagagauccccgaacggucauggaacucuggccacgagugggugaccgacuucaaggguaagacagugugguuugucccuagcauuaaagccgggaaugauauagcugcgugccuaaggaagaacggaaaaaagguaauccaacugagucgcaaaaccuucgacuuugaauauauuaagacucguacaaaugauugggacuucgugguuaccacggauaucuccgagaugggcgccaacuuuaaggcagagagagugauugacccacggagguguaugaaacccgucauccucacugauggcgaagagcgcgugauauuagcugggccuaugccgguuacacauagcucugccgcacagcgaagaggacggguggguaggaauccaaagaacgaaaaugaccaguacaucuacaugggcgagccccuggaaaacgaugaggacugcgcccacuggaaagaggcuaagaugcuucuggacaauauuaacaccccugaagggaucauucccucaauguucgagccagaacgcgagaaagucgaugccaucgacggagaauauagacucaggggcgaggcgcggaagaccuuuguggauuugaugcgucgcggugaccugccuguauggcucgcauaccgaguggccgcugaggggauaaacuaugccgauagaaggugguguuucgacggcguuaaaaauaaccaaauucuggaagagaaugucgaaguggagaucuggacuaaggagggagaacggaagaaacuuaagccccgcuggcuagaugcuagaauuuacuccgacccacuggcauugaaagaguucaaggaauuugccgcuggcaggaaaaguuuaacacugaaccucaucaccgagauggggcggcugccuacauucaugacucagaaggcccgaaaugcacuugauaaccuggcggugcuccauacggccgaagcuggagguagagccuauaaucacgcauugagcgagcugccggagacccuagaaacacugcuccuucugacuuuauuggcuaccgucacaggcgggauauuucuguuccucaugucgggaaagggcaucgguaaaaugacccuggggaugugcugcauuaucacugccucuauucuucugugguacgcacagauccagccccacuggauagccgcuuccauuauccucgaguuuuucuugaucguucuguuaauuccagaaccugagaagcaacgcacgccccaggacaaccagcuaaccuaugugguaaucgcgauacugacaguggucgccgcaacuauggcuaaugaaaugggcuuucucgagaaaaccaagaaagauuucggacuuggcagcauuacaacccagcaacuggagucaaacaucuuggacauugaucugaggccagccagugccuggacucucuacgcaguggcuacaacguuuaucaccccuaugcugcggcauucuauagaaaauuccagcguuaacgugucacuuacugccaucgcgaaucaggcuacaguccucauggggcugggaaaggguuggcccuugaguaagauggacauuggcguaccgcuguuagccaucggguguuacagccaggugaacccaauuacccuaaccgcagcccugcuccuucugguugcucacuaugcaaucauuggaccuggcuugcaggccaaagcgacacgugaggcucaaaagagagccgcagccgguaucaugaaaaaucccacuguggacgggauaacggucauugaucuggacccaauccccuacgauccuaaguucgaaaaacagcucggccaggugaugcugcuugucuuaugcgugacccagguucugaugaugaggacaacuugggcucucugugaggccuugacccuggcaacaggaccgaucuccacccuaugggaaggcaaccccgggcgcuuuuggaauacuacgauugcugugucuauggccaacauauuccggggaagcuaucuggcgggcgccggucuccuuuuuuccaucaugaagaacacagcaaauacccgaagagggacuggaaacaccggcgagacacugggugagaaguggaaaaauagguugaacgcucugggcaagucagaauuccaaauuuacaaaaagucugggauccaggagguagaccgcacucucgccaaagaaggaauuaagcggggcgagaccgaucaucacgcagugaguagagggucggcuaaacugcguugguucgucgagaggaauuuaguuacaccagaaggaaagguggucgaccuuggcugcggucgggggggauggagcuauuacuguggcggucugaagaacgugaaagagguaaagggccucacgaaagggggaccuggccaugaagagcccaucccuauguccaccuauggguggaaucuagugcgccugcagucuggaguugauguguuuuucacuccacccgaaaagugcgacacauugcugugugauauaggcgagucaagcccuaacccaaccgucgaggccggucgaacucucagagugcuuaaucuggucgaaaacugguugaauaacaauacacaauuuugcaucaaagugcugaaccccuacaugccguccguuauugagaagauggaagcccuccagaggaaguacgggggagcguuaguacggaauccucugagucgcaacucuacccacgagauguauugggugagcaacgcuucaggcaauaucgucuccagugugaacaugauuagcagaaugcuuaucaauagguucacgaugcgacacaaaaaggcaaccuacgaaccagacguugaucugggcucugggacacggaacauaggaauugaguccgagacucccaaucuagacaucaucgguaaacguauugaaaagauaaaacaggagcaugaaaccucauggcacuaugaucaggaccauccuuacaagacaugggccuaucacggcagcuacgagacuaagcaaaccgggucggcuucuaguauggugaacggagucgugagacuccugacaaaaccaugggacguaauccccauggugacccagauggccaugacugauacgacaccguuuggccagcagcgcguuuucaaggaaaaagucgacaccaggacucaagagccuaaggaggguaccaaaaaguugaugaagauuacagcagaauggcuguggaaagagcucgggaagaaaaagacgccccggauguguaccagagaagaguuuacucgcaaagugagguccaaugccgcucuuggagcgaucuucacagaugagaacaaguggaaaagcgcccgagaagcaguggaggacucaggcuuuugggaacuggucgauaaggagcggaauuuacaccuggaaggcaagugcgagaccuguguuuauaacaugauggggaaaagagagaagaaauugggagaauucgguaaggcuaaaggcuccagggccauuugguacauguggcucggggcacgcuuucuggaguucgaagcccuaggauuucuuaaugaggaccauugguucucucgugaaaacagccugaguggcguggagggugaggggcuccacaagcugggauacaucuugcgggauguauccaagaaagaaggcggcgcuauguaugccgacgauacugcggggugggacacaagaauaacccuggaggaucucaagaaugaagagauggugacaaaccauauggaaggagagcacaaaaggcuugcagaggccaucuuccgccugacuuaccagaauaaggucgugcgaguucagcggccaaccccuagagguacggugauggacauuaucagcaggcgcgaccagagaggcucugggcaagucgugaccuauggauuaaacacauuuacuaacauggaagcucagcugauucggcagauggagggcgaagguguauucaaaucaauccaacauuugaccguuacagaggagauugccgugaagaauuggcucgcaagggucgggcgugaacgacugagucgcauggcuauauccggagaugacugcguggugaagccccuagaugacagauuugccagcgcucuuacugcccugaacgauaugggcaaaguccggaaggacauccagcagugggagccaucuaggggcuggaaugauuggacccagguucccuucugcucgcaccacuuucaugaacucauuaugaaagacgggcgcgugcugguagugccuuguagaaaccaagaugaguugaucggacgggcaaggaucucacagggugcgggcuggagcuuacgagaaacggccugccuggggaaguccuacgcucagauguggagucucauguauuuccaccguagagaccuucgccuggccgcaaaugcuauuuguucugccgucccaagccauugggugccgacaucccggaccacuuggucaauacacgcaacacacgaguggaugaccacugaggauaugcuaaccguuuggaacaggguguggauccaggaaaaucccuggauggaggacaaaacaccugucgaaaguugggaggaaauuccauaccugggaaagagagaggaucaauggugcggcucucucaucgguuugacgagccgcgccaccugggcgaagaacauucagacugcuaucaaucaggugcggucccugauagggaacgaggaauauacagacuacaugcccucaaugaaaagguuucgaagagaggaagaggaagccggaguacuuugguga

SEQ ID NO: 14940 - RNA, 9876 nt, Artificial Sequence
  derived and/or modified CDS sequence (opt3) from DENV-2__KC762658__SS-prME
accgcaggaaucauuauaaugaugauccccacugugauggcuuuccaccugacuacgcgaaacggggagccucauaugauugucagcaggcaggaaaagggaaaaucccuccuuuuuaagaccgagaaugguguuaacaugugcacacugauggcaauggacuugggcgaauuaugugaggauacuaucaccuacaauugcccacuguuacggcaaaacgaaccggaggacauugauuguuggugcaauucuacaucaaccugggugacuuaugggacauguaccgcccccggagagcaccgccgagaaaaacguaguguagcgcucgugccucaugucggcaugggucuggagacgcggacugaaaccuggaugagcuccgagggggcuggaaagcacgcccagaggaucgagacaugggugcuucggcauccaggcuucacuauaauggcagccauccuggcuuacaccauuggcacaaccuauuuucagcgcguuuugaucuucauucuccugacggcagugacucccucuaugacaaugagaugcaucgggauaucgaacagggacuuugucgaaggagugucagguggcagcuggguugauauuguucuggagcacgggaguugugugaccacuauggccaaaaauaagccuacacucgacuucgaauuaaucaagaccgaggcuaaacugccagccacgcuucggaaguacugcauugaagcgaaauugaccaacacaacuaccgcaucccgcugucccacacagggagagccuucucugaaugaggaacaagauaagcgauuugucugcaaacacagcaugguggacagaggcugggguaacggguguggacuuuucggcaagggcgggaucgugacuugcgccauguuuaccugcaagaaaaauauggagggaaagaucguccagccagaaaaccucgaguauacaauuguuauaaccccgcauuccggugaagagaaugcugugggcaacgauacugggaaacacggaaaggagaucaaaguaacgccccagucaaguauuacagaagccgagcugaccggcuacgguacugugaccauggaauguagcccuaggacagggcuugacuucaaugagaugguccuguugcagauggaaaacaaggcauggcucgugcaucggcaaugguuucuggauuuaccacugcccuggcucccuggcgcugacacccagggaucuaacuggauccagaaagagacucuuguuacauucaagaauccacacgccaagaaacaggauguggucgugcugggcucccaagagggggcgaugcacacggccuugaccggagcaacugaaauacagaugucaagcgguaaccuacuguuuacaggccaucucaagugccgucugcgcauggacaaacuucagcugaaggggaugaguuauucuauguguaccggaaaauucaagguaguuaaggagauugcugaaacacaacacggcacuaucgugaucagaguccaguacgagggugacgggucccccugcaaaauuccguucgagaucauggauuuggaaaagaggcaugugcucggccggcugauuaccgucaauccuauagugacggagaaagacagccccguuaacaucgaagccgagccaccuuuuggagauucguacauuaucaucggcguggaacccgggcaguuaaagcugucuugguucaaaaagggauccucaauuggucagauguuugagaccacaaugcgaggcgcuaagcgcauggccauacuaggggacacugcaugggauuucggaagucucggcgguguauuuaccagcaucgggaaagcccugcaccaagucuucggcgcuauuuauggagcggcauuuuccggcgugucuuggacaaugaagauccuuauugggguugugaucacuuggauaggaaugaauagcagaucaaccaguuuguccgucagccuggugcucguaggcgugguuacgcuguaccuuggugucauggugcaggccgacucuggguguguggucucauggaaaaacaaggagcugaaaugcggaaguggcaucuucauuacagauaauguucauaccuggacugaacaguauaaguuucagccagagagccccuccaaguuggcuucugccauccaaaaagcacacgaagaggguauuuguggcaucaggucggugacacggcucgaaaaccugauguggaagcagauaaccccugaguuaaaucacauucugagcgagaacgaagugaaacuaacuaucaugaccggggacauuaagggaaucaugcaggccggcaaacgcucccucagaccacagccgacagagcugaaguacucauggaaaacgugggggaaggcuaagaugcuuaguaccgaauugcauaaucacacuuuccugauagauggacccgagacagccgaaugcccuaacaccaauagggcauggaacucucucgagguagaggacuauggcuuuggugucuucacaacuaauaucuggcugaaauuaaaggaacgucaagauguguuuugugacagcaaacugauguccgcggcuauuaaggacaaccgggccguucaugcagauaugggguacuggaucgagucagcccuuaacgacaccuggaaaauugaaaaggcuagcuucaucgaggugaagucuugccacuggccaaaaucccacacguuguggaguaauggaguccucgagagcgaaaugauaauucccaagaacuucgccggcccugugucucagcauaauuaucgaccagguuaccacacacagaccgcaggccccuggcaucuggggagacuagagauggauuuugacuucugugaaggaacuaccguugugguaacagaggauugcggcaacagggggccgucccugcgcacuaccacagcuucaggaaaacucaucacggaauggugcugucggaguugcacccugccuccacuuagauacaggggcgaggacgguuguugguaugggauggagauccgccccuugaaggaaaaagaggaaaaucuggucaacagcuuagugacugccggacacggccagauugauaauuuuucgcucggugugcugggcauggcgcuuuuccuggaggaaauguugcgaacacgggucgggaccaagcaugccauccuccugguugcuguguccuuuguaacucuaauuacaggaaacaugucuuuccgugaccugggcagagugauggucauggugggggcaaccaugacggaugacauaggaaugggcguuacuuaccucgcccugcuugcugccuuuaaggugaggccuaccuucgcagcggguuugcuguuacgcaaacucacaagcaaggagcugaugaugaccacuaucgggauuguccuucugucacaaaguacaauccccgagaccauucuagaacucacagaugcccuggcuuugggaaugauggugcugaaaaucguucggaauauggagaaguaucaguuagccgugacuauaauggcaauccucugcgucccaaacgcuguaauucugcagaaugccuggaaaguguccuguaccacgcuugcaguugugucugucagcccucuguugcucacauccucacaacagaaggccgacuggaucccccuggcucuaaccauuaagggccugaacccaacugcgaucuuucuuaccacacucagcagaacaagcaaaaagaggucuuggccgcugaaugaagccauaauggcagugggcaugguauccauuuuggcuagcucgcugcuaaagaacgauaucccuaugaccgggccccucguggccggaggucugcuuacggucugcuacguucugacaggccgaucagccgacuuggagcucgaacgcgcugcagacgugcggugggaggagcaggccgaaaucucugggaguuccccaauucugagcauaaccaucucugaggauggaagcauguccauuaagaaugaagaggaggaacagacucuaacaauccugauuagaaccggccuucucgugaucucaggucuguuccccgucaguauaccuaucacugcggcugccugguauuugugggaggugaaaaagcaaagggcagggguuuuaugggacguaccaagucccccuccggugggaaaagccgaacuggaggauggcgcuuaccguauuaagcagaagggcauccucggguauucucagauuggagccggugucuacaaagaaggcacauuucacaccauguggcacgugacgcgcggggccguucugaugcauaagggaaaacggaucgagccauccugggcggacgugaagaaagaucuuauaucauacggcgguggguggaagcuggagggagaauggaaggagggcgaagagguccagguguuggcucuagaacccggcaaaaacccuagagccguacaaacuaagccagggcuguucaaaaccaacacaggaaccauuggugcagucagucucgacuuuagccccggcacauccgggucuccuaucguggauaagaaaggaaagguugugggccuguaugguaauggggucgugacuaggucgggaaccuacguuagcgccaucgcucagacggagaagucaauugaggacaacccggaaaucgaggaugacauauuccggaaaaagagacuuacaauuauggauuuacaccccggcgccggcaaaacuaagcgcuaucugccagcaaucgugagagaagcuauuaaaagggggcuccggaccuugauccuggccccuacacgagucguggcggccgagauggaagaggcacucagaggacugcccauacgcuaccagaccccagcuauuagggccgagcauacuggucgugaaaucguagaccuuaugugucacgcuaccuucacaaugcggcuguuguccccuaucagagugcccaauuauaaccuaauuaucauggaugaggcacauuuuacggacccagccaguauugccgcuaggggcuacauaucuacucgcguugaaaugggggaggcggcaggaaucuucaugaccgccacaccgccuggcagccgagaccccuuuccacaguccaaugcucccauuauggaugaggaaagagagaucccugaacggucauggaacucuggucacgagugggucaccgacuucaaggggaagacugugugguuugugccaagcaucaaagccggaaaugauauugcagccugccugaggaagaacggcaaaaaggucauacaacucagucgcaaaacauucgacuuugaauauaucaagacccguacgaaugauugggacuucguagugacuacagauauuuccgagaugggcgcuaacuuuaaggcggagagaguuaucgacccccggagguguaugaaaccugugauuuuaaccgauggggaggaacgcgucauccuggccggaccgaugccagugacccacagcucugcagcucagcgaagaggucggguuggcaggaaucccaagaacgaaaaugaccaguacauauacaugggggagccucuugaaaacgaugaggacugcgcccauuggaaagaggcaaagaugcugcucgacaauaucaacacucccgaaggaauuaucccaucaauguucgagccugaacgcgagaaaguggaugccauugacggcgaauauagauugaggggugaggcucggaagacauuugucgagcugaugcgucgcggggaucuccccguguggcuggccuaccgaguagcggcagaaggcaucaacuaugccgacagaaggugguguuucgauggagugaaaaauaaccaaauacuugaggaaaauguugaggucgagauuuggaccaaggaaggcgagcggaagaaacuaaagccacgcuggcuggacgcuagaaucuacuccgauccuuuggccuuaaaagaguucaaggaguuugcugcagggaggaaaagucugacacucaaccugauuacugaaaugggacggcuuccgacguucaugacccagaaggcccgaaaugcucuggacaaccucgccguguugcacacagcagaggcggguggcagagccuauaaucaugcucugagcgagcuacccgaaacucuggagacccuccuucuguuaacauugcuggccaccgugacugggggaaucuuucucuuccugaugucgggcaaggguauagggaaaaugacgcuuggcaugugcugcaucauuaccgcaucuauccugcucugguacgcucagauucagccacacuggaucgccgcauccauaauuuuggaauuuuuccugaucgucuuacuaaucccugagcccgaaaagcaacgcacaccacaggauaaccagcugacuuauguugugauugccauccucaccguaguggcugcgacaauggccaaugagaugggauuucuugagaaaaccaagaaagacuucggccuggggagcauaacuacacagcaaccugaaucaaacauuuuggauaucgaccugaggcccgcaagugcuuggacgcucuacgccgucgccaccacuuuuauuacaccgaugcugcggcacucuaucgaaaauuccagcgugaacguuucacuuaccgcaauagcuaaucaggccaccgugcucaugggacuggguaagggcuggccauugaguaagauggauaucggggucccucuguuagcgauuggauguuacagccagguaaaccccaucacacuaacugcugcccugcuccuucugguggcacauuaugccauuaucggcccagguuugcaggcuaaagcaacgcgugaagcccaaaagagagcggcugccgggauuaugaaaaaucccaccguugacggcaucacagugauagaccuggauccuauuccguacgaccccaaguucgagaaacagcucggacaggucaugcugcuuguguuaugcgucacucaggugcugaugaugaggaccacaugggcacucugugaagccuugacccuggcuacuggcccaaucuccacgcuaugggaggggaacccuggacgcuuuuggaauacaaccaucgccguuucuauggcaaacauuuuccggggcagcuaucuggcuggugccgggcuccuauuuuccauaaugaagaacacugcgaauacccgaagaggaacaggcaacacuggugagacccugggcgaaaaguggaaaaauagguugaacgcccuggggaagucagaguuccaaaucuacaaaaagucuggcauucaggaaguggaucgcacacucgcaaaagagggcaucaagagaggggaaacggaccaccaugcuguaaguagaggaucggccaaacugcguugguucguggaaaggaauuuagucacccccgagggcaagguuguggaucuugguugcgggcggggaggcuggagcuauuacugugguggccugaagaacgucaaagaagugaaggggcucacuaaaggaggcccugggcacgaggaaccaauucccauguccacauauggauggaaucuaguacgccugcagucuggcguggacguauuuuucaccccuccagagaagugcgauacuuugcugugugacaucggugagucaagccccaacccgacaguggaagcagggcgaacccucagaguccuuaaucugguggagaacugguugaauaacaauacgcaauuuugcauaaaaguccugaacccuuacaugccauccgugaucgaaaagauggaggcucuccagaggaaguacggaggcgccuuaguucggaauccccugagucgcaacucuacccaugaaauguauuggguaagcaacgccucaggcaauauuguguccagugucaacaugaucagcagaaugcuuauuaauagguucacaaugcgacacaaaaaggcgacuuacgagccugauguggaccuggggucuggaacccggaacaucgguauagaguccgaaacaccaaaucuagauauuaucggcaaacguaucgagaagauuaaacaggaacacgagacuucauggcauuaugaccaggaucaccccuacaagaccugggcuuaucaugggagcuacgaaacaaagcaaaccggaucggcaucuaguaugguuaacggcguggucagacuccugacuaaaccgugggacgugauaccuaugguaacgcagauggccaugacagacaccacucccuuuggucagcagcgcguguucaaggagaaaguugauaccaggacacaagagccaaaggaagggacgaaaaaguugaugaagaucaccgcugaguggcuguggaaagaacucggaaagaaaaagacuccucggauguguacaagagaggaguuuacccgcaaagucagguccaaugccgcacuuggcgccauuuucacugacgaaaacaaguggaaaagcgcucgagaggcgguggaagauucaggcuuuugggagcugguggacaaggaacggaauuuacaccuggaggggaagugcgagacaugugucuauaacaugaugggaaaaagagaaaagaaauugggugaguucggcaaggccaaaggguccagggcaaucugguacauguggcucggagcucgcuuucuggaguucgaggcccuaggcuuucuuaaugaagaucacugguucucucgugagaacagccugagugguguugagggggaaggacuccauaagcugggcuacauuuugcgggacguguccaagaaagagggcggggcaauguaugccgaugacaccgcuggaugggauacaagaaucacucuggaagaccucaagaaugaggaaaugguaaccaaccacauggagggugagcauaagaaacuugccgaagcgauauucaaacugacguaccagaauaaaguggucagggugcagcgccccaccccacgaggcacaguuauggauaucauuagccggagagaccagagggggucuggacaaguggucacuuauggcuuaaacaccuuuacaaacauggaggcacagcugauccgccagauggaaggugaggggguguucaagucaauucaacaguugacuguaaccgaggaaaucgccguuaaaaauuggcucgugagagucggacgggagaggcugagucguauggcuauuuccggcgacgauugcguggugaagccccuagacgaucgauuugccagcgcacuuacggcucugaacgacaugggcaaaguccgcaaggauauacagcagugggaaccuucuagaggguggaaugacuggacacaaguuccauucugcucgcaccauuuucacgagcucaucaugaaagauggacgggugcugguagugccguguaggaaccaggacgaauugauuggucgcgccagaaucucacagggcgcuggguggagcuuacgggagaccgccugccugggaaaguccuacgcacagauguggagucucauguauuuccacaggcgagaucuucgucuggcggccaaugcuaucuguucugccguccccagccauugggugccuacuuccagaacaaccuggucaauucacgcaacucaugaguggaugaccacagaagacaugcuaacgguuuggaaccgcguguggauacaagagaauccauggauggaagauaagacccccgucgagaguugggaagagaucccuuaccugggcaaacgggaggaccaguggugcgguucucucauuggguugacuagcagggcuacaugggccaagaacauccagaccgcaauuaaucaggugagaucccugaucggaaacgaaaaauauacugauuacaugccaucaaugaagcgcuuucggagggaggaagaggaagccggcguacuuugguga

SEQ ID NO: 14941 - RNA, 9876 nt, Artificial Sequence
  derived and/or modified CDS sequence (opt3) from DENV-2__KC762660__SS-prME
accgccggaaucauuauaaugaugauccccacagugauggcuuuccaccugacuacgcgaaacggggaaccucauaugauugucagcaggcaggaaaagggaaaaucccuccuuuuuaagaccgagaaugguguuaacaugugcacacugauggcaauggacuugggcgaauuaugugaggauacuaucaccuacaauugcccacugcuacggcaaaacgaaccggaggacauugauuguuggugcaauucuacaucaaccugggugacuuaugggacauguaccgccacgggagagcaccgccgagaaaaacguaguguagcgcucgugccccaugucggcaugggucuggagacuagaaccgaaacauggaugagcuccgagggggcuuggaagcacgcccagaggaucgagacuugggugcuucggcauccuggauucaccauaauggcagccauccuggcuuacacaauuggcaccacguauuuucagcgcguuuugaucuucauucuccugacugcagugacaccaucuaugaccaugaggugcaucggcauaucgaacagggacuuugucgaaggggugucaggagguagcuggguagauauuguucuggagcacggcaguugugugacuacaauggccaaaaauaagcccacccucgacuucgaauuaaucaagacggaggcuaaacacccugccacccugcggaaguacugcauugaagcgaaacuuacaaacacuaccacagcaucccgcuguccaacucagggggagcccucuuugaaugaggaacaagauaagcgauuugucugcaaacauagcaugguggacagaggauggggcaacgguugugggcuguucggaaagggcggcaucgugaccugcgccauguuuacaugcaagaaaaauauggaggggaaggucguucagccugaaaaccuagaguauaccaucgugauuacuccacacuccggagaagagaaugcuguagguaacgauacgggcaaacaugggaaggagauaaaagugacaccgcagucaaguaucaccgaagccgagcucacuggauacggcaccgucacaauggaauguagccccaggaccggucuggacuucaaugagauggugcuucugcagauggaaaacaaggcaugguugguucaccggcaaugguuucucgaucugccuuuaccauggcugcccggggcugacacucagggcucuaacuggauucagaaagagacacucgugacguucaagaauccucacgccaagaaacaggaugucgugguacuuggaucccaagagggcgcgaugcauaccgcccugacuggggcaacagaaauccagaugucaagcggaaacuugcuauuuaccggucaccugaagugccgucuccgcauggacaaacugcagcuuaagggcaugaguuauucuauguguacagggaaauucaagguugugaaggagauagcugaaacucaacauggaaccauugucaucagagugcaguacgagggcgacgguuccccaugcaaaauccccuucgagauuauggaucuggaaaagaggcacgucuuggggcggcucaucacggugaauccgauuguuaccgagaaagacagcccugugaacauagaagccgagcccccauuuggcgauucguacaucauuaucggaguagaaccuggccagcugaaguuaucuugguucaaaaagggguccucaaucggacagauguuugagacaacuaugcgaggugcuaagcgcauggccauucugggcgacaccgcaugggauuucgggagucuaggaggcgucuuuacaagcauagguaaagcccuccaucaaguguucggggcuaucuauggcgcggcauuuuccggaguuucuuggacuaugaagauucugaucggcguggucauuaccuggaucgggaugaauagcagaucaacgagucuuuccgugagcuugguacuggugggaguugucacacucuaccugggcgugauggugcaggccgacucugguugugucguuucauggaaaaacaaggagcuuaaaugcgggaguggaauauucaucaccgauaaugugcacacuuggacagaacaguauaaguuucagcccgagagcccauccaagcuggcuucugccauucaaaaagcacacgaagagggcaucugugguauuaggucggugacccgguuggaaaaccucauguggaagcagaucacucccgagcugaaucauauauuaagcgagaacgaaguaaaacugaccauuaugacaggcgacaucaaggggauuaugcaggccggaaaacgcucccuaagaccucagccaacggagcucaaguacucauggaaaaccuggggcaaggcuaagaugcugaguacugaacuucacaaucauacauucuugaucgaugggccggagaccgccgaaugccccaacacaaauagggcauggaacucucuggaggucgaggacuauggauuuggcguguucacuaccaauauauggcucaaacugaaggaacgucaagauguauuuugugacagcaaauuaauguccgcggcuaucaaggacaaccgggccgugcacgcagauauggguuacuggauugagucagcccugaacgacacguggaaaaucgaaaaggcuagcuucauugaggucaagucuugccacuggccuaaaucccauacacuuuggaguaaugggguguuggagagcgaaaugaucauaccaaagaacuucgccggacccguuucucagcacaauuaucgaccuggcuaccauacccagacugcagguccauggcaccucggcagacuggagauggauuuugacuucugugaagggaccacagugguagucacugaggauugcggaaacaggggccccucccuacgcaccacaacggcuucagggaaacugauuaccgaauggugcugucggaguugcacucucccgccucugagauacaggggagaggacggcuguugguaugguauggagauccgcccacuuaaggaaaaagaggaaaauuuggugaacagccuggugacagccgggcauggacagaucgauaauuuuucguuaggcguccucgguauggcgcuguuccuugaggaaaugcugcgaacccggguuggcacuaagcacgccauuuugcucguggcuguauccuuugugacacugaucaccgggaacaugucuuuccgugaccuaggaagagucauggugaugguuggcgcaacgaugacugaugacauugggaugggagugaccuaccuggcccuccuggcugccuuuaaggucaggcccacauucgcagcgggccuuuugcugcgcaaauuaaccagcaaggagcucaugaugacuacaauagguaucgugcugcuuucacaaaguaccauuccugaguccauccuggaacuaacagaugcccucgcucuggggaugaugguuuugaaaauugugcggaauauggagaaguaucagcuggccgucacuaucauggcaauauuaugcguacccaacgcugugauccuccagaaugccuggaaaguuucuuguaccacgcuggcaguggucagcguguccccacuucuguugacaucaagccaacagaaggccgacuggauuccucucgcucugaccaucaagggacuaaaccccacugcgauuuuucugaccacacuuaguagaacuucuaaaaagagguccuggccacucaaugaagccaucauggcaguaggcauggugagcauacuggcuucgucauugcugaaaaacgauauuccgaugaccggcccuuuagucgccgggggacuccugacgguuugcuacgugcuuacaggucgaucugccgaccuggaguuggaacgcgcugcagacgugcggugggaggagcaggccgaaaucaguggcuccagccccauccucucuauuaccauaagcgaggauggguccaugucaaucaagaaugaagaggaggaacagacucugacaauucuaaucagaaccggacugcuugucauuaguggccucuucccagugagcauccccauaacugcggcugccugguaucugugggagguuaaaaagcaaagggccgguguuuugugggacgugccuucuccacccccugucgggaaagcagaauuagaggauggagcuuaccguaucaagcagaagggcauucugggcuauucccagaucggggcaggaguguacaaagaagguacauuucacaccauguggcauguuacgcgcggcgccgugcucaugcacaaggggaaacggauugagccgucaugggcggacgucaagaaagaucugaucaguuacggaggcgguuggaaacuugagggggaauggaaggagggagaagaggugcagguacuggcuuuggaaccaggcaaaaaccccagagccguccaaacuaagccuggccuauucaaaaccaacacagggaccauaggagcagugagccuggacuuuuccccagguacaucuggcucgcccauuguugauaagaaagggaagguggucggacucuauggcaauggugugguuacuaggagcgggaccuacgugucagccaucgcucagacggagaaguccaucgaggacaacccugaaauugaggaugacaucuucagaaagaaacggcugacaauaauggaucuucauccgggagccggcaaaacuaagcgcuauuuacccgcaauugucagagaagcuaucaaaaggggccugcggacccucauuuuggccccaacacgagugguagcggccgagauggaagaggcacugagagggcucccuauccgcuaccagacccccgcuauaagggccgagcacacuggacgugaaauuguggaccugaugugucaugcuaccuucacaaugcggcuucugaguccaaucagaguuccuaauuauaacuugaucauuauggaugaggcacacuuuaucgaccccgccucuauugccgcuagggguuacauaagcacgcgcgucgaaaugggcgaggcggcagggaucuucaugacugccaccccaccgggaucccgagacccuuuuccccagucaaaugcuccaauuauggaugaggaaagagagauccccgaacggucuuggaacagcggccacgagugggugacagacuucaaggguaagaccgugugguuugucccuaguaucaaagccgggaaugauauugcagccugccuaaggaagaacggcaagaagguaauacaacugucccgcaaaacuuucgacuuugaauauaucaagacacguaccaaugauugggacuucgugguuacgacugauauuagcgagaugggcgcuaacuuuaaggcggagagagugaucgacccacggagguguaugaaacccgucauucucacagauggcgaagaacgcgugaucuuagccgggccuaugccgguuacccauucuucagcagcucagcgaagaggacggguggguaggaauccaaagaacgaaaaugaccaguacauauacaugggcgagccccuggaaaacgaugaggacugcgcccacuggaaagaggcaaagaugcuucuggacaauaucaacaccccugaagggauuauccccuccauguucgagccagaacgcgagaaagucgaugccauugacggagaauauagacucaggggcgaggcucggaagacuuuuguggauuugaugcgucgcggugaccugccuguauggcucgccuaccgaguggcggcagaggggaucaacuaugccgauagaaggugguguuucgacggcguuaaaaauaaccaaauacuggaagagaaugucgaaguggagauuuggacaaaggagggagaacggaagaaacuuaagccccgcuggcuagaugcuagaaucuacagugacccacuggccuugaaagaguucaaggaauuugcugcaggcaggaagucguuaacccugaaccucauuacagagauggggcggcugccuacuuucaugacgcagaaggccaagaaugcucuugauaaccuggccgugcuccauaccgcagaagcgggaggucgagccuauaaucacgcuuugagcgagcugccggagacacuagaaacucugcuccuucugaccuuauuggccacagucaccggcgggaucuuucuguuccucaugucuggaaaaggcauagguaagaugacucuggggaugugcugcaucauuacggcauccauccuucugugguacgcucagauucagccccacuggaucgccgcaagcauaauucucgaguuuuucuugaucguucuguuaaucccagaaccugagaaacaaagaacaccccaggacaaccagcuaacauaugugguaauugccauccugacuguggucgcugcgaccauggccaaugaaaugggcuuucucgagaagaccaagaaggauuucggacuuggcucaauaaccacucagcaaccagagaguaacauucuggacaucgauuugcgcccugcaucugcuuggacacuguacgccguggccacgaccuuuauuacucccaugcucaggcauuccaucgaaaauagcucaguuaacgugagucugacagcaauagcuaaucaggccaccguccuuauggggcucggaaaggguuggccgcugagcaaaauggacaucggcguaccauugcuggcgauuggguguuacucccaggugaacccuaucaccuuaacagcugcccuacugcuccuuguugcacacuaugccauuaucggacccggccugcaggcuaaggcaacucgggaggcccaaaaacgugcggcugccgguauuaugaagaauccaacgguggacgggaucaccgucauagauuuggaccccauuccuuacgauccgaaauucgaaaagcagcugggccaggugaugcuccugguccuuugcgugacacagguuuuaaugaugagaacuaccugggcacugugugaggcccucacauuggcuaccggacccaucucuacucugugggaaggcaacccagggagguuuuggaauacgacaaucgccgugagcauggcaaacauuuuccgcggauccuaucuagcuggcgccggucugcucuuuucaauaaugaagaacaccgcgaauacucggcgagggaccggaaacacaggcgagacucuuggugagaaauggaagaauagacugaacgccuugggcaaaucugaguuccaaaucuacaagaaaagugggauucaggagguagacaggacccuggcaaaggaaggaaucaaacgcggcgagacagaucaucacgcugugucgcgggggagcgccaagcucagaugguucgucgagcguaaucugguuacgccugaaggaaagguggucgacuuaggcugcgguagagggggaugguccuauuacuguggcggucuuaaaaacgugaaggagguaaaaggccugaccaaagggggacccggccaugaagaaccuauuccaaugucuacuuauggguggaaucucgugcggcuacagucaggaguugauguguuuuucacacccccugaaaaaugcgacacccuguugugugauaucggcgagagcuccccaaaccccacugucgaggcaggucgcacacugcgagugcucaaucuugucgaaaacuggcugaauaacaauacccaauuuugcauaaagguguugaacccguacaugccuaguguuaucgagaagauggaagcucugcagagaaaauacgggggagcccucguaaggaauccauuaucucggaacagcacgcacgagauguauugggugucaaacgccuccggcaauauugucaguagcgugaacaugaucucucgcaugcugauuaauagauucaccaugaggcacaagaaagcgacauacgaacccgacguugaucuuggcuccgggacucgaaacaucggaauagagucagagaccccuaaucuggacauuaucgguaagcggaucgagaaaauuaagcaggagcaugaaacaagcuggcacuaugaucaggaccauccauacaagacuugggcuuaucacggcucguacgagaccaaacaaacagggucugcaaguuccauggugaacggagucgugcgucuacucaccaagcccugggacguaauaccgauggugacucagauggccaugacggauacaaccccuuuuggccagcagagaguuuucaaagaaaaggucgacacucgcacccaagagcccaaagaggguacaaagaagcugaugaaaaucacggcugaaugguuguggaaggagcuggggaaaaagaaaaccccaaggauguguacucgggaagaguuuacaagaaaggugcgcagcaaugccgcacucggagccauuuucaccgaugagaacaaauggaagucagcuagggaagcgguggaggacuccggcuuuugggaacuugucgauaaggagcgaaaucugcacuuagaaggcaaaugcgagacuuguguuuauaacaugauggggaagcgggagaaaaagcugggagaguucgguaaagccaagggcucuagagcaaucugguacaugugguugggggcuagguuucucgaguucgaagcccugggauuucuaaaugaggaccauugguucagccgcgaaaacagucuuuccggcguggagggugaggggcugcacaagcucggauacauucugcgugauguaagcaaaaaggaaggcggcgcaauguaugccgacgauacagcugggugggacacccggaucacauuggaggaucugaaaaaugaagagauggugacuaaccauauggaaggagagcacaagaaacucgccgaggcgauauucaaacuuaccuaccagaauaaggucgugagaguucagaggccuacgccccgcgguaccgugauggacaucauuucucgacgggaccagagaggcucagggcaagucgugacauauggacugaacacuuuuaccaacauggaagcacaguuaaucaggcagauggagggcgaagguguauucaaaaguauucaacagcugacaguuacugaggagaucgccgugaagaauugguugguccgcguggggagagaacggcucuccaggauggcuauuagcggagaugacugcguggucaaaccacuggaugaccguuuugccucugcacuaaccgcucuuaacgauaugggcaagguucgaaaagacauacagcagugggagcccucgcgcggcuggaaugauuggacgcaagugccuuucugcucacaucacuuucacgaacugaucaugaaggacgggagaguacucguggucccaugucggaaccaggaugagcugauuggaagggcccgcaucagccagggugcuggcugguccuugcaggaaacagccugcuuagggaagaguuacgcacaaauguggucucugauguauuuccauagacgggaccucaggcuugcggccaaugcuaucuguagcgccgugccgucccacuggguucccaccucacgaacuacauggaguauucaugcaacccacgaguggaugacuaccgaggauaugcugacaguguggaaccgugucuggauacaggaaaauccuuggauggaggacaaaacgccaguggaaucuugggaggaaauccccuaccuaggaaagagagaggaucaguggugcggcagccugauuggucucaccucccgcgcuacuugggccaaaaacauccagacagcaauuaaucaaguacggucauugaucgggaacgaggaauauaccgacuacaugccuagcaugaagagguuuagacgcgaggaagaggaagccggaguucugugguga

SEQ ID NO: 14942 - RNA, 9876 nt, Artificial Sequence
  derived and/or modified CDS sequence (opt3) from DENV-2__KC762676__SS-prME
accgccggcaucauuauaaugaugauccccacagugauggcuuuccaccugacuacgagaaacggggagccucauaugauugucagcaggcaggaaaagggaaaaucccuccuuuuuaagaccgagaaugguguuaacaugugcacacugauggcaauggacuugggcgaauuaugugaggauacuaucaccuacaauugcccacugcuacggcaaaacgaaccggaggacauugauuguuggugcaauucuacaucaaccugggugacuuaugggacauguaccgccacgggagagcaccgccgagaaaaacguaguguagcgcucgugccccaugucggcaugggucuggagacuagaaccgaaacauggaugagcuccgagggggcuuggaagcacgcccagaggaucgagacuugggugcuucggcauccuggauucaccauaauggcagccauccuggcuuacacaauuggcaccacgcacuuucagcgcguuuugaucuucauucuccugacugcaguggccccaucuaugacaaugagaugcaucggcauaucgaacagggacuuugucgaaggggugucaggagguagcuggguagauauuguucuggagcacggcaguugugugaccacuauggcuaaaaauaagcccacacucgacuucgaauuaaucaagaccgaggccaaacauccugcgacgcugcggaaguauugcauugaagcaaaacuuaccaacacaacuaccgccucccgcuguccaacacagggggagcccucuuugaaugaggaacaagauaagcgauuugucugcaaacacagcaugguggacagaggauggggcaacgguugugggcuguucggaaagggcggcaucgugacuugcgcuauguuuaccugcaagaaaaauauggaggggaagaucguccagccugaaaaccuagaguacacaauuguuauaaccccacauuccggagaagagaaugccguggguaacgauacuggcaaacacgggaaggagaucaaaguaacgccgcagucaaguauuacagaagcagagcucaccggauauggcacugugaccauggaauguagccccaggacaggucuggacuucaaugagaugguccuucugcagauggaaaacaaggcuugguuggugcaccggcaaugguuucucgaucugccuuuaccauggcugcccggggccgacacccagggcucuaacuggauccagaaagagacucucguuacauucaagaauccucaugcgaagaaacaggauguggucgugcuuggaucccaagagggcgccaugcacacggcacugaccggggcuacugaaauacagaugucaagcggaaacuugcuauuuacaggucaucugaagugccgucuccgcauggacaaacugcagcuuaagggcaugaguuacucuauguguaccgggaaauucaagguaguuaaggagauugccgaaacacaacacggaacuaucgugaucagaguccaguaugagggcgacgguuccccaugcaaaauucccuucgagaucauggaucuggaaaagaggcauguguuggggcggcucauuaccgucaauccgauagugacggagaaagacagcccuguuaacaucgaagcugagcccccauuuggcgauucguacauuaucaucggaguggaaccuggccagcugaaguuaucuugguucaaaaagggguccucaauuggacagauguuugagaccacaaugcgaggugccaagcgcauggcaauacugggcgacacugccugggauuucgggagucuaggaggcguauuuaccagcaucgguaaagcucuccaccaagucuucggggcgauuuacggcgcagccuuuuccggagugucuuggacaaugaagauccugauuggcguugugaucacuuggauagggaugaauagcagaucaaccagucuuuccgucagcuuggugcugguaggagugguuacgcucuaucugggcgucauggugcaggcugacucugguuguguggucucauggaaaaacaaggagcuuaaaugcgggaguggaaucuucauuacagauaauguucacaccuggacugaacaguacaaguuucagcccgagagcccauccaagcuggccucugcaauccaaaaagcccaugaagagggcauuugugguaucaggucggugacacgguuggaaaaccucauguggaagcagauaacccccgagcugaaucacauuuuaagcgagaacgaagugaaacugacuaucaugaccggcgacauuaaggggaucaugcaggcuggaaaacgcucccuaagaccucagccaacagagcucaaguauucauggaaaacguggggcaaggccaagaugcugaguaccgaacuucauaaucacacuuucuugauagaugggccggagacagcagaaugccccaacaccaauagggcguggaacucucuggagguagaggacuacggauuuggcgucuucacaacuaauaucuggcucaaacugaaggaacgucaagauguguauugugacagcaaauuaauguccgcugccauuaaggacaaccgggcaguucacgccgauauggguuacuggaucgagucagcucugaacgacaccuggaaaauugaaaaggccagcuuuaucgaggugaagucuugcuauuggccuaaaucccauacgcuuuggaguaauggggucuuggagagcgaaaugauaauuccaaagaacuucgcaggacccgugucucagcacaauuaccgaccuggcuaccauacacagaccgcugguccauggcaccucggcagacuggagauggauuucgacuuuugugaagggacuaccguugugguaacagaggauugcggaaacaggggccccucccuacgcacuaccacagccucagggaaacugaucacggaauggugcugucggaguugcacccucccgccucugagauauaggggagaggacggcuguugguacgguauggagauccgcccacuuaaggaaaaagaggaaaauuuggucaacagccuggugacugcggggcauggacagauugauaauuucucguuaggcgugcucgguauggcccuguuucuugaggaaaugcugcgaacacgggucggcaccaagcacgcuaucuugcucguugcaguguccuucguaacucugauuacagggaacaugucuuuucgugaccuaggaagagugauggucauggugggcgccaccaugacggaugacauagggaugggaguuacuuaucuggcucuccuggccgcauucaaggugaggcccaccuuugcggccggccuuuugcugcgcaaauuaacaagcaaggagcucaugaugaccacuaucgguauuguccugcuuucacaaaguacaaucccugagaccauucuggaacuaacagaugcucucgcccuggggaugauggcauugaaaaucgugcggaauauggagaaguaccagcuggcuguuacuauaauggccaucuuaugcgugcccaacgcagucauucuccagaaugccuggaaaguauccuguaccacgcuggcugugguuucugugagcccacuucuguugacauccucacaacagaaggcggacuggaucccucucgcccugaccauuaagggacuaaaccccacugcaaucuuccugaccacacuuagcagaacuaguaaaaagaggucuuggccacucaaugaagcuauaauggccgucggcaugguguccauucuggccagcucguugcugaaaaacgauaucccgaugaccggcccuuuaguagcugggggacuccugacggugugcuauguccuuacaggucgaucagcagaccuggaguuggaacgcgccgcggacguucggugggaggagcaggcugaaaucucuggcaguucccccauucucagcauaaccaucucugaggaugggagcauguccauuaagaaugaagaggaggaacagacucugacaauccuaauuagaaccggacugcuugugaucucaggccucuuuccagugaguauacccaucacugccgcagccugguaccugugggaggucaaaaagcaaagggcugguguguugugggacguuccuagcccacccccuguagggaaagcagaauuagaggauggagccuaucguauuaagcagaagggcauccugggcuacucucagauuggggcgggaguguacaaagaagguacauuccacaccauguggcaugucacgcgcggcgcugugcucaugcacaaggggaaacggaucgagccguccugggccgacguuaagaaagaucugauaucauauggaggcgguuggaagcuugagggggaauggaaggagggagaagaggugcagguccuggcauuggaaccaggcaaaaaccccagagccgugcaaacuaagccuggccuauuuaaaaccaacacagggaccauuggagcuguaagucuggacuucagcccagguacauccggcucucccaucgucgauaagaaagggaaggugguuggacucuacggcaaugguguggucacuaggucggggaccuaugugagcgccaucgcacagacggagaagucaauugaggacaacccugaaaucgaggaugacauauuucgaaaaaagcggcugacaauuauggaucuucauccgggagcuggcaaaacuaagcgcuacuuacccgccaucguuagagaagcgauuaaaaggggccugcggacccucaucuuggccccaacacgaguggucgcagcugagauggaagaggcccugagagggcucccuauacgcuaucagacccccgcuauuagggcagagcacacuggacgugaaaucguggaccugaugugucaugccaccuucacaaugcggcuucuguccccaaucagaguaccuaauuacaacuugauuaucauggaugaggcccacuucacggaccccgcuaguauugcggcaagggguuauauaucuacucgcguggaaaugggcgaggccgcugggaucuuuaugaccgccacaccaccgggaagccgagacccuuucccccaguccaaugcaccaauuauggaugaggaaagagagauccccgaacggucauggaacucuggccacgaguggguuaccgacuuuaaggguaagacugucugguucgugccuagcaucaaagccgggaaugauauugcugcgugccuaaggaagaacggaaaaaaggugauacaacugagucgcaaaacauuugacuucgaauacaucaagacccguacgaaugauugggacuuugucguaacuacagauauuuccgagaugggcgccaacuucaaggcagagagagugaucgacccacggagguguaugaaacccguuauucucaccgauggcgaagagcgcgugaucuuagcugggccuaugccggucacccauagcucugccgcacagcgaagaggacggguggguaggaauccaaagaacgaaaaugaccaguacauauauaugggcgagccccuggaaaacgaugaggacugcgcccacuggaaagaggcuaagaugcuucuggacaauaucaacacuccugaagggauuauccccucaauguuugagccagaacgcgagaaaguugaugccauugacggagaauacagacucaggggcgaggcgcggaagacauucguggauuugaugcgucgcggugaccugccugucuggcucgcauaucgaguggccgcugaggggaucaacuacgccgauagaaggugguguuuugacggcguaaaaaauaaccaaauacuggaagagaauguggaaguugagauuuggaccaaggagggagaacggaagaaacuuaagccccgcuggcuagaugcuagaaucuauuccgacccacuggcauugaaagaguucaaggaauucgccgcuggcaggaaaaguuuaacacugaaccucauuacugagauggggcggcugccuacguuuaugacccagaaggcccgaaaugcacuugauaaccuggcgguccuccauacagccgaagcuggagguagagccuacaaucacgcauugagcgagcugccggagacucuagaaacccugcuccuucugacauuauuggcuaccgugacuggcgggaucuuccuguuucucaugucgggaaagggcauagguaaaaugacgcuggggaugugcugcaucauuaccgccucuauccuucugugguaugcacagauucagccccacuggaucgccgcuuccauaauucucgaguucuuuuugaucgugcuguuaaucccagaaccugagaagcaacgcacaccccaggacaaccagcuaacuuacgucguuauugcgauccugaccgugguagccgcaacaauggcuaaugaaaugggcuuccucgagaaaaccaagaaagauuuuggacuuggcagcauaacuacacagcaaccagagucaaacauucuggacaucgauuugaggccugccagugccuggacgcuguacgcaguggcuaccacuuucauuacacccaugcuccggcauucuaucgaaaauuccagcgucaacgugucacugaccgccauagcgaaucaggcuaccguucuuauggggcucggaaaggguuggccgcugaguaagauggacaucggcgugagcuugcuggccauuggguguuauucccaggucaacccaaucacauuaacugcagcccuacugcuccuuguagcucacuacgcaauuaucggaccuggccugcaggccaaagcgacgcgugaggcucaaaagagagccgcagccgguauuaugaaaaaucccaccguggacgggaucacaguuauagauuuggacccaauucccuaugauccuaaguuugaaaaacagcugggccaggugaugcuccugguccuuugcgugacucaggucuuaaugaugaggaccacaugggcucugugugaggcccucaccuuggcaacuggaccgaucucuacgcugugggaaggcaaccccgggcgcuucuggaauacaaccaucgcugugagcauggccaacauuuuucggggauccuaccuagcgggcgccggucugcucuucucaauaaugaagaacacugcaaauacccgaagagggacaggaaacacuggcgagacccuuggugagaaguggaaaaauaggcugaacgcuuugggcaagucugaauuucaaaucuauaaaaagagugggauucaggagguugaccgcacacuggccaaagaaggaaucaagcggggcgagacggaucaucacgcagugucgagagggagcgcuaaacuccguugguucguagagaggaaucuggugaccccagaaggaaaggucguugacuuaggcugcggucgggggggaugguccuacuauuguggcggucuuaagaacgugaaagaggucaagggccugacuaaagggggaccuggccaugaagagcccauuccuaugucuacauacggguggaaucucgugcgccuacagucaggaguagauguguucuuuaccccacccgaaaagugcgacacucuguugugugauaucggcgagagcuccccuaacccaacaguugaggccggucgaacccugagagugcucaaucuugucgaaaacuggcugaauaacaauacgcaauucugcauaaaaguguugaaccccuacaugccgagugucaucgagaagauggaagcccugcagaggaaguaugggggagcgcucgugcggaauccuuuaucucgcaacagcacccacgagauguacuggguuucaaacgcuuccggcaauauuguaaguagcgugaacaugaucucuagaaugcugauuaauagguuuacaaugcgacacaaaaaggcaacuuaugaaccagacgucgaucuuggcuccgggacccggaacaucggaauagagucagagauucccaaucuggacaucaucgguaaacguauugaaaagauaaaacaggagcaugaaacaagcuggcacuacgaucaggaccauccuuauagaacuugggccuaccacggcucguaugagaccaagcaaacagggucugcuaguuccauggugaacggaguugugcgccuacucaccaagccaugggacgucauccccauggugacucagauggccaugacggauacaaccccguucggccagcagaggguauuuaaagaaaagguggacacucggacccaagagccuaaagaggguacaaagaaacugaugaagauuacggcagaaugguuguggaaggagcuggggaaaaagaaaacccccagaauguguacucgcgaagaguucacaaggaagguucgaagcaaugccgcucucggagcgaucuuuaccgaugagaacaaauggaagucagcccgggaagcagucgaggacuccggcuucugggaacuuguggauaaagagagaaaucugcacuuagaaggcaagugcgagacuuguguguacaacaugauggggaagagggagaaaaagcugggagaauuugguaaagcuaagggcucucgcgccauuugguacaugugguugggggcacguuuccucgaguuugaagcccugggauuccuaaaugaggaccauugguuuagccgggaaaacagucuuuccggcgucgagggugaggggcugcacaaacucggauauauccugagagauguuagcaagaaggaaggcggcgcuauguacgccgacgauacagcggggugggacaccaggauaacauuggaggaucugaaaaaugaagagauggugacuaaccauauggaaggagagcacaagaaacucgcagaggccaucuucaagcuuaccuaucagaauaaaguagugcgcguccagcgaccaacgccucgggguaccgugauggacauuaucucuagaagggaccagcgcggcucagggcaaguugugacauacggacugaacacuuucaccaacauggaagcucaguuaauuagacagauggagggcgaaggugucuuuaagaguauccaacagcugacagugacugaggagauugccguaaagaauugguugguucggguggggagggaacgucucucccgaauggcaauaagcggagaugacugcgucgugaaaccccuggaugaccgcuucgcuaacgcccuaaccgcucuuaaugauaugggcaaggugagaaaagacauccagcagugggagccaucucggggcuggaacgauuggacgcaaguccccuuuugcucgcaucacuuccacgaacugauuaugaaggacgggaggguucucgugguaccuugucgcaaucaggaugagcugaucggaagagcccggaucucacagggugcaggcuggagcuugagggaaacagcgugcuuagggaaauccuaugcccagauguggagucugauguacuuucaucgacgugaccucagacuugcugccaacgcaauuuguucugcugugccaagccacugggucccgaccucccgcacuacauggucaauacaugccacccacgaguggaugacuaccgaggauaugcugacaguguggaaucggguuuggauccaagaaaaccccuggauggaggacaagacgccuguggaaaguugggaggaaauuccauaucuaggaaagagggaggaucaguggugcggcucucugaucggucucaccagcagagcaacuugggccaaaaauauucagacagcgaucaaccagguccgcuccuugauagggaaugaggaauacaccgacuacaugcccucaaugaagcgguucaggcgagaggaagaggaagcuggagugcugugguga

SEQ ID NO: 14943 - RNA, 9876 nt, Artificial Sequence
  derived and/or modified CDS sequence (opt3) from DENV-2__KC762662__SS-prME
accgcaggaaucauuauaaugaugauccccacagugauggcuuuccaccugacuacgcgaaacggggagccucauaugauuguaagcaggcaggaaaagggaaaaucccuccuuuuuaagaccgagaaugguguuaacaugugcacacugauggcaauggacuugggcgaauuaugugaggauacuaucaccuacaauugcccacugcuacggcaaaacgaaccggaggacauugauuguuggugcaauucuacaucaaccugggugacuuaugggacauguaccgccacgggagagcaccgccgagaaaaacguaguguagcgcucgugccccaugucggcaugggucuggagacuagaaccgaaacauggaugagcuccgagggggcuuggaagcacgcccagaggaucgagacuugggugcuucggcauccuggauucaccauaauggcagccauccuggcuuacacaauuggcaccacguauuuucagcgcguuuugaucuucauucuccugacugcagugacaccaucuaugaccaugcggugcaucggcauaucgaacagggacuuugucgaaggggugucaggagguagcuggguagauauuguucuggagcacggcaguugugugacuacaauggccaaaaauaagcccacccucgacuucgaauuaaucaagacggaggcuaaacacccugccacccugcggaaguacugcauugaagcgaaacuuacaaacacuaccacagcaucccgcuguccaacucagggggagcccucuuugaaugaggaacaagauaagcgauuugucugcaaacauagcaugguggacagaggauggggcaacgguugugggcuguucggaaagggcggcaucgugaccugcgccauguuuacaugcaagaaaaauauggaggggaagaucguccagccugaaaaccuagaguauaccauuguuauaacuccacacuccggagaagagaaugcuguggguaacgauacgggcaaacaugggaaggagaucaaaguaacaccgcagucaaguauuaccgaagccgagcucacuggauacggcaccgugacaauggaauguagccccaggaccggucuggacuucaaugagaugguccuucugcagauggaaaacaaggcaugguuggugcaccggcaaugguuucucgaucugccuuuaccauggcugcccggggcugacacucagggcucuaacuggauccagaaagagacacucguuacguucaagaauccucacgccaagaaacaggauguggucgugcuuggaucccaagagggcgcgaugcauaccgcccugacuggggcaacagaaauacagaugucaagcggaaacuugcuauuuaccggucaccugaagugccgucuccgcauggacaaacugcagcuuaagggcaugaguuauucuauguguacagggaaauucaagguaguuaaggagauugcugaaacucaacauggaaccaucgugaucagaguccaguacgagggcgacgguuccccaugcaaaauucccuucgagaucauggaucuggaaaagaggcacguguuggggcggcucauuacggucaauccgauagugaccgagaaagacagcccuguuaacaucgaagccgagcccccauuuggcgauucguacauuaucaucggaguggaaccuggccagcugaaguuaucuugguucaaaaagggguccucaauuggacagauguuugagacaacuaugcgaggugcuaagcgcauggccauacugggcgacaccgcaugggauuucgggagucuaggaggcguauuuacaagcaucgguaaagcccuccaucaagucuucggggcuauuuauggcgcggcauuuuccggagugucuuggacuaugaagauccugauuggcguugugaucaccuggauagggaugaauagcagaucaacgagucuuuccgucagcuuggugcugguaggagugguuacacucuaccugggcgucauggugcaggccgacucugguuguguggucucauggaaaaacaaggagcuuaaaugcgggaguggaaucuucauuaccgauaauguucacacuuggacagaacaguauaaguuucagcccgagagcccauccaagcuggcuucugccauccaaaaagcacacgaagagggcauuugugguaucaggucggugacccgguuggaaaaccucauguggaagcagauaacucccgagcugaaucauauuuuaagcgagaacgaagugaaacugaccaucaugacaggcgacauuaaggggaucaugcaggccggaaaacgcucccuaagaccucagccaacggagcucaaguacucauggaaaaccuggggcaaggcuaagaugcugaguacugaacuucacaaucauacauucuugauagaugggccggagaccgccgaaugccccaacgcaaauagggcguggaacucucuggagguagaggacuauggauuuggcgucuucacaacuaauaucuggcucaaacugaaggaacgucaagaugcuuuuugugacagcaaauuaauguccgccgcaauuaaggacaaccgggccgugcacgcugauauggguuacuggaucgagucagcccugaacgacaccuggaaaauugaaaaggccagcuucaucgagguuaagucuugccacuggccuaaaucccauacgcuuuggaguaaugggguguuggagagcgaaaugauaauuccaaagaacuucgcuggacccgucucucagcacaauuaucgaccuggcuaccauacacagaccgccgguccauggcaccucggcagacuggagauggauuuugacuucugugaagggacuaccgugguugugacagaggauugcggaaacaggggccccucccuacgcacuaccacagcgucagggaaacugaucacggaauggugcugucggaguugcacccucccgccucugagauacaggggagaggacggcuguugguaugguauggagauccgcccacuuaaggaaaaagaggaaaauuugguaaacagccuggucacugccgggcauggacagauugauaauuuuucguuaggcgugcucgguauggcucuguuccuugaggaaaugcugcgaacacgggugggcaccaagcacgcaaucuugcucgucgccguuuccuuugugacucugauuacagggaacaugucuuuccgugaccuaggaagaguaauggugauggucggcgcuaccaugacggaugacauagggaugggagugacuuaccuggcccuccuggcagcguuuaagguuaggcccaccuucgccgcuggccuuuugcugcgcaaauuaacaagcaaggagcucaugaugaccacuaucgguauuacacugcuuucacaaaguaccaucccugagacaauucuggaacuaacugaugcccucgcacuggggaugaugguguugaaaaucguccggaauauggagaaguaucagcuggcugugaccauaauggccaucuuaugcguucccaacgcagugauucuccagaaugccuggaaagucuccuguacgacacuggcuguagugucuguuagcccacuucuguugaccuccucacaacagaaggcggacuggaucccucucgcccugacuauuaagggacuaaaccccaccgcaaucuuucugacaacucuuagcagaaccaguaaaaagaggucuuggccacucaaugaagcuauaauggccgugggcauggucuccauucuggccagcucguugcugaaaaacgauaucccgaugacgggcccuuuaguggcugggggacuccugacaguaugcuacgugcuuaccggucgaucagcagaccuggaguuggaacgcgccgcggacguccggugggaggagcaggcugaaaucucuggcaguucccccauucucagcauaacuaucucugaggaugggagcauguccauuaagaaugaagaggaggaacagacacugaccauccuaauuagaacuggacugcuuguuaucucaggccucuucccagugaguauacccaucacagccgcagccugguaucugugggaggugaaaaagcaaagggcuggugucuugugggacgugccuagcccacccccuguugggaaagcagaauuagaggauggagccuaccguauuaagcagaagggcauccugggcuauucucagauuggggcgggaguauacaaagaagguaccuuucacacgauguggcaugugacucgcggcgcuguccucaugcacaaggggaaacggaucgagccguccugggccgacgugaagaaagaucugauaucauacggaggcgguuggaaacuugagggggaauggaaggagggagaagagguucaggugcuggcauuggaaccaggcaaaaaccccagagccguccaaaccaagccuggccuauucaaaacaaguaccgggacaauuggagcugugagccuggacuuuuccccagguacuucuggcucgcccaucguagauaagaaagggaaggucgugggacucuauggcaacgguguugugaccaggagcgggacguacgucucagccaucgcacagacagagaaguccauugaggacaauccugaaaucgaggaugacauauucagaaagaaacggcugacuauuauggaucuucauccgggagcuggcaaaaccaagcgcuauuuacccgccaucgugagagaagcgauuaaaaggggccugcggacacucaucuuggccccaacccgaguuguggcagcugagauggaagaggcccugagagggcucccuauacgcuaccagacucccgcuauuagggcagagcacaccggacgugaaaucgucgaccugaugugucaugccacauucacgaugcggcuucugaguccaaucagagugccuaacuauaauuugauuaucauggaugaggcccacuuuacugaccccgcuucuauugcggcaagggguuacauaagcacccgcguagaaaugggcgaggccgcugggaucuucaugacagccaccccaccgggaucccgagacccuuuuccccagucaaacgcaccaauuauggaugaggaaagagagauccccgaacggucuuggaauagcggccacgagugggugacugacuucaaggguaagacaguuugguuugucccuaguaucaaagccgggaacgauauugcugcgugccuaaggaagaauggcaaaaaggugauacaacugucccgcaaaaccuucgacuuugaauauaucaagacgcguacuaacgauugggacuucguggucacaaccgauauuagcgagaugggcgccaauuuuaaggcagagagaguaaucgacccacggagguguaugaaacccgugauucucaccgauggcgaagaacgcguuaucuuagcugggccuaugccggugacucauucuucagccgcacagcgaagaggacgggucgguaggaacccaaagaaugaaaacgaccaguacauauacaugggcgagccccuggaaaaugaugaggacugcgcccacuggaaagaggcuaagaugcuucuggacaacaucaauacaccugaagggauuauccccuccauguucgagccagaacgcgagaaaguggaugccauugacggagaauauagacucaggggcgaggcgcggaagaccuuuguugauuugaugcgucgcggugaccugccuguguggcucgcauaccgagucgccgcugaggggaucaacuaugccgauagaaggugguguuucgacggcgugaaaaacaaucaaauacuggaagagaacguagaaguggagauuuggacaaaggagggagaacggaagaaacuuaagccccgcuggcuagaugcuagaaucuacagugacccacuggcauugaaagaguucaaggaauuugccgcuggcaggaagucguuaacucugaaucucauuacggagauggggcggcugccuaccuucaugacacagaaggcccgaaacgcacuugauaaucuggcgguucuccauacugccgaagcuggagguagagccuauaaccacgcauugagcgagcugccggagacccuagaaacacugcuccuucugaccuuauuggcuacugucacgggcgggaucuuucuguuccucaugucuggaaagggcguggguaaaaugacccuggggaugugcugcauaaucacagccuccauucuucugugguacgcacagauccagccccacuggauugccgcuagcaucauacucgaguuuuucuugauugugcuguuaaucccagaaccugagaagcaacgcacuccccaggacaaucagcuaaccuaugucguuaucgcgauucugacagugguagccgcaaccauggcuaacgaaaugggcuuucucgagaaaacuaagaaagauuucggacuuggcucaaucacaacgcagcaaccagagaguaauauacuggacauugauuugaggccugccucugccuggacccuguacgcaguggcuacuacauuuaucacccccaugcuccggcauuccauugaaaacagcucagucaaugugagucugaccgccaucgcgaaccaggcuacaguucuuauggggcucggaaaggguuggccgcugagcaagauggacauaggcgugccauugcuggccaucggguguuacucccaggucaauccuauuacuuuaacggcagcccuacugcuccuuguagcucacuaugcaaucauuggacccggccugcaggccaaagcgacccgugaggcucaaaagagagccgcagccgguaucaugaaaaacccaacaguggacgggauuacuguuaucgauuuggaccccauaccuuacgauccgaaguucgaaaaacagcugggccaggugaugcuccugguccuuugcgugacccaggucuuaaugaugaggacaaccugggcucugugugaggcccucacuuuggcaacgggacccauuucuacacugugggaaggcaauccagggcgcuuuuggaacaccacuaucgcugugagcauggccaauaucuuccggggauccuaucuagcgggcgccggucugcucuuuucaauuaugaagaacaccgcaaacacacgaagagggacuggaaauaccggcgagacacuuggugagaaguggaaaaacaggcugaaugcuuugggcaagucugaguuccaaauauacaaaaagagugggauccaggagguugaccgcacgcuggccaaagaaggaauuaagcggggcgagaccgaucaucacgcagugucgagagggagcgcuaaacuccguugguucguagagaggaaccuggugacuccugaaggaaaggucguugacuuaggcugcgguagagggggaugguccuauuacuguggcggucuuaagaaugugaaagaggucaagggccugacaaaagggggacccggccaugaagaaccuaucccaaugucuaccuauggguggaaccucgugcgccuacagucaggaguagauguguuuuucacucccccugaaaagugcgacacacuguugugugauauuggcgagagcuccccaaaucccaccguugaggccggucgaacgcugagagugcucaaccuugucgaaaauuggcugaacaauaacacccaauuuugcaucaaaguguugaauccguacaugccuagugucauagagaagauggaagcccugcagaggaaguacgggggagcgcucgugcggaacccauuaucucgcaauagcacacacgagauguauuggguuucaaacgcuuccggcaacaucguaaguagcgugaauaugauuucuagaaugcugaucaacagguucacuaugcgacacaaaaaggcaaccuacgaacccgacgucgaucuuggcuccgggacacggaauauuggaaucgagucagagacuccuaaccuggacauaauugguaaacguaucgaaaagaucaaacaggagcaugaaaccagcuggcacuaugaucaggaccauccauacaagacaugggccuaucacggcucguacgagaccaagcaaacugggucugcuaguuccauggugaauggaguugugagacuacucacgaaacccugggacgucauuccgauggugacacagauggccaugaccgauacuaccccuuuuggccagcagcgcguauucaaggaaaaaguggacacaaggacgcaagagcccaaggaggguaccaaaaagcugaugaagauaacugcagaaugguuguggaaagagcuggggaagaaaaagacaccacggauguguaccagagaagaguuuacucgcaaaguuaggagcaacgccgcucucggagcgaucuucacagaugagaauaaguggaaaucagcccgagaagcagucgaggacuccggcuuuugggaacuuguggauaaggagcggaaccugcacuuagaaggcaagugcgagaccuguguguauaauaugauggggaaaagagagaagaaacugggagaguucgguaaggcuaaaggcucuagggccauuugguacaugugguugggggcacgcuuucucgaguucgaagcccugggauuucuaaacgaggaccauugguucagccgugaaaauagucuuuccggcgucgagggugaggggcugcacaagcucggauacauccugcgggauguuagcaagaaagaaggcggcgcuauguaugccgacgauacagcggggugggacacuagaauuaccuuggaggaucugaagaacgaagagauggugacgaaucauauggaaggagagcacaaaaagcucgcagaggccaucuucaaacuuaccuaccagaacaagguagugaggguccagcgcccuacaccccgagguacugugauggacauaaucucucggagagaccagaggggcucagggcaaguugugaccuauggacugaauacauuuacuaacauggaagcucaguuaauucgccagauggagggcgaaggugucuucaagaguauccaacagcugaccgugacggaggagauugccgucaaaaacugguugguuacaguggggagagaacggcucuccaggauggcaaucagcggagaugacugcgucgugaagccacuggaugaccguuuugcuucugcccuaaccgcucuuaaugauaugggcaaagugcgaaaggacauucagcagugggagcccucgcgcggcuggaacgauuggacucaagucccuuucugcucacaucacuuucacgaacugauaaugaaagacgggagaguucucgugguaccaugucggaaucaggaugagcugaucggaagggcccgcauuagccagggugcaggcugguccuugagagaaacagcgugcuuagggaagaguuacgcccagauguggucucugauguauuuccaucggagggaccuccgacuugcugccaacgcaaucuguagcgcugugccgucccacuggguccccaccucacguacuaccuggaguauccaugccacacacgaguggaugacgaccgaggauaugcugacuguguggaauagaguuuggauucaagaaaacccuuggauggaggacaagacaccaguggaaucuugggaggaaauacccuaccuaggaaaacgcgaggaucaguggugcggcagccugaucggucucaccucccgggcaacuugggccaagaauauucagacagcgaucaaccaggucaggucauugauugggaaugaggaauauaccgacuacaugccuagcaugaaaagauuucgccgggaggaagaggaagcuggagugcugugguga

SEQ ID NO: 14944 - RNA, 9876 nt, Artificial Sequence
  derived and/or modified CDS sequence (opt3) from DENV-2__KC762661__SS-prME
accgcaggaaucauuauaaugaugauccccacagugauggcuuuccaccugacuacgcgaaacggggagccucauaugauugucagcaggcaggaaaagggaaaaucccuccuuuuuaagaccgagaaugguguuaacaugugcacacugauggcaauggacuugggcgaauuaugugaggauacuaucaccuacaauugcccacugcuacggcaaaacgaaccggaggacauugauuguuggugcaauucuacaucaaccugggugacuuaugggacauguaccgccacgggagagcaccgccgagaaaaacguaguguagcgcucgugccccaugucggcaugggucuggagacuagaaccgaaacauggaugagcuccgagggggcuuggaagcacgcccagaggaucgagacuugggugcuucggcauccuggauucaccauaauggcagccauccuggcuuacacaauuggcaccacguauuuucagcgcguuuugaucuucauucuccugacugcagugacaccaucuaugaccaugcggugcaucggcauaucgaacagggacuuugucgaaggggugucaggagguagcuggguagauauuguucuggagcacggcaguugugugacuacaauggccaaaaauaagcccacccucgacuucgaauuaaucaagacggaggcuaaacacccugccacccugcggaaguacugcauugaagcgaaacuuacaaacacuaccacagcaucccgcuguccaacucagggggagcccucuuugaaugaggaacaagauaagcgauuugucugcaaacauagcaugguggacagaggauggggcaacgguugugggcuguucggaaagggcggcaucgugaccugcgccauguuuacaugcaagaaaaauauggaggggaagaucguccagccugaaaaccuagaguauaccauuguuauaacuccacacuccggagaagagaaugcuguggguaacgauacgggcaaacaugggaaggagaucaaaguaacaccgcagucaaguauuaccgaagccgagcucacuggauacggcaccgugacaauggaauguagccccaggaccggucuggacuucaaugagaugguccuucugcagauggaaaacaaggcaugguuggugcaccggcaaugguuucucgaucugccuuuaccauggcugcccggggcugacacucagggcucuaacuggauccagaaagagacacucguuacguucaagaauccucacgccaagaaacaggauguggucgugcuuggaucccaagagggcgcgaugcauaccgcccugacuggggcaacagaaauacagaugucaagcggaaacuugcuauuuaccggucaccugaagugccgucuccgcauggacaaacugcagcuuaagggcaugaguuauucuauguguacagggaaauucaagguaguuaaggagauugcugaaacucaacauggaaccaucgugaucagaguccaguacgagggcgacgguuccccaugcaaaauucccuucgagaucauggaucuggaaaagaggcacguguuggggcggcucauuacggucaauccgauagugaccgagaaagacagcccuguuaacaucgaagccgagcccccauuuggcgauucguacauuaucaucggaguggaaccuggccagcugaaguuaucuugguucaaaaagggguccucaauuggacagauguuugagacaacuaugcgaggugcuaagcgcauggccauacugggcgacaccgcaugggauuucgggagucuaggaggcguauuuacaagcaucgguaaagcccuccaucaagucuucggggcuauuuauggcgcggcauuuuccggagugucuuggacuaugaagauccugauuggcguugugaucaccuggauagggaugaauagcagaucaacgagucuuuccgucagcuuggugcugguaggagugguuacacucuaccugggcgucauggugcaggccgacucugguuguguggucucauggaaaaacaaggagcuuaaaugcgggaguggaaucuucauuaccgauaauguucacacuuggacagaacaguauaaguuucagcccgagagcccauccaagcuggcuucugccauccaaaaagcacacgaagagggcauuugugguaucaggucggugacccgguuggaaaaccucauguggaagcagauaacucccgagcugaaucauauuuuaagcgagaacgaagugaaacugaccaucaugacaggcgacauuaaggggaucaugcaggccggaaaacgcucccuaagaccucagccaacggagcucaaguacucauggaaaaccuggggcaaggcuaagaugcugaguacugaacuucacaaucauacauucuugauagaugggccggagaccgccgaaugccccaacgcaaauagggcguggaacucucuggagguagaggacuauggauuuggcgucuucacaacuaauaucuggcucaaacugaaggaacgucaagaugcuuuuugugacagcaaauuaauguccgccgcaauuaaggacaaccgggccgugcacgcugauauggguuacuggaucgagucagcccugaacgacaccuggaaaauugaaaaggccagcuucaucgagguuaagucuugccacuggccuaaaucccauacgcuuuggaguaaugggguguuggagagcgaaaugauaauuccaaagaacuucgcuggacccgucucucagcacaauuaucgaccuggcuaccagacacagaccgccgguccauggcaucucggcagacuggagauggauuuugacuucugugaagggacuaccgugguugugacagaggauugcggaaacaggggccccucccuacgcacuaccacagcgucagggaaacugaucacggaauggugcugucggaguugcacccucccgccucugagauacaggggagaggacggcuguugguaugguauggagauccgcccacuuaaggaaaaagaggaaaauuugguaaacagccuggucacugccgggcacggacaaauugauaauuuuucguuaggcgugcucgguauggcucuguuccuugaggaaaugcugcgaacacgggugggcaccaagcaugcaaucuugcucgucgccguuuccuuugugacucugauuacagggaacaugucuuuccgugaccuaggaagaguaauggugauggucggcgcuaccaugacggaugacauagggaugggagugacuuaccuggcccuccuggcagcguuuaagguuaggcccaccuucgccgcuggccuuuugcugcgcaaauuaacaagcaaggagcucaugaugaccacuaucgguauuacacugcuuucacagaguaccaucccugagacaauucuggaacuaacugaugcccucgcacuggggaugaugguguugaaaaucguccggaauauggagaaguaucagcuggcugugaccauaauggccaucuuaugcguucccaacgcagugauucuccaaaaugccuggaaagucuccuguacgacacuggcuguagugucuguuagcccacuucuguugaccuccucacagcagaaggcggacuggaucccucucgcccugacuauuaagggacuaaaccccaccgcaaucuuucugacaacucuuagcagaaccaguaaaaagaggucuuggccacucaaugaagcuauaauggccgugggcauggucuccauucuggccagcucguugcugaaaaacgauaucccgaugacgggcccuuuaguggcugggggacuccugacaguaugcuacgugcuuaccggucgaucagcagaccuggaguuggaacgcgccgcggacguccggugggaggagcaggcugaaaucucuggcaguucccccauucucagcauaacuaucucugaggaugggagcauguccauuaagaaugaagaggaggaacaaacacugaccauccuaauuagaacuggacugcuuguuaucucaggccucuucccagugaguauacccaucacagccgcagccugguaucugugggaggugaaaaagcagagggcuggugucuugugggacgugccuagcccacccccuguugggaaagcagaauuagaggauggagccuaccguauuaagcagaagggcauccugggcuauucucagauuggggcgggaguauacaaagaagguaccuuucacacgauguggcacgugacucgcggcgcuguccucaugcauaaggggaaacggaucgagccguccugggccgacgugaagaaagaucugauaucauacggaggcgguuggaaacuugagggggaauggaaggagggagaagagguucaagugcuggcauuggaaccaggcaaaaaccccagagccguccagaccaagccuggccuauucaaaacaaguaccgggacaauuggagcugugagccuggacuuuuccccagguacuucuggcucgcccaucguagauaagaaagggaaggucgugggacucuauggcaacgguguugugaccaggagcgggacguacgucucagccaucgcacagacagagaaguccauugaggacaauccugaaaucgaggaugacauauucagaaagaaacggcugacuauuauggaucuucacccgggagcuggcaaaaccaagcgcuauuuacccgccaucgugagagaagcgauuaaaaggggccugcggacacucaucuuggccccaacccgaguuguggcagcugagauggaagaggcccugagagggcucccuauacgcuaccagacucccgcuauuagggcagagcauaccggacgugaaaucgucgaccugaugugucacgccacauucacgaugcggcuucugaguccaaucagagugccuaacuauaauuugauuaucauggaugaggcccauuuuacugaccccgcuucuauugcggcaagggguuacauaagcacccgcguagaaaugggcgaggccgcugggaucuucaugacagccaccccaccgggaucccgagacccuuuuccccaaucaaacgcaccaauuauggaugaggaaagagagauccccgaacggucuuggaauagcggccacgagugggugacugacuucaaggguaagacaguuugguuugucccuaguaucaaagccgggaacgauauugcugcgugccuaaggaagaauggcaaaaaggugauacagcugucccgcaaaaccuucgacuuugaauauaucaagacgcguacuaacgauugggacuucguggucacaaccgauauuagcgagaugggcgccaauuuuaaggcagagagaguaaucgacccacggagguguaugaaacccgugauucucaccgauggcgaagaacgcguuaucuuagcugggccuaugccggugacucacucuucagccgcacagcgaagaggacgggucgguaggaacccaaagaaugaaaacgaccaauacauauacaugggcgagccccuggaaaaugaugaggacugcgcccauuggaaagaggcuaagaugcuucuggacaacaucaauacaccugaagggauuauccccuccauguucgagccagaacgcgagaaaguggaugccauugacggagaauauagacucaggggcgaggcgcggaagaccuuuguugauuugaugcgucgcggugaccugccuguguggcucgcauaccgagucgccgcugaggggaucaacuaugccgauagaaggugguguuucgacggcgugaaaaacaaucagauacuggaagagaacguagaaguggagauuuggacaaaggagggagaacggaagaaacuuaagccccgcuggcuagaugcuagaaucuacagugacccacuggcauugaaagaguucaaggaauuugccgcuggcaggaagucguuaacucugaaucucauuacggagauggggcggcugccuaccuucaugacacagaaggcccgaaacgcacuugauaaucuggcgguucuccacacugccgaagcuggagguagagccuauaaccaugcauugagcgagcugccggagacccuagaaacacugcuccuucugaccuuauuggcuacugucacgggcgggaucuuucuguuccucaugucuggaaagggcauagguaaaaugacccuggggaugugcugcaucauuacagccuccauccuucugugguacgcacagauucaaccccacuggaucgccgcuagcauaauucucgaguuuuucuugaucgugcuguuaaucccagaaccugagaagcagcgcacuccccaggacaaucagcuaaccuauguggucauugcgauccugacaguuguggccgcaaccauggcuaacgaaaugggcuuucucgagaaaacuaagaaagauuucggacuuggcucaauaacaacgcaacagccagagaguaauauucuggacaucgauuugaggccugccucugccuggacccuguacgcaguagcuacuacauuuauuacccccaugcuccggcacuccaucgaaaacagcucagugaaugucagucugaccgccauagcgaaccaggcuacagugcuuauggggcucggaaaggguuggccgcugagcaagauggacaucggcguuccauugcuggccauuggguguuacucccaggugaauccuaucacuuuaacggcagcccuacugcuccuugucgcucauuaugcaauuaucggacccggccugcaagccaaagcgacccgugaggcucagaagagagccgcagccgguauuaugaaaaacccaacaguagacgggaucacugugauagauuuggaccccauuccuuacgauccgaaguucgaaaaacagcugggccagguuaugcuccuggugcuuugcgucacccaaguguuaaugaugaggacaaccugggcucugugugaggcccucacuuuggcaacgggacccaucucuacacugugggaaggcaauccagggcgcuuuuggaacaccacuaucgcugucagcauggccaauauuuuccggggauccuaucuagcgggcgccggucugcucuuuucaauaaugaagaacaccgcaaacacacgaagagggacuggaaauaccggcgagacacuuggugagaaguggaaaaacaggcugaaugcuuugggcaagucugaguuccagaucuacaaaaagagugggauucaggagguggaccgcacgcuggccaaagaaggaaucaagcggggcgagaccgaucaccaugcaguuucgagagggagcgcuaaacuccguugguucguggagaggaaccugguaacuccugaaggaaagguggucgacuuaggcugcgguagaggcgggugguccuauuacugugggggucuuaagaauguuaaagaggugaagggccugacaaaagggggacccggccacgaagaaccuauuccaaugucuaccuauggguggaaccucguccgccuacaaucaggaguggauguauuuuucacucccccugaaaagugcgacacacuguugugugauaucggcgagagcuccccaaaucccaccguggaggccggucgaacgcugagaguucucaaccuuguggaaaauuggcugaacaauaacacccaguuuugcauaaaagucuugaauccguacaugccuagugugaucgagaagauggaagcccugcagaggaaguacgggggagcgcucguccggaacccauuaucucgcaauagcacacaugagauguauugggugucaaacgcuuccggcaacauuguuaguagcguaaauaugaucucuagaaugcugauuaacagguucacuaugcgacacaaaaaggcaaccuacgaacccgacguggaucuuggcuccgggacacggaauaucggaauagagucagagacuccuaaccuggacauuaucgguaaacguaucgaaaagauuaaacaggagcacgaaaccagcuggcauuaugaucaagaccacccauacaagacaugggccuaucauggcucguacgagaccaagcagacugggucugcuaguuccauggucaauggagugguuagacuacucacgaaacccugggacgugauaccgauggucacacagauggccaugaccgauacuaccccuuuuggccagcaacgcguguucaaggaaaaaguagacacaaggacgcaggagcccaaggaggguaccaaaaagcugaugaagaucacugcagaaugguuguggaaagagcuggggaagaaaaagacaccacggauguguaccagagaagaguuuacucgcaaagugaggagcaacgccgcucucggagcgauuuucacagaugagaauaaguggaaaucagcccgagaagcaguugaggacuccggcuuuugggaacuugucgauaaggagcggaaccugcacuuagaaggcaagugcgagaccuguguguauaauaugauggggaaaagagagaagaaacugggagaguucgguaaggcuaaaggcucuagggccaucugguacaugugguugggggcacgcuuucucgaguucgaagcccugggauuucuaaacgaggaccacugguucagccgugaaaauagucuuuccggcguggagggugaggggcugcauaagcucggauacauucugcgggaugucagcaagaaagaaggcggcgcuauguaugccgacgauacagcggggugggacacuagaaucaccuuggaggaucugaagaacgaagagaugguuacgaaucacauggaaggagagcauaaaaagcucgcagaggccauauucaaacuuaccuaccagaacaaggugguaagggugcagcgcccuacaccccgagguacugucauggacaucauuucucggagagaccaaaggggcucaggacaggugguuaccuauggacugaauacauuuacuaacauggaagcucaguuaauccgccaaauggagggcgaagguguguucaagaguauucagcagcugaccgucacggaggagaucgccgugaaaaacugguugguaagaguugggcgggaaaggcucucccguauggcaauuagcggagaugacugcguggucaagccacuggaugaccgauuugcuucugcccuaacagcucuuaaugauaugggcaaagugcgcaaggacauacagcaaugggagcccucgagaggcuggaacgauuggacccaggugccuuucugcucacaccauuuucacgaacugaucaugaaagacgggcggguccucguugugccauguaggaaucaggaugagcugauuggacgcgccagaaucagccagggugcaggcugguccuugcgggaaacugcgugcuuagggaagaguuacgcccaaauguggucucugauguauuuccacaggcgagaccuccgucuugcugccaacgcaaucuguagcgcuguaccgucccauugggugcccacaucaagaaccacuuggaguauucacgccacccaugaguggaugacaacggaggauaugcugaccgucuggaaucgcguguggauacaggaaaacccuuggauggaggacaagacuccaguugaaucuugggaggaaauccccuaccuaggaaaacgggaggaucaguggugcggcagccugauuggucucacauccagggcaaccugggccaagaauauccagacugcgauuaaccaagugagaucauugaucgggaaugaggaauauacagacuacaugccuagcaugaaacgcuuucggagggaggaagaggaagcuggaguccugugguga

SEQ ID NO: 14945 - RNA, 9876 nt, Artificial Sequence
  derived and/or modified CDS sequence (opt3) from DENV-2__KC762655__SS-prME
accgcaggcaucauuauaaugaugauccccacugugauggcuuuccaccugacuacgagaaacggggaaccucauaugauuguaagcaggcaggaaaagggaaaaucccuccuuuuuaagaccgagaaugguguuaacaugugcacccugauggcaauggacuugggcgaauuaugugaggauacuaucaccuacaauugcccacugcuacggcaaaacgaaccggaggacauugauuguuggugcaauucuacaucaaccugggugacuuaugggacauguaccgccacgggagagcaccgccgagaaaaacguaguguagcgcucgugccccaugucggcaugggucuggagacuaggaccgaaacauggaugagcuccgagggggcuuggaagcacgcccagaggaucgagacuugggugcuucggcauccuggauucaccauaauggcagccauccuggcuuacacaauuggcaccacguauuuucagcgcguuuugaucuucauucuccugacugcagugacaccaucuaugaccaugagaugcaucggcauaucgaacagggacuuugucgaaggggugucaggagguagcuggguagauauuguucuggagcacggcaguugugugacuacaauggccaaaaauaagcccacccucgacuucgaauuaaucaagacggaggcuaaacacccugccacccugcggaaguacugcauugaagcgaaacuuacaaacacuaccacagcaucccgcuguccaacucagggggagcccucuuugaaugaggaacaagauaagcgauuugucugcaaacauagcaugguggacagaggauggggcaacgguugugggcuguucggaaagggcggcaucgugaccugcgccauguuuacaugcaagaaaaauauggaggggaaggucguucagccugaaaaccuagaguauaccaucgugauuacuccacacuccggagaagagaaugcuguagguaacgauacgggcaaacaugggaaggagauaaaagugacaccgcagucaaguaucaccgaagccgagcucacuggauacggcaccgucacaauggaauguagccccaggaccggucuggacuucaaugagauggugcuucugcagauggaaaacaaggcaugguugguucaccggcaaugguuucucgaucugccuuuaccauggcugcccggggcugacacucagggcucuaacuggauucagaaagagacacucgugacguucaagaauccucacgccaagaaacaggaugucgugguacuuggaucccaagagggcgcgaugcauaccgcccugacuggggcaacagaaauccagaugucaagcggaaacuugcuauuuaccggucaccugaagugccgucuccgcauggacaaacugcagcuuaagggcaugaguuauucuauguguacagggaaauucaagguugugaaggagauagcugaaacucaacauggaaccauugucaucagagugcaguacgagggcgacgguuccccaugcaaaauccccuucgagauuauggaucuggaaaagaggcacgucuuggggcggcucaucacggugaauccgauuguuaccgagaaagacagcccugugaacauagaagccgagcccccauuuggcgauucguacaucauuaucggaguagaaccuggccagcugaaguuaucuugguucaaaaagggguccucaaucggacagauguuugagacaacuaugcgaggugcuaagcgcauggccauucugggcgacaccgcaugggauuucgggagucuaggaggcgucuuuacaagcauagguaaagcccuccaucaaguguucggggcuguuuauggcgcggcauuuuccggagugucuuggacuaugaagauccugauuggcgucgugaucaccuggauugggaugaauagcagaucaacgagucuuuccgucagcuuggugcugguuggagucgugacacucuaccugggcgugaugguccaggccgacucugguuguguugugucauggaaaaacaaggagcuuaaaugcgggaguggaaucuucauaaccgauaaugugcacacuuggacagaacaguauaaguuucagcccgagagcccauccaagcuggcuucugccauccaaaaagcacacgaagagggcauuugugguaucaggucgguaacccgguuggaaaaccucauguggaagcagauuacucccgagcugaaucauaucuuaagcgagaacgaagucaaacugaccauaaugacaggcgacauuaaggggaucaugcaggccggaaaacgcucccuaagaccucagccaacggagcucaaguacucauggaaggcuuggggcaaggccaagaugcugaguaccgaacuucacaaucauacuuucuugauugaugggccggagacagcagaaugccccaacaccaauagggcguggaacucucuggagguggaggacuauggauuuggcguuuucacaacuaauaucuggcucaaacugaaggaacgucaagauguguuuugugacagcaaauuaauguccgcugccauaaaggacaacaaagcaguccacgccgauauggguuacuggaucgagucagcucugaacgacaccuggaagauugaaaaggccagcuucaucgaggugaaaucuugccacuggccuaagucccauacgcuuuggaguaaugggguuuuggagagcgaaaugauuauccccaagaacuucgcaggacccgugucucagcacaauuaucggccuggcuaccauacacagaccgcugguccauggcaccucggccgacuggagauggauuuugacuucugugaagggacuaccguagucgugacagaggauugcggaaacagaggccccucccuaaggacuaccacagccucagggaagcugauaacggaauggugcugucgcaguugcacccucccgccucugcgguacagaggagaggacggcuguugguaugguauggagauuaggccacuuaaagaaaaggaggaaaauuuggugaacagccuggucacugcggggcauggacagaucgauaauuuuucguuaggcguucucgguauggcccuguuccuugaggaaaugcugcgcacacgagugggcaccaagcacgcuaucuugcucguagcaguguccuuugucacucugauuacagggaacaugucuuuccgggaccuaggacgugugaugguuauggugggcgccaccaugacggaugacaucgggaugggagucacuuaccuggcucuccuggccgcauuuaaagugagacccaccuucgcggccggccuuuugcugaggaaguuaacaagcaaagagcucaugaugaccacuauugguauaguucugcuuucacaaaguacaaucccugagaccauucuggaacuaacagaugcucucgcccuggggaugaugguguugaagaucguccgcaauauggagaaauaucagcuggcaguaacuauuauggcuaucuuaugcgugcccaacgccguuauacuccagaaugcauggaagguguccuguaccacgcuggccgucgugucuguaagcccacuucuguugacauccucacaacagaaggcugacuggaucccucucgcgcugaccauuaaaggacuaaaccccacugccaucuuucugaccacacuuagccggacaaguaagaaaagaucuuggccacucaaugaagcaauuauggcugugggcauggucuccauccuggccagcucguugcugaagaacgauauaccgaugaccggcccuuuaguugccgggggacuccugacggugugcuacgugcuuacagguaggucagcugaccuggaguuggaacgagcagccgacguccgcugggaggagcaggcggaaauuucuggcaguucccccauccucagcaucaccauuucugaggaugggagcauguccaucaagaaugaagaggaggaacagacucugacaauccuaauucggaccggacugcuugugaucucaggccucuucccaguuaguauucccaucacugcuacagccugguaucugugggagguaaagaaacaaagagccgguguguugugggacgucccuagcccacccccuguggggaaggccgaauuagaggauggagcuuacaggauaaagcagaaaggcauccugggcuauucucagauuggggcaggaguuuacaaggaagguaccuuucacacgauguggcaugugacucguggcgccguccucaugcacaaagggaagcgcaucgagccguccugggcggacgugaaaaaggaucugauuucauacggaggcgguuggaaacuugagggggaauggaaagagggagaagagguacagguccuggcuuuggaaccaggcaagaacccccgggccgugcaaaccaaaccuggccuauucaagacaaacaccgggacaaucggagcaguuagucuggacuuuagcccagguacuuccggcucucccauaguggauaaaaaggggaaggucgugggacucuauggcaaugguguugugaccagaucggggacguacgucagcgccauugcucagacagagaaaucaaucgaggacaacccugaaaucgaggaugacauuuucaggaagaaacgacugacuaucauggaucuucauccgggagccggcaagaccaaacgguauuuacccgcaauagugcgcgaagcuauuaagagaggccugaggacacucaucuuggccccaacccggguaguggcggccgagauggaagaggcacugcgagggcucccuauuagauaccagacucccgcuauccgcgccgagcacaccggaagggaaauaguugaccugaugugucaugcuacauucacgaugcgucuucuguccccaauucgggucccuaauuauaacuugaucaucauggaugaggcacacuuuacugaccccgccaguauugccgcuagagguuacaucucuaccaggguggaaaugggcgaggcggcagggauuuucaugacagccaccccaccgggaagccgcgacccuuuuccccaguccaaugcuccaauaauggaugaggaacgagagauccccgaaagaucauggaacucuggccacgagugggugacugacuucaaggguaaaacagucugguuuguaccuagcauuaaggccgggaaugauaucgcagccugccuacggaaaaacggaaagaaagugauccaacugaguaggaagaccuucgacuuugaauauauuaagacgcgcacuaaugauugggacuucguugugacaaccgauauauccgagaugggcgcuaacuuuaaagcggagcgugucaucgacccaagacgguguaugaagcccgugauucucaccgauggcgaagagaggguuaucuuagccgggccuaugccggugacucauagcucugcagcucagcgccgaggaagagucggucggaaucccaagaacgaaaaugaccaguacauuuacaugggcgagccccuggaaaacgaugaggacugcgcccacuggaaggaggcaaaaaugcuucuggacaauaucaacacaccugaagggauaauccccucaauguucgagccagaaagggagaagguggaugccauugacggagaauaucgccucagaggcgaggcuaggaaaaccuuuguagauuugaugcggcguggugaccugccuguguggcucgccuaccgcguugcggcagaggggaucaacuaugccgaucgaagaugguguuucgacggcgucaagaauaaccaaauucuggaagagaauguggaaguggagaucuggacaaaggagggagaaaggaaaaagcuaaaaccccgguggcuugaugcucgcauauacuccgacccacuggccuugaaggaguucaaagaauuugcugcaggcagaaagaguuuaacucugaaccucauuacggagauggggaggcugccuaccuucaugacacagaaggcccggaaugcucuugauaaccuggccguccuccauacugcagaagcgggaggucgagccuauaaucacgcuuugagcgagcugccggagacccuagaaacacugcuccuucugaccuuauuggccacuguuacgggcgggaucuuucuguuccucaugucgggaaaaggcauugguaagaugacccuggggaugugcugcaucauaacagcaucuauccuucugugguacgcucagauucagccccacuggaucgccgcauccauuauccucgaguuuuucuugauagugcuguuaauuccagaaccugagaaacaaagaacuccccaggacaaccagcuaaccuauguagugaucgccauccugacagucguggcugcgaccauggccaaugaaaugggcuuucucgagaagacuaaaaaggauuucggacuuggcagcauugcaacacagcaaccagagucaaacauccuggacauagauuugcgcccugcuagugccuggacgcuguacgccguugcaaccacuuuuauuacacccaugcucaggcauucuaucgaaaauuccagcgugaacgucucacugaccgcuauugccaaucaggcgaccguacuuauggggcucggaaaggguuggccgcugaguaaaauggacaucggcgugccauugcuggcuauaggguguuacagccagguuaacccuaucacauuaacugccgcacuacugcuccuuguggcccacuaugcuauuaucggacccggccugcaggcaaaggccacgcgggaggcgcaaaaacgugcugccgcagguauuaugaagaauccaaccgucgacgggaucacagugauugauuuggaccccaucccuuacgauccgaaauucgaaaagcagcugggccaggucaugcuccuggugcuuugcguuacucagguguuaaugaugagaaccacaugggcccugugugaggcucucaccuuggccacuggacccauauccacgcugugggaaggcaacccagggagguuuuggaauacaaccauugcaguaucuauggcuaacaucuuccgcggaagcuaucuagccggcgcgggucugcucuuuuccaucaugaagaacacugccaauacccggcgagggacaggaaacacuggcgagacccuuggugagaaauggaagaauagacugaacgcauugggcaaaucagaguuccaaauuuacaagaaaucugggauacaggagguggacaggacacuggcuaaggaaggaaucaaacgcggcgagacggaucaucacgccgucagucgggggucggcaaagcucagaugguucguugagcguaaucuggugaccccugaaggaaaggucguggacuuaggcugcgguagagggggauggagcuauuacuguggcggucuuaaaaacguaaaggaggugaaaggccugacuaaagggggacccggccaugaagaaccuauuccaauguccacauauggguggaaucucguucggcuacagucuggaguggaugucuuuuucacaccaccugaaaaaugcgacacucuguugugugauaucggcgagucaagcccaaaccccacaguggaggcuggucgcacccugcgaguccucaaucuuguggaaaacuggcugaauaacaauacgcaauuuugcauuaagguuuugaacccguacaugccuuccguaaucgagaagauggaagcccugcagagaaaauacgggggagcccucgugaggaauccauuaagucggaacucuacccacgagauguauugggucagcaacgcgucaggcaauauaguguccaguguuaacaugaucagccgcaugcugauuaauagauucacaaugaggcacaagaaagcuacuuacgaacccgacguggaucuuggcucugggacccgaaacaucggaauugaguccgagacaccuaaucuggacaucauagguaagcggauugagaaaauaaagcaggaacaugaaacuucauggcacuaugaucaggaccauccauacaagaccugggcauaucacggcagcuacgagacaaaacaaaccgggucggccucuaguauggucaacggagugguacgucuacucacuaagcccugggacgugaucccgaugguuacgcagauggcuaugacagauaccacuccuuuuggccagcagagagucuucaaagaaaagguggacacccgcacacaagagcccaaagaggguacgaagaagcugaugaaaauuaccgccgaaugguuguggaaggagcuggggaaaaagaaaacuccaaggauguguacacgggaagaguuuaccagaaaggugcgcuccaaugcagcccucggagcuauauucacugaugagaacaaauggaaaagcgcgagggaagccgucgaggacucaggcuuuugggaacuuguugauaaggagcgaucccugcacuuagaaggcaaaugcgagacauguguguauaauaugauggggaagcgggagaaaaagcugggagaguucgguaaagcaaagggcucuagagcuaucugguacaugugguugggggccagguuucucgaguucgaagcacugggauuucuaaacgaggaccauugguucagccgcgaaaauagucuuuccggcguagagggugaggggcugcacaagcucggauacauucugcgugaugugagcaaaaaggaaggcggcgccauguaugcugacgauaccgccgggugggacacacggaucacuuuggaggaucugaaaaacgaagagauggucaccaaucauauggaaggagagcacaagaaacucgcggaggcaauuuucaaacuuacguaccagaacaaggugguuagagugcagaggccuaccccacgcgguaucgucauggacauaaucucucgacgggaccagagaggcucagggcaagugguaacauauggacugaauacuuuuaccaacauggaagcccaguuaauuaggcagauggagggcgaagguguuuucaaaaguauccaacagcugacagugacugaggagauugcugucaagaacugguuggcccgcguggggagagaacggcucuccaggauggcaaucagcggagaugacugcguggucaaaccacuggaugaccguuuugcuucugcccuaaccgcucuuaaugauaugggcaagguucgaaaagacauucagcagugggagcccucgcgcggcuggaacgauuggacgcaagugccuuucugcucacaucacuuucacgaacugauaaugaaggacgggagaguacucguggucccaugucggaaucaggaugagcugaucggaagggcccgcauuagccagggugcaggcugguccuugagagaaacagcgugcuuagggaagaguuacgcccagauguggucucugauguauuuccaucggagggaccuccgacuugcugccaacgcaaucuguagcgcugugccgucccacuggguucccaccucacguacuacauggaguauccaugccacccacgaguggaugacuaccgaggauaugcugacaguguggaauagagucuggauucaagaaaacccuuggauggaggacaaaacgccaguggaaucuugggaggaaauacccuaccuaggaaagcgcgaggaucaguggugcggcagccugaucggucucaccucccgggcaacuugggccaggaauauucagacagcgaucaaccagguaagaucauugauugggaaugaggaauauaccgacuacaugccuagcaugaaacgcuuucggagggaggaagaggaagcuggaguucugugguga

SEQ ID NO: 14946 - RNA, 9876 nt, Artificial Sequence
  derived and/or modified CDS sequence (opt3) from DENV-2__KC762656__SS-prME
accgccggaaucauuauaaugaugauccccacagugauggcuuuccaccugacuacgcgaaacggggagccucauaugauuguaagcaggcaggaaaagggaaaaucccuccuuuuuaagaccgagaaugguguuaacaugugcacacugauggcaauggacuugggcgaauuaugugaggauacuaucaccuacaauugcccacugcuacggcaaaacgaaccggaggacauugauuguuggugcaauucuacaucaaccugggugacuuaugggacauguaccgccacgggagagcaccgccgagaaaaacguaguguugcgcucgugccccaugucggcaugggucuggagacuagagcugaaaccuggaugagcuccgagggggccuggaagcacgcacagaggaucgagacaugggugcuucggcauccuggauucacuauaauggccgcuauccuggcauacaccauuggcacaaccuauuuucagcgcguuuugaucuucauucuccugacggccgugacuccaucuaugacaaugcggugcaucggcauaucgaacagggacuuugucgaaggggugucaggagguagcuggguagauauuguucuggagcacggcaguugugugaccacuauggcuaaaaauaagcccacacucgacuucgaauuaaucaagaccgaggccaaacacccugcgacgcugcggaaguacugcauugaagcaaaacuuaccaacacaacuaccgccucccgcuguccaacacagggggagcccucuuugaaugaggaacaagauaagcgauuugucugcaaacauagcaugguggacagaggauggggcaacgguugugggcuguucggaaagggcggcaucgugacuugcgcuauguuuaccugcaagaaaaauauggaggggaaggucguucagccugaaaaccuagaguauacaaucgugauuaccccacacuccggagaagagaaugccguagguaacgauacuggcaaacaugggaaggagauaaaagugacgccgcagucaaguaucacagaagcagagcucaccggauacggcacugucaccauggaauguagccccaggacaggucuggacuucaaugagauggugcuucugcagauggaaaacaaggcuugguugguucaccggcaaugguuucucgaucugccuuuaccauggcugcccggggccgacacccagggcucuaacuggauucagaaagagacucucgugacauucaagaauccucacgcgaagaaacaggaugucgugguacuuggaucccaagagggcgccaugcauacggcacugaccggggcuacugaaauccagaugucaagcggaaacuugcuauuuacaggucaccugaagugccgucuccgcauggacaaacugcagcuuaagggcaugaguuauucuauguguaccgggaaauucaagguugugaaggagauagccgaaacacaacauggaacuauugucaucagagugcaguacgagggcgacgguuccccaugcaaaauccccuucgagauuauggaucuggaaaagaggcacgucuuggggcggcucaucaccgugaauccgauuguuacggagaaagacagcccugugaacauagaagcugagcccccauuuggcgauucguacaucauuaucggaguagaaccuggccagcugaaguuaucuugguucaaaaagggguccucaaucggacagauguuugagaccacaaugcgaggugccaagcgcauggcaauucugggcgacacugccugggauuucgggagucuaggaggcgucuuuaccagcauagguaaagcucuccaucaaguguucgggacaaucuauggcgcggcauuuuccggaguuucuuggacuaugaagauucugaucggcguggucauuaccuggaucgggaugaauagcagaucaacgagucuuuccgugagcuugguacuggugggaguugucacacucuaccugggcgugauggugcaggccgacucugguugugucguuucauggaaaaacaaggagcuuaaaugcgggaguggaauauucaucaccgauaaugugcacacuuggacagaacaguauaaguuucagcccgagagcccauccaagcuggcuucugccauucaaaaagcacacgaagagggcaucugugguauuaggucggugacccgguuggaaaaccucauguggaagcagaucacucccgagcugaaucauauauuaagcgagaacgaaguaaaacugaccauuaugacaggcgacaucaaggggauuaugcaggccggaaaacgcucccuaagaccucagccaacggagcucaaguacucauggaaggcuuggggcaaggccaagaugcugaguaccgaacuucacaaucauacuuucuugaucgaugggccggagacagcagaaugccccaacaccaauagggcguggaacucucuggaggucgaggacuauggauuuggcguguucacaacuaauauauggcucaaacugaaggaacgucaagauguauuuugugacagcaaauuaauguccgcugccaucaaggacaaccgggcagugcacgccgauauggguuacuggauugagucagcucugaacgacaccuggaaaaucgaaaaggccagcuucauugaggucaagucuugccaguggccuaaaucccacacgcuuuggaguaaugggguguuggagagcgaaaugaucauaccaaagaacuucgcaggacccguuucucagcauaauuaucgaccuggcuaccacacacagaccgcugguccauggcaucucggcagacuggagauggauuuugacuucugugaagggacuaccgugguagucacagaggauugcggaaacaggggccccucccuacgcacuaccacagccucagggaaacugauuacggaauggugcugucggaguugcacccucccgccucugagauacaggggagaggacggcuguugguaugguauggagauccgcccacuuaaggaaaaagaggaaaauuuggugaacagccuggugacugcggggcacggacaaaucgauaauuuuucguuaggcguccucgguauggcccuguuccuugaggaaaugcugcgaacacggguuggcaccaagcaugcuauuuugcucguggcaguauccuuugugacucugaucacagggaacaugucuuuccgugaccuaggaagagucauggugaugguuggcgccaccaugacggaugacauugggaugggagugacuuaccuggcucuccuggccgcauuuaaggucaggcccaccuucgcggccggccuuuugcugcgcaaauuaacaagcaaggagcucaugaugaccacuauagguaucgugcugcuuucacagaguacaauuccugagaccauccuggaacuaacagaugcucucgcccuggggaugaugguuuugaaaauugugcggaauauggagaaguaucagcuggcagucacuaucauggcuauauuaugcguacccaacgccgugauccuccaaaaugcauggaaaguuuccuguaccacgcuggccguggucucugugagcccacuucuguugacauccucacagcagaaggcugacuggauuccucucgcgcugaccaucaagggacuaaaccccacugccauuuuucugaccacacuuagcagaacaaguaaaaagaggucuuggccacucaaugaagcaaucauggcuguaggcaugguguccauacuggccagcucguugcugaaaaacgauauuccgaugaccggcccuuuagucgccgggggacuccugacgguuugcuacgugcuuacaggucgaucagcugaccuggaguuggaacgcgcagccgacgugcggugggaggagcaggcggaaaucucuggcaguucccccauccucagcauuaccauaucugaggaugggagcauguccaucaagaaugaagaggaggaacaaacucugacaauucuaaucagaaccggacugcuugucgugucaggccucuucccaguuaguauucccaucacugcugccgcaugguaucugugggaggucaagaaacagagggccgguguguugugggacgucccuagcccacccccuguggggaaagcugaauuagaggauggagcauaccguauaaagcagaagggcauccugggcuauucucagauuggggccggaguuuacaaagaagguacauuucacaccauguggcacgugacgcgcggcgcgguccucaugcauaaggggaaacggaucgagccguccugggcugacgugaagaaagaucugauuucauacggaggcgguuggaaacuugagggggaauggaaggagggagaagagguacaaguccuggccuuggaaccaggcaaaaaccccagagcagugcagacuaagccuggccuauucaaaaccaacacagggaccaucggagccguuagucuggacuuuagcccagguacauccggcucucccauaguggauaagaaagggaaggucgugggacucuauggcaaugguguugugacuaggucggggaccuacgucagcgcuauugcccagacggagaagucaaucgaggacaacccugaaaucgaggaugacauuuuccggaaaaagagacugacaaucauggaucuucacccgggagcaggcaaaacuaagcgcuauuuacccgcuauagugagagaagccauuaaaaggggccugcggacccucaucuuggcgccaacacgaguaguggccgcagagauggaagaggcucugagagggcucccuauucgcuaccagacccccgccaucagggcugagcauacuggacgugaaauaguugaccugaugugucacgcaaccuucacaaugcggcuucuguccccaauuagagucccuaauuauaacuugaucaucauggaugaggcccauuuuacggaccccgccaguauugcugcgagggguuacaucucuacucgcguggaaaugggcgaggcagccgggauuuucaugaccgcuacaccaccgggaagccgagacccuuuuccccaauccaaugccccaauaauggaugaggaaagagagauccccgaacggucauggaacucuggccacgagugggugaccgacuucaaggguaagacugucugguuuguaccuagcauuaaagcagggaaugauaucgccgcuugccuaaggaagaacggcaaaaaggugauccagcugagucgcaaaacauucgacuuugaauauauuaagacccguacgaaugauugggacuucguugugacuacagauauauccgagaugggcgcgaacuuuaaggccgagagagucaucgacccacggagguguaugaaacccgugauucucaccgauggcgaagaacgcguuaucuuagcagggccuaugccggugacccacagcucugcugcccagcgaagaggacgggucgguaggaauccaaagaacgaaaaugaccaauacauuuacaugggcgagccccuggaaaacgaugaggacugcgcacauuggaaagaggccaagaugcuucuggacaauaucaacacuccugaagggauaauccccucaauguucgagccagaacgcgagaaaguggaugcuauugacggagaauauagacucaggggcgaggcccggaagacauuuguagauuugaugcgucgcggugaccugccuguguggcucgcguaccgaguugcagccgaggggaucaacuaugcugauagaaggugguguuucgacggcgucaaaaauaaccagauucuggaagagaauguggaaguggagaucuggaccaaggagggagaacggaagaaacuuaagccccgcuggcuagaugccagaauauacuccgacccacuggcuuugaaagaguucaaggaauuugcagccggcaggaaaaguuuaacacugaaccucauuacugagauggggcggcugccuacguucaugacccagaaggcucgaaaugcccuugauaaccuggcaguccuccacacagcggaagccggagguagagcuuauaaucaugccuugagcgagcugccggagacucuagaaacccugcuccuucugacauuauuggcaaccguuacuggcgggaucuuucuguuccucaugucgggaaagggcauugguaaaaugacgcuggggaugugcugcaucauaaccgcuucuauccuucugugguacgcccagauucaaccccacuggaucgcagccuccauuauccucgaguuuuucuugauagugcuguuaauuccagaaccugagaagcagcgcacaccccaggacaaccagcuaacuuauguagugaucgcuauccugaccgucguggcggccacaauggcaaaugaaaugggcuuucucgagaaaaccaagaaagauuucggacuuggcagcauugcuacucaacagccagagucaaacauccuggacauagauuugaggccugccagugccuggacacuguacgcaguugcuacgaccuuuauuacucccaugcuccggcacucuaucgaaaauuccagcgugaacgucucacugacagccauugcgaaucaggcuaccguacuuauggggcucggaaaggguuggccgcugaguaagauggacaucggcgugccauugcuggccauaggguguuacagccagguuaacccuaucaccuuaacagcagcccuacugcuccuuguggcucauuaugcaauuaucggacccggccugcaagccaaagcgacucgugaggcucagaagagagccgcagccgguauuaugaaaaauccaacggucgacgggaucaccgugauugauuuggaccccaucccuuacgauccgaaguucgaaaaacagcugggccaggucaugcuccuggugcuuugcguuacacaaguguuaaugaugaggacuaccugggcucugugugaggcccucacauuggcaaccggacccauauccacucugugggaaggcaacccagggcgcuuuuggaauacgacaauugcuguaucuauggccaacaucuuccggggaagcuaucuagcgggcgccggucugcucuuuuccaucaugaagaacaccgcaaauacucgaagagggaccggaaacacaggcgagacucuuggugagaaguggaaaaauaggcugaacgcuuugggcaagucagaguuccagauuuacaaaaagucugggauacaggagguggaccgcacccuggccaaagaaggaaucaagcggggcgagacagaucaccaugcagucaguagagggucggcuaaacuccguugguucguugagaggaaucuggugacgccugaaggaaaggucguggacuuaggcugcgguagaggcggguggagcuauuacugugggggucuuaagaacguaaaagaggugaagggccugaccaaagggggacccggccacgaagaaccuauuccaauguccacuuauggguggaaucucguucgccuacaaucuggaguggaugucuuuuucacacccccugaaaagugcgacacccuguugugugauaucggcgagucaagcccaaaccccacuguggaggccggucgaacacugagaguccucaaucuuguggaaaacuggcugaauaacaauacccaguuuugcauuaaaguuuugaacccguacaugccuuccguaaucgagaagauggaagcccugcagaggaaguacgggggagcgcucgugcggaauccauuaagucgcaacucuacgcaugagauguauugggucagcaacgcuucaggcaauauaguguccaguguuaacaugaucagcagaaugcugauuaauagguucaccaugcgacacaaaaaggcaacauacgaacccgacguggaucuuggcucugggacucggaacaucggaauugaguccgagaccccuaaucuggacaucauagguaaacguauugaaaagaucaaacaggagcacgaaacaucauggcauuaugaucaagaccacccauacaagacuugggccuaucauggcagcuacgagaccaagcagacagggucggcuucuaguauggucaacggagugguaagacuacucaccaaacccugggacgugaucccgaugguuacucagauggccaugacggauacaaccccuuuuggccagcaacgcgucuucaaggaaaaaguggacacuaggacccaggagcccaaggaggguacuaaaaagcugaugaagauuacggcagaaugguuguggaaagagcuggggaagaaaaagaccccacggauguguacuagagaagaguuuacacgcaaagugagguccaaugccgcucucggagcgauauucaccgaugagaacaaguggaaaagcgcccgagaagcagucgaggacucaggcuuuugggaacuuguugauaaggagcggaaucugcacuuagaaggcaagugcgagacuuguguguauaacaugauggggaaaagagagaagaaacugggagaguucgguaaggcuaaaggcuccagggccaucugguacaugugguugggggcacgcuuucucgaguucgaagcccugggauuucuaaaugaggaccacugguucucucgugaaaacagccuuaguggcguagagggugaggggcugcauaagcucggauacauucugcgggauguguccaagaaagaaggcggcgcuauguaugccgacgauacagcggggugggacaccagaaucacauuggaggaucugaagaaugaagagauggucacuaaccacauggaaggagagcauaaaaagcucgcagaggccauuuucaaacuuaccuaccagaauaaggugguuagggugcagcgcccuacgccccgagguaccgucauggacaucauaagccggagagaccaaaggggcucuggacaggugguaacauauggacugaacacuuuuaccaacauggaagcucaguuaauccgccaaauggagggcgaagguguuuucaagucaauucagcagcugacagugacugaggagaucgccgucaaaaauugguuggugagaguggggcgggaaaggcucagucguauggcaauuuccggagaugacugcgucguuaagccacuggaugaccgauuugcuagcgcccuaaccgcucuuaacgauaugggcaaagugcgcaaggacauccagcaaugggagcccucuagaggcuggaaugauuggacgcagguaccuuucugcucgcaccauuuucacgaacugauuaugaaagacgggcgggugcucgucgugccauguaggaaccaggaugagcugauaggacgcgccagaaucucacagggugcaggcuggagcuugcgggaaacagcgugcuuagggaaguccuacgcccaaauguggagucugauguauuuccacaggcgagaccuccgucuugcugccaaugcaauuuguucugcuguuccgagccauugggugcccaccuccagaacuacauggucaauccacgccacccaugaguggaugacuaccgaggauaugcugacagucuggaaccgcguguggauccaggaaaauccuuggauggaggacaagacgccaguagaaaguugggaggaaauucccuaccuaggaaaacgggaggaucaguggugcggcucucugauaggucucaccagcagggcaacuugggccaagaacauccagacagcgauuaaucaaguuagauccuugaucgggaacgaggaauauaccgacuacaugccuucaaugaaacgcuuucggagggaggaagaggaagcuggagugcugugguga

SEQ ID NO: 14947 - RNA, 9876 nt, Artificial Sequence
  derived and/or modified CDS sequence (opt3) from DENV-2__KC762673__SS-prME
accgccggcaucauuauaaugaugauccccacagugauggcuuuccaccugacuacgagaaacggggagccucauaugauuguaagcaggcaggaaaagggaaaaucccuccuuuuuaagaccgagaaugguguuaacaugugcacacugauggcaauggacuugggcgaauuaugugaggauacuaucaccuacaauugcccacugcugcggcaaaacgaaccggaggacauugauuguuggugcaauucuacaucaaccugggugacuuaugggacauguaccgccacgggagagcaccgccgagaaaaacguaguguggcgcucgugccccaugucggcaugggucuggagacuaggaccgaaacauggaugagcuccgagggggcuuggaagcacgcccagaggaucgagacuugggugcuucggcauccuggauucaccauaauggcagccauccuggcuuacacaauuggcaccacgcacuuucagcgcguuuugaucuucauucuccugacugcaguggccccaucuaugacaaugagaugcaucggcauaucgaacagggacuuugucgaaggggugucaggagguagcuggguagauauuguucuggagcacggcaguugugugaccacuauggcuaaaaauaagcccacacucgacuucgaauuaaucaagaccgaggccaaacauccugcgacgcugcggaaguauugcauugaagcaaaacuuaccaacacaacuaccgccucccgcuguccaacacagggggagcccucuuugaaugaggaacaagauaagcgauuugucugcaaacacagcaugguggacagaggauggggcaacgguugugggcuguucggaaagggcggcaucgugacuugcgcuauguuuaccugcaagaaaaauauggaggggaagaucguccagccugaaaaccuagaguacacaauuguuauaaccccacauuccggagaagagaaugccguggguaacgauacuggcaaacacgggaaggagaucaaaguaacgccgcagucaaguauuacagaagcagagcucaccggauauggcacugugaccauggaauguagccccaggacaggucuggacuucaaugagaugguccuucugcagauggaaaacaaggcuugguuggugcaccggcaaugguuucucgaucugccuuuaccauggcugcccggggccgacacccagggcucuaacuggauccagaaagagacucucguuacauucaagaauccucaugcgaagaaacaggauguggucgugcuuggaucccaagagggcgccaugcacacggcacugaccggggcuacugaaauacagaugucaagcggaaacuugcuauuuacaggucaucugaagugccgucuccgcauggacaaacugcagcuuaagggcaugaguuacucuauguguaccgggaaauucaagguaguuaaggagauugccgaaacacaacacggaacuaucgugaucagaguccaguaugagggcgacgguuccccaugcaaaauucccuucgagaucauggaucuggaaaagaggcauguguuggggcggcucauuaccgucaauccgauagugacggagaaagacagcccuguuaacaucgaagcugagcccccauuuggcgauucguacauuaucaucggaguggaaccuggccagcugaaguuaucuugguucaaaaagggguccucaauuggacagauguuugagaccacaaugcgaggugccaagcgcauggcaauacugggcgacacugccugggauuucgggagucuaggaggcguauuuaccagcaucgguaaagcucuccaccaagucuucggggcgauuuacggcgcagccuuuuccggagugucuuggacaaugaagauccugauuggcguugugaucacuuggauagggaugaauagcagaucaacaccccuuagugucuccuuggugcugguaggagugguuacgcucuaucugggcgucauggugcaggcugacagcgguuguguggucucuuggaaaaacaaggagcuuaaaugcgggucaggaaucuucauuacagauaauguucacaccuggacugaacaguacaaguuucagccagagagucccagcaagcuggccuccgcaauccaaaaagcccaugaagagggcauuugugguaucaggucugugacacgguuggaaaaccucauguggaagcagauaaccccugagcugaaucacauuuuaucggagaacgaagugaaacugacuaucaugaccggcgacauuaaggggaucaugcaggcuggaaaacgcagccuaagaccacagccgacagagcucaaguauuccuggaaaacguggggcaaggccaagaugcugucaaccgaacuucauaaucacacuuucuugauagaugggcccgagacagcagaaugcccuaacaccaauagggcguggaacagucuggagguagaggacuacggauuuggcgucuucacaacuaauaucuggcucaaacugaaggaacgucaagauguguauugugacucuaaauuaaugagcgcugccauuaaggacaaccgggcaguucacgccgauauggguuacuggaucgaguccgcucugaacgacaccuggaaaauugaaaaggccucauuuaucgagguaaagagcugcuauuggccaaaaucucauacgcuuugguccaauggggucuuggagagugaaaugauaauucccaagaacuucgcaggaccugugagccagcacaauuaccgaccaggcuaccauacacagaccgcuggucccuggcaccucggcagacuggagauggauuucgacuuuugugaagggacuaccguugugguaacagaggauugcggaaacaggggcccgucucuacgcacuaccacagccuccgggaaacugaucacggaauggugcugucggucaugcacccucccuccacugagauauaggggagaggacggcuguugguacgguauggagauccgcccccuuaaggaaaaagaggaaaauuuggucaacagucuggugacugcggggcauggacagauugauaauuucagcuuaggcgugcucgguauggcccuguuucuugaggaaaugcugcgaacacgggucggcaccaagcacgcuaucuugcucguugcagugucguucguaacucugauuacagggaacauguccuuucgugaccuaggaagagugauggucauggugggcgccaccaugacggaugacauagggaugggaguuacuuaucuggcucuccuggccgcauucaaggugaggccuaccuuugcggccggccuuuugcugcgcaaauuaacaucuaaggagcucaugaugaccacuaucgguauuguccugcuuagccaaucaacaauccccgagaccauucuggaacuaacagaugcucucgcccuggggaugauggcauugaaaaucgugcggaauauggagaaguaccagcuggcuguuacuauaauggccaucuuaugcgugccaaacgcagucauucuccagaaugccuggaaaguaaguuguaccacgcuggcugugguuuccgugucuccucuucuguugacaagcucccaacagaaggcggacuggaucccccucgcccugaccauuaagggacuaaacccaacugcaaucuuccugaccacacuuucaagaacuagcaaaaagaggaguuggccgcucaaugaagcuauaauggccgucggcauggugucuauucuggccuccagcuugcugaaaaacgauaucccuaugaccggccccuuaguagcugggggacuccugacggugugcuauguccuuacaggucgaucggcagaccuggaguuggaacgcgccgcggacguucggugggaggagcaggcugaaaucucaggcucuaguccaauucucuccauaaccaucagcgaggaugggucuaugagcauuaagaaugaagaggaggaacagacucugacaauccuaauuagaaccggacugcuugugaucuccggccucuuucccgugucaauaccuaucacugccgcagccugguaccugugggaggucaaaaagcaaagggcugguguguugugggacguuccaagucccccuccgguagggaaagcagaauuagaggauggagccuaucguauuaagcagaagggcauccugggcuacagccagauuggggcgggaguguacaaagaagguacauuccacaccauguggcaugucacgcgcggcgcugugcucaugcacaaggggaaacggaucgagccaucuugggccgacguuaagaaagaucugauauccuauggaggcgguuggaaacuugagggggaauggaaggagggagaagaggugcagguccuggcauuggaacccggcaaaaacccuagagccgugcaaacuaagccaggccuauuuaaaaccaacacagggaccauuggagcuguaucacuggacuucagucccgguacaagcggcuccccuaucgucgauaagaaagggaaggugguuggacucuacggcaaugguguggucacuaggucugggaccuaugugucggccaucgcacagacggaaaagagcauugaggacaacccggaaaucgaggaugacauauuuagaaagaagcggcugacaauuauggaucuucaucccggagcuggcaaaacuaagcgcuacuuaccagccaucguuagagaagcgauuaaaaggggccugcggacccucaucuuggccccuacacgaguggucgcagcugagauggaagaggcccugagagggcuccccauacgcuaucagaccccagcuauuaaggcagagcacacuggaagggaaaucguggaccugaugugucaugccaccuucacaaugcgucuucugucaccuauccggguacccaauuacaacuugauuaucauggaugaggcccacuucacggacccagcuuccauugcggcaagagguuauauaaguacuaggguggaaaugggcgaggccgcugggaucuuuaugaccgccacaccgccuggaucucgcgaccccuucccacagagcaaugcacccauuauggaugaggaacgagagaucccugaaagauccuggaacucaggccacgaguggguuaccgacuuuaaggguaaaacugucugguucgugccaucuaucaaggccgggaaugauauugcugcgugccuacggaaaaacggaaagaaagugauacaacugagcaggaagacauuugacuucgaauacaucaagacccgcacgaaugauugggacuuugucguaacuacagauauuagugagaugggcgccaacuucaaagcagagcgugugaucgaccccagacgguguaugaagccuguuauucucaccgauggcgaagagagggugaucuuagcugggccgaugccagucacccauuccagcgccgcacagcgccgaggaagagugggucggaaucccaaaaacgaaaaugaccaguacauauauaugggcgagccucuggaaaacgaugaggacugcgcccacuggaaggaggcuaaaaugcuucuggacaauaucaacacucccgaagggauuaucccaucuauguuugagccugaaagggagaagguugaugccauugacggagaauaccgccucagaggcgaggcgaggaaaacauucguggauuugaugcggcguggugaccugcccgucuggcucgcauaucgcguggccgcugaggggaucaacuacgccgaucgaagaugguguuuugacggcguaaagaauaaccaaauacuggaagagaauguggaaguugagauuuggaccaaggagggagaaaggaagaaacuuaaaccacgguggcuagaugcucgcaucuauucagacccucuggcauugaaagaguucaaagaguucgccgcuggcagaaaguccuuaacacugaaccucauuacugagauggggaggcugccgacguuuaugacccagaaggcccggaaugcacuugauaaccuggcgguccuccauacagccgaagcuggaggucgagccuacaaucacgcauugagugagcugcccgagacucuagaaacccugcuccuucugacauuauuggcuaccgugacuggcgggaucuuccuguuucucaugagcggaaaaggcauagguaagaugacgcuggggaugugcugcaucauuaccgccucgauccuucugugguaugcacagauucagccacacuggaucgccgcuucuauaauucucgaguucuuuuugaucgugcuguuaaucccugaacccgagaaacaaagaacaccacaggacaaccagcuaacuuacgucguuauugcgauccugaccgugguagccgcaacaauggcuaaugaaaugggcuuccucgagaagaccaaaaaggauuuuggacuuggcuccauaacuacacagcaaccugagagcaacauucuggacaucgauuugcgccccgccucagccuggacgcuguacgcaguggcuaccacuuucauuacaccgaugcucaggcauaguaucgaaaauucuuccgucaacgugagccugaccgccauagcgaaucaggcuaccguucuuauggggcucggaaaggguuggccacugucaaaaauggacaucggcgugccuuugcuggccauuggguguuauagucaggucaaccccaucacauuaacugcagcccuacugcuccuuguagcucacuacgcaauuaucggaccaggccugcaggccaaggcgacgcgggaggcucaaaaacgugccgcagccgguauuaugaagaaucccaccguggacgggaucacaguuauagauuuggacccuauuccguaugaucccaaauuugaaaagcagcugggccaggugaugcuccugguccuuugcgugacucaggucuuaaugaugagaaccacaugggcucugugugaggcccucaccuuggcaacuggaccaaucagcacgcugugggaaggcaacccugggagguucuggaauacaaccaucgcuguguccauggccaacauuuuucgcggaucuuaccuagcgggcgccggucuacucuucagcauaaugaagaacacugcaaauacccggcgagggacaggaaacacuggcgagacccuuggugagaaauggaagaauagacugaacgcuuugggcaaauccgaauuucaaaucuauaagaaaucagggauucaggagguugacaggacacuggccaaggaaggaaucaaacgcggcgagacggaucaucacgcagugucucgggggagugcuaagcucagaugguucguagagcguaaucuggugacccccgaaggaaaggucguugacuuaggcugcgguagaggcggguggucguacuauugugggggucuuaaaaacgugaaggaggucaaaggccugacuaaagggggaccuggccaugaagaaccaauucccaugagcacauacggguggaaucucgugcggcuacaguccggaguagauguguucuuuaccccuccagaaaaaugcgacacucuguugugugauaucggcgagucuucacccaacccgacaguugaggccggucgcacccugcgagugcucaaucuugucgaaaacuggcugaauaacaauacgcaauucugcauaaagguguugaacccuuacaugccaagcgucaucgagaagauggaagcccugcagagaaaauaugggggagcgcucgugaggaaucccuuaucccggaacaguacccacgagauguacuggguuucuaacgcuagcggcaauauuguaucauccgugaacaugaucagucgcaugcugauuaauagauuuacaaugaggcacaagaaagcaacuuaugaaccugacgucgaucuuggcagcgggacccgaaacaucggaauagagucugagauuccaaaucuggacaucaucgguaagcggauugagaagauaaagcaggagcaugaaacauccuggcacuacgaucaggaccaucccuaucguacuugggccuaccacggcucauaugagaccaagcaaacagggagcgcuucgucuauggugaacggaguugugagacuacucaccaaaccgugggacgucaucccuauggugacucagauggccaugacggauacaacccccuucggccagcagcgcguauuuaaggaaaaaguggacacuaggacccaagagccaaaggaggguaccaagaagcugaugaagauuacggcagaaugguuguggaaagagcuggggaagaaaaagaccccucggauguguacuagagaagaguucacacgcaaaguuaggaguaaugccgcucucggagcgaucuuuaccgaugagaacaaguggaaauccgcccgagaagcagucgaggacagcggcuucugggaacuuguggauaaggagcggaaucugcacuuagaaggcaagugcgagacuuguguguacaacaugauggggaaaagagagaagaaacugggagaauuugguaaggcuaaaggcucaagggccauuugguacaugugguugggggcacgcuuccucgaguuugaagcccugggauuccuaaaugaggaccauugguuuucccgugaaaacucucuuagcggcgucgagggugaggggcugcacaagcucggauauauccugcgggauguuaguaagaaagaaggcggcgcuauguacgccgacgauacagcggggugggacaccagaauaacauuggaggaucugaagaaugaagagauggugacuaaccauauggaaggagagcacaaaaagcucgcagaggccaucuucaaacuuaccuaucagaauaagguagugaggguccagcgccccacgccacgagguaccgugauggacauuaucucccggagagaccagaggggcagcgggcaaguugugacauacggacugaacacuuucaccaacauggaagcucaguuaauucgccagauggagggcgaaggugucuuuaagucuauccaacagcugacagugacugaggagauugccgucaaaaauugguugguuagaguggggcgggaaaggcucucacguauggcaauaaguggagaugacugcgucgugaagccccuggaugaccgauucgcuuccgcccuaaccgcucuuaacgauaugggcaaagugcgcaaggacauccagcagugggagccuagcagaggcuggaaugauuggacgcaagucccauuuugcucucaucacuuccacgaacugauuaugaaagacgggcggguucucgugguaccguguaggaaccaggaugagcugaucggacgcgccagaaucucgcagggugcaggcuggucauugcgggaaacagcgugcuuaggaaagagcuaugcccagauguggucccugauguacuuucauaggcgagaccuccgucuugcugccaaugcaauuuguagugcugugcccucucacugggucccuaccagcagaacuacaugguccauacaugccacccacgaguggaugacuaccgaggauaugcugacaguguggaaccgcguuuggauccaagaaaauccauggauggaggacaagacgcccguggaaucaugggaggaaauuccuuaucuaggaaaacgggaggaucaguggugcggcagucugaucggucucaccucuagggcaacuugggccaagaacauucagacagcgaucaaucagguccgcagcuugauagggaacgaggaauacaccgacuacaugccauccaugaaacgauuccggagggaggaagaggaagcuggagugcugugguga

SEQ ID NO: 14948 - RNA, 9876 nt, Artificial Sequence
  derived and/or modified CDS sequence (opt3) from DENV-2__KC762663__SS-prME
accgccggaaucauuauaaugaugauccccaccgugauggcuuuccaccugacuacgagaaacggggaaccucauaugauugucagcaggcaggaaaagggaaaaucccuccuuuuuaagaccgaaaaugguguuaacaugugcacacugauggcaauggacuugggcgaauuaugugaggauacuaucaccuacaauugcccacugcuacggcaaaacgaaccggaggacauugauuguuggugcaauucuacaucaaccugggugacuuaugggacauguaccgccacgggagagcaccgccgagaaaaacguaguguagcgcucgugccccaugucggcaugggucuggagacuagaaccgaaacauggaugagcuccgagggggcuuggaagcacgcccagaggaucgagacuugggugcuucggcauccuggauucaccauaauggcagccauccuggcuuacacaauuggcaccacguauuuucagcgcguuuugaucuucauucuccugacugcagugacaccaucuaugaccaugagaugcaucggcauaucgaacagggacuuugucgaaggggugucaggagguagcuggguagauauuguucuggagcacggcaguugugugacuacaauggccaaaaauaagcccacccucgacuucgaauuaaucaagacggaggcuaaacacccugccacccugcggaaguacugcauugaagcgaaacuuacaaacacuaccacagcaucccgcuguccaacucagggggagcccucuuugaaugaggaacaagauaagcgauuugucugcaaacauagcaugguggacagaggauggggcaacgguugugggcuguucggaaagggcggcaucgugaccugcgccauguuuacaugcaagaaaaauauggaggggaagaucguccagccugaaaaccuagaguauaccauuguuauaacuccacacuccggagaagagaaugcuguggguaacgauacgggcaaacaugggaaggagaucaaaguaacaccgcagucaaguauuaccgaagccgagcucacuggauacggcaccgugacaauggaauguagccccaggaccggucuggacuucaaugagaugguccuucugcagauggaaaacaaggcaugguuggugcaccggcaaugguuucucgaucugccuuuaccauggcugcccggggcugacacucagggcucuaacuggauccagaaagagacacucguuacguucaagaauccucacgccaagaaacaggauguggucgugcuuggaucccaagagggcgcgaugcauaccgcccugacuggggcaacagaaauacagaugucaagcggaaacuugcuauuuaccggucaccugaagugccgucuccgcauggacaaacugcagcuuaagggcaugaguuauucuauguguacagggaaauucaagguaguuaaggagauugcugaaacucaacauggaaccaucgugaucagaguccaguacgagggcgacgguuccccaugcaaaauucccuucgagaucacggaucuggaaaagaggcacguguuggggcggcucauuaccgucaauccgauagugacagagaaagacagcccuguuaacaucgaagccgagcccccauuuggcgauucguacauuaucaucggaguggaaccuggccagcugaaguuaucuugguucaaaaagggguccucaauuggacagauguuugagacuaccaugcgaggugcuaagcgcauggccauacugggcgacacagcaugggauuucgggagucuaggaggcguauuuacuagcaucgguaaagcccuccaucaagucuucggggcuauuuauggcgcggcauuuuccggagugucuuggaccaugaagauccugauuggcguugugaucacguggauagggaugaauagcagaucaacaagucuuuccgucagcuuggugcugguaggagugguuacccucuaccugggcgucauggugcaggccgacucugguuguguggucucauggaaaaacaaggagcuuaaaugcgggaguggaaucuucauuacugauaauguucacacauggaccgaacaguauaaguuucagcccgagagcccauccaagcuggcuucugccauccaaaaagcacacgaagagggcauuugugguaucaggucggugacucgguuggaaaaccucauguggaagcagauaacccccgagcugaaucauauuuuaagcgagaacgaagugaaacugacaaucaugacgggcgacauuaaggggaucaugcaggccggaaaacgcucccuaagaccucagccaaccgagcucaaguacucauggaaaacuuggggcaaggcuaagaugcugaguacagaacuucacaaucauaccuucuugauagaugggccggagacagccgaaugccccaacgcaaauagggcguggaacucucuggagguagaggacuauggauuuggcgucuucacuaccaauaucuggcucaaacugaaggaacgucaagaugcuuuuugugacagcaaauuaauguccgccgcaauuaaggacaaccgggccgugcacgcugauauggguuacuggaucgagucagcccugaacgacacguggaaaauugaaaaggccagcuucaucgagguuaagucuugccacuggccuaaaucccauacacuuuggaguaaugggguguuggagagcgaaaugauaauuccaaagaacuucgcuggacccgucucucagcacaauuaucgaccuggcuaccauacccagacugccgguccauggcaccucggcagacuggagauggauuuugacuucugugaagggaccacagugguugugacugaggauugcggaaacaggggccccucccuacgcaccacaacggcgucagggaaacugaucaccgaauggugcugucggaguugcacucucccgccucugagauacaggggagaggacggcuguugguaugguauggagauccgcccacuuaaggaaaaagaggaaaauuugguaaacagccuggucacagccgggcauggacagauugauaauuuuucguuaggcgugcucgguauggcucuguuccuugaggaaaugcugcgaacccgggugggcacuaagcacgcaaucuugcucgucgccguuuccuuugugacacugauuaccgggaacaugucuuuccgugaccuaggaagaguaauggugauggucggcgcuacgaugacugaugacauagggaugggagugaccuaccuggcccuccuggcagcguuuaagguuaggcccacauucgccgcuggccuuuugcugcgcaaauuaaccagcaaggagcucaugaugacuacaaucgguauuacccugcuuucacaaaguacaaucccugagacuauucuggaacuaaccgaugcccucgcacuggggaugaugguguugaaaaucguccggaauauggagaaguaucagcuggcugugacgauaauggccaucuuaugcguucccaacgcagugauucuccagaaugccuggaaagucuccuguacaacccuggcuguagugucuguuagcccacuucuguugacuuccucacaacagaaggcggacuggaucccucucgcccugaccauuaagggacuaaaccccacagcaaucuuucugacuacccuuagcagaacgaguaaaaagaggucuuggccacucaaugaagcuauaauggccgugggcauggucuccauucuggccagcucguugcugaaaaacgauaucccgaugacaggcccuuuaguggcugggggacuccugaccguaugcuacgugcuuacuggucgaucagcagaccuggaguuggaacgcgccgcggacguccggugggaggagcaggcugaaaucucuggcaguucccccauucucagcauaacaaucucugaggaugggagcauguccauuaagaaugaagaggaggaacagacccugacuauccuaauuagaacaggacugcuuguuaucucaggccucuucccagugaguauacccaucaccgccgcagccugguaucugugggaggugaaaaagcaaagggcuggugucuugugggacgugccuagcccacccccuguugaaaaagcagaguuagaagauggggccuaccguauuaagcagaagggaauccugggcuauucucagauuggcgcggggguauacaaagagggaacguuucacacuauguggcaugugacccgcggugcuguccucaugcacaagggcaaacggaucgagccguccugggccgacgugaagaaagaucugauaucauacgggggaggcuggaaacuugaaggugaguggaaggaaggggaggaaguucaggugcuggcauuggagccaggcaagaaccccagagccguccaaacaaagccuggccuauucaaaaccaguacaggcacuauuggggcugugagccuggacuuuuccccaggaaccucugguucgcccaucguagauaagaaaggcaaggucguggggcucuauggaaacggcguugugacgaggagcgguacauacgucucagccaucgcacagacugagaaguccauugaagacaauccugagaucgaagaugacauauucaggaagaaacggcugaccauuauggaucuucauccgggggcuggaaaaacaaaacgcuauuuacccgccaucgugagagaggcgauuaaaaggggccugcggacccucaucuuggccccaacucgaguuguggcagcugaaauggaggaggcccugagaggccucccuauacgcuaccagacccccgcuauuagggcagaacacacagggcgugagaucgucgaccugaugugucaugccacguucacuaugcggcuucugaguccaaucagagugccuaacuauaauuugauuaucauggaugaagcccacuuuaccgaccccgcuucuauugcggcaaggggauacauaagcacacgcguagagaugggugaggccgcuggcaucuucaugaccgccacuccaccggggucccgagacccuuuuccccagucaaacgcaccaauuauggaugaagagagagaaauccccgagcggucuuggaauagcggacacgaaugggugacagacuucaagggcaagaccguuugguuugucccuaguaucaaagccgguaacgauauugcugcgugccuaaggaagaaugggaaaaaggugauacaacugucccgcaaaacguucgacuuugaguauaucaagacucguacaaacgauugggacuucguggucaccaccgauauuagcgagaugggagccaauuuuaaggcagaaagaguaaucgacccacggagguguaugaaacccgugauucucacugauggcgaggaacgcguuaucuuagcuggcccuaugccggugacacauucuucagccgcacagcgaagagggcgggucggaaggaacccaaagaaugagaacgaccaguacauauacaugggugaaccccuggagaaugaugaggacugcgcccacuggaaagaagcuaagaugcuucuggacaacaucaauaccccugagggcauuauccccuccauguucgaaccagagcgcgaaaaaguggaugccauugacggggaguauagacucaggggagaggcgcggaagacauuuguugauuugaugcgucgcggcgaccugccuguguggcucgcauaccgagucgccgcugaagguaucaacuaugccgauagaaggugguguuucgacggggugaaaaacaaucaaauacuggaggaaaacguagagguggagauuuggacuaaggaaggcgagcggaagaaacuuaagccccgcuggcuagaugcuagaaucuacagugacccacuggcauugaaagaguucaaggaguuugccgcuggaagaaagagcuuaacgcugaaucucauuaccgaaaugggccggcugccuacauucaugacucagaaggcccgaaacgcacuugauaaucuggcgguucuccauaccgccgaggcugggggacgagcauauaaccacgcauugucggagcugccggaaacacuagagacccugcuccuucugacuuuauuggcuacggucaccgguggcaucuuucuguuccucaugucugggaagggaauaggcaaaaugacacuggguaugugcugcaucauuacugccuccauccuucugugguacgcacagauucagccccacuggaucgccgcuagcauaauucucgaauuuuucuugaucgugcuguuaaucccagagccugaaaagcaacgcacaccccaggacaaucagcuaacauauguggucauugcgauccugaccguuguggccgcaacuauggcuaacgagaugggguuucucgagaaaacaaagaaagauuucggccuuggaucaauaacgacccagcaaccagaaaguaauauucuggacaucgauuugaggccugccucugccuggacucuguacgcaguagcuacaaccuuuauuacccccaugcuccggcauuccaucgagaacagcucagugaaugucagucugacagccauagcgaaccaggcuacugugcuuaugggccucgggaagggauggccgcugagcaagauggacaucgguguuccauugcuggccauuggcuguuacucccaggugaauccuaucacguuaaccgcagcccuacugcuccuugucgcucacuaugcaauuaucgggcccggacugcaggccaaagcgacacgugaagcucaaaagagagccgcagccggcauuaugaaaaacccaacuguagacgguaucaccgugauagauuuggaccccauuccuuacgauccgaaguucgagaaacagcuggggcagguuaugcuccuggugcuuugcgucacacagguguuaaugaugaggaccacuugggcucugugugaagcccucacguuggcaacaggccccaucucuacccugugggagggaaauccaggccgcuuuuggaacacuaccaucgcugucagcauggccaauauuuuccggggguccuaucuagcgggagccggccugcucuuuucaauaaugaagaacacagcaaacacucgaagagguaccgggaauacaggagagacgcuuggcgaaaaguggaaaaacaggcugaaugcuuuggguaagucugaguuccaaaucuacaaaaagaguggcauucaggaaguggaccgcacccuggccaaagaggggaucaagcggggagagacugaucaucacgcaguuucgagaggcagcgcuaaacuccguugguucguggaaaggaaccugguaacaccugaggggaagguggucgacuuaggaugcggccggggugggugguccuauuacuguggaggccuuaagaauguuaaagaagugaagggucugaccaaaggcgggcccggacaugaggaaccuauuccaaugucuacuuauggcuggaaccucguccgccuacagucagggguggauguauuuuucacacccccugagaagugcgacacccuguugugugauaucggagagagcuccccaaaucccacgguggaagccggccgaacccugagaguucucaaccuuguggagaauuggcugaacaauaacacacaauuuugcauaaaagucuugaauccguacaugccuagugugaucgaaaagauggaggcccugcagaggaaguacgguggggcgcucguccggaacccauuaucucgcaauagcacucacgaaauguauugggugucaaacgcuuccggaaacauuguuaguagcguaaauaugaucucuagaaugcugauuaacagguucaccaugcgacacaaaaaggcaacauacgagcccgacguggaucuuggcuccggcacucggaauaucgggauagagucagaaaccccuaaccuggacauuaucggaaaacguaucgagaagauuaaacaggaacaugagacaagcuggcacuaugaucaggaccauccauacaagaccugggccuaucacgguucguacgaaacuaagcaaacgggcucugcuaguuccauggucaauggggugguuagacuacucacaaaacccugggacgugauaccgauggucacccagauggccaugacugauaccacaccuuuuggacagcagcgcguguucaaggagaaaguagacacgaggacccaagagcccaaggaaggcacuaaaaagcugaugaagaucacagcagagugguuguggaaagaacuggguaagaaaaagaccccacggauguguacuagagaggaguuuacacgcaaagugaggagcaacgccgcucucggggcgauuuucaccgaugaaaauaaguggaaaucagcccgagaggcaguugaagacuccggauuuugggagcuugucgauaaggaacggaaccugcacuuagagggcaagugcgagacauguguguauaauaugaugggcaaaagagaaaagaaacugggggaguucggaaaggcuaaagguucuagggccaucugguacaugugguugggcgcacgcuuucucgaguucgaggcccugggguuucuaaacgaagaccauugguucagccgugagaauagucuuuccggaguggagggcgaaggucugcacaagcucggguacauucugcgggaugucagcaagaaagagggaggcgcuauguaugccgacgauacugcgggcugggacaccagaaucacguuggaagaucugaagaacgaggaaaugguuaccaaucauauggagggggagcacaaaaagcucgcagaagccauauucaaacuuacauaccagaacaaggugguaagggugcagcgcccuacuccccgaggaaccgucauggacaucauuucucggagagaccagagggguucaggccaagugguuacauaugggcugaauacuuuuaccaacauggaggcucaguuaauccgccagauggaaggagagggcguguucaagaguauucaacagcugacggucacagaggaaaucgccgugaaaaacugguugguaaccguugguagagagcggcucuccaggauggcaauuagcggggaugacugcguggucaagccacuggaugaccguuuugcuucugcccuaacugcucuuaaugauaugggaaaagugcgaaaggacauacagcagugggaacccucgcgcggcuggaacgauuggacacaagugccuuucugcucacaucacuuucacgagcugaucaugaaagacggcagaguccucguugugccaugucggaaucaggaugaacugauugggagggcccgcaucagccagggagcagguugguccuugagagagaccgcgugcuuaggcaagaguuacgcccagauguggucucugauguauuuccaucggagggaccuccgacuugcugccaacgcaaucuguagcgcuguaccgucccacugggugcccacuucacguaccacauggaguauucaugccacgcacgaguggaugaccacugaagauaugcugacagucuggaauagaguguggauacaagagaacccuuggauggaagacaagaccccaguugagucuugggaagagauccccuaccuagggaaacgcgaggaucaguggugcggaagccugauuggccucacuucccgggcaacaugggccaagaauauccagaccgcgauuaaccaggugaggucauugaucgguaaugaagaguauacggacuacaugccuagcaugaaaagauuucgccgggaagaggaagaggcugggguccugugguga

SEQ ID NO: 14949 - RNA, 9876 nt, Artificial Sequence
  derived and/or modified CDS sequence (opt3) from DENV-2__KC762675__SS-prME
accgccggcaucauuauaaugaugauccccacagugauggcuuuccaccugacuacgagaaacggggagccucauaugauugucagcaggcaggaaaagggaaaaucccuccuuuuuaagaccgagaaugguguuaacaugugcacacugauggcaauggacuugggcgaauuaugugaggauacuaucaccuacaauugcccacugcuacggcaaaacgaaccggaggacauugauuguuggugcaauucuacaucaaccugggugacuuaugggacauguaccgccacgggagagcaccgccgagaaaaacguaguguagcgcucgugccccaugucggcaugggucuggagacuagaaccgaaacauggaugagcuccgagggggcuuggaagcacgcccagaggaucgagacuugggugcuucggcauccuggauucaccauaauggcagccauccuggcuuacacaauuggcaccacgcacuuucagcgcguuuugaucuucauucuccugacugcaguggccccaucuaugacaaugagaugcaucggcauaucgaacagggacuuugucgaaggggugucaggagguagcuggguagauauuguucuggagcacggcaguugugugaccacuauggcuaaaaauaagcccacacucgacuucgaauuaaucaagaccgaggccaaacauccugcgacgcugcggaaguauugcauugaagcaaaacuuaccaacacaacuaccgccucccgcuguccaacacagggggagcccucuuugaaugaggaacaagauaagcgauuugucugcaaacacagcaugguggacagaggauggggcaacgguugugggcuguucggaaagggcggcaucgugacuugcgcuauguuuaccugcaagaaaaauauggaggggaagaucguccagccugaaaaccuagaguacacaauuguuauaaccccacauuccggagaagagaaugccguggguaacgauacuggcaaacacgggaaggagaucaaaguaacgccgcagucaaguauuacagaagcagagcucaccggauauggcacugugaccauggaauguagccccaggacaggucuggacuucaaugagaugguccuucugcagauggaaaacaaggcuugguuggugcaccggcaaugguuucucgaucugccuuuaccauggcugcccggggccgacacccagggcucuaacuggauccagaaagagacucucguuacauucaagaauccucaugcgaagaaacaggauguggucgugcuuggaucccaagagggcgccaugcacacggcacugaccggggcuacugaaauacagaugucaagcggaaacuugcuauuuacaggucaucugaagugccgucuccgcauggacaaacugcagcuuaagggcaugaguuacucuauguguaccgggaaauucaagguaguuaaggagauugccgaaacacaacacggaacuaucgugaucagaguccaguaugagggcgacgguuccccaugcaaaauucccuucgagaucauggaucuggaaaagaggcauguguuggggcggcucauuaccgucaauccgauagugacggagaaagacagcccuguuaacaucgaagcugagcccccauuuggcgauucguacauuaucaucggaguggaaccuggccagcugaaguuaucuugguucaaaaagggguccucaauuggacagauguuugagaccacaaugcgaggugccaagcgcauggcaauacugggcgacacugccugggauuucgggagucuaggaggcguauuuaccagcaucgguaaagcucuccaccaagucuucggggcgauuuacggcgcagccuuuuccggagugucuuggacaaugaagauccugauuggcguugugaucacuuggauagggaugaauagcagaucaaccagucuuuccgucagcuuggugcugguaggagugguuacgcucuaucugggcgucauggugcaggcugacucugguuguguggucucauggaaaaacaaggagcuuaaaugcgggaguggaaucuucauuacagauaauguucacaccuggacugaacaguacaaguuucagcccgagagcccauccaagcuggccucugcaauccaaaaagcccaugaagagggcauuugugguaucaggucggugacacgguuggaaaaccucauguggaagcagauaacccccgagcugaaucacauuuuaagcgagaacgaagugaaacugacuaucaugaccggcgacauuaaggggaucaugcaggcuggaaaacgcucccuaagaccucagccaacagagcucaaguauucauggaaaacguggggcaaggccaagaugcugaguaccgaacuucauaaucacacuuucuugauagaugggccggagacagcagaaugccccaacaccaauagggcguggaacucucuggagguagaggacuacggauuuggcgucuucacaacuaauaucuggcucaaacugaaggaacgucaagauguguauugugacagcaaauuaauguccgcugccauuaaggacaaccgggcaguucacgccgauauggguuacuggaucgagucagcucugaacgacaccuggaaaauugaaaaggccagcuuuaucgaggugaagucuugcuauuggccuaaaucccauacgcuuuggaguaauggggucuuggagagcgaaaugauaauuccaaagaacuucgcaggacccgugucucagcacaauuaccgaccuggcuaccauacacagaccgcugguccauggcaccucggcagacuggagauggauuucgacuuuugugaagggacuaccguugugguaacagaggauugcggaaacaggggccccucccuacgcacuaccacagccucagggaaacugaucacggaauggugcugucggaguugcacccucccgccucugagauauaggggagaggacggcuguugguacgguauggagauccgcccacuuaaggaaaaagaggaaaauuuggucaacagccuggugacugcggggcauggacagauugauaauuucucguuaggcgugcucgguauggcccuguuucuugaggaaaugcugcgaacacgggucggcaccaagcacgcuaucuugcucguugcaguguccuucguaacucugauuacagggaacaugucuuuucgugaccuaggaagagugauggucauggugggcgccaccaugacggaugacauagggaugggaguuacuuaucuggcucuccuggccgcauucaaggugaggcccaccuuugcggccggccuuuugcugcgcaaauuaacaagcaaggagcucaugaugaccacuaucgguauuguccugcuuucacaaaguacaaucccugagaccauucuggaacuaacagaugcucucgcccuggggaugauggcauugaaaaucgugcggaauauggagaaguaccagcuggcuguuacuauaauggccaucuuaugcgugcccaacgcagucauucuccagaaugccuggaaaguauccuguaccacgcuggcugugguuucugugagcccacuucuguugacauccucacaacagaaggcggacuggaucccucucgcccugaccauuaagggacuaaaccccacugcaaucuuccugaccacacuuagcagaacuaguaaaaagaggucuuggccacucaaugaagcuauaauggccgucggcaugguguccauucuggccagcucguugcugaaaaacgauaucccgaugaccggcccuuuaguagcugggggacuccugacggugugcuauguccuuacaggucgaucagcagaccuggaguuggaacgcgccgcggacguucggugggaggagcaggcugaaaucucuggcaguucccccauucucagcauaaccaucucugaggaugggagcauguccauuaagaaugaagaggaggaacagacucugacaauccuaauuagaaccggacugcuugugaucucaggccucuuuccagugaguauacccaucacugccgcagccugguaccugugggaggucaaaaagcaaagggcugguguguugugggacguuccuagcccacccccuguagggaaagcagaauuagaggauggagccuaucguauuaagcagaagggcauccugggcuacucucagauuggggcgggaguguacaaagaagguacauuccacaccauguggcaugucacgcgcggcgcugugcucaugcacaaggggaaacggaucgagccguccugggccgacguuaagaaagaucugauaucauauggaggcgguuggaagcuugagggggaauggaaggagggagaagaggugcagguccuggcauuggaaccaggcaaaaaccccagagccgugcaaacuaagccuggccuauuuaaaaccaacacagggaccauuggagcuguaagucuggacuucagcccagguacauccggcucucccaucgucgauaagaaagggaaggugguuggacucuacggcaaugguguggucacuaggucggggaccuaugugagcgccaucgcacagacggagaagucaauugaggacaacccugaaaucgaggaugacauauuucgaaaaaagcggcugacaauuauggaucuucauccgggagcuggcaaaacuaagcgcuacuuacccgccaucguuagagaagcgauuaaaaggggccugcggacccucaucuuggccccaacacgaguggucgcagcugagauggaagaggcccugagagggcucccuauacgcuaucagacccccgcuauuagggcagagcacacuggacgugaaaucguggaccugaugugucaugccaccuucacaaugcggcuucuguccccaaucagaguaccuaauuacaacuugauuaucauggaugaggcccacuucacggaccccgcuaguauugcggcaagggguuauauaucuacucgcguggaaaugggcgaggccgcugggaucuuuaugaccgccacaccaccgggaagccgagacccuuucccccaguccaaugcaccaauuauggaugaggaaagagagauccccgaacggucauggaacucuggccacgaguggguuaccgacuuuaaggguaagacugucugguucgugccuagcaucaaagccgggaaugauauugcugcgugccuaaggaagaacggaaaaaaggugauacaacugagucgcaaaacauuugacuucgaauacaucaagacccguacgaaugauugggacuuugucguaacuacagauauuuccgagaugggcgccaacuucaaggcagagagagugaucgacccacggagguguaugaaacccguuauucucaccgauggcgaagagcgcgugaucuuagcugggccuaugccggucacccauagcucugccgcacagcgaagaggacggguggguaggaauccaaagaacgaaaaugaccaguacauauauaugggcgagccccuggaaaacgaugaggacugcgcccacuggaaagaggcuaagaugcuucuggacaauaucaacacuccugaagggauuauccccucaauguuugagccagaacgcgagaaaguugaugccauugacggagaauacagacucaggggcgaggcgcggaagacauucguggauuugaugcgucgcggugaccugccugucuggcucgcauaucgaguggccgcugaggggaucaacuacgccgauagaaggugguguuuugacggcguaaaaaauaaccaaauacuggaagagaauguggaaguugagauuuggaccaaggagggagaacggaagaaacuuaagccccgcuggcuagaugcuagaaucuauuccgacccacuggcauugaaagaguucaaggaauucgccgcuggcaggaaaaguuuaacacugaaccucauuacugagauggggcggcugccuacguuuaugacccagaaggcccgaaaugcacuugauaaccuggcgguccuccauacagccgaagcuggagguagagccuacaaucacgcauugagcgagcugccggagacucuagaaacccugcuccuucugacauuauuggcuaccgugacuggcgggaucuuccuguuucucaugucgggaaagggcauagguaaaaugacgcuggggaugugcugcaucauuaccgccucuauccuucugugguaugcacagauucagccccacuggaucgccgcuuccauaauucucgaguucuuuuugaucgugcuguuaaucccagaaccugagaagcaacgcacaccccaggacaaccagcuaacuuacgucguuauugcgauccugaccgugguagccgcaacaauggcuaaugaaaugggcuuccucgagaaaaccaagaaagauuuuggacuuggcagcauaacuacacagcaaccagagucaaacauucuggacaucgauuugaggccugccagugccuggacgcuguacgcaguggcuaccacuuucauuacacccaugcuccggcauucuaucgaaaauuccagcgucaacgugucacugaccgccauagcgaaucaggcuaccguucuuauggggcucggaaaggguuggccgcugaguaagauggacaucggcgugccauugcuggccauuggguguuauagccaggucaacccuaucacauuaacugcagcccuacugcuccuuguagcucacuacgcaauuaucggacccggccugcaggccaaagcgacgcgugaggcucaaaagagagccgcagccgguauuaugaaaaauccaaccguggacgggaucacaguuauagauuuggaccccauuccuuaugauccgaaguuugaaaaacagcugggccaggugaugcuccugguccuuugcgugacucaggucuuaaugaugaggaccacaugggcucugugugaggcccucaccuuggcaacuggacccaucuccacgcugugggaaggcaacccagggcgcuucuggaauacaaccaucgcugugucuauggccaacauuuuucggggaagcuaccuagcgggcgccggucugcucuucuccauaaugaagaacacugcaaauacccgaagagggacaggaaacacuggcgagacccuuggugagaaguggaaaaauaggcugaacgcuuugggcaagucagaauuucaaaucuauaaaaagucugggauucaggagguugaccgcacacuggccaaagaaggaaucaagcggggcgagacggaucaucacgcagugaguagagggucggcuaaacuccguugguucguagagaggaaucuggugaccccugaaggaaaggucguugacuuaggcugcggucgggggggauggagcuacuauuguggcggucuuaagaacgugaaagaggucaagggccugacuaaagggggacccggccaugaagagccuauuccaauguccacauacggguggaaucucgugcgccuacagucuggaguagauguguucuuuacccccccugaaaagugcgacacucuguugugugauaucggcgagucaagcccaaaccccacaguugaggccggucgaacccugagagugcucaaucuugucgaaaacuggcugaauaacaauacgcaauucugcauaaaaguguugaacccguacaugccuuccgucaucgagaagauggaagcccugcagaggaaguaugggggagcgcucgugcggaauccauuaagucgcaacucuacccacgagauguacuggguuagcaacgcuucaggcaauauuguauccagugugaacaugaucagcagaaugcugauuaauagguuuacaaugcgacacaaaaaggcaacuuaugaacccgacgucgaucuuggcucugggacccggaacaucggaauagaguccgagauuccuaaucuggacaucaucgguaaacguauugaaaagauacagcaggagcaugaaacaucauggcacuacgaucaagaccauccauauagaacuugggccuaccacggcagcuaugagaccaaacagacagggucggcuucuaguauggugaacggaguugugcgccuacucaccaagcccugggacgucaucccgauggugacucagauggccaugacggauacaaccccuuucggccagcaaaggguauuuaaggaaaaaguggacacucggacccaggagcccaaggaggguacaaaaaagcugaugaaaauuacggcagaaugguuguggaaggagcuggggaagaaaaagaccccaagaauguguacucgcgaagaguucacaaggaaaguucgauccaaugccgcucucggagcgaucuuuaccgaugagaacaaguggaaaagcgcccgggaagcagucgaggacucaggcuucugggaacuuguggauaaggagagaaaucugcacuuagaaggcaaaugcgagacuuguguguacaacaugauggggaagagggagaagaaacugggagaauuugguaaggcuaaaggcucccgcgccauuugguacaugugguugggggcacguuuccucgaguuugaagcccugggauuccuaaaugaggaccauugguuuucucgggaaaacagccuuaguggcgucgagggugaggggcugcacaagcucggauauauccugagagauguuuccaaaaaggaaggcggcgcuauguacgccgacgauacagcggggugggacaccaggauaacauuggaggaucugaagaaagaagagauggugacuaaucauauggaaggagagcacaagaaacucgcagaggccaucuucaagcuuaccuaucagaacaaaguagugcgcguccagcgaccuacgccccgggguaccgugauggacauuaucagcagaagggaccaacgcggcucugggcagguugugacauacggacugaauacuuucaccaacauggaagcucaguuaauuagacaaauggagggcgaaggugucuuuaagucaauccagcagcugacagugacugaggagauugccguaaagaacugguugguucggguggggagggaacgucucagucgaauggcaauauccggagaugacugcgucgugaaaccacuggaugaccgcuucgcuagcgcccuaaccgcucuuaaugauaugggcaaggugagaaaagacauccagcaaugggagcccucucggggcuggaacgauuggacgcaggucccuuuuugcucgcaucacuuccacgaacugauuaugaaggacgggaggguucucgugguaccaugucgcaaucaggaugagcugaucggaagagcccggaucucacagggugcaggcuggagcuugagggaaacagcgugcuuagggaaauccuaugcccaaauguggagucugauguacuuucaucgacgugaccucagacuugcugccaacgcaauuuguucugcugugccgagccacuggguccccaccucccgcacuacauggucaauacaugccacccacgaguggaugacuaccgaggauaugcugacaguguggaaucggguuuggauccaggaaaacccuuggauggaggacaagacgccaguggaaaguugggaggaaauucccuaucuaggaaagagggaggaucaguggugcggcucucugaucggucucaccagcagagcaacuugggccaaaaauauucagacagcgaucaaccaaguccgcuccuugauagggaaugaggaauacaccgacuacaugccuucaaugaagcgguucaggcgagaggaagaggaagcuggagugcugugguga

SEQ ID NO: 14950 - RNA, 9876 nt, Artificial Sequence
  derived and/or modified CDS sequence (opt3) from DENV-2__KC762671__SS-prME
accgccggcaucauuauaaugaugauccccacagugauggcuuuccaccugacuacgagaaacggggagccucauaugauugucagcaggcaggaaaagggaaaaucccuccuuuuuaagaccgagaaugguguuaacaugugcacacugauggcaauggacuugggcgaauuaugugaggauacuaucaccuacaauugcccacugcuacggcaaaacgaaccggaggacauugauuguuggugcaauucuacaucaaccugggugacuuaugggacauguaccgccacgggagagcaccgccgagaaaaacguaguguagcgcucgugccccaugucggcaugggucuggagacuagaaccgaaacauggaugagcuccgagggggcuuggaagcacgcccagaggaucgagacuugggugcuucggcauccuggauucaccauaauggcagccauccuggcuuacacaauuggcaccacguauuuucagcgcguuuugaucuucauucuccugacugcaguggccccaucuaugacaaugagaugcaucggcauaucgaacagggacuuugucgaaggggugucaggagguagcuggguagauauuguucuggagcacggcaguugugugaccacuauggcuaaaaauaagcccacacucgacuucgaauuaaucaagaccgaggccaaacacccugcgacgcugcggaaguacugcauugaagcaaaacuuaccaacacaacuaccgccucccgcuguccaacacagggggagcccucuuugaaugaggaacaagauaagcgauuugucugcaaacauagcaugguggacagaggauggggcaacgguugugggcuguucggaaagggcggcaucgugacuugcgcuauguuuaccugcaagaaaaauauggaggggaagaucguccagccugaaaaccuagaguauacaauuguuauaaccccacacuccggagaagagaaugccguggguaacgauacuggcaaacaugggaaggagaucaaaguaacgccgcagucaaguauuacagaagcagagcucaccggauacggcacugugaccauggaauguagccccaggacaggucuggacuucaaugagaugguccuucugcagauggaaaacaaggcuugguuggugcaccggcaaugguuucucgaucugccuuuaccauggcugcccggggccgacacccagggcucuaacuggauccagaaagagacucucguuacauucaagaauccucacgcgaagaaacaggauguggucgugcuuggaucccaagagggcgccaugcauacggcacugaccggggcuacugaaauacagaugucaagcggaaacuugcuauuuacaggucaccugaagugccgucuccgcauggacaaacugcagcuuaagggcaugaguuauucuauguguaccgggaaauucaagguaguuaaggagauugccgaaacacaacauggaacuaucgugaucagaguccaguacgagggcgacgguuccccaugcaaaauucccuucgagaucauggaucuggaaaagaggcacguguuggggcggcucauuaccgucaauccgauagugacggagaaagacagcccuguuaacaucgaagcugagcccccauuuggcgauucguacauuaucaucggaguggaaccuggccagcugaaguuaucuugguucaaaaagggguccucaauuggacagauguuugagaccacaaugcgaggugccaagcgcauggcaauacugggcgacacugccugggauuucgggagucuaggaggcguauuuaccagcaucgguaaagcucuccaucaagucuucggggcgauuuauggcgcagccuuuuccggagugucuuggacaaugaagauccugauuggcguugugaucacuuggauagggaugaauagcagaucaaccagucuuuccgucagcuuggugcugguaggagugguuacgcucuaccugggcgucauggugcaggcugacucugguuguguggucucauggaaaaacaaggagcuuaaaugcgggaguggaaucuucauuacagauaauguucacaccuggacugaacaguauaaguuucagcccgagagcccauccaagcuggccucugcaauccaaaaagcccacgaagagggcauuugugguaucaggucggugacacgguuggaaaaccucauguggaagcagauaacccccgagcugaaucauauuuuaagcgagaacgaagugaaacugacuaucaugaccggcgacauuaaggggaucaugcaggcuggaaaacgcucccuaagaccucagccaacagagcucaaguacucauggaaagccuggggcaaggcaaagaugcugaguacggaacuucacaaucauaccuucuugauagaugggccggagacugcggaaugccccaacacaaauagggcuuggaacucucuggagguagaggacuauggauuuggcgucuucaccacaaauaucuggcucaaacugaaggaacgucaagauguguuuugugacagcaaauuaauguccgccgcaauuaaggacucacgggccguucacgcugauauggguuacuggaucgagagcgcccugaacgacacuuggaaaauugaaaaggcaucuuucaucgaggugaaguccugccacuggccuaaaagucauacccuuuggagcaacggggucuuggagucugaaaugauaauuccaaagaauuucgcuggacccgugucccagcacaacuaucgaccuggcuaccauacgcagacagccgguccauggcaccucggcagacuggagauggauuuugacuucugugaagggaccacuguugugguaaccgaggauugcggaaauaggggccccucacuacgcacaacuaccgcgagugggaaacugaucacagaauggugcugucggagcugcacgcucccgccucugagauacaggggagaggacggcuguugguaugguauggagauccgcccacuuaaggaaaaagaggaaaacuuggucaauucgcuggugaccgccgggcauggacagauugauaacuuuuccuuaggcgugcucgguauggcucuguuccuugaggaaaugcugcgaacucgggucggcacaaagcacgcaaucuugcucguugccgugucuuuuguaacccugauuacugggaauaugagcuuccgugaccuaggaagagugauggucauggugggcgcuacaaugaccgaugacauagggaugggaguuacguaccuggcccuccuggcagcguuuaaggugaggcccacuuucgccgcuggccuuuugcugcgcaaauuaaccucaaaggagcucaugaugacaaccaucgguauuguccugcuuagucaagccacuaucccugagacaauucuggaacuaaccgaugcacucgcucuggggaugaugguguugaaaaucguucggaacauggagaaguaucagcuggccgugacaauaauggcaaucuuaugcguccccaaugccguaauucuccagaacgcuuggaaaguguccuguacuacccuggcgguugugucugucagcccacuucuguugacguccucacaacagaaggccgacuggaucccucucgcacugacaauuaagggacuaaaucccaccgcuaucuuucugacuacccuuagcagaacaaguaaaaagaggucuuggccacucaacgaagccauaauggccgugggcaugguauccauucuggcuagcucguugcugaaaaaugauaucccgaugacuggcccuuuaguggcagggggacuccugaccgucugcuacguucuuacgggucgaucagccgaccuggaguuggaacgcgcggcugacgugcggugggaggagcaggccgaaaucucuggcaguucccccauucucagcauaacaaucucugaggaugggagcauguccauuaagaacgaagaggaggaacagacccugacuauccuaauuagaacaggacugcuugugaucucaggccucuucccagucaguauacccaucaccgcagccgcuugguaucugugggaggugaaaaagcaaagggcagguguuuugugggacguaccuagcccacccccuguggggaaagccgaauuagaggauggagcguaccguauuaagcagaagggcauccugggcuauucucagauuggggcuggagucuacaaagaagguacuuuucacacaauguggcaugugacccgcggcgccguucucaugcacaaggggaaacggaucgagccguccugggcagacgugaagaaagaucugauaucauacggaggcgguuggaagcuugagggggaauggaaggagggagaagagguccaggugcuggccuuggaaccaggcaaaaaucccagagcuguacaaacgaagccuggccuauucaaaacuaacaccgggacaauuggagccgucagucuggacuuuagcccagguaccuccggcucucccaucguggauaagaaagggaagguugugggacucuauggcaacggugucgugacaaggucggggacuuacguuagcgcaaucgcucagaccgagaagucaauugaggacaauccugaaaucgaggaugacauauuccgaaaaaagcggcugacgauuauggaucuucauccgggagccggcaaaacaaagcgcuauuuacccgcgaucgugagagaagccauuaaaaggggccugcggacucucaucuuggcaccaacccgagucguggcugccgagauggaagaggcucugagagggcucccuauacgcuaccagacacccgcaauuagggccgagcacaccggacgugaaaucguagaccugaugugucaugccacuuucaccaugcggcuucuguccccaaucagagugccuaacuauaauuugauuaucauggaugaggcucacuuuacagaccccgcgaguauugcagccagggguuacauaucuacgcgcguugaaaugggcgaggcugccgggaucuucaugacugcaaccccaccgggaagccgagacccuuuuccccaguccaacgccccaauuauggaugaggaaagagagauccccgaacggucauggaauucuggccacgagugggucacagacuucaaggguaagaccgugugguuugugccuagcaucaaagcugggaacgauauugcggccugccuaaggaagaauggaaaaaaggucauacaacugagucgcaaaacuuucgacuuugaauauaucaagacacguaccaacgauugggacuucguagugacgacugauauuuccgagaugggcgcaaauuuuaaggcugagagaguuaucgacccacggagguguaugaaacccgugauucucacagauggcgaagagcgcgucaucuuagccgggccuaugccggugacccauagcucugcagcccagcgaagaggacggguugguaggaacccaaagaaugaaaacgaccaguacauauacaugggcgagccccuggaaaaugaugaggacugcgcucacuggaaagaggccaagaugcuucuggacaacaucaauaccccugaagggauuauccccucaauguucgagccagaacgcgagaaaguggaugcgauugacggagaauauagacucaggggcgaggcacggaagacuuuugucgauuugaugcgucgcggugaccugccuguguggcucgccuaccgaguagcugccgaggggaucaacuaugcugauagaaggugguguuucgacggcgugaaaaacaaucaaauacuggaagagaacguugaagucgagauuuggacaaaggagggagaacggaagaaacuuaagccccgcuggcuagaugcaagaaucuacuccgacccacuggccuugaaagaguucaaggaauuugcugccggcaggaaaaguuuaacccugaaucucauuacagagauggggcggcugccuacuuucaugacgcagaaggcacgaaacgcgcuugauaaucuggccgugcuccauaccgcugaagccggagguagagcauauaaccacgcuuugagcgagcugccggagacacuagaaacucugcuccuucugaccuuauuggccacagugaccggcgggaucuuucuguuccucaugucgggaaagggcauagguaaaaugacucuggggaugugcugcaucauuacggcaucuauccuucugugguacgcccagauucagccccacuggaucgcugcguccauaauucucgaguuuuucuugaucguccuguuaaucccagaaccugagaagcaacgcaccccccaggacaaucagcuaacauauguugugauugccauccugacuguaguggcagcuaccauggccaacgaaaugggcuuucucgagaaaacaaagaaagauuucggacuuggcagcauaaccacucagcaaccagagucaaauauucuggacaucgauuugaggccugccagugcauggacacuguacgcugucgccacgaccuuuauuacucccaugcuccggcauucuaucgaaaacuccagcgugaauguuucacugacagcgauagcuaaccaggccaccgugcuuauggggcucggaaaggguuggccgcugaguaagauggacaucggcgucccauugcuggcaauuggguguuacagccagguaaauccuaucaccuuaacagccgcucuacugcuccuuguggcacacuaugccauuaucggacccggccugcaggcgaaagcuacucgugaggcccaaaagagagcagccgcugguauuaugaaaaacccaacgguugacgggaucaccgugauagauuuggaccccauuccuuacgauccgaaguucgaaaaacagcugggccaggucaugcuccuggugcuuugcgucacacagguguuaaugaugaggacuaccugggcccugugugaggcacucacauuggcuaccggacccaucuccacucugugggaaggcaauccagggcgcuuuuggaacacgacaaucgccguuucuauggcgaauauuuuccggggaagcuaucuagccggcgcaggucugcucuuuuccauaaugaagaacaccgcuaacacucgaagagggaccggaaauacaggcgagacucuuggugagaaguggaaaaacaggcugaaugccuugggcaagucagaauuccaaaucuacaaaaagucugggauucaggagguggaccgcacccuggcaaaagaaggaaucaagcggggcgagacagaucaucacgcuguaaguagagggucggccaaacuccguugguucguggagaggaaccuggucacgccugaaggaaagguuguggacuuaggcugcggucgggggggauggagcuauuacuguggcggucuuaagaaugucaaagaggugaagggccugaccaaagggggacccggccaugaagagccuauuccaauguccacuuauggguggaaccucguacgccuacagucuggaguggauguuuuuuucacacccccugaaaagugcgacacccuguugugugauaucggcgagucaagcccaaaucccacuguggaggccggucgaacacugagaguccucaaccuuguggaaaauuggcugaacaauaacacccaauuuugcauaaaagucuugaauccguacaugccuuccgugaucgagaagauggaagcgcugcagaggaaguacgggggagcucucguucggaacccauuaagucgcaauucuacgcacgagauguauuggguaagcaacgcaucaggcaacauuguguccagugucaauaugaucagcagaaugcugauuaacagguucaccaugcgacacaaaaaggccacauacgaacccgacguggaucuuggcucugggacucggaauaucggaauagaguccgagaccccuaaccuggacauuaucgguaaacguaucgaaaagauuaaacaggagcaugaaacaucauggcacuaugaucaggaccauccauacaagacuugggcuuaucacggcagcuacgagaccaagcaaacagggucggccucuaguaugguuaauggaguggucagacuacucaccaaacccugggacgugauaccgaugguaacucagauggcaaugacggauacaaccccuuuuggccagcagcgcguguucaaggaaaaaguugacacuaggacccaagagcccaaggaggguacaaaaaagcugaugaagaucacggccgaaugguuguggaaagagcuggggaagaaaaagaccccacggauguguacuagagaagaguuugcucgcaaagucagguccaacgcggcccucggagcaauuuucacagaugagaauaaguggaaaagcgcucgagaagccguggaggacucaggcuuuugggaacuuguggauaaggagcggaaccugcacuuagaaggcaagugcgagaccugugucuauaauaugauggggaaaagagagaagaaacugggagaauucgguaaggcaaaaggcuccagggccaucugguacaugugguugggggcucgcuuucucgaguucgaagcccugggauuucuaaacgaggaccauugguucucucgugaaaauagccuuaguggcguugagggugaggggcugcacaagcucggauacauucugcgggauguguccaugaaggaaggcggcgcgauguaugcagacgauacugccgggugggacacaagaaucaccuuggaggaucugaaaaacgaagagaugguaacaaaucauauggaaggagagcacaagaaacucgcugaggccauauucaagcuuacuuaccagaacaaaguggucagggugcagcgcccuaccccccgagguacgguuauggacaucauuagccggagagaccagaggggcucugggcaaguggucaccuauggacugaauacauuuacuaacauggaagcacaguuaauccgccagauggagggcgaagguguguucaagucaauucaacagcugaccguaacagaggagaucgcuguuaagaacugguuggugagagucgggcgggaaaggcucagucguauggccauuuccggagaugacugcguggugaaaccacuggaugaccgauuugcuagcgcccuaacugcacuuaaugauaugggcaagguccgcaaagacauacagcagugggagcccucuagaggcuggaacgauuggacccaaguuccuuucugcucgcaucacuuucacgaacugaucaugaaggacgggcgggugcucguagugccauguaggaaucaggaugagcugauuggacgcgcgagaaucucacagggugccggcuggagcuugcgggaaacggcuugcuuagggaaauccuacgcccagauguggagucugauguauuuccauaggcgagaccuccgucuugcagcuaacgccaucuguucugcagucccgagccacugggugcccacauccagaaccacuuggucaauucaugccacacacgaguggaugaccacugaggauaugcugaccguuuggaaucgcguguggauacaagaaaacccuuggauggaggacaagacaccagucgaaaguugggaggaaauccccuaccuaggaaagcgggaggaucaguggugcggcucucugauuggucucacgagcagggcgaccugggcuaaaaauauccagacugccauuaaccaggugagauccuugaucgggaaugaggaauauacagacuacaugccuucaaugaagcgcuuucggagggaggaagaggaagcaggaguacugugguga

SEQ ID NO: 14951 - RNA, 9876 nt, Artificial Sequence
  derived and/or modified CDS sequence (opt3) from DENV-2__KC762664__SS-prME
accgcaggcaucauuauaaugaugauccccacagugauggcuuuccaccugacuacgaggaacggggagccucauaugauugucagcaggcaggaaaagggaaaaucccuccuuuuuaagaccgagaaugguguuaacaugugcacacugauggcaauggacuugggcgaauuaugugaggauacuaucaccuacaauugcccacugcuacggcaaaacgaaccggaggacauugauuguuggugcaauucuacaucaaccugggugacuuaugggacauguaccgccacgggagagcaccgccgagaaaaacguaguguagcgcucgugccccaugucggcaugggucuggagacucggaccgaaacauggaugagcuccgagggggcuuggaagcacgcccagaggaucgagacuugggugcuucggcauccuggauucaccauaauggcagccauccuggcuuacacaauuggcaccacguauuuucagcgcguuuugaucuucauucuccugacugcagugacaccaucuaugaccaugagaugcaucggcauaucgaacagggacuuugucgaaggggugucaggagguagcuggguagauauuguucuggagcacggcaguugugugacuacaauggccaaaaauaagcccacccucgacuucgaauuaaucaagacggaggcuaaacacccugccacccugcggaaguacugcauugaagcgaaacuuacaaacacuaccacagcaucccgcuguccaacucagggggagcccucuuugaaugaggaacaagauaagcgauuugucugcaaacauagcaugguggacagaggauggggcaacgguugugggcuguucggaaagggcggcaucgugaccugcgccauguuuacaugcaagaaaaauauggaggggaagaucguccagccugaaaaccuagaguauaccauuguuauaacuccacacuccggagaagagaaugcuguggguaacgauacgggcaaacaugggaaggagaucaaaguaacaccgcagucaaguauuaccgaagccgagcucacuggauacggcaccgugacaauggaauguagccccaggaccggucuggacuucaaugagaugguccuucugcagauggaaaacaaggcaugguuggugcaccggcaaugguuucucgaucugccuuuaccauggcugcccggggcugacacucagggcucuaacuggauccagaaagagacacucguuacguucaagaauccucacgccaagaaacaggauguggucgugcuuggaucccaagagggcgcgaugcauaccgcccugacuggggcaacagaaauacagaugucaagcggaaacuugcuauuuaccggucaccugaagugccgucuccgcauggacaaacugcagcuuaagggcaugaguuauucuauguguacagggaaauucaagguaguuaaggagauugcugaaacucaacauggaaccaucgugaucagaguccaguacgagggcgacgguuccccaugcaaaauucccuucgagaucacggaucuggaaaagaggcacggguugggccggcucauuaccgugaauccgauagucacagagaaagacagcccugugaacaucgaagccgagcccccauuuggagauucguacauuaucaucggcguugaaccugggcagcugaaguuaucuugguucaaaaagggauccucaauuggucagauguuugagacuaccaugcgaggcgcuaagcgcauggccauacugggggacacagcaugggauuucggaagucuaggcgguguguuuacuagcaucgggaaagcccuccaucaaguauucggcgcuauuuauggagcggcauuuuccggcgucucuuggaccaugaagauccugauuggggugguuaucacguggauaggaaugaauagcagaucaacaagucuuuccgugagcuugguccuggugggcguagugacccucuaccuggguguuaugguccaggccgacucuggguguguggugucauggaaaaacaaggagcuuaaaugcggaaguggcaucuucauuacugauaauguccacacauggaccgaacaguauaaguuucagcccgagagcccauccaagcuggcuucugccauccaaaaagcacacgaagaggguauuuguggcaucaggucgguuacucgguuggaaaaccucauguggaagcagauaacccccgagcugaaucauauuuuaagcgagaacgaagugaaacugacaaucaugacgggggacauuaagggaaucaugcaggccggcaaacgcucccuaagaccucagccaaccgagcucaaguacucauggaaaacuugggggaaggcuaagaugcugaguacagaacuucacaaucauaccuucuugauagauggaccggagacagccgaaugccccaacgcaaauagggcguggaacucucuggagguggaggacuauggcuuugguguauucacuaccaauaucuggcucaaacugaaggaacgucaagaugcuuuuugugacagcaaauuaauguccgccgcaauuaaggacaaccgggccguccacgcugauaugggguacuggaucgagucagcccugaacgacacguggaaaauugaaaaggccagcuucaucgaggugaagucuugccacuggccuaaaucccauacacuuuggaguaauggaguuuuggagagcgaaaugauaauuccaaagaacuucgcuggccccgugucucagcacaauuaucgaccugguuaccauacccagacugccggcccauggcaccucgggagacuggagauggauuuugacuucugugaaggaaccacagucgugguuacugaggauugcggcaacagggggcccucccuacgcaccacaacggcgucaggaaaacugaucaccgaauggugcugucggaguugcacucucccgccucugagauacaggggcgaggacgguuguugguaugggauggagauccgcccacuuaaggaaaaagaggaaaauuuggugaacagccugguaacagccggacauggccagauugauaauuuuucguuagguguccucggcauggcucuguuccuugaggaaaugcugcgaacccggguggggacuaagcacgcaaucuugcucguggccgucuccuuuguuacacugauuaccggaaacaugucuuuccgugaccuaggcagagugaugguaauggugggggcuacgaugacugaugacauaggaaugggcgucaccuaccuggcccuccuggcagcguuuaaggugaggcccacauucgccgcuggucuuuugcugcgcaaauuaaccagcaaggagcucaugaugacuacaaucgggauuacccugcuuucacaaaguacaaucccugagacuauucuggaacuaaccgaugcccucgcacugggaaugaugguuuugaaaaucgugcggaauauggagaaguaucagcuggcugucacgauaauggccaucuuaugcgugcccaacgcaguuauucuccagaaugccuggaaaguguccuguacaacccuggcugucguaucugugagcccacuucuguugacuuccucacaacagaaggcggacuggaucccucucgcccugaccauuaagggccuaaaccccacagcaaucuuucugacuacccuuagcagaacgaguaaaaagaggucuuggccacucaaugaagcuauaauggccguuggcaugguguccauucuggccagcucguugcugaaaaacgauaucccgaugacagggccuuuagucgcuggaggucuccugaccgugugcuacguacuuacuggccgaucagcagaccuggaguuggaacgcgccgcggacgugcggugggaggagcaggcugaaaucucugggaguucccccauucucagcauaacaaucucugaggauggaagcauguccauuaagaaugaagaggaggaacagacccugacuauccuaauuagaacaggccugcuugucaucucaggucucuucccaguuaguauacccaucaccgccgcagccugguaucugugggaggugaaaaagcaaagggcugggguguugugggacgucccuagcccacccccuguggaaaaagcagaguuagaagauggagccuaccguauuaagcagaagggcauccugggcuauucucagauuggggcgggaguuuacaaagaggguacguuucacacuauguggcauguaacccgcggcgcugugcucaugcacaaggggaaacggaucgagccguccugggccgacgucaagaaagaucugauaucauacggaggcgguuggaaacuugaaggggaguggaaggaaggagaggaagugcagguucuggcauuggagccaggcaaaaaccccagagccgugcaaacaaagccuggccuauucaaaaccaguacagggacuauuggagcugucagccuggacuuuuccccagguaccucuggcucgcccaucguggauaagaaagggaagguagucggacucuauggcaacggugugguuacgaggagcgggacauacgugucagccaucgcacagacugagaaguccauugaagacaauccugagaucgaagaugacauauucagaaagaagcggcugaccauuauggaucuucauccgggagcuggcaaaacaaagcgcuauuuacccgccaucgucagagaggcgauuaaaaggggccugcggacccucaucuuggccccaacucgagugguugcagcugaaauggaggaggcccugagagggcucccuauacgcuaccagacccccgcuauuagggcagaacacacaggacgugagaucguggaccugaugugucaugccacguucacuaugcggcuucugaguccaaucagagucccuaacuauaauuugauuaucauggaugaagcccacuuuaccgaccccgcuucuauugcggcaagggguuacauaagcacacgcguggagaugggcaaggccgcugggaucuucaugaccgccacuccaccgggaucccgagacccuuuuccccagucaaacgcaccaauuauggaugaggaaagagagauccccgaacggucuuggaauagcggccacgaguggguaacagacuucaaggguaaaaccgugugguuuguuccuaguaucaaggccgggaacgauauugcugcgugccuaaggaaaaauggaaagaaagucauacaacugucccgcaagacguucgacuuugaauauaucaagacucguacaaacgauugggacuucguggugaccaccgauauuagcgagaugggcgccaauuuuaaagcagagagagucaucgacccacggagguguaugaagcccguaauucucacugauggcgaagaacgcgugaucuuagcugggccuaugccgguuacacauucuucagccgcacagcgaagaggacggguggguaggaaccccaagaaugaaaacgaccaguacauauacaugggcgagccccuggaaaaugaugaggacugcgcccacuggaaggaggcuaaaaugcuucuggacaacaucaauaccccugaagggauuauccccuccauguucgagccagaacgcgagaaggucgaugccauugacggagaauauagacucaggggcgaggcgcggaaaacauuuguggauuugaugcgucgcggugaccugccuguuuggcucgcauaccgaguggccgcugaggggaucaacuaugccgauagaaggugguguuucgacggcgucaagaacaaucaaauacuggaagagaacguggaaguagagauuuggacuaaggagggagaacggaagaaacuuaaaccccgcuggcuagaugcuagaaucuacagugacccacuggcauugaaagaguucaaagaauuugccgcuggcagaaagagcuuaacgcugaaucucauuaccgagauggggcggcugccuacauucaugacucagaaggcccgaaacgcacuugauaaucuggcggugcuccauaccgccgaagcuggagguagagccuauaaccacgcauugucggagcugccggagacacuagaaacccugcuccuucugacuuuauuggcuacgguuaccggcgggaucuuucuguuccucaugucuggaaaaggcauagguaagaugacacuggggaugugcugcaucauuacugccuccauccuucugugguacgcacagauucagccccacuggaucgccgcuagcauaauucucgaguuuuucuugaucguccuguuaaucccagaaccugagaaacaacgcacaccacaggacaaucagcuaacauauguggugauugcgauccugaccgucguugccgcaacuauggcuaacgaaaugggcuuucucgagaagaccaagaaggauuucggacuuggcucaauaacgacccagcaaccagagaguaauauucuggacaucgauuugaggccugccucugccuggacucuguacgcaguggcuacaaccuuuauuacccccaugcuccggcauuccaucgaaaacagcucaguaaaugugagucugacagccauagcgaaccaggcuacuguccuuauggggcucggaaaggguuggccgcugagcaaaauggacaucggcgugccauugcuggccauuggguguuacucccagguuaauccuaucacguuaaccgcagcccuacugcuccuuguggcucacuaugcaauuaucggacccggccugcaggccaaggcgacacgugaggcucaaaagcgagccgcagccgguauuaugaagaacccaacugucgacgggaucaccguaauagauuuggaccccauuccuuacgauccgaaauucgaaaagcagcugggccaggugaugcuccugguucuuugcgugacacaggucuuaaugaugaggaccacuugggcucugugugaggcccucacguuggcaacaggacccaucucuacccugugggaaggcaauccagggcgcuuuuggaacacuaccaucgcugugagcauggccaauauuuuccggggauccuaucuagcgggcgccggucugcucuuuucaauaaugaagaacacagcaaacacucgaagagggaccggaaauacaggcgagacgcuuggugagaaauggaagaacaggcugaaugcuuugggcaaaucugaguuccaaaucuacaagaaaagugggauucaggaggucgaccgcacccuggccaaggaaggaaucaaacggggcgagacugaucaucacgcagugucgagagggagcgcuaagcuccguugguucguugagaggaaccuggugacaccugaaggaaagguaguggacuuaggcugcgguagagggggaugguccuauuacuguggcggucuuaaaaaugucaaggagguuaaaggccugaccaaagggggacccggccaugaagaaccuauuccaaugucuacuuauggguggaaccucgugcgccuacagucaggagucgauguguuuuucacacccccugaaaaaugcgacacccuguugugugauaucggcgagagcuccccaaaucccacgguagaggccggucgaacccugagagugcucaaccuuguugaaaauuggcugaacaauaacacacaauuuugcauaaagguguugaauccguacaugccuagugucaucgagaagauggaagcccugcagaggaaauacgggggagcgcucgugcggaacccauuaucucgcaauagcacucacgagauguauugggucucaaacgcuuccggcaacauugugaguagcguuaauaugaucucuagaaugcugauuaacagguucaccaugcgacacaagaaagcaacauacgaacccgacguagaucuuggcuccgggacucggaauaucggaauagagucagagaccccuaaccuggacauuaucgguaagcguaucgagaaaauuaagcaggaacaugaaacaagcuggcacuaugaucaggaccauccauacaagaccugggccuaucacggcucguacgagacuaaacaaacggggucugcuaguuccauggugaauggagucgugagacuacucacaaagcccugggacguuauaccgauggugacccagauggccaugacugauaccacaccuuuuggccagcagcgcgucuucaaagaaaagguggacacgaggacccaagagcccaaagaggguacuaagaagcugaugaaaaucacagcagaaugguuguggaaggagcuggggaaaaagaaaaccccacggauguguacuagagaagaguuuacacgcaagguaaggagcaacgccgcucucggagcgauuuucaccgaugagaauaaauggaagucagcccgagaagcaguggaggacuccggcuuuugggaacuuguugauaaggagcggaaccugcacuuagaaggcaaaugcgagacaugugucuauaauaugauggggaagagagagaaaaagcugggagaguucgguaaagcuaagggcucuagggccaucugguacaugugguugggggcacgcuuucucgaguucgaagcccugggauuucuaaacgaggaccauugguucagccgugaaaauagucuuuccggcguggagggugaggggcugcacaagcucggauacauucugcgggaugugagcaaaaaggaaggcggcgcuauguaugccgacgauacugcggggugggacaccagaaucacguuggaggaucugaaaaacgaagagauggucaccaaucauauggaaggagagcacaagaaacucgcagaggccauauucaaacuuacauaccagaacaagguugugaggguacagcgcccuacuccccgagguaccgugauggacaucauuucucggagagaccagaggggcucagggcaagucgugacauauggacugaauacuuuuaccaacauggaagcucaguuaauccgccagauggagggcgaagguguuuucaaaaguauucaacagcugacggugacagaggagaucgccgucaagaacugguuggugaccguagggagagaacggcucuccaggauggcaauuagcggagaugacugcguugugaaaccacuggaugaccguuuugcuucugcccuaacugcucuuaaugauaugggcaagguccgaaaagacauacagcagugggagcccucgcgcggcuggaacgauuggacacaagugccuuucugcucacaucacuuucacgaacugaucaugaaggacgggagagugcucgucguuccaugucggaaucaggaugagcugauuggaagggcccgcaucagccagggugcaggcugguccuugagagaaaccgcgugcuuagggaagaguuacgcccagauguggucucugauguauuuccaucggagggaccuccgacuugcugccaacgcaaucuguagcgcugugccgucccacuggguacccacuucacguaccacauggaguauucaugccacgcacgaguggaugaccacugaggauaugcugacaguguggaauagagucuggauacaagaaaacccuuggauggaggacaaaaccccagugggaucuugggaagagauccccuaccuaggcaagcgcgaagaucaguggugcgguagccugauugggcucacuucccgggcaacaugggccaaaaauauccagaccgcgauuaaccagguuaggucauugaucggaaaugaggaguauacggacuacaugccuagcaugaagagauuucgccgggaagaggaagaggcuggcgugcugugguga

SEQ ID NO: 14952 - RNA, 9876 nt, Artificial Sequence
  derived and/or modified CDS sequence (opt3) from DENV-2__KC762674__SS-prME
accgccggcaucauuauaaugaugauccccacagugauggcuuuccaccugacuacgagaaacggggagccucauaugauugucagcaggcaggaaaagggaaaaucccuccuuuuuaagaccgagaaugguguuaacaugugcacacugauggcaauggacuugggcgaauuaugugaggauacuaucaccuacaauugcccacugcuacggcaaaacgaaccggaggacauugauuguuggugcaauucuacaucaaccugggugacuuaugggacauguaccgccacgggagagcaccgccgagaaaaacguaguguagcgcucgugccccaugucggcaugggucuggagacuagaaccgaaacauggaugagcuccgagggggcuuggaagcacgcccagaggaucgagacuugggugcuucggcauccuggauucaccauaauggcagccauccuggcuuacacaauuggcaccacgcacuuucagcgcguuuugaucuucauucuccugacugcaguggccccaucuaugacaaugagaugcaucggcauaucgaacagggacuuugucgaaggggugucaggagguagcuggguagauauuguucuggagcacggcaguugugugaccacuauggcuaaaaauaagcccacacucgacuucgaauuaaucaagaccgaggccaaacauccugcgacgcugcggaaguauugcauugaagcaaaacuuaccaacacaacuaccgccucccgcuguccaacacagggggagcccucuuugaaugaggaacaagauaagcgauuugucugcaaacacagcaugguggacagaggauggggcaacgguugugggcuguucggaaagggcggcaucgugacuugcgcuauguuuaccugcaagaaaaauauggaggggaagaucguccagccugaaaaccuagaguacacaauuguuauaaccccacauuccggagaagagaaugccguggguaacgauacuggcaaacacgggaaggagaucaaaguaacgccgcagucaaguauuacagaagcagagcucaccggauauggcacugugaccauggaauguagccccaggacaggucuggacuucaaugagaugguccuucugcagauggaaaacaaggcuugguuggugcaccggcaaugguuucucgaucugccuuuaccauggcugcccggggccgacacccagggcucuaacuggauccagaaagagacucucguuacauucaagaauccucaugcgaagaaacaggauguggucgugcuuggaucccaagagggcgccaugcacacggcacugaccggggcuacugaaauacagaugucaagcggaaacuugcuauuuacaggucaucugaagugccgucuccgcauggacaaacugcagcuuaagggcaugaguuacucuauguguaccgggaaauucaagguaguuaaggagauugccgaaacacaacacggaacuaucgugaucagaguccaguaugagggcgacgguuccccaugcaaaauucccuucgagaucauggaucuggaaaagaggcauguguuggggcggcucauuaccgucaauccgauagugacggagaaagacagcccuguuaacaucgaagcugagcccccauuuggcgauucguacauuaucaucggaguggaaccuggccagcugaaguuaucuugguucaaaaagggguccucaauuggacagauguuugagaccacaaugcgaggugccaagcgcauggcaauacugggcgacacugccugggauuucgggagucuaggaggcguauuuaccagcaucgguaaagcucuccaccaagucuucggggcgauuuacggcgcagccuuuuccggagugucuuggacaaugaagauccugauuggcguugugaucacuuggauagggaugaauagcagaucaaccagucuuuccgucagcuuggugcugguaggagugguuacgcucuaucugggcgucauggugcaggcugacucugguuguguggucucauggaaaaacaaggagcuuaaaugcgggaguggaaucuucauuacagauaauguucacaccuggacugaacaguacaaguuucagcccgagagcccauccaagcuggccucugcaauccaaaaagcccaugaagagggcauuugugguaucaggucggugacacgguuggaaaaccucauguggaagcagauaacccccgagcugaaucacauuuuaagcgagaacgaagugaaacugacuaucaugaccggcgacauuaaggggaucaugcaggcuggaaaacgcucccuaagaccucagccaacagagcucaaguauucauggaaaacguggggcaaggccaagaugcugaguaccgaacuucauaaucacacuuucuugauagaugggccggagacagcagaaugccccaacaccaauagggcguggaacucucuggagguagaggacuacggauuuggcgucuucacaacuaauaucuggcucaaacugaaggaacgucaagauguguauugugacagcaaauuaauguccgcugccauuaaggacaaccgggcaguucacgccgauauggguuacuggaucgagucagcucugaacgacaccuggaaaauugaaaaggccagcuuuaucgaggugaagucuugcuauuggccuaaaucccauacgcuuuggaguaauggggucuuggagagcgaaaugauaauuccaaagaacuucgcaggacccgugucucagcacaauuaccgaccuggcuaccauacacagaccgcugguccauggcaccucggcagacuggagauggauuucgacuuuugugaagggacuaccguugugguaacagaggauugcggaaacaggggccccucccuacgcacuaccacagccucagggaaacugaucacggaauggugcugucggaguugcacccucccgccucugagauauaggggagaggacggcuguugguacgguauggagauccgcccacuuaaggaaaaagaggaaaauuuggucaacagccuggugacugcggggcauggacagauugauaauuucucguuaggcgugcucgguauggcccuguuucuugaggaaaugcugcgaacacgggucggcaccaagcacgcuaucuugcucguugcaguguccuucguaacucugauuacagggaacaugucuuuucgugaccuaggaagagugauggucauggugggcgccaccaugacggaugacauagggaugggaguuacuuaucuggcucuccuggccgcauucaaggugaggcccaccuuugcggccggccuuuugcugcgcaaauuaacaagcaaggagcucaugaugaccacuaucgguauuguccugcuuucacaaaguacaaucccugagaccauucuggaacuaacagaugcucucgcccuggggaugauggcauugaaaaucgugcggaauauggagaaguaccagcuggcuguuacuauaauggccaucuuaugcgugcccaacgcagucauucuccagaaugccuggaaaguauccuguaccacgcuggcugugguuucugugagcccacuucuguugacauccucacaacagaaggcggacuggaucccucucgcccugaccauuaagggacuaaaccccacugcaaucuuccugaccacacuuagcagaacuaguaaaaagaggucuuggccacucaaugaagcuauaauggccgucggcaugguguccauucuggccagcucguugcugaaaaacgauaucccgaugaccggcccuuuaguagcugggggacuccugacggugugcuauguccuuacaggucgaucagcagaccuggaguuggaacgcgccgcggacguucggugggaggagcaggcugaaaucucuggcaguucccccauucucagcauaaccaucucugaggaugggagcauguccauuaagaaugaagaggaggaacagacucugacaauccuaauuagaaccggacugcuugugaucucaggccucuuuccagugaguauacccaucacugccgcagccugguaccugugggaggucaaaaagcaaagggcugguguguugugggacguuccuagcccacccccuguagggaaagcagaauuagaggauggagccuaucguauuaagcagaagggcauccugggcuacucucagauuggggcgggaguguacaaagaagguacauuccacaccauguggcaugucacgcgcggcgcugugcucaugcacaaggggaaacggaucgagccguccugggccgacguuaagaaagaucugauaucauauggaggcgguuggaagcuugagggggaauggaaggagggagaagaggugcagguccuggcauuggaaccaggcaaaaaccccagagccgugcaaacuaagccuggccuauuuaaaaccaacacagggaccauuggagcuguaagucuggacuucagcccagguacauccggcucucccaucgucgauaagaaagggaaggugguuggacucuacggcaaugguguggucacuaggucggggaccuaugugagcgccaucgcacagacggagaagucaauugaggacaacccugaaaucgaggaugacauauuucgaaaaaagcggcugacaauuauggaucuucauccgggagcuggcaaaacuaagcgcuacuuacccgccaucguuagagaagcgauuaaaaggggccugcggacccucaucuuggccccaacacgaguggucgcagcugagauggaagaggcccugagagggcucccuauacgcuaucagacccccgcuauuagggcagagcacacuggacgugaaaucguggaccugaugugucaugccaccuucacaaugcggcuucuguccccaaucagaguaccuaauuacaacuugauuaucauggaugaggcccacuucacggaccccgcuaguauugcggcaagggguuauauaucuacucgcguggaaaugggcgaggccgcugggaucuuuaugaccgccacaccaccgggaagccgagacccuuucccccaguccaaugcaccaauuauggaugaggaaagagagauccccgaacggucauggaacucuggccacgaguggguuaccgacuuuaaggguaagacugucugguucgugccuagcaucaaagccgggaaugauauugcugcgugccuaaggaagaacggaaaaaaggugauacaacugagucgcaaaacauuugacuucgaauacaucaagacccguacgaaugauugggacuuugucguaacuacagauauuuccgagaugggcgccaacuucaaggcagagagagugaucgacccacggagguguaugaaacccguuauucucaccgauggcgaagagcgcgugaucuuagcugggccuaugccggucacccauagcucugccgcacagcgaagaggacggguggguaggaauccaaagaacgaaaaugaccaguacauauauaugggcgagccccuggaaaacgaugaggacugcgcccacuggaaagaggcuaagaugcuucuggacaauaucaacacuccugaagggauuauccccucaauguuugagccagaacgcgagaaaguugaugccauugacggagaauacagacucaggggcgaggcgcggaagacauucguggauuugaugcgucgcggugaccugccugucuggcucgcauaucgaguggccgcugaggggaucaacuacgccgauagaaggugguguuuugacggcguaaaaaauaaccaaauacuggaagagaauguggaaguugagauuuggaccaaggagggagaacggaagaaacuuaagccccgcuggcuagaugcuagaaucuauuccgacccacuggcauugaaagaguucaaggaauucgccgcuggcaggaaaaguuuaacacugaaccucauuacugagauggggcggcugccuacguuuaugacccagaaggcccgaaaugcacuugauaaccuggcgguccuccauacagccgaagcuggagguagagccuacaaucacgcauugagcgagcugccggagacucuagaaacccugcuccuucugacauuauuggcuaccgugacuggcgggaucuuccuguuucucaugucgggaaagggcauagguaaaaugacgcuggggaugugcugcaucauuaccgccucuauccuucugugguaugcacagauucagccccacuggaucgccgcuuccauaauucucgaguucuuuuugaucgugcuguuaaucccagaaccugagaagcaacgcacaccccaggacaaccagcuaacuuacgucguuauugcgauccugaccgugguagccgcaacaauggcuaaugaaaugggcuuccucgagaaaaccaagaaagauuuuggacuuggcagcauaacuacacagcaaccagagucaaacauucuggacaucgauuugaggccugccagugccuggacgcuguacgcaguggcuaccacuuucauuacacccaugcuccggcauucuaucgaaaauuccagcgucaacgugucacugaccgccauagcgaaucaggcuaccguucuuauggggcucggaaaggguuggccgcugaguaagauggacaucggcgugccauugcuggccauuggguguuauagccaggucaacccuaucacauuaacugcagcccuacugcuccuuguagcucacuacgcaauuaucggacccggccugcaggccaaagcgacgcgugaggcucaaaagagagccgcagccgguauuaugaaaaauccaaccguggacgggaucacaguuauagauuuggaccccauuccuuaugauccgaaguuugaaaaacagcugggccaggugaugcuccugguccuuugcgugacucaggucuuaaugaugaggaccacaugggcucugugugaggcccucaccuuggcaacuggacccaucuccacgcugugggaaggcaacccagggcgcuucuggaauacaaccaucgcugugucuauggccaacauuuuucggggaagcuaccuagcgggcgccggucugcucuucuccauaaugaagaacacugcaaauacccgaagagggacaggaaacacuggcgagacccuuggugagaaguggaaaaauaggcugaacgcuuugggcaagucagaauuucaaaucuauaaaaagucugggauucaggagguugaccgcacacuggccaaagaaggaaucaagcggggcgagacggaucaucacgcagugaguagagggucggcuaaacuccguugguucguagagaggaaucuggugaccccugaaggaaaggucguugacuuaggcugcggucgggggggauggagcuacuauuguggcggucuuaagaacgugaaagaggucaagggccugacuaaagggggacccggccaugaagagccuauuccaauguccacauacggguggaaucucgugcgccuacagucuggaguagauguguucuuuacccccccugaaaagugcgacacucuguugugugauaucggcgagucaagcccaaaccccacaguugaggccggucgaacccugagagugcucaaucuugucgaaaacuggcugaauaacaauacgcaauucugcauaaaaguguugaacccguacaugccuuccgucaucgagaagauggaagcccugcagaggaaguaugggggagcgcucgugcggaauccauuaagucgcaacucuacccacgagauguacuggguuagcaacgcuucaggcaauauuguauccagugugaacaugaucagcagaaugcugauuaauagguuuacaaugcgacacaaaaaggcaacuuaugaacccgacgucgaucuuggcucugggacccggaacaucggaauagaguccgagauuccuaaucuggacaucaucgguaaacguauugaaaagauaaaacaggagcaugaaacaucauggcacuacgaucaggaccauccauauaagacuugggccuaccacggcagcuaugagaccaagcaaacagggucggcuucuaguauggugaacggaguugugagacuacucaccaaacccugggacgucaucccgauggugacucagauggccaugacggauacaaccccuuucggccagcagcgcguauuuaaggaaaaaguggacacuaggacccaagagcccaaggaggguacaaaaaagcugaugaagauuacggcagaaugguuguggaaagagcuggggaagaaaaagaccccacggauguguacuagagaagaguucacacgcaaaguuagguccaaugccgcucucggagcgaucuuuaccgaugagaacaaguggaaaagcgcccgagaagcagucgaggacucaggcuucugggaacuuguggauaaggagcggaaucugcacuuagaaggcaagugcgagacuuguguguacaacaugauggggaaaagagagaagaaacugggagaauuugguaaggcuaaaggcuccagggccauuugguacaugugguugggggcacgcuuccucgaguuugaagcccugggauuccuaaaugaggaccauugguuuucucgugaaaacagccuuaguggcgucgagggugaggggcugcacaagcucggauauauccugcgggauguuuccaagaaagaaggcggcgcuauguacgccgacgauacagcggggugggacaccagaauaacauuggaggaucugaagaaugaagagauggugacuaaccauauggaaggagagcacaaaaagcucgcagaggccaucuucaaacuuaccuaucagaauaagguagugaggguccagcgcccuacgccccgagguaccgugauggacauuaucagccggagagaccagaggggcucugggcaaguugugacauacggacugaacacuuucaccaacauggaagcucaguuaauucgccagauggagggcgaaggugucuuuaagucaauccaacagcugacagugacugaggagauugccguaaaaaauugguugguuagaguggggcgggaaaggcucagucguauggcaauauccggagaugacugcgucgugaagccacuggaugaccgauucgcuagcgcccuaaccgcucuuaacgauaugggcaaagugcgcaaggacauccagcagugggagcccucuagaggcuggaaugauuggacgcaagucccuuuuugcucgcaucacuuccacgaacugauuaugaaagacgggcggguucucgugguaccauguaggaaccaggaugagcugaucggacgcgccagaaucucacagggugcaggcuggagcuugcgggaaacagcgugcuuagggaaguccuaugcccagauguggagucugauguacuuucauaggcgagaccuccgucuugcugccaaugcaauuuguucugcugugccgagccacuggguccccaccuccagaacuacauggucaauacaugccacccacgaguggaugacuaccgaggauaugcugacaguguggaaccgcguuuggauccaagaaaauccuuggauggaggacaagacgccaguggaaaguugggaggaaauucccuaucuaggaaaacgggaggaucaguggugcggcucucugaucggucucaccagcagggcaacuugggccaagaacauucagacagcgaucaaucaggucagauccuugauagggaacgaggaauacaccgacuacaugccuucaaugaaacgcuuccggagggaggaagaggaagcuggagugcugugguga

SEQ ID NO: 14953 - RNA, 9876 nt, Artificial Sequence
  derived and/or modified CDS sequence (opt3) from DENV-2__KC762672__SS-prME
accgccggcaucauuauaaugaugauccccacagugauggcuuuccaccugacuacgagaaacggggagccucauaugauugucagcaggcaggaaaagggaaaaucccuccuuuuuaagaccgagaaugguguuaacaugugcacacugauggcaauggacuugggcgaauuaugugaggauacuaucaccuacaauugcccacugcuacggcaaaacgaaccggaggacauugauuguuggugcaauucuacaucaaccugggugacuuaugggacauguaccgccacgggagagcaccgccgagaaaaacguaguguagcgcucgugccccaugucggcaugggucuggagacuagaaccgaaacauggaugagcuccgagggggcuuggaagcacgcccagaggaucgagacuugggugcuucggcauccuggauucaccauaauggcagccauccuggcuuacacaauuggcaccacguauuuucagcgcguuuugaucuucauucuccugacugcaguggccccaucuaugacaaugagaugcaucggcauaucgaacagggacuuugucgaaggggugucaggagguagcuggguagauauuguucuggagcacggcaguugugugaccacuauggcuaaaaauaagcccacacucgacuucgaauuaaucaagaccgaggccaaacacccugcgacgcugcggaaguacugcauugaagcaaaacuuaccaacacaacuaccgccucccgcuguccaacacagggggagcccucuuugaaugaggaacaagauaagcgauuugucugcaaacauagcaugguggacagaggauggggcaacgguugugggcuguucggaaagggcggcaucgugacuugcgcuauguuuaccugcaagaaaaauauggaggggaagaucguccagccugaaaaccuagaguauacaauuguuauaaccccacacuccggagaagagaaugccguggguaacgauacuggcaaacaugggaaggagaucaaaguaacgccgcagucaaguauuacagaagcagagcucaccggauacggcacugugaccauggaauguagccccaggacaggucuggacuucaaugagaugguccuucugcagauggaaaacaaggcuugguuggugcaccggcaaugguuucucgaucugccuuuaccauggcugcccggggccgacacccagggcucuaacuggauccagaaagagacucucguuacauucaagaauccucacgcgaagaaacaggauguggucgugcuuggaucccaagagggcgccaugcauacggcacugaccggggcuacugaaauacagaugucaagcggaaacuugcuauuuacaggucaccugaagugccgucuccgcauggacaaacugcagcuuaagggcaugaguuauucuauguguaccgggaaauucaagguaguuaaggagauugccgaaacacaacauggaacuaucgugaucagaguccaguacgagggcgacgguuccccaugcaaaauucccuucgagaucauggaucuggaaaagaggcacguguuggggcggcucauuaccgucaauccgauagugacggagaaagacagcccuguuaacaucgaagcugagcccccauuuggcgauucguacauuaucaucggaguggaaccuggccagcugaaguuaucuugguucaaaaagggguccucaauuggacagauguuugagaccacaaugcgaggugccaagcgcauggcaauacugggcgacacugccugggauuucgggagucuaggaggcguauuuaccagcaucgguaaagcucuccaucaagucuucggggcgauuuauggcgcagccuuuuccggagugucuuggacaaugaagauccugauuggcguugugaucacuuggauagggaugaauagcagaucaaccagucuuuccgucagcuuggugcugguaggagugguuacgcucuaccugggcgucauggugcaggcugacucugguuguguggucucaugggagaacaaagaacuuaagugcgggaguggaaucuucauuacagauaauguucacaccuggacugagcaguauaaauuucagcccgaaagcccauccaagcuggccucugcaauccaaaaggcccacgaggaaggcauuugugguaucaggucggugacacgguuggagaaccucauguggaaacagauaacccccgagcugaaucauauuuuaagcgaaaacgaggugaagcugacuaucaugaccggcgacauuaaagggaucaugcaggcuggaaagcgcucccuaagaccucagccaacagaacucaaauacucauggaaggccuggggcaaagcaaagaugcugaguacggagcuucacaaucauaccuucuugauagaugggccggaaacugcggagugccccaacacaaauagggcuuggaacucucuggagguagaagacuauggauuuggcgucuucaccacaaauaucuggcucaagcugaaagagcgucaagauguguuuugugacagcaaguuaauguccgccgcaauuaaagacucacgggccguucacgcugauauggguuacuggaucgaaagcgcccugaacgacacuuggaagauugagaaagcaucuuucaucgaggugaaguccugccacuggccuaagagucauacccuuuggagcaacggggucuuggaaucugagaugauaauuccaaaaaauuucgcuggacccgugucccagcacaacuaucgaccuggcuaccauacgcagacagccgguccauggcaccucggcagacuggaaauggauuuugacuucugugaggggaccacuguugugguaaccgaagauugcggaaauaggggccccucacuacgcacaacuaccgcgagugggaagcugaucacagaguggugcugucggagcugcacgcucccgccucugagauacaggggagaggacggcuguugguaugguauggaaauccgcccacuuaaagagaaggaagagaacuuggucaauucgcuggugaccgccgggcauggacagauugauaacuuuuccuuaggcgugcucgguauggcucuguuccuugaagagaugcugcgaacucgggucggcacaaaacacgcaaucuugcucguugccgugucuuuuguaacccugauuacugggaauaugagcuuccgugaccuaggaagagugauggucauggugggcgcuacaaugaccgaugacauagggaugggaguuacguaccuggcccuccuggcagcguuuaaggugaggcccacuuucgccgcuggccuuuugcugcgcaaguuaaccucaaaagagcucaugaugacaaccaucgguauuguccugcuuagucaagccacuaucccugaaacaauucuggagcuaaccgaugcacucgcucuggggaugaugguguugaagaucguucggaacauggaaaaauaucagcuggccgugacaauaauggcaaucuuaugcguccccaaugccguaauucuccagaacgcuuggaagguguccuguacuacccuggcgguugugucugucagcccacuucuguugacguccucacaacagaaagccgacuggaucccucucgcacugacaauuaagggacuaaaucccaccgcuaucuuucugacuacccuuagcagaacaaguaagaaaaggucuuggccacucaacgaggccauaauggccgugggcaugguauccauucuggcuagcucguugcugaagaaugauaucccgaugacuggcccuuuaguggcagggggacuccugaccgucugcuacguucuuacgggucgaucagccgaccuggaauuggagcgcgcggcugacgugcggugggaggaacaggccgagaucucuggcaguucccccauucucagcauaacaaucucugaagaugggagcauguccauuaaaaacgaggaggaagagcagacccugacuauccuaauuagaacaggacugcuugugaucucaggccucuucccagucaguauacccaucaccgcagccgcuugguaucugugggaagugaagaaacaaagggcagguguuuugugggacguaccuagcccacccccuguggggaaggccgaguuagaagauggagcguaccguauuaaacagaagggcauccugggcuauucucagauuggggcuggagucuacaaggaggguacuuuucacacaauguggcaugugacccgcggcgccguucucaugcacaaagggaagcggaucgagccguccugggcagacgugaaaaaggaucugauaucauacggaggcgguuggaaacuugaaggggaguggaaggaaggagaggaaguccaggugcuggccuuggagccaggcaagaaucccagagcuguacaaacgaaaccuggccuauucaagacuaacaccgggacaauuggagccgucagucuggacuuuagcccagguaccuccggcucucccaucguggauaaaaaggggaaaguugugggacucuauggcaacggugucgugacaaggucggggacuuacguuagcgcaaucgcucagaccgagaagucaauugaagacaauccugagaucgaagaugacauauuccgaaagaaacggcugacgauuauggaucuucauccgggagccggcaagacaaaacgcuauuuacccgcgaucgugagagaggccauuaagaggggccugcggacucucaucuuggcaccaacccgagucguggcugccgaaauggaggaggcucugagagggcucccuauacgcuaccagacacccgcaauuagggccgaacacaccggacgugagaucguagaccugaugugucaugccacuuucaccaugcggcuucuguccccaaucagagugccuaacuauaauuugauuaucauggaugaagcucacuuuacagaccccgcgaguauugcagccagggguuacauaucuacgcgcguugagaugggcgaggcugccgggaucuucaugacugcaaccccaccgggaagccgagacccuuuuccccaguccaacgccccaauuauggaugaagagagagaaauccccgagcggucauggaauucuggccacgaaugggucacagacuucaaagguaagaccgugugguuugugccuagcaucaaggcugggaacgauauugcggccugccuaaggaaaaauggaaagaaagucauacaacugagucgcaagacuuucgacuuugaguauaucaaaacacguaccaacgauugggacuucguagugacgacugauauuuccgagaugggcgcaaauuuuaaggcugaaagaguuaucgacccacggagguguaugaagcccgugauucucacagauggcgaggaacgcgucaucuuagccgggccuaugccggugacccauagcucugcagcccagcgaagaggacggguugguaggaacccaaaaaaugagaacgaccaguacauauacaugggcgaaccccuggagaaugaugaggacugcgcucacuggaaggaagccaaaaugcuucuggacaacaucaauaccccugaggggauuauccccucaauguucgaaccagagcgcgaaaagguggaugcgauugacggagaguauagacucaggggcgaggcacggaaaacuuuugucgauuugaugcgucgcggugaccugccuguguggcucgccuaccgaguagcugccgaagggaucaacuaugcugauagaaggugguguuucgacggcgugaagaacaaucaaauacuggaggaaaacguugaggucgagauuuggacaaaagaaggagagcggaagaagcuuaaaccccgcuggcuagaugcaagaaucuacuccgacccacuggccuugaaggaauucaaagaguuugcugccggcaggaagaguuuaacccugaaucucauuacagaaauggggcggcugccuacuuucaugacgcagaaagcacgaaacgcgcuugauaaucuggccgugcuccauaccgcugaggccggagguagagcauauaaccacgcuuugagcgagcugccggaaacacuagagacucugcuccuucugaccuuauuggccacagugaccggcgggaucuuucuguuccucaugucgggaaagggcauagguaagaugacucuggggaugugcugcaucauuacggcaucuauccuucugugguacgcccagauucagccccacuggaucgcugcguccauaauucucgaauuuuucuugaucguccuguuaaucccagagccugaaaaacaacgcaccccccaggacaaucagcuaacauauguugugauugccauccugacuguaguggcagcuaccauggccaacgagaugggcuuucucgagaagacaaaaaaggauuucggacuuggcagcauaaccacucagcaaccagaaucaaauauucuggacaucgauuugaggccugccagugcauggacacuguacgcugucgccacgaccuuuauuacucccaugcuccggcauucuaucgagaacuccagcgugaauguuucacugacagcgauagcuaaccaggccaccgugcuuauggggcucggaaaagguuggccgcugaguaagauggacaucggcgucccauugcuggcaauuggguguuacagccagguaaauccuaucaccuuaacagccgcucuacugcuccuuguggcacacuaugccauuaucggacccggccugcaggcgaaggcuacucgugaagcccaaaaaagagcagccgcugguauuaugaagaacccaacgguugacgggaucaccgugauagauuuggaccccauuccuuacgauccgaaauucgagaagcagcugggccaggucaugcuccuggugcuuugcgucacacagguguuaaugaugaggacuaccugggcccugugugaagcacucacauuggcuaccggacccaucuccacucugugggagggcaauccagggcgcuuuuggaacacgacaaucgccguuucuauggcgaauauuuuccggggaagcuaucuagccggcgcaggucugcucuuuuccauaaugaaaaacaccgcuaacacucgaagagggaccggaaaugccggcgagacacuuggugaaaaguggaagaacaggcugaaugcauugggcaaaucagaguuccaaaucuacaagaaaucugggauucaggaaguggaccgcacucuggcuaaggagggaaucaaacggggcgagaccgaucaucacgccguaaguagagggucggccaagcuccguugguucguggaaaggaaccuggucacaccugagggaaaaguuguggacuuaggcugcggucgggggggauggagcuauuacuguggcggucuuaagaaugucaaggaagugaaaggccugacgaaggggggacccggccaugaggaaccuauuccaauguccaccuauggguggaaccucguacgccuacagucuggaguggauguuuuuuucacucccccugagaaaugcgacacacuguugugugauaucggcgagucaagcccaaaucccaccguggaagcgggucgaacucugagaguccucaaccuuguggagaauuggcugaacaauaacacacaauuuugcauaaaggucuugaauccguacaugccuuccgugaucgaaaaaauggaggcucugcagaggaaguacgggggagcacucguucggaacccauuaagucgcaauucuacccacgaaauguauuggguaagcaacgccucaggcaacauuguguccagugucaauaugaucagcagaaugcugauuaacagguucacgaugcgacacaagaaagcuaccuacgagcccgacguggaucuuggcucugggacacggaauaucggaauagaguccgaaacuccuaaccuggacauuaucgguaagcguaucgagaaaauuaagcaggaacaugagaccucauggcacuaugaucaggaccauccauacaaaacaugggccuaucacggcagcuacgaaacuaagcaaaccgggucggcaucuaguaugguuaauggaguggucagacuacucacaaagcccugggacgugauaccgaugguaacccagauggccaugacugauacgacaccuuuuggccagcagcgcguguucaaagagaagguugacaccaggacucaagagcccaaagaagguaccaagaaacugaugaagaucacagcugagugguuguggaaggaacuggggaaaaagaaaacgccacggauguguaccagagaggaguuugcgcgcaaggucagguccaacgccgcacucggagcuauuuucacugaugaaaauaaauggaagagcgcccgagaggcaguggaagacucaggcuuuugggagcuuguggauaaagaacggaaccugcacuuagagggcaagugcgagacaugugucuauaauaugauggggaagagagaaaaaaagcugggagaguucgguaaagccaagggcuccagggcuaucugguacaugugguugggggcccgcuuucucgaauucgaggcgcugggauuucuaaacgaagaccauugguucucucgugagaauagccuuaguggcguugagggugaagggcugcacaaacucggauacauucugcgggauguguccaugaaggagggcggcgcaauguaugccgacgauaccgcugggugggacacuagaaucacauuggaagaucugaagaacgaggaaaugguaaccaaucauauggagggagagcacaaaaagcucgccgaagcaauauucaaacuuacauaccagaacaagguggucagggugcagcgcccuacuccccgagguaccguuauggacaucauuagccggagagaccagaggggcucugggcaaguggucacguauggacugaauaccuuuacaaacauggaggcucaguuaauccgccagauggaaggcgaggguguguucaaaucaauucaacagcugacuguaaccgaggaaaucgccguuaagaacugguuggugagagucgggcgggagaggcucagucguauggcuauuuccggagaugacugcguggugaagccacuggaugaccgauuugccagcgcacuaacagcgcuuaaugauaugggcaaaguccgcaaggacauacagcagugggaacccucuagaggcuggaacgauuggacucaaguuccuuucugcucgcaucacuuucacgagcugaucaugaaagacgggcgggugcucguagugccauguaggaaucaggaugaacugauuggacgcgccagaaucucacagggugcuggcuggagcuugcgggagaccgccugcuuagggaaguccuacgcacagauguggagucugauguauuuccauaggcgagaccuccgucuugcugccaacgcaaucuguucugccgucccgagccacugggugcccacguccagaacaaccuggucaauucaugcgacucacgaguggaugacaaccgaagauaugcugacuguuuggaaucgcguguggauacaagagaacccuuggauggaagacaaaaccccagucgagaguugggaagagauccccuaccuaggaaagcgggaggaucaguggugcggcucucugauuggucucacaagcagggcuacgugggccaagaauauccagaccgcaauuaaccaggugagauccuugaucgggaaugaagaguauacugacuacaugccuucaaugaaacgcuuucggagggaagaggaagaggccggaguacugugguga

SEQ ID NO: 14954 - RNA, 9876 nt, Artificial Sequence
  derived and/or modified CDS sequence (opt3) from DENV-2__KC762667__SS-prME
accgccggaaucauuauaaugaugauccccacagugauggcuuuccaccugacuacgagaaacggggagccucauaugauuguaagcaggcaggaaaagggaaaaucccuccuuuuuaagaccgagaaugguguuaacaugugcacacugauggcaauggacuugggcgaauuaugugaggauacuaucaccuacaauugcccacugcuacggcaaaacgaaccggaggacauugauuguuggugcaauucuacaucaaccugggugacuuaugggacauguaccgccacgggagagcaccgccgagaaaaacguaguguagcgcucgugccccauguaggcaugggucuggagacucggaccgaaacauggaugagcuccgagggggcuuggaagcacgcccagaggaucgagacuugggugcuucggcauccuggauucaccauaauggcagccauccuggcuuacacaauuggcaccacguauuuucagcgcguuuugaucuucauucuccugacugcagugacaccaucuaugaccaugagaugcaucggcauaucgaacagggacuuugucgaaggggugucaggagguagcuggguagauauuguucuggagcacggcaguugugugacuacaauggccaaaaauaagcccacccucgacuucgaauuaaucaagacggaggcuaaacacccugccacccugcggaaguacugcauugaagcgaaacuuacaaacacuaccacagcaucccgcuguccaacucagggggagcccucuuugaaugaggaacaagauaagcgauuugucugcaaacauagcaugguggacagaggauggggcaacgguugugggcuguucggaaagggcggcaucgugaccugcgccauguuuacaugcaagaaaaauauggaggggaagaucguccagccugaaaaccuagaguauaccauuguuauaacuccacacuccggagaagagaaugcuguggguaacgauacgggcaaacaugggaaggagaucaaaguaacaccgcagucaaguauuaccgaagccgagcucacuggauacggcaccgugacaauggaauguagccccaggaccggucuggacuucaaugagaugguccuucugcagauggaaaacaaggcaugguuggugcaccggcaaugguuucucgaucugccuuuaccauggcugcccggggcugacacucagggcucuaacuggauccagaaagagacacucguuacguucaagaauccucacgccaagaaacaggauguggucgugcuuggaucccaagagggcgcgaugcauaccgcccugacuggggcaacagaaauacagaugucaagcggaaacuugcuauuuaccggucaccugaagugccgucuccgcauggacaaacugcagcuuaagggcaugaguuauucuauguguacagggaaauucaagguaguuaaggagauugcugaaacucaacauggaaccaucgugaucagaguccaguacgagggcgacgguuccccaugcaaaauucccuucgagaucauggaucuggaaaagaggcacguguuggggcggcucauuacggucaauccgauagugaccgagaaagacagcccuguuaacaucgaagccgagcccccauuuggcgauucguacauuaucaucggaguggaaccuggccagcugaaguuaucuugguucaaaaagggguccucaauuggacagauguuugagacaacuaugcgaggugcuaagcgcauggccauacugggcgacaccgcaugggauuucgggagucuaggaggcguauuuacaagcaucgguaaagcccuccaucaagucuucggggcuauuuauggcgcggcauuuuccggagugucuuggacuaugaagauccugauuggcguugugaucaccuggauagggaugaauagcagaucaacgagucuuuccgucagcuuggugcugguaggagugguuacacucuaccugggcgucauggugcaggccgacucugguuguguggucucauggaaaaacaaggagcuuaaaugcgggaguggaaucuucauuaccgauaauguucacacuuggacagaacaguauaaguuucagcccgagagcccauccaagcuggcuucugccauccaaaaagcacacgaagagggcauuugugguaucaggucggugacccgguuggaaaaccucauguggaagcagauaacucccgagcugaaucauauuuuaagcgagaacgaagugaaacugaccaucaugacaggcgacauuaaggggaucaugcaggccggaaaacgcucccuaagaccucagccaacggagcucaaguacucauggaaaaccuggggcaaggcuaagaugcugaguacugaacuucacaaucauacauucuugauagaugggccggagaccgccgaaugccccaacgcaaauagggcguggaacucucuggagguagaggacuauggauuuggcgucuucacaacuaauaucuggcucaaacugaaggaacgucaagaugcuuuuugugacagcaaauuaauguccgccgcaauuaaggacaaccgggccgugcacgcugauauggguuacuggaucgagucagcccugaacgacaccuggaaaauugaaaaggccagcuucaucgagguuaagucuugccacuggccuaaaucccauacgcuuuggaguaaugggguguuggagagcgaaaugauaauuccaaagaacuucgcuggacccgucucucagcacaauuaucgaccuggcuaccauacacagaccgccgguccauggcaccucggcagacuggagauggauuuugacuucugugaagggacuaccgugguugugacagaggauugcggaaacaggggccccucccuacgcacuaccacagcgucagggaaacugaucacggaauggugcugucggaguugcacccucccgccucugagauacaggggagaggacggcuguugguaugguauggagauccgcccacuuaaggaaaaagaggaaaauuugguaaacagccuggucacugccgggcauggacagauugauaauuuuucguuaggcgugcucgguauggcucuguuccuugaggaaaugcugcgaacacgggugggcaccaagcacgcaaucuugcucgucgccguuuccuuugugacucugauuacagggaacaugucuuuccgugaccuaggaagaguaauggugauggucggcgcuaccaugacggaugacauagggaugggagugacuuaccuggcccuccuggcagcguuuaagguuaggcccaccuucgccgcuggccuuuugcugcgcaaauuaacaagcaaggagcucaugaugaccacuaucggugugacacugcuuucacaaaguaccauuccugagacaauccuggaacuaacugaugcccucgcacuggggaugauggucuugaaaauugugcggaauauggagaaguaucagcuggcuguuaccaucauggccauauuaugcgugcccaacgcagucauccuccagaaugccuggaaaguauccuguacgacacuggcugugguuucugugagcccacuucuguugaccuccucacaacagaaggcggacuggauuccucucgcccugacuaucaagggacuaaaccccaccgcaauuuuucugacaacucuuagcagaaccaguaaaaagaggucuuggccacucaaugaagcuaucauggccgucggcaugguguccauacuggccagcucguugcugaaaaacgauauuccgaugacgggcccuuuaguagcugggggacuccugacagugugcuacguccuuaccggucgaucagcagaccuggaguuggaacgcgccgcggacguucggugggaggagcaggcugaaaucucuggcaguucccccauccucagcauuacuauaucugaggaugggagcauguccaucaagaaugaagaggaggaacagacacugaccauucuaaucagaacuggacugcuugugauuucaggccucuucccagugaguauccccauaacagccgcagccugguaucugugggaggucaaaaagcaaagggcugguguguugugggacguuccuagcccacccccuguagggaaagcagaauuagaggauggagccuaccguaucaagcagaagggcauucugggcuauucucagaucggggcgggaguguacaaagaagguaccuuucacacgauguggcaugucacucgcggcgcugugcucaugcacaaggggaaacggauugagccguccugggccgacguuaagaaagaucugaucucauacggaggcgguuggaaacuugagggggaauggaaggagggagaagaggugcagguccuggcauuggaaccaggcaaaaaccccagagccgugcaaaccaagccuggccuauucaaaacaaguaccgggacaauaggagcuguaagccuggacuuuuccccagguacuucuggcucgcccauugucgauaagaaagggaaggugguuggacucuauggcaacgguguggucaccaggagcgggacguacgugucagccaucgcacagacagagaaguccaucgaggacaauccugaaauugaggaugacaucuucagaaagaaacggcugacuauaauggaucuucauccgggagcuggcaaaaccaagcgcuauuuacccgccauuguuagagaagcgaucaaaaggggccugcggacacucauuuuggccccaacccgaguggucgcagcugagauggaagaggcccugagagggcucccuauccgcuaccagacucccgcuauaagggcagagcacaccggacgugaaauuguggaccugaugugucaugccacauucacgaugcggcuucugaguccaaucagaguaccuaacuauaauuugaucauuauggaugaggcccacuuuacugaccccgcuucuaucgcggcaagggguuacauuagcacccgcguggaaaugggcgaggccgcugggauauucaugacagccaccccaccgggaucccgagacccuuuuccccagucaaacgcaccaaucauggaugaggaaagagagauucccgaacggucuuggaauagcggccacgaguggguuacugacuucaaggguaagacagucugguuugugccuaguaucaaagccgggaacgauaucgcugcgugccuaaggaagaauggcaaaaaggugauucaacugucccgcaaaaccuucgacuuugaauauauaaagacgcguacuaacgauugggacuucgucguaacaaccgauaucagcgagaugggcgccaauuuuaaggcagagagagugauugacccacggagguguaugaaacccguuauccucaccgauggcgaagaacgcgugauuuuagcugggccuaugccggucacucauucuucagccgcacagcgaagaggacggguggguaggaacccaaagaaugaaaacgaccaguacaucuacaugggcgagccccuggaaaaugaugaggacugcgcccacuggaaagaggcuaagaugcuucuggacaacauaaauacaccugaagggaucauucccuccauguucgagccagaacgcgagaaaguugaugccaucgacggagaauauagacucaggggcgaggcgcggaagaccuuuguggauuugaugcgucgcggugaccugccugucuggcucgcauaccgaguggccgcugaggggauuaacuaugccgauagaaggugguguuucgacggcgucaaaaacaaucaaauccuggaagagaacguggaaguugagauauggacaaaggagggagaacggaagaaacuuaagccccgcuggcuagaugcuagaauuuacagugacccacuggcauugaaagaguucaaggaauuugccgcuggcaggaagucguuaacucugaaucucaucacggagauggggcggcugccuaccuucaugacacagaaggcccgaaacgcacuugauaaucuggcgguccuccauacugccgaagcuggagguagagccuauaaccacgcauugagcgagcugccggagacccuagaaacacugcuccuucugaccuuauuggcuacugugacgggcgggauuuuucuguuccucaugucuggaaagggcaucgguaaaaugacccuggggaugugcugcauaaucacagccuccauucuucugugguacgcacagauccagccccacuggauugccgcuagcaucauacucgaguuuuucuugauugugcuguuaaucccagaaccugagaagcaacgcacuccccaggacaaucagcuaaccuaugucguuaucgcgauucugacagugguagccgcaaccauggcuaacgaaaugggcuuucucgagaaaacuaagaaagauuucggacuuggcucaaucacaacgcagcaaccagagaguaauauacuggacauugauuugaggccugccucugccuggacccuguacgcaguggcuacuacauuuaucacccccaugcuccggcauuccauugaaaacagcucagucaaugugagucugaccgccaucgcgaaccaggcuacaguucuuauggggcucggaaaggguuggccgcugagcaagauggacauaggcgugccauugcuggccaucggguguuacucccaggucaauccuauuacuuuaacggcagcccuacugcuccuuguagcucacuaugcaaucauuggacccggccugcaggccaaagcgacccgugaggcucaaaagagagccgcagccgguaucaugaaaaacccaacaguggacgggauuacuguuaucgauuuggaccccauaccuuacgauccgaaguucgaaaaacagcugggccaggugaugcuccugguccuuugcgugacccaggucuuaaugaugaggacaaccugggcucugugugaggcccucacuuuggcaacgggacccauuucuacacugugggaaggcaauccagggcgcuuuuggaacaccacuaucgcugugagcauggccaauaucuuccggggauccuaucuagcgggcgccggucugcucuuuucaauuaugaagaacaccgcaaacacacgaagagggacuggaaauaccggcgagacacuuggugagaaguggaaaaacaggcugaaugcuuugggcaagucugaguuccaaauauacaaaaagagugggauccaggagguugaccgcacgcuggccaaagaaggaauuaagcggggcgagaccgaucaucacgcagugucgagagggagcgcuaaacuccguugguucguagagaggaaccuggugacuccugaaggaaaggucguugacuuaggcugcgguagagggggaugguccuauuacuguggcggucuuaagaaugugaaagaggucaagggccugacaaaagggggacccggccaugaagaaccuaucccaaugucuaccuauggguggaaccucgugcgccuacagucaggaguagauguguuuuucacucccccugaaaagugcgacacacuguugugugauauuggcgagagcuccccaaaucccaccguugaggccggucgaacgcugagagugcucaaccuugucgaaaauuggcugaacaauaacacccaauuuugcaucaaaguguugaauccguacaugccuagugucauagagaagauggaagcccugcagaggaaguacgggggagcgcucgugcggaacccauuaucucgcaauagcacacacgagauguauuggguuucaaacgcuuccggcaacaucguaaguagcgugaauaugauuucuagaaugcugaucaacagguucacuaugcgacacaaaaaggcaaccuacgaacccgacgucgaucuuggcuccgggacacggaauauuggaaucgagucagagacuccuaaccuggacauaauugguaaacguaucgaaaagaucaaaagagagcaugaaaccagcuggcacuaugaucaggaccauccauacaagacaugggccuaucacggcucguacgagaccaagcagacugggucugcuaguuccauggugaauggaguugugcgccuacucacgaaacccugggacgucauuccgauggugacacaaauggccaugaccgauacuaccccuuuuggccagcagaggguauucaaggaaaaaguggacacacggacgcaggagcccaaggaggguaccaaaaagcugaugaagauaacugcagaaugguuguggaaagagcuggggaagaaaaagacaccaagaauguguacccgcgaagaguuuacuaggaaaguucgaagcaacgccgcucucggagcgaucuucacagaugagaauaaguggaaaucagcccgggaagcagucgaggacuccggcuuuugggaacuuguggauaaggagagaaaccugcacuuagaaggcaagugcgagaccuguguguauaauaugauggggaaaagggagaagaaacugggagaguucgguaaggcuaaaggcucucgcgccauuugguacaugugguugggggcacguuuucucgaguucgaagcccugggauuucuaaacgaggaccauugguucagccgggaaaauagucuuuccggcgucgagggugaggggcugcacaagcucggauacauccugagagauguuagcaagaaagaaggcggcgcuauguaugccgacgauacagcggggugggacacuaggauuaccuuggaggaucugaagaacgaagagauggugacgaaucauauggaaggagagcacaaaaagcucgcagaggccaucuucaaacuuaccuaccaaaacaagguagugcgcguccagcgaccuacaccccgggguacugugauggacauaaucucuagaagggaccagcgcggcucagggcagguugugaccuauggacugaauacauuuacuaacauggaagcucaauuaauuagacagauggagggcgaaggugucuucaagaguauccagcaucugaccgugacggaggagauugccgucaaaaacugguugguucggguggggagggaacgucucucccgaauggcaaucagcggagaugacugcgucgugaagccacuggaugaccgcuuugcuucugcccuaacagcucuuaaugauaugggcaaagugagaaaggacauucaacagugggagcccucgcggggcuggaacgauuggacccaggucccuuucugcucacaccacuuucaugaacugauaaugaaagacgggaggguucucgugguaccaugucgcaaucaggaugagcugaucggacgagcacggauuagccaaggugcaggcugguccuugagggaaacugcgugcuuagggaagaguuacgcccagauguggucucugauguauuuccaccgacgugaccucagacuugcugccaacgcaaucuguagcgcugugccgucccauuggguccccacaucacgcaccacuuggaguauccacgccacccacgaguggaugacaacggaggauaugcugaccguguggaaucggguuuggauucaggaaaacccuuggauggaggacaagacuccaguggaaucuugggaggaaauacccuaccuaggaaaaagggaggaucaguggugcggcagccugaucggucucacauccagagcaaccugggccaagaauauucaaacugcgaucaaccagguccgcucauugauugggaaugaggaauauacagacuacaugccuagcaugaaacgguuuaggcgagaggaagaggaagcuggagugcugugguga

SEQ ID NO: 14955 - RNA, 9876 nt, Artificial Sequence
  derived and/or modified CDS sequence (opt3) from DENV-2__KC762659__SS-prME
accgccggaaucauuauaaugaugauccccacagugauggcuuuccaccugacuacgagaaauggggagccucauaugauugucagcaggcaggaaaagggaaaaucccuccuuuuuaagaccgagaaugguguuaacaugugcacacugauggcaauggacuugggagaauuaugugaggauacuaucaccuacaauugcccacugcuacggcaaaacgaaccggaggacauugauuguuggugcaauucuacaucaaccugggugacuuaugggacauguaccgccacgggagagcaccgccgagaaaaacguaguguagcgcucgugccccaugucggcaugggucuggagacuagaaccgaaacauggaugagcuccgagggggcuuggaagcacgcccagaggaucgagacuugggugcuucggcauccuggauucaccauaauggcagccauccuggcuuacacaauuggcaccacguauuuucagcgcguuuugaucuucauucuccugacugcagugacaccaucuaugaccaugagaugcaucggcauaucgaacagggacuuugucgaaggggugucaggagguagcuggguagauauuguucuggagcacggcaguugugugacuacaauggccaaaaauaagcccacccucgacuucgaauuaaucaagacggaggcuaaacacccugccacccugcggaaguacugcauugaagcgaaacuuacaaacacuaccacagcaucccgcuguccaacucagggggagcccucuuugaaugaggaacaagauaagcgauuugucugcaaacauagcaugguggacagaggauggggcaacgguugugggcuguucggaaagggcggcaucgugaccugcgccauguuuacaugcaagaaaaauauggaggggaaggucguucagccugaaaaccuagaguauaccaucgugauuacuccacacuccggagaagagaaugcuguagguaacgauacgggcaaacaugggaaggagauaaaagugacaccgcagucaaguaucaccgaagccgagcucacuggauacggcaccgucacaauggaauguagccccaggaccggucuggacuucaaugagauggugcuucugcagauggaaaacaaggcaugguugguucaccggcaaugguuucucgaucugccuuuaccauggcugcccggggcugacacucagggcucuaacuggauucagaaagagacacucgugacguucaagaauccucacgccaagaaacaggaugucgugguacuuggaucccaagagggcgcgaugcauaccgcccugacuggggcaacagaaauccagaugucaagcggaaacuugcuauuuaccggucaccugaagugccgucuccgcauggacaaacugcagcuuaagggcaugaguuauucuauguguacagggaaauucaagguugugaaggagauagcugaaacucaacauggaaccauugucaucagagugcaguacgagggcgacgguuccccaugcaaaauccccuucgagauuauggaucuggaaaagaggcacgucuuggggcggcucaucacggugaauccgauuguuaccgagaaagacagcccugugaacauagaagccgagcccccauuuggcgauucguacaucauuaucggaguagaaccuggccagcugaaguuaucuugguucaaaaagggguccucaaucggacagauguuugagacaacuaugcgaggugcuaagcgcauggccauucugggcgacaccgcaugggauuucgggagucuaggaggcgucuuuacaagcauagguaaagcccuccaucaaguguucggggcuaucuauggcgcggcauuuuccggaguuucuuggacuaugaagauucugaucggcguggucauuaccuggaucgggaugaauagcagaucaacgagucuuuccgugagcuugguacuggugggaguugucacacucuaccugggcgugauggugcaggccgacucugguugugucguuucauggaaaaacaaggagcuuaaaugcgggaguggaauauucaucaccgauaaugugcacacuuggacagaacaguauaaguuucagcccgagagcccauccaagcuggcuucugccauucaaaaagcacacgaagagggcaucugugguauuaggucggugacccgguuggaaaaccucauguggaagcagaucacucccgagcugaaucauauauuaagcgagaacgaaguaaaacugaccauuaugacaggcgacaucaaggggauuaugcaggccggaaaacgcucccuaagaccucagccaacggagcucaaguacucauggaaaaccuggggcaaggcuaagaugcugaguacugaacuucacaaucauacauucuugaucgaugggccggagaccgccgaaugccccaacacaaauagggcauggaacucucuggaggucgaggacuauggauuuggcguguucacuaccaauauauggcucaaacugaaggaacgucaagauguauuuugugacagcaaauuaauguccgcggcuaucaaggacaaccgggccgugcacgcagauauggguuacuggauggagucagcccugaacgacacguggaaaauugaaaaggcuagcuucaucgaggucaagucuugccacuggccuaaaucccauacacuuuggaguaaugggguguuggagagcgaaaugauuaucccaaagaacuucgccggacccguuucucagcacaauuaucgaccuggcuaccauacccagacugcagguccauggcaccucggcagacuggagauggauuuugacuucugugaagggaccacagugguagucacugaggauugcggaaacaggggccccucccuacgcaccacaacggcuucagggaaacugauaaccgaauggugcugucggaguugcacucucccgccucugagauacaggggagaggacggcuguugguaugguauggagauucgcccacuuaaggaaaaagaggaaaauuuggugaacagccuggugacagccgggcauggacagaucgauaauuuuucguuaggcguccucgguauggcgcuguuccuugaggaaaugcugcgaacccggguuggcacuaagcacgccaucuugcucguggcuguauccuuugugacacugauuaccgggaacaugucuuuccgugaccuaggaagagucauggugaugguuggcgcaacgaugacugaugacaucgggaugggagugaccuaccuggcccuccuggcugccuuuaaggucaggcccacauucgcagcgggccuuuugcugcgccgguuaaccagcaaagagcucaugaugacuacaauugguauagugcugcuuucacaaaguaccaucccugagacaauucuggaacuaacugaugcccucgcucuggggaugaugguuuugaagaucgugagaaaaauggagaaguaucagcuggccgucaccauuauggcaaucuuaugcguacccaaugcugugauacuccagaacgccuggaaaguuuccuguacgacacuggcaguggucucugugagcccacuucuguugaccuccucacaacagaaggccgacuggaucccucucgcucugacuauuaagggacuaaaucccaccgcgaucuuucugacaacucuuagcaggaccaguaaaaagcgaucuuggccacucaacgaagccauuauggcaguaggcaugguguccauccuggcuagcucguugcugaaaaaugauauaccgaugacgggcccuuuagucgccgggggacuccugacaguuugcuacgugcuuaccggucgcucagccgaccuggaguuggaacgggcugcagacgugagaugggaggagcaggccgaaauuucuggcaguucccccauccucagcaucacuauuucugaggaugggagcauguccauaaagaacgaagaggaggaacagacacugaccauccuaauuaggacuggacugcuugucaucucaggccucuucccagugaguauucccaucacagcggcugccugguaucugugggagguuaaaaagcaacgugccgguguuuugugggacgugccuagcccacccccugucgggaaagcagaauuagaggauggagcuuaccgcauaaagcagaagggcauccugggcuauucucagauuggggcaggaguguacaaagaagguaccuuucacacgauguggcauguuacucggggcgccgugcucaugcacaaggggaaaagaaucgagccguccugggcggacgucaagaaagaucugauuucauacggaggcgguuggaaacuugagggggaauggaaggagggagaagaggugcagguacuggcuuuggaaccaggcaaaaaucccagggccguccaaaccaagccuggccuauucaaaacaaacaccgggacaaucggagcagugagucuggacuuuagcccagguacuuccggcucucccauaguugauaagaaagggaagguggucggacucuauggcaacggugugguuacccgaucggggacguacgugagcgccauugcucagacagagaagucaaucgaggacaauccugaaaucgaggaugacauuuuccggaaaaagcgccugacuaucauggaucuucauccgggagccggcaaaaccaagagauauuuacccgcaauagucagggaagcuauuaaacggggccugcgaacacucaucuuggccccaaccagagugguagcggccgagauggaagaggcacugcgcgggcucccuauuagguaccagacucccgcuauccgugccgagcacaccggacgggaaauaguggaccugaugugucaugcuacauucacgaugagacuucuguccccaauuaggguuccuaacuauaauuugaucaucauggaugaggcacacuuuacugaccccgccaguauugccgcucgcgguuacaucucuacccgagucgaaaugggcgaggcggcagggauuuucaugacagccaccccaccgggaagcagagacccuuuuccccaguccaacgcuccaauaauggaugaggaacgggagauccccgaaaggucauggaacucuggccacgagugggugacugacuucaaggguaagacagugugguuugucccuagcauuaaagccgggaacgauaucgcagccugccuacgcaagaauggcaagaagguaauccaacugagucguaaaaccuucgacuuugaauauauuaagacgagaacuaacgauugggacuucgugguuacaaccgauauauccgagaugggcgcuaauuuuaaggcggagcgggugaucgacccaaggcgcuguaugaaacccgucauucucaccgauggcgaagaacgagugaucuuagccgggccuaugccgguuacucauagcucugcagcucagagacggggaagggugggucgcaacccaaagaaugaaaacgaccaguacauuuacaugggcgagccccuggaaaaugaugaggacugcgcccacuggaaagaggcaaagaugcuucuggacaacaucaauacaccugaagggauaauccccucaauguucgagccagaaagagagaaagucgaugccauugacggagaauauaggcuccggggcgaggcucguaagaccuuuguggauuugaugcgccgaggugaccugccuguauggcucgccuacagaguggcggcagaggggaucaacuaugccgauaggcggugguguuucgacggcguuaaaaacaaucaaauucuggaagagaacgucgaaguggagaucuggacaaaggagggagaacgcaagaaacuuaagcccagauggcuagaugcuaggauauacuccgacccacuggccuugaaagaguucaaggaauuugcugcaggccggaaaaguuuaacucugaaucucauuacggagauggggcgacugccuaccuucaugacacagaaggccagaaacgcucuugauaaucuggccgugcuccauacugcagaagcgggaggucgcgccuauaaccacgcuuugagcgagcugccggagacccuagaaacacugcuccuucugaccuuauuggccacugucacgggcgggaucuuucuguuccucaugucgggaaagggcauugguaaaaugacccuggggaugugcugcaucauaacagcaucuauccuucugugguacgcucagauucagccccacuggaucgccgcauccauuauccucgaguuuuucuugauaguucuguuaauuccagaaccugagaagcaaaggacuccccaggacaaucagcuaaccuaugugguaaucgccauccugacaguggucgcugcgaccauggccaacgaaaugggcuuucucgagaaaacuaagaaagauuucggacuuggcagcauuacaacgcagcaaucagagaguaauauccuggacauagauuugcggccagcaucugcuuggacccuguacgccguggccacuacauuuauuaccccuaugcuccgucauuccaucgaaaacagcucaguuaaugugagucugaccgcaauugcuaaccaggccacaguccuuauggggcucggaaaggguuggccccugagcaagauggacaucggcguaccguugcuggcgauaggguguuacucccaggugaauccaaucacuuuaacggcugcccuacugcuccuuguugcacacuaugccauuaucggaccuggccugcaggcuaaagcaaccagagaggcccaaaagagggcggcugccgguauuaugaaaaaccccacaguggacgggaucacugucauugauuuggacccaauccccuacgauccuaaguucgaaaaacagcugggccaggugaugcuccugguccuuugcgugacccagguuuuaaugaugcgcacaaccugggcacugugugaggcccucacuuuggcuacgggaccgauaucuacacugugggaaggcaaucccgggcgguuuuggaacaccacuauugccgugagcauggcaaauaucuuccgaggauccuaucuagcuggcgccggucugcucuuuucaaucaugaagaacaccgcgaacacaagaagggggacuggaaauaccggcgagacacuuggugagaaguggaaaaaccgccugaaugccuugggcaagucugaguuccaaauuuacaaaaagagugggauacaggagguagaccggacgcuggcaaaagaaggaaucaagagaggcgagaccgaucaucacgcugugucgcgugggagcgccaaacucaggugguucgucgagcggaaccugguuacuccagaaggaaagguggucgacuuaggcugcggucgcgggggaugguccuauuacuguggcggucuuaagaaugugaaagagguaaagggccugacaaaagggggaccuggccaugaagaacccauuccuaugucuaccuauggguggaaccucgugcgacuacagucaggaguugauguguuuuucacuccacccgaaaagugcgacacacuguugugugauaucggcgagagcuccccuaauccaaccgucgaggcagguagaacgcugagggugcucaaccuugucgaaaauuggcugaacaauaacacccaauuuugcauuaaaguguugaaucccuacaugccgaguguuaucgagaagauggaagcucugcagcggaaguacgggggagcccucguacgcaacccuuuaucuagaaauagcacacacgagauguauugggugucaaacgccuccggcaacauagucaguagcgugaauaugaucucuaggaugcugauuaaccgauucacuaugcggcacaaaaaggcgaccuacgaaccagacguugaucuuggcuccgggacacguaauaucggaauugagucagagacucccaaccuggacaucauagguaaaagaauugaaaagaucaaacaggagcaugaaaccagcuggcacuaugaucaggaccauccuuacaagacaugggcuuaucacggcucguacgagaccaagcaaacugggucugcaaguuccauggugaauggagucgugcgccuacucacgaaaccaugggacguaauccccauggugacacagauggccaugaccgauacuaccccguuuggccagcagaggguuuucaaggaaaaagucgacacacggacgcaagagccuaaggaggguaccaaaaagcugaugaagauuacugcugaaugguuguggaaagagcuggggaagaaaaagacacccagaauguguacccgcgaagaguuuacuaggaaagugcgaagcaacgccgcacucggagccauauucacagaugagaauaaguggaaaucagcucgggaagcgguggaggacuccggcuuuugggaacuugucgauaaggagagaaaccugcacuuagaaggcaagugcgagaccuguguuuauaauaugauggggaaaagggagaagaaacugggagaguucgguaaggccaaaggcucucgcgcaaucugguacaugugguugggggcucguuuucucgaguucgaagcccugggauuucuaaacgaggaccauugguucagccgggaaaauagucuuuccggcguggagggugaggggcugcacaagcucggauacauucugagagauguaagcaagaaagaaggcggcgcaauguaugccgacgauacagcugggugggacacuaggaucaccuuggaggaucugaagaacgaagagauggugacgaaucauauggaaggagagcacaaaaagcucgccgaggcgauuuucaaacuuaccuaccagaacaaggucgugcgcguucagcgaccaacaccucgggguacugugauggacaucauaucuagaagggaccagcgcggcucagggcaagucgugaccuauggacugaauacauuuacuaacauggaagcacaguuaaucagacagauggagggcgaagguguauucaagaguauucaacagcugaccgccacggaggagaucgcuguuaaaaacugguuggugcgggucgggagggaacgucucucccgaauggccauuagcggagaugacugcguggugaagccccuggaugaccgcuuugcaucugcucuaacagcccuuaaugauaugggcaaagucagaaaggacauccagcagugggagccaucgcggggcuggaacgauuggacccaaguucccuucugcucacaucacuuucacgaacugauuaugaaagacgggagggugcucguagugccuugucgcaaucaggaugagcugauaggcagagcucggaucagccagggugccggcugguccuugagggaaacugcaugcuuagggaagaguuacgcgcagauguggucucugauguauuuccaucgacgugaccucagacuugccgcuaacgccauuuguagcgcagucccaucccacugggugccgacaucacgcaccacuuggaguauccaugcuacccacgaguggaugacaacggaggauaugcugaccguuuggaaucggguguggauccaagaaaaccccuggauugaggacaagacuccugucgaaucuugggaggaaauaccauaccuaggaaaaagggaggaucaguggugcggcagccugaucggucucacauccagagccaccugggcaaagaauauucagacugccaucaaccaggugcgcucauugauugggaaugaggaauauacagacuacaugcccagcaugaaacgguuuaggcgagaggaagaggaagcgggaguacugugguga

SEQ ID NO: 14956 - RNA, 9876 nt, Artificial Sequence
  derived and/or modified CDS sequence (opt3) from DENV-2__KC762657__SS-prME
accgccggaaucauuauaaugaugauccccacagugaugguauuccaccugacuacgagaaauggggagccucauaugauuguuagcaggcaggaaaagggaaaaucccuccuuuuuaagaccgagaauggugugaacaugugcacacugauggcuauggacuugggcgaauuaugugaggauacuaucaccuacaauugcccacugcuacggcaaaacgaaccggaggacauugauuguuggugcaauucuacaucaaccuggguaacuuaugggacauguaccgcaacgggagagcaccgccgagaaaaacguaguguggcccucgucccccaugugggcaugggucuggagacuagaaccgaaacauggaugagcuccgagggggcguggaagcacgcucagaggaucgagacuuggguucuucggcauccuggauucaccauaauggccgcaauccuggccuacacaauuggcaccacguauuuucagcgcguguugaucuucauucuccugacugcugucacaccaucuaugaccaugagaugcaucggcauaucgaacagggacuuuguggaagggguaucaggagguagcuggguugauauugugcuggagcacggcaguugugucacuacaauggccaagaauaagcccacccucgacuucgaauuaaucaagacggaggccaaacacccugcuacccugcggaaguacugcauugaagccaaacuuacaaacacuaccacagcgucccgcuguccaacucagggggagcccucuuugaaugaggaacaagauaagcgauuugugugcaaacauagcaugguggacagaggauggggcaacgguugugggcuguucggaaagggcggcaucguaaccugcgcaauguuuacaugcaagaaaaauauggaggggaagguugugcagccugaaaaccuagaguauaccaucguaauuacuccacacuccggagaagagaaugccguggguaacgauacgggcaaacaugggaaggagauaaaagucacaccgcagucaaguaucaccgaagcugagcucacuggauacggcaccgugacaauggaauguagccccaggaccggucuggacuucaaugagaugguucuucugcagauggaaaacaaggccugguuggugcaccggcaaugguuucucgaucugccuuuaccauggcugcccggggcagacacucagggcucuaacuggauucagaaagagacacucgucacguucaagaauccucacgcuaagaaacaggaugugguaguucuuggaucccaagagggcgccaugcauaccgcgcugacuggggccacagaaauccagaugucaagcggaaacuugcuauuuaccggucaccugaagugccgucuccgcauggacaaacugcagcuuaagggcaugaguuauucuauguguacagggaaauucaagguggucaaggagauagcagaaacucaacauggaaccauugugaucagaguccaguacgagggcgacgguuccccaugcaaaauccccuucgagauuauggaucuggaaaagaggcacguguuggggcggcucaucacgguuaauccgauugugaccgagaaagacagcccuguaaacauagaagcugagcccccauuuggcgauucguacaucauuaucggagucgaaccuggccagcugaaguuaucuugguucaaaaagggguccucaaucggacagauguuugagacaacuaugcgaggugccaagcgcauggcuauucugggcgacaccgccugggauuucgggagucuaggaggcguguuuacaagcauagguaaagcacuccaucaaguuuucggggccaucuauggcgcugcguuuuccggagugucuuggacuaugaagauucugaucggcgucgugauuaccuggaucgggaugaauagcagaucaacgagucuuuccgucagcuuggugcugguuggagucgugacacucuaccugggcgugaugguccaggcagacucugguuguguugugucauggaaaaacaaggagcuuaaaugcgggaguggaauauucaucaccgauaaugugcacacuuggacagaacaguauaaguuucagcccgagagcccauccaagcuggccucugcuauucaaaaagcccacgaagagggcaucugugguauuaggucgguaacccgguuggaaaaccucauguggaagcagaucacucccgagcugaaucauauauuaagcgagaacgaagucaaacugaccauuaugacaggcgacaucaaggggauuaugcaggcaggaaaacgcucccuaagaccucagccaacggagcucaaguacucauggaaaaccuggggcaaggccaagaugcugaguacugaacuucacaaucauacauucuugaucgaugggccggagaccgcugaaugccccaacacaaauagggccuggaacucucuggagguggaggacuauggauuuggcguuuucacuaccaauauauggcucaaacugaaggaacgucaagauguguuuugugacagcaaauuaauguccgcagcgaucaaggacaaccgggcuguccacgccgauauggguuacuggauggagucagcacugaacgacacguggaaaauugaaaaggccagcuucaucgaggugaagucuugccacuggccuaaaucccauacacuuuggaguaaugggguuuuggagagcgaaaugauuaucccaaagaacuucgcuggacccgugucucagcacaauuaucgaccuggcuaccauacccagacugccgguccauggcaccucggcagacuggagauggauuuugacuucugugaagggaccacaguagucgugacugaggauugcggaaacaggggccccucccuacgcaccacaacggcaucagggaaacugauaaccgaauggugcugucggaguugcacucucccgccucugagauacaggggagaggacggcuguugguaugguauggagauucgcccacuuaaggaaaaagaggaaaauuuggugaacagccuggucacagcugggcauggacagaucgauaauuuuucguuaggcguucucgguauggcccuguuccuugaggaaaugcugcgaacccgggugggcacuaagcacgcgaucuugcucguagccguguccuuugucacacugauuaccgggaacaugucuuuccgugaccuaggaagagugaugguuauggugggcgcuacgaugacugaugacaucgggaugggagucaccuaccuggcacuccuggccgcuuuuaaggugaggcccacauucgccgcaggccuuuugcugcgccgguuaaccagcaaagagcucaugaugacuacaauugguauaguucugcuuucacaaaguaccaucccugagacaauucuggaacuaacugaugcgcucgcccuggggaugaugguguugaagaucgucagaaaaauggagaaguaucagcuggcuguaaccauuauggccaucuuaugcgugcccaaugcaguuauacuccagaacgcuuggaaaguguccuguacgacacuggccgucgugucuguaagcccacuucuguugaccuccucacaacagaaggcagacuggaucccucucgcccugacuauuaagggacuaaaucccaccgcuaucuuucugacaacucuuagcaggaccaguaaaaagcgaucuuggccacucaacgaagcgauuauggccgugggcauggucuccauccuggcaagcucguugcugaaaaaugauauaccgaugacgggcccuuuaguugcugggggacuccugacagugugcuacgugcuuaccggucgcucagccgaccuggaguuggaacgggccgcugacgucagaugggaggagcaggcagaaauuucuggcaguucccccauccucagcaucacuauuucugaggaugggagcauguccauaaagaacgaagaggaggaacagacacugaccauccuaauuaggacuggacugcuugugaucucaggccucuucccaguuaguauucccaucacagccgcggcuugguaucugugggaggucaaaaagcaacgugccgguguguugugggacgucccuagcccacccccuguggggaaagcagaauuagaggauggagccuaccgcauaaagcagaagggcauccugggcuauucucagauuggggcuggaguuuacaaagaagguaccuuucacacgauguggcaugugacucggggcgcaguccucaugcacaaggggaaaagaaucgagccguccugggccgacgugaagaaagaucugauuucauacggaggcgguuggaaacuugagggggaauggaaggagggagaagagguacagguccuggcguuggaaccaggcaaaaaucccagggcugugcaaaccaagccuggccuauucaaaacaaacaccgggacaaucggagccguuagucuggacuuuagcccagguacuuccggcucucccauaguggauaagaaagggaaggucgugggacucuauggcaacgguguugugacccgaucggggacguacgucagcgcaauugcccagacagagaagucaaucgaggacaauccugaaaucgaggaugacauuuuccggaaaaagcgccugacuaucauggaucuucauccgggagcuggcaaaaccaagagauauuuacccgccauagugagggaagcaauuaaacggggccugcgaacacucaucuuggcuccaaccagaguaguggccgcggagauggaagaggcccugcgcgggcucccuauuagguaccagacucccgcaauccgugcugagcacaccggacgggaaauaguugaccugaugugucaugccacauucacgaugagacuucuguccccaauuagggucccuaacuauaauuugaucaucauggaugaggcucacuuuacugaccccgcaaguauugccgcccgcgguuacaucucuacccgaguggaaaugggcgaggcugcggggauuuucaugacagcaaccccaccgggaagcagagacccuuuuccccaguccaacgccccaauaauggaugaggaacgggagauccccgaaaggucauggaacucuggccacgagugggugacugacuucaaggguaagacagucugguuuguaccuagcauuaaagcugggaacgauaucgccgcaugccuacgcaagaauggcaaaaaggugauccaacugagucguaaaaccuucgacuuugaauauauuaagacgagaacuaacgauugggacuucguugugacaaccgauauauccgagaugggcgccaauuuuaaggcugagcgggucaucgacccaaggcgcuguaugaaacccgugauucucaccgauggcgaagaacgaguuaucuuagcggggccuaugccggugacucauagcucugccgcacagagacggggaagggucggucgcaacccaaagaaugaaaacgaccaguacauuuacaugggcgagccccuggaaaaugaugaggacugcgcucacuggaaagaggccaagaugcuucuggacaacaucaauacaccugaagggauaauccccucaauguucgagccagaaagagagaaaguggaugcaauugacggagaauauaggcuccggggcgaggcccguaagaccuuuguagauuugaugcgccgaggugaccugccuguguggcucgcuuacagaguugccgcggaggggaucaacuaugcagauaggcggugguguuucgacggcgucaaaaacaaucaaauucuggaagagaacguggaaguggagaucuggacaaaggagggagaacgcaagaaacuuaagcccagauggcuagaugccaggauauacuccgacccacuggcuuugaaagaguucaaggaauuugccgcuggccggaaaaguuuaacucugaaucucauuacggagauggggcgacugccuaccuucaugacacagaaggcaagaaacgcccuugauaaucuggcuguccuccauacugccgaagcaggaggucgcgcguauaaccacgccuugagcgagcugccggagacccuagaaacacugcuccuucugaccuuauuggcuacuguuacgggcgggaucuuucuguuccucaugucgggaaagggcauugguaaaaugacccuggggaugugcugcaucauaacagccucuauccuucugugguacgcacagauucagccccacuggaucgcugccuccauuauccucgaguuuuucuugauagugcuguuaauuccagaaccugagaagcaaaggacuccccaggacaaucagcuaaccuauguagugaucgcaauccugacagucguggccgcuaccauggcgaacgaaaugggcuuucucgagaaaacuaagaaagauuucggacuuggcagcauuacaacgcagcaaucagagaguaauauccuggacauagauuugcggccagccucugcauggacccuguacgcuguugccacuacauuuauuaccccuaugcuccgucauuccaucgaaaacagcucagugaaugucagucugaccgccauugcaaaccaggcuacaguacuuauggggcucggaaaggguuggccccugagcaagauggacaucggcgugccguugcuggccauaggguguuacucccagguuaauccaaucacuuuaacggcggcucuacugcuccuuguggcccacuaugcaauuaucggaccuggccugcaggccaaagcuaccagagaggcacaaaagagggccgcggcugguauuaugaaaaaccccacagucgacgggaucacugugauugauuuggacccaauccccuacgauccuaaguucgaaaaacagcugggccaggucaugcuccuggugcuuugcguuacccagguguuaaugaugcgcacaaccugggcccugugugaggcacucacuuuggccacgggaccgauaucuacacugugggaaggcaaucccgggcgguuuuggaacaccacuauugcuguaagcauggccaauaucuuccgaggauccuaucuagcaggcgcuggucugcucuuuucaaucaugaagaacaccgccaacacaagaagggggacuggaaauaccggcgagacacuuggugagaaguggaaaaaccgccugaaugcguugggcaagucugaguuccaaauuuacaaaaagagugggauacaggagguggaccggacgcuggccaaagaaggaaucaagagaggcgagaccgaucaucacgcagucucgcgugggagcgcuaaacucaggugguucguugagcggaaccuggugacuccagaaggaaaggucguggacuuaggcugcggucgcgggggaugguccuauuacuguggcggucuuaagaauguaaaagaggugaagggccugacaaaagggggaccuggccaugaagaacccauuccuaugucuaccuauggguggaaccucguucgacuacagucaggaguggaugucuuuuucacuccacccgaaaagugcgacacacuguugugugauaucggcgagagcuccccuaauccaaccguggaggccgguagaacgcugaggguccucaaccuuguggaaaauuggcugaacaauaacacccaauuuugcauuaaaguuuugaaucccuacaugccgaguguaaucgagaagauggaagcacugcagcggaaguacgggggagcucucgugcgcaacccuuuaucuagaaauagcacacacgagauguauugggucucaaacgccuccggcaacauagugaguagcguuaauaugaucucuaggaugcugauuaaccgauucacuaugcggcacaaaaaggccaccuacgaaccagacguggaucuuggcuccgggacacguaauaucggaauugagucagagacucccaaccuggacaucauagguaaaagaauugaaaagaucaaacaggagcaugaaaccagcuggcacuaugaucaggaccauccuuacaagacaugggcguaucacggcucguacgagaccaagcaaacugggucugcuaguuccauggucaauggagugguacgccuacucacgaaaccaugggacgugauccccaugguuacacagauggcaaugaccgauacuaccccguuuggccagcagagggucuucaaggaaaaaguggacacacggacgcaagagccuaaggaggguaccaaaaagcugaugaagauuacugccgaaugguuguggaaagagcuggggaagaaaaagacacccagaauguguacccgcgaagaguuuacuaggaaagugcgaagcaacgcugcccucggagcaauauucacagaugagaauaaguggaaaucagcccgggaagcugucgaggacuccggcuuuugggaacuuguugauaaggagagaaaccugcacuuagaaggcaagugcgagaccuguguguauaauaugauggggaaaagggagaagaaacugggagaguucgguaaggcgaaaggcucucgcgccaucugguacaugugguugggggcacguuuucucgaguucgaagcucugggauuucuaaacgaggaccauugguucagccgggaaaauagucuuuccggcguagagggugaggggcugcacaagcucggauacauucugagagaugugagcaagaaagaaggcggcgccauguaugcagacgauacagccgggugggacacuaggaucaccuuggaggaucugaagaacgaagagauggucacgaaucauauggaaggagagcacaaaaagcucgcugaggccauuuucaaacuuaccuaccagaacaaggugguucgcgugcagcgaccaacaccucgggguacugucauggacaucauaucuagaagggaccagcgcggcucagggcaagugguaaccuauggacugaauacauuuacuaacauggaagcgcaguuaaucagacagauggagggcgaagguguuuucaagaguauucaacaucugaccgcaacggaggagaucgccgugaaaaacugguugguccggguggggagggaacgucucucccgaauggcuauuagcggagaugacugcguggucaagccccuggaugaccgcuuugccucugcacuaacagcucuuaaugauaugggcaaaguuagaaaggacauccagcagugggagccaucgcggggcuggaacgauuggacccaggugcccuucugcucacaccacuuucaugaacugauuaugaaagacgggaggguacucguggucccuugucgcaaucaagaugagcugauagguagagcacggaucagccagggagcuggcugguccuugagggaaacugccugcuuagggaagaguuacgcacagauguggucucugauguauuuccaccgacgugaccucagacuugcggccaacgcuauuuguagcgccgugccaucccauuggguuccgacaucacgcaccacuuggaguauccacgcaacccacgaguggaugacaacggaggauaugcugaccguguggaaucgggucuggauccaggaaaaccccuggauugaggacaagacuccuguggaaucuugggaggaaauaccauaccuaggaaaaagggaggaucaauggugcggcagccugaucggucucacauccagagcuaccugggccaagaauauucagacugcaaucaaccagguacgcucauugauugggaaugaggaauauacagacuacaugcccagcaugaaacgguuuaggcgagaggaagaggaagccggaguucugugguga

SEQ ID NO: 14957 - RNA, 9876 nt, Artificial Sequence
  derived and/or modified CDS sequence (opt3) from DENV-2__KC762666__SS-prME
accgccggaaucauuauaaugaugauccccacagugauggcuuuccaccugacuacgagaaacggggagccucauaugauugucagcaggcaggaaaagggaaaaucccuccuuuuuaagaccgagaaugguguuaacaugugcacacugauggcaauggacuugggcgaauuaugugaggauacuaucaccuacaauugcccacugcuacggcaaaacgaaccggaggacauugauuguuggugcaauucuacaucaaccugggugacuuaugggacauguaccgccacgggagagcaccgccgagaaaaacguaguguagcgcucgugccccaugucggcaugggucuggagacucggaccgaaacauggaugagcuccgagggggcuuggaagcacgcccagaggaucgagacuugggugcuucggcauccuggauucaccauaauggcagccauccuggcuuacacaauuggcaccacguauuuucagcgcguuuugaucuucauucuccugacugcagugacaccaucuaugaccaugagaugcaucggcauaucgaacagggacuuugucgaaggggugucaggagguagcuggguagauauuguucuggagcacggcaguugugugacuacaauggccaaaaauaagcccacccucgacuucgaauuaaucaagacggaggcuaaacacccugccacccugcggaaguacugcauugaagcgaaacuuacaaacacuaccacagcaucccgcuguccaacucagggggagcccucuuugaaugaggaacaagauaagcgauuugucugcaaacauagcaugguggacagaggauggggcaacgguugugggcuguucggaaagggcggcaucgugaccugcgccauguuuacaugcaagaaaaauauggaggggaagaucguccagccugaaaaccuagaguauaccauuguuauaacuccacacuccggagaagagaaugcuguggguaacgauacgggcaaacaugggaaggagaucaaaguaacaccgcagucaaguauuaccgaagccgagcucacuggauacggcaccgugacaauggaauguagccccaggaccggucuggacuucaaugagaugguccuucugcagauggaaaacaaggcaugguuggugcaccggcaaugguuucucgaucugccuuuaccauggcugcccggggcugacacucagggcucuaacuggauccagaaagagacacucguuacguucaagaauccucacgccaagaaacaggauguggucgugcuuggaucccaagagggcgcgaugcauaccgcccugacuggggcaacagaaauacagaugucaagcggaaacuugcuauuuaccggucaccugaagugccgucuccgcauggacaaacugcagcuuaagggcaugaguuauucuauguguacagggaaauucaagguaguuaaggagauugcugaaacucaacauggaaccaucgugaucagaguccaguacgagggcgacgguuccccaugcaaaauucccuucgagaucauggaucuggaaaagaggcacguguuggggcggcucauuacggucaauccgauagugaccgagaaagacagcccuguuaacaucgaagccgagcccccauuuggcgauucguacauuaucaucggaguggaaccuggccagcugaaguuaucuugguucaaaaagggguccucaauuggacagauguuugagacaacuaugcgaggugcuaagcgcauggccauacugggcgacaccgcaugggauuucgggagucuaggaggcguauuuacaagcaucgguaaagcccuccaucaagucuucggggcuauuuauggcgcggcauuuuccggagugucuuggacuaugaagauccugauuggcguugugaucaccuggauagggaugaauagcagaucaacgagucuuuccgucagcuuggugcugguaggagugguuacacucuaccugggcgucauggugcaggccgacucugguuguguggucucauggaaaaacaaggagcuuaaaugcgggaguggaaucuucauuaccgauaauguucacacuuggacagaacaguauaaguuucagcccgagagcccauccaagcuggcuucugccauccaaaaagcacacgaagagggcauuugugguaucaggucggugacccgguuggaaaaccucauguggaagcagauaacucccgagcugaaucauauuuuaagcgagaacgaagugaaacugaccaucaugacaggcgacauuaaggggaucaugcaggccggaaaacgcucccuaagaccucagccaacggagcucaaguacucauggaaaaccuggggcaaggcuaagaugcugaguacugaacuucacaaucauacauucuugauagaugggccggagaccgccgaaugccccaacgcaaauagggcguggaacucucuggagguagaggacuauggauuuggcgucuucacaacuaauaucuggcucaaacugaaggaacgucaagaugcuuuuugugacagcaaauuaauguccgccgcaauuaaggacaaccgggccgugcacgcugauauggguuacuggaucgagucagcccugaacgacaccuggaaaauugaaaaggccagcuucaucgagguuaagucuugccacuggccuaaaucccauacgcuuuggaguaaugggguguuggagagcgaaaugauaauuccaaagaacuucgcuggacccgucucucagcacaauuaucgaccuggcuaccauacacagaccgccgguccauggcaccucggcagacuggagauggauuuugacuucugugaagggacuaccgugguugugacagaggauugcggaaacaggggccccucccuacgcacuaccacagcgucagggaaacugaucacggaauggugcugucggaguugcacccucccgccucugagauacaggggagaggacggcuguugguaugguauggagauccgcccacuuaaggaaaaagaggaaaauuugguaaacagccuggucacugccgggcauggacagauugauaauuuuucguuaggcgugcucgguauggcucuguuccuugaggaaaugcugcgaacacgggugggcaccaagcacgcaaucuugcucgucgccguuuccuuugugacucugauuacagggaacaugucuuuccgugaccuaggaagaguaauggugauggucggcgcuaccaugacggaugacauagggaugggagugacuuaccuggcccuccuggcagcguuuaagguuaggcccaccuucgccgcuggccuuuugcugcgcaaauuaacaagcaaggagcucaugaugaccacuaucgguauuacacugcuuucacaaaguaccaucccugagacaauucuggaacuaacugaugcccucgcacuggggaugaugguguugaaaaucguccggaauauggagaaguaucagcuggcugugaccauaauggccaucuuaugcguucccaacgcagugauucuccagaaugccuggaaagucuccuguacgacacuggcuguagugucuguuagcccacuucuguugaccuccucacaacagaaggcggacuggaucccucucgcccugacuauuaagggacuaaaccccaccgcaaucuuucugacaacucuuagcagaaccaguaaaaagaggucuuggccacucaaugaagcuauaauggccgugggcauggucuccauucuggccagcucguugcugaaaaacgauaucccgaugacgggcccuuuaguggcugggggacuccugacaguaugcuacgugcuuaccggucgaucagcagaccuggaguuggaacgcgccgcggacguccggugggaggagcaggcugaaaucucuggcaguucccccauucucagcauaacuaucucugaggaugggagcauguccauuaagaaugaagaggaggaacagacacugaccauccuaauuagaacuggacugcuuguuaucucaggccucuucccagugaguauacccaucacagccgcagccugguaucugugggaggugaaaaagcaaagggcuggugucuugugggacgugccuagcccacccccuguugggaaagcagaauuagaggauggagccuaccguauuaagcagaagggcauccugggcuauucucagauuggggcgggaguauacaaagaagguaccuuucacacgauguggcaugugacucgcggcgcuguccucaugcacaaggggaaacggaucgagccguccugggccgacgugaagaaagaucugauaucauacggaggcgguuggaaacuugagggggaauggaaggagggagaagagguucaggugcuggcauuggaaccaggcaaaaaccccagagccguccaaaccaagccuggccuauucaaaacaaguaccgggacaauuggagcugugagccuggacuuuuccccagguacuucuggcucgcccaucguagauaagaaagggaaggucgugggacucuauggcaacgguguugugaccaggagcgggacguacgucucagccaucgcacagacagagaaguccauugaggacaauccugaaaucgaggaugacauauucagaaagaaacggcugacuauuauggaucuucauccgggagcuggcaaaaccaagcgcuauuuacccgccaucgugagagaagcgauuaaaaggggccugcggacacucaucuuggccccaacccgaguuguggcagcugagauggaagaggcccugagagggcucccuauacgcuaccagacucccgcuauuagggcagagcacaccggacgugaaaucgucgaccugaugugucaugccacauucacgaugcggcuucugaguccaaucagagugccuaacuauaauuugauuaucauggaugaggcccacuuuacugaccccgcuucuauugcggcaagggguuacauaagcacccgcguagaaaugggcgaggccgcugggaucuucaugacagccaccccaccgggaucccgagacccuuuuccccagucaaacgcaccaauuauggaugaggaaagagagauccccgaacggucuuggaauagcggccacgagugggugacugacuucaaggguaagacaguuugguuugucccuaguaucaaagccgggaacgauauugcugcgugccuaaggaagaauggcaaaaaggugauacaacugucccgcaaaaccuucgacuuugaauauaucaagacgcguacuaacgauugggacuucguggucacaaccgauauuagcgagaugggcgccaauuuuaaggcagagagaguaaucgacccacggagguguaugaaacccgugauucucaccgauggcgaagaacgcguuaucuuagcugggccuaugccggugacucauucuucagccgcacagcgaagaggacgggucgguaggaacccaaagaaugaaaacgaccaguacauauacaugggcgagccccuggaaaaugaugaggacugcgcccacuggaaagaggcuaagaugcuucuggacaacaucaauacaccugaagggauuauccccuccauguucgagccagaacgcgagaaaguggaugccauugacggagaauauagacucaggggcgaggcgcggaagaccuuuguugauuugaugcgucgcggugaccugccuguguggcucgcauaccgagucgccgcugaggggaucaacuaugccgauagaaggugguguuucgacggcgugaaaaacaaucaaauacuggaagagaacguagaaguggagauuuggacaaaggagggagaacggaagaaacuuaagccccgcuggcuagaugcuagaaucuacagugacccacuggcauugaaagaguucaaggaauuugccgcuggcaggaagucguuaacucugaaucucauuacggagauggggcggcugccuaccuucaugacacagaaggcccgaaacgcacuugauaaucuggcgguucuccauacugccgaagcuggagguagagccuauaaccacgcauugagcgagcugccggagacccuagaaacacugcuccuucugaccuuauuggcuacugucacgggcgggaucuuucuguuccucaugucuggaaagggcauagguaaaaugacccuggggaugugcugcaucauuacagccuccauccuucugugguacgcacagauucagccccacuggaucgccgcuagcauaauucucgaguuuuucuugaucgugcuguuaaucccagaaccugagaagcaacgcacuccccaggacaaucagcuaaccuauguggucauugcgauccugacaguuguggccgcaaccauggcuaacgaaaugggcuuucucgagaaaacuaagaaagauuucggacuuggcucaauaacaacgcagcaaccagagaguaauauucuggacaucgauuugaggccugccucugccuggacccuguacgcaguagcuacuacauuuauuacccccaugcuccggcauuccaucgaaaacagcucagugaaugucagucugaccgccauagcgaaccaggcuacagugcuuauggggcucggaaaggguuggccgcugagcaagauggacaucggcguuccauugcuggccauuggguguuacucccaggugaauccuaucacuuuaacggcagcccuacugcuccuugucgcucacuaugcaauuaucggacccggccugcaggccaaagcgacccgugaggcucaaaagagagccgcagccgguauuaugaaaaacccaacaguagacgggaucacugugauagauuuggaccccauuccuuacgauccgaaguucgaaaaacagcugggccagguuaugcuccuggugcuuugcgucacccagguguuaaugaugaggacaaccugggcucugugugaggcccucacuuuggcaacgggacccaucucuacacugugggaaggcaauccagggcgcuuuuggaacaccacuaucgcugucagcauggccaauauuuuccggggauccuaucuagcgggcgccggucugcucuuuucaauaaugaagaacaccgcaaacacacgaagagggacuggaaauaccggcgagacacuuggugagaaguggaaaaacaggcugaaugcuuugggcaagucugaguuccaaaucuacaaaaagagugggauucaggagguggaccgcacgcuggccaaagaaggaaucaagcggggcgagaccgaucaucacgcaguuucgagagggagcgcuaaacuccguugguucguggagaggaaccugguaacuccugaaggaaagguggucgacuuaggcugcgguagaggcgggugguccuauuacugugggggucuuaagaauguuaaagaggugaagggccugacaaaagggggacccggccaugaagaaccuauuccaaugucuaccuauggguggaaccucguccgccuacagucaggaguggauguauuuuucacucccccugaaaagugcgacacacuguugugugauaucggcgagagcuccccaaaucccaccguggaggccggucgaacgcugagaguucucaaccuuguggaaaauuggcugaacaauaacacccaauuuugcauaaaagucuugaauccguacaugccuagugugaucgagaagauggaagcccugcagaggaaguacgggggagcgcucguccggaacccauuaucucgcaauagcacacacgagauguauugggugucaaacgcuuccggcaacauuguuaguagcguaaauaugaucucuagaaugcugauuaacagguucacuaugcgacacaaaaaggcaaccuacgaacccgacguggaucuuggcuccgggacacggaauaucggaauagagucagagacuccuaaccuggacauuaucgguaaacguaucgaaaagauuaaaagagagcaugaaaccagcuggcacuaugaucaggaccauccauacaagacaugggccuaucacggcucguacgagaccaagcagacugggucugcuaguuccauggucaauggagugguucgccuacucacgaaacccugggacgugauaccgauggucacacaaauggccaugaccgauacuaccccuuuuggccagcagaggguguucaaggaaaaaguagacacacggacgcaggagcccaaggaggguaccaaaaagcugaugaagaucacugcagaaugguuguggaaagagcuggggaagaaaaagacaccaagaauguguacccgcgaagaguuuacuaggaaagugcgaagcaacgccgcucucggagcgauuuucacagaugagaauaaguggaaaucagcccgggaagcaguugaggacuccggcuuuugggaacuugucgauaaggagagaaaccugcacuuagaaggcaagugcgagaccuguguguauaauaugauggggaaaagggagaagaaacugggagaguucgguaaggcuaaaggcucucgcgccaucugguacaugugguugggggcacguuuucucgaguucgaagcccugggauuucuaaacgaggaccauugguucagccgggaaaauagucuuuccggcguggagggugaggggcugcacaagcucggauacauucugagagaugucagcaagaaagaaggcggcgcuauguaugccgacgauacagcggggugggacacuaggaucaccuuggaggaucugaagaacgaagagaugguuacgaaucauauggaaggagagcacaaaaagcucgcagaggccauauucaaacuuaccuaccaaaacaaggugguacgcgugcagcgaccuacaccccgggguacugucauggacaucauuucuagaagggaccagcgcggcucaggacaggugguuaccuauggacugaauacauuuacuaacauggaagcucaauuaaucagacagauggagggcgaagguguguucaagaguauucagcaacugaccgucacggaggagaucgccgugaaaaacugguugguacggguugggagggaacgucucucccgaauggcaauuagcggagaugacugcguggucaagccacuggaugaccgcuuugcuucugcccuaacagcucuuaaugauaugggcaaagugagaaaggacauacagcagugggagcccucgcggggcuggaacgauuggacccaggugccuuucugcucacaucacuuucacgaacugaucaugaaagacgggaggguccucguugugccaugucgcaaucaagaugagcugauuggacgagcacggaucagccagggugcaggcugguccuugagggaaacugcgugcuuagggaagaguuacgcccagauguggucucugauguauuuccaucgacgugaccucagacuugcugccaacgcaaucuguagcgcuguaccgucccacugggugcccacaucacgcaccacuuggaguauucaugccacccacgaguggaugacaacggaggauaugcugaccgucuggaaucggguguggauacaggaaaacccuuggauggaggacaagacuccaguugaaucuugggaggaaauccccuaccuaggaaaaagggaggaucaauggugcggcagccugauuggucucacauccagagcaaccugggccaagaauauccagacugcgauuaaccaggugcgcucauugaucgggaaugaggaauauacagacuacaugccuagcaugaaacgguuuaggcgagaggaagaggaagcuggaguccugugguga

SEQ ID NO: 14958 - RNA, 9876 nt, Artificial Sequence
  derived and/or modified CDS sequence (opt3) from DENV-2__KC762677__SS-prME
accgccggaaucauuauaaugaugauccccacugugauggcuuuccaccugacuacgagaaacggggagccucauaugauuguaagcaggcaggaaaagggaaaaucccuccuuuuuaagaccgagaaugguguuaacaugugcacccugauggcaauggacuugggcgaauuaugugaggauacuaucaccuacaauugcccacugcuacggcaaaacgaaccggaggacauugauuguuggugcaauucuaccucaaccugggugacuuaugggacauguaccgccacgggagagcaccgccgagaaaaacguaguguagcgcucgugccccauguaggcaugggucuggagacucggaccgaaacauggaugagcuccgagggggcuuggaagcacgcccagaggaucgagacuugggugcuucggcauccuggauucaccauaauggcagccauccuggcuuacacaauuggcaccacgcacuuucagcgcguuuugaucuucauucuccugacugcaguggccccaucuaugacaaugagaugcaucggcauaucgaacagggacuuugucgaaggggugucaggagguagcuggguagauauuguucuggagcacggcaguugugugaccacuauggcuaaaaauaagcccacacucgacuucgaauuaaucaagaccgaggccaaacauccugcgacgcugcggaaguauugcauugaagcaaaacuuaccaacacaacuaccgccucccgcuguccaacacagggggagcccucuuugaaugaggaacaagauaagcgauuugucugcaaacacagcaugguggacagaggauggggcaacgguugugggcuguucggaaagggcggcaucgugacuugcgcuauguuuaccugcaagaaaaauauggaggggaagaucguccagccugaaaaccuagaguacacaauuguuauaaccccacauuccggagaagagaaugccguggguaacgauacuggcaaacacgggaaggagaucaaaguaacgccgcagucaaguauuacagaagcagagcucaccggauauggcacugugaccauggaauguagccccaggacaggucuggacuucaaugagaugguccuucugcagauggaaaacaaggcuugguuggugcaccggcaaugguuucucgaucugccuuuaccauggcugcccggggccgacacccagggcucuaacuggauccagaaagagacucucguuacauucaagaauccucaugcgaagaaacaggauguggucgugcuuggaucccaagagggcgccaugcacacggcacugaccggggcuacugaaauacagaugucaagcggaaacuugcuauuuacaggucaucugaagugccgucuccgcauggacaaacugcagcuuaagggcaugaguuacucuauguguaccgggaaauucaagguaguuaaggagauugccgaaacacaacacggaacuaucgugaucagaguccaguaugagggcgacgguuccccaugcaaaauucccuucgagaucauggaucuggaaaagaggcauguguuggggcggcucauuaccgucaauccgauagugacggagaaagacagcccuguuaacaucgaagcugagcccccauuuggcgauucguacauuaucaucggaguggaaccuggccagcugaaguuaucuugguucaaaaagggguccucaauuggacagauguuugagaccacaaugcgaggugccaagcgcauggcaauacugggcgacacugccugggauuucgggagucuaggaggcguauuuaccagcaucgguaaagcucuccaccaagucuucggggcgauuuacggcgcagccuuuuccggagugucuuggacaaugaagauccugauuggcguugugaucacuuggauagggaugaauagcagaucaaccagucuuuccgucagcuuggugcugguaggagugguuacgcucuaucugggcgucauggugcaggcugacucugguuguguggucucauggaaaaacaaggagcuuaaaugcgggaguggaaucuucauuacagauaauguucacaccuggacugaacaguacaaguuucagcccgagagcccauccaagcuggccucugcaauccaaaaagcccaugaagagggcauuugugguaucaggucggugacacgguuggaaaaccucauguggaagcagauaacccccgagcugaaucacauuuuaagcgagaacgaagugaaacugacuaucaugaccggcgacauuaaggggaucaugcaggcuggaaaacgcucccuaagaccucagccaacagagcucaaguauucauggaaaacguggggcaaggccaagaugcugaguaccgaacuucauaaucacacuuucuugauagaugggccggagacagcagaaugccccaacaccaauagggcguggaacucucuggagguagaggacuacggauuuggcgucuucacaacuaauaucuggcucaaacugaaggaacgucaagauguguauugugacagcaaauuaauguccgcugccauuaaggacaaccgggcaguucacgccgauauggguuacuggaucgagucagcucugaacgacaccuggaaaauugaaaaggccagcuuuaucgaggugaagucuugcuauuggccuaaaucccauacgcuuuggaguaauggggucuuggagagcgaaaugauaauuccaaagaacuucgcaggacccgugucucagcacaauuaccgaccuggcuaccauacacagaccgcugguccauggcaccucggcagacuggagauggauuucgacuuuugugaagggacuaccguugugguaacagaggauugcggaaacaggggccccucccuacgcacuaccacagccucagggaaacugaucacggaauggugcugucggaguugcacccucccgccucugagauauaggggagaggacggcuguugguacgguauggagauccgcccaaugaaggaaaaagaggaaaaucuugucaacagcuuggugacugcggggcauggacagauugauaauuucucgcugggcguguuagguauggcccucuuucuggaggaaaugcuucgaacacgggucggcaccaagcacgcuauccuguugguugcaguguccuucguaacucucauuacagggaacaugucuuuucgugaccugggaagagugauggucauggugggcgccaccaugacggaugacauagggaugggaguuacuuaucuagcucugcucgccgcauucaaggugaggcccaccuuugcggccggccugcuuuugcgcaaacugacaagcaaggaguuaaugaugaccacuaucgguauuguccuccugucacaaaguacaaucccugagaccauucuugaacugacagaugcucuagcccucgggaugauggcacugaaaaucgugcggaauauggagaaguaccaguuggcuguuacuauaauggccauccugugcgugcccaacgcagucauuuuacagaaugccuggaaaguauccuguaccacgcucgcugugguuucugugagcccacugcuucugacauccucacaacagaaggcggacuggaucccuuuggcccucaccauuaagggacugaaccccacugcaaucuuccuaaccacacugagcagaacaaguaaaaagaggucuuggccacuuaaugaagcuauaauggccgucggcaugguguccauucucgccagcucgcuguugaaaaacgauaucccgaugaccggcccucugguagcugggggauuacucacggugugcuauguccugacaggucgaucagcagaccuugagcuggaacgcgccgcggacguucggugggaggagcaggcugaaaucucuggcaguucccccauuuugagcauaaccaucucugaggaugggagcauguccauuaagaaugaagaggaggaacagacucucacaauccugauuagaaccggacuacuggugaucucaggccuuuuuccagugaguauacccaucacugccgcagccugguaccucugggaggucaaaaagcaaagggcuggugugcugugggacguuccuagcccacccccuguagggaaagcagaauuggaggauggagccuaucguauuaagcagaagggcaucuuaggcuacucucagauuggggcgggaguguacaaagaagguacauuccacaccauguggcaugucacgcgcggcgcugugcugaugcacaaggggaaacggaucgagccguccugggccgacguuaagaaagaucucauaucauauggaggcgguuggaagcuggagggggaauggaaggagggagaagaggugcagguccuugcacuggaaccaggcaaaaaccccagagccgugcaaacuaagccuggcuuguuuaaaaccaacacagggaccauuggagcuguaagucuagacuucagcccagguacauccggcucucccaucgucgauaagaaagggaaggugguuggacuguacggcaaugguguggucacuaggucggggaccuaugugagcgccaucgcacagacggagaagucaauugaggacaacccugaaaucgaggaugacauauuucggaaaaagagacucacaauuauggaucugcauccgggagcuggcaaaacuaagcgcuaccuucccgccaucguuagagaagcgauuaaaaggggcuuacggacccugauccucgccccaacacgaguggucgcagcugagauggaagaggccuugagagggcugccuauacgcuaucagacccccgcuauuagggcagagcacacuggacgugaaaucguggaccucaugugucaugccaccuucacaaugcggcugcuuuccccaaucagaguaccuaauuacaaccugauuaucauggaugaggcccacuucacggaccccgcuaguauugcggcaagggguuauauaucuacucgcguggaaaugggcgaggccgcugggaucuuuaugaccgccacaccaccgggaagccgagacccuuucccccaguccaaugcaccaauuauggaugaggaaagagagauccccgaacggucauggaacucuggccacgaguggguuaccgacuuuaaggguaagacugucugguucgugccuagcaucaaagccgggaaugauauugcugcgugcuugaggaagaacggcaaaaaggugauacaacuaagucgcaaaacauuugacuucgaauacaucaagacccguacgaaugauugggacuuugucguaacuacagauauuuccgagaugggcgccaacuucaaggcagagagagugaucgacccacggagguguaugaaacccguuauucugaccgauggcgaagaacgcgugauccucgcugggccuaugccggucacccauagcucugccgcacagcgaagaggacggguggguaggaauccaaagaacgaaaaugaccaguacauauauaugggcgagcccuuagaaaacgaugaggacugcgcccacuggaaagaggcuaagaugcugcuugacaauaucaacacuccugaagggauuauccccucaauguuugagccagaacgcgagaaaguugaugccauugacggagaauacagacugaggggcgaggcgcggaagacauucguggaucucaugcgucgcggugacuugccugucuggcuggcauaucgaguggccgcugaggggaucaacuacgccgauagaaggugguguuuugacggcgucaaaaauaaccaaauacucgaagagaauguggaaguugagauuuggaccaaggagggagaacggaagaaacugaagccccgcuggcuugaugcuagaaucuauuccgacccacuagcacugaaagaguucaaggaguucgccgcuggcaggaaaaguuugacauuaaaccugauuacugagauggggcggcucccuacguuuaugacccagaaggcccgaaaugcacuggauaaccuugcgguccugcauacagccgaagcuggagguagagccuacaaucacgcacucagcgaguugccggagacucuggaaacccuacugcuccuuacacuguuagcuaccgugacuggcgggaucuucuuguuucugaugucgggaaagggcauagguaaaaugacgcucgggaugugcugcaucauuaccgccucuauccugcuuugguaugcacagauucagccccacuggaucgccgcuuccauaauucuggaguucuuucucaucguguugcugaucccagaaccugagaagcaacgcacaccccaggacaaccaguuaacuuacgucguuauugcgauccuaaccgugguagccgcaacaauggcuaaugaaaugggcuuccuggagaaaaccaagaaagauuuuggacucggcagcauaacuacacagcaaccagagucaaacauucuugacaucgaucugaggccugccagugccuggacguuguacgcaguggcuaccacuuucauuacacccaugcugcggcauucuaucgaaaauuccagcgucaacgugucacucaccgccauagcgaaucaggcuaccguucugauggggcuuggaaaggguuggccgcucaguaagauggacaucggcgugccacuguuggccauuggguguuauagccaggucaacccuaucacacugacugcagccuuacuacugcucguagcucacuacgcaauuaucggacccggccuucaggccaaagcgacgcgugaggcucaaaagagagccgcagccgguauuaugaaaaauccaaccguggacgggaucacaguuauagaucuggaccccauuccuuaugauccgaaguuugaaaaacaguugggccaggugaugcugcucguccugugcgugacucagguccuuaugaugaggaccacaugggcuuuaugugaggcccugacccucgcaacuggacccaucuccacguugugggaaggcaacccagggcgcuucuggaauacaaccaucgcugugucuauggccaacauuuuucggggaagcuaccuggcgggcgccggucuacuguucuccauaaugaagaacacugcaaauacccgaagagggacaggaaacacuggcgagacccucggugagaaguggaaaaauaggcuuaacgcucugggcaagucagaauuucaaaucuauaaaaagucugggauucaggagguugaccgcacauuggccaaagaaggaaucaagcggggcgagacggaucaucacgcagugaguagagggucggcuaaacugcguugguucguagagaggaaucucgugaccccugaaggaaaggucguugaccugggcugcgguagagggggauggagcuacuauuguggcgguuuaaagaacgugaaagaggucaagggccuuacuaaagggggacccggccaugaagaaccuauuccaauguccacauacggguggaaucuggugcgccuccagucuggaguagauguguucuuuacacccccugaaaagugcgacacucuacugugugauaucggcgagucaagcccaaaccccacaguugaggccggucgaaccuugagagugcugaaucucgucgaaaacuggcuuaauaacaauacgcaauucugcauaaaagugcugaacccguacaugccuuccgucaucgagaagauggaagccuugcagaggaaguaugggggagcgcuggugcggaauccacucagucgcaacucuacccacgagauguacuggguuagcaacgcuucaggcaauauuguauccagugugaacaugaucagcagaauguuaauuaauagguuuacaaugcgacacaaaaaggcaacuuaugaacccgacgucgaucugggcucugggacccggaacaucggaauagaguccgagauuccuaaucuugacaucaucgguaaacguauugaaaagauaaaacaggagcaugaaacaucauggcacuacgaucaggaccauccauauagaacuugggccuaccacggcagcuaugagaacaagcaaaccgggucggcuucuaguauggugaauggaguugugcgccugcuaacaaagcccugggacgucaucccgauggugacccagauggccaugacugauacgacaccuuucggccagcagaggguauuuaaagaaaagguggacacccggacucaagagcccaaagaggguaccaagaaacucaugaagauuacagcagaauggcuguggaaggaguuggggaaaaagaaaacgccaagaauguguacccgcaaggaguucacuaggaaaguucgauccaacgccgcucugggagcgaucuuuacagaugagaauaaguggaaaagcgcccgggaggcagucgaagacucaggcuucugggagcucguggauaaggaaagaaaccuucaccuggagggcaagugcgaaaccuguguguacaauaugauggggaaaagggagaagaaauuaggagaguuugguaaggcuaaaggcucccgcgccauuugguacauguggcugggggcacguuucuuggaauuugaggcccucggauuccugaacgaagaccauugguuuucucgggagaauagccuaaguggcgucgaaggugaggggcuucacaagcugggauauauccucagagauguuuccaagaaagagggcggcgcuauguacgccgacgauacugcggggugggacacaaggauaacccuggaagauuugaagaacgaggaaauggugacaaaucauauggagggagaacacaaaaagcuggcagaggccaucuucaaacucacuuaucagaacaagguagugcgcguccagcgaccuacaccccgggguacggugauggacauuaucagcagaagggaccagcgcggcucugggcaaguugugaccuacggacuuaacacauucacuaauauggaggcucagcugauuagacagauggaaggcgagggugucuuuaagucaauccaacaguuaaccgugacagaagagauugccgucaaaaacuggcugguucggguggggagggagcguuugagucgaauggcaauauccggagaugacugcgucgugaagccacucgaugaccgcuucgcuagcgcccugacugcucuaaaugauaugggcaaagugagaaaggacauccagcagugggaacccucucggggcuggaacgauuggacccaagucccuuuuugcucgcaucacuuccacgagcuuauuaugaaagacgggaggguucuggugguaccaugucgcaaucaggaugaacucaucggacgagcccggaucucacagggugcaggcuggagccugagggagacggcgugcuuggggaaguccuaugcccagauguggaguuuaauguacuuucaucgacgugaccugagacucgcugccaacgcaauuuguucugcugugccgagccacuggguccccacaucccgcaccacuuggucaauacaugccacacacgaauggaugaccacugaggauaugcuuaccguguggaaucggguuuggauccaagagaacccuuggauggaagacaagacaccaguggagaguugggaagagauucccuaucugggaaaaagggaagaucaguggugcggcucucuaaucggucugacgagcagagcaaccugggccaagaauauucagacugcgaucaaccagguccgcucccucauagggaaugaggaguacacagacuacaugccuucaaugaaacgguucaggcgagaagaggaagaggcuggaguguugugguga

SEQ ID NO: 14959 - RNA, 9876 nt, Artificial Sequence
  derived and/or modified CDS sequence (opt3) from DENV-2__KC762668__SS-prME
accgccggcaucauuauaauggugauccccacagucauggcuuuccaccugacuacgagaaacggggagccucauaugauuguuagcaggcaggaaaagggaaaaucccuccuuuuuaagaccgagaauggugugaacaugugcacacugauggcaauggacuugggcgaauuaugugaggauacuaucaccuacaauugcccacugcuacggcaaaacgaaccggaggacauugauuguuggugcaauucuacaucaaccuggguaacuuaugggacauguaccgccacgggagagcaccgccgagaaaaacguaguguggcgcucgucccccaugugggcaugggucuggagacuagaaccgaaacauggaugagcuccgagggggcuuggaagcacgcccagaggaucgagacuuggguucuucggcauccuggauucaccauaauggcagccauccuggcuuacacaauuggcaccacguauuuucagcgcguguugaucuucauucuccugacugcagucgccccaucuaugacaaugagaugcaucggcauaucgaacagggacuuuguggaagggguaucaggagguagcuggguugauauugugcuggagcacggcaguugugucaccacuauggcuaaaaauaagcccacacucgacuucgaauuaaucaagaccgaggccaaacacccugcgacgcugcggaaguacugcauugaagcaaaacuuaccaacacaacuaccgccucccgcuguccaacacagggggagcccucuuugaaugaggaacaagauaagcgauuugugugcaaacauagcaugguggacagaggauggggcaacgguugugggcuguucggaaagggcggcaucgucacuugcgcuauguuuaccugcaagaaaaauauggaggggaagaucguucagccugaaaaccuagaguauacaauugugauaaccccacacuccggagaagagaaugccguagguaacgauacuggcaaacaugggaaggagaucaaaauuacgccgcagucaaguaucacagaagcagagcucaccggauacggcacugugaccauggaauguagccccaggacaggucuggacuucaaugagaugguccuucugcagauggaaaacaaggcuugguuggugcaccggcaaugguuucucgaucugccuuuaccauggcugcccggggccgacacccagggcucuaacuggauacagaaagagacucucguuacauucaagaauccucacgcgaagaaacaggauguggucgugcuuggaucccaagagggcgccaugcauacggcacugaccggggcuacugaaauucagaugucaagcggaaacuugcuauuuacaggucaccugaagugccgucuccgcauggacaaacugcagcuuaagggcaugaguuauucuauguguaccgggaaauucaagguaguuaaggagaucgccgaaacacaacauggaacuaucgugauuagaguccaguacgagggcgacgguuccccaugcaaaauccccuucgagauuauggaucuggaaaagaggcacguguuggggcggcucauaaccgucaauccgaucgugacggagaaagacagcccuguuaacauugaagcugagcccccauuuggcgauucguacaucaucauuggaguggaaccuggccagcugaaguuaucuugguucaaaaagggguccucaauaggacagauguuugagaccacaaugcgaggugccaagcgcauggcaauccugggcgacacugccugggauuucgggagucuaggaggcguauuuaccagcauugguaaagcucuccaucaagucuucggggcgaucuauggcgcagccuuuuccggagugucuuggacaaugaagauucugaucggcguugugauaacuuggaucgggaugaauagcagaucaaccagucuuuccgucagcuuggugcugguaggagugguuacgcucuaccugggcgucauggugcaggcugacucugguuguguggucucauggaaaaacaaggagcuuaaaugcgggaguggaauuuucaucacagauaauguucacaccuggacugaacaguauaaguuucagcccgagagcccauccaagcuggccucugcaauucaaaaagcccacgaagagggcaucugugguauaaggucggugacacgguuggaaaaccucauguggaagcagauuacccccgagcugaaucauaucuuaagcgagaacgaagugaaacugacuauuaugaccggcgacaucaaggggauaaugcaggcuggaaaacgcucccuaagaccucagccaacagagcucaaguacucauggaaagccuggggcaaggcaaagaugcugaguacggaacuucacaaucauaccuucuugaucgaugggccggagacugcggaaugccccaacacaaauagggcuuggaacucucuggagguagaggacuauggauuuggcgucuucaccacaaauauuuggcucaaacugaaggaacgucaagauguguuuugugacagcaaauuaauguccgccgcaaucaaggacaaccgggccguucacgcugauauggguuacuggauugagucagcccugaacgacacuuggaaaaucgaaaaggcaagcuucauagaggugaagucuugccacuggccuaaaucccauacccuuuggaguaauggggucuuggagagcgaaaugauuaucccaaagaacuucgcuggacccgugucucagcacaauuaucgaccuggcuaccauacgcagacagccgguccauggcaccucggcagacuggagauggauuuugacuucugugaagggaccacuguugugguaaccgaggauugcggaaacaggggccccucccuacgcacaacuaccgcgucagggaaacugaucacagaauggugcugucggaguugcacgcucccgccucugagauacaggggagaggacggcuguugguaugguauggagauucgcccacuuaaggaaaaagaggaaaauuuggucaacagccuggugaccgccgggcauggacagaucgauaauuuuucguuaggcgugcucgguauggcucuguuccuugaggaaaugcugcgaacucgggucggcacaaagcacgcaauuuugcucguugccguguccuuuguaacccugauaacugggaacaugucuuuccgugaccuaggaagagugauggucauggugggcgcuacaaugaccgaugacaucgggaugggaguuacguaccuggcccuccuggcagcguuuaaggugaggcccacuuucgccgcuggccuuuugcugcgcaaauuaaccagcaaggagcucaugaugacaaccauugguaucguccugcuuucacaaaguacuauuccugagacaauccuggaacuaaccgaugcccucgcacuggggaugaugguguugaaaauaguucggaauauggagaaguaucagcuggcugugacaaucauggccauuuuaugcguccccaacgcaguaauccuccagaaugccuggaaaguguccuguacuacccuggcuguugugucugucagcccacuucuguugacguccucacaacagaaggcggacuggauuccucucgcccugacaaucaagggacuaaaccccaccgcaauauuucugacuacccuuagcagaacaaguaaaaagaggucuuggccacucaaugaagcuauuauggccgugggcaugguauccauccuggccagcucguugcugaaaaacgauaucccgaugacuggcccuuuaguggcugggggacuccugaccgucugcuacguucuuacgggucgaucagcagaccuggaguuggaacgcgccgcggacgugcggugggaggagcaggcugaaauuucuggcaguucccccauacucagcaucacaauuucugaggaugggagcauguccaucaagaaugaagaggaggaacagacccugacuauucuaaucagaacaggacugcuugugauaucaggccucuucccagucaguauccccauuaccgccgcagccugguaucugugggaggugaaaaagcaaagggcugguguuuugugggacguaccuagcccacccccuguggggaaagcagaauuagaggauggagccuaccguaucaagcagaagggcauucugggcuauucucagaucggggcgggagucuacaaagaagguacuuuucacacaauguggcaugugacccgcggcgcuguucucaugcacaaggggaaacggauagagccguccugggccgacgugaagaaagaucugauuucauacggaggcgguuggaagcuugagggggaauggaaggagggagaagagguccaggugcuggcauuggaaccaggcaaaaaccccagagccguacaaacgaagccuggccuauucaaaacuaacaccgggaucaucggagcugucagucuggacuuuagcccagguacauccggcucucccauuguggauaagaaagggaagguugugggacucuauggcaauggugucgugaccaggucggggacauacguuagcgccaucgcacagacugagaagucaauagaggacaacccugaaauugaggaugacaucuuccgaaaaaagcggcugaccauuauggaucuucauccgggagcuggcaaaacgaagcgcuauuuacccgccaucgugagagaagcgauaaaaaggggccugcggacacucauuuuggccccaacucgagucguggcagcugagauggaagaggcccugagagggcucccuauccgcuaccagacccccgcuaucagggcagagcacacaggacgugaaauuguagaccugaugugucaugccaccuucacuaugcggcuucuguccccaaucagagugccuaauuauaacuugauuauaauggaugaggcccacuuuaccgaccccgcuaguaucgcggcaagggguuacauuucuacacgcguugaaaugggcgaggccgcugggaucuucaugacggccacuccaccgggaagccgagacccuuuuccccaguccaaugcaccaaucauggaugaggaaagagagauucccgaacggucauggaacucuggccacgagugggucaccgacuucaaggguaagacagugugguuugugccuagcauaaaagccgggaaugauaucgcugcgugccuaaggaagaacggaaaaaaggucauucaacugagucgcaaaaccuucgacuuugaauauaucaagacucguacaaaugauugggacuucguagugaccacggauauuuccgagaugggcgccaacuuuaaggcagagagaguuaucgacccacggagguguaugaaacccgugauacucacugauggcgaagagcgcgucaucuuagcugggccuaugccggugacacauagcucugccgcacagcgaagaggacggguugguaggaauccaaagaacgaaaaugaccaguacauuuacaugggcgagccccuggaaaacgaugaggacugcgcccacuggaaagaggcuaagaugcuucuggacaauaucaacaccccugaagggauuauccccucaauguucgagccagaacgcgagaaaguggaugccauagacggagaauauagacucaggggcgaggcgcggaagaccuuugucgauuugaugcgucgcggugaccugccuguguggcucgcauaccgaguagccgcugaggggauuaacuaugccgauagaaggugguguuucgacggcgugaaaaauaaccaaauccuggaagagaauguugaagucgagauuuggacuaaggagggagaacggaagaaacuuaagccccgcuggcuagaugcuagaaucuacuccgacccacuggcauugaaagaguucaaggaauuugccgcuggcaggaaaaguuuaacacugaaccucauaaccgagauggggcggcugccuacauucaugacucagaaggcccgaaaugcacuugauaaccuggcggugcuccauacggccgaagcuggagguagagccuauaaucacgcauugagcgagcugccggagacccuagaaacacugcuccuucugacuuuauuggcuaccgugacaggcgggaucuuucuguuccucaugucgggaaagggcauugguaaaaugacccuggggaugugcugcaucauuacugccucuauccuucugugguacgcacagauacagccccacuggauugccgcuuccaucauccucgaguuuuucuugauuguccuguuaaucccagaaccugagaagcaacgcacgccccaggacaaccagcuaaccuauguugugauagcgauucugacaguaguggccgcaacuauggcuaaugaaaugggcuuucucgagaaaaccaagaaagauuucggacuuggcagcaucacaacccagcaacuggagucaaacauuuuggacaucgaucugaggccagccagugccuggacucucuacgcagucgcuacaacguuuauaaccccuaugcugcggcauucuaucgaaaauuccagcgugaacguuucacuuacugccauugcgaaucaggcuacagugcucauggggcugggaaaggguuggcccuugaguaagauggacaucggcgucccgcuguuagccauuggguguuacagccagguaaacccaaucacccuaaccgcagcccugcuccuucugguggcucacuaugcaauuaucggaccuggcuugcaggccaaagcgacacgugaggcucaaaagagagccgcagccgguauaaugaaaaaucccacuguugacgggauuacggugaucgaucuggacccaauccccuacgauccuaaguucgaaaaacagcucggccaggucaugcugcuuguguuaugcgucacccaggugcugaugaugaggacaacuugggcucucugugaggccuugacccuggcaacaggaccgauuuccacccuaugggaaggcaaccccgggcgcuuuuggaauacuacgauagcuguuucuauggccaacaucuuccggggaagcuaucuggcgggcgccggucuccuuuuuuccauuaugaagaacacagcaaauacccgaagagggacuggaaacaccggcgagacacugggugagaaguggaaaaauagguugaacgcucugggcaagucagaauuccaaaucuacaaaaagucugggauucaggagguggaccgcacucucgccaaagaaggaaucaagcggggcgagaccgaucaucacgcaguaaguagagggucggcuaaacugcguugguucguggagaggaauuuagucacaccagaaggaaagguuguggaccuuggcugcggucgggggggauggagcuauuacuguggcggucugaagaacgucaaagaggugaagggccucacgaaagggggaccuggccaugaagagcccauaccuauguccaccuauggguggaaucuaguacgccugcagucuggaguggauguuuuuuucacuccacccgaaaagugcgacacauugcugugugauaucggcgagucaagcccuaacccaaccguggaggccggucgaacucucagaguccuuaaucugguggaaaacugguugaauaacaauacacaauuuugcauuaaaguccugaaccccuacaugccguccgugaucgagaagauggaagcccuccagaggaaguacgggggagcguuaguucggaauccucugagucgcaacucuacccacgagauguauuggguaagcaacgcuucaggcaauauuguguccagugucaacaugaucagcagaaugcuuauaaauagguucacgaugcgacacaaaaaggcaaccuacgaaccagacguggaucugggcucugggacacggaacauuggaaucgaguccgagacucccaaucuagacaucauugguaaacguauagaaaagaucaaacaggagcaugaaaccucauggcacuaugaucaggaccauccuuacaagacaugggccuaucacggcagcuacgagacuaagcaaaccgggucggcuucuaguaugguuaacggaguggucagacuccugacaaaaccaugggacgugauucccaugguaacccagauggccaugacugauacgacaccguuuggccagcagcgcguguucaaggaaaaaguugacaccaggacucaagagccuaaggaggguaccaaaaaguugaugaagaucacagcagaauggcuguggaaagagcucgggaagaaaaagacgccccggauguguaccagagaagaguuuacucgcaaagucagguccaaugccgcucuuggagcgauuuucacagaugagaacaaguggaaaagcgcccgagaagcaguggaggacucaggcuuuugggaacugguggauaaggagcggaauuuacaccuggaaggcaagugcgagaccugugucuauaacaugauggggaaaagagagaagaaauugggagaauucgguaaggcuaaaggcuccagggccaucugguacauguggcucggggcacgcuuucuggaguucgaagcccuaggauuucuuaaugaggaccauugguucucucgugaaaacagccugaguggcguugagggugaggggcuccacaagcugggauacauauugcgggauguguccaagaaagaaggcggcgcuauguaugccgacgauacugcggggugggacacaagaaucacccuggaggaucucaagaaugaagagaugguaacaaaccauauggaaggagagcacaaaaggcuugcagaggccauuuuccgccugacuuaccagaauaaggugguccgagugcagcggccaaccccuagagguacgguuauggacaucauuagcaggcgcgaccagagaggcucugggcaaguggucaccuauggauuaaacacauuuacuaacauggaagcucagcugauccggcagauggagggcgaagguguguucaaaucaauucaacauuugaccguaacagaggagauagccguuaagaauuggcucgcaaggguggggcgugaacgacugagucgcauggcuaucuccggagaugacugcgucgugaagccccuagaugacagauuugccagcgcucuuacugcccugaacgauaugggcaaagugcggaaggacauucagcagugggagccaucuaggggcuggaaugauuggacccagguccccuucugcucgcaccacuuucaugaacucaucaugaaagacgggcgcguucuggugguaccuuguagaaaccaagaugaguugaucggacgggcaaggauuucacagggugcgggcuggagcuuacgagaaacggccugccuggggaaguccuacgcucagauguggagucucauguauuuccaccguagagaccuucgccuggccgcaaaugcuauauguucugccgugccaagccauugggucccgacaucccggaccacuuggucaauccacgcaacacacgaguggaugaccacugaggauaugcuaaccguguggaacaggguuuggauucaggaaaaucccuggauggaggacaaaacaccuguggaaaguugggaggaaaucccauaccugggaaagagagaggaucaauggugcggcucucucauugguuugacgagccgcgccaccugggcgaagaacauccagacugcuauaaaucagguccggucccugaucgggaacgaggaauauacagacuacaugcccucaaugaaaagguuucgaagagaggaagaggaagccggagugcuuugguga

SEQ ID NO: 14960 - RNA, 9876 nt, Artificial Sequence
  derived and/or modified CDS sequence (opt3) from DENV-2__KC762678__SS-prME
accgcaggaaucauuauaaugaugauccccacagugauggcuuuccaccugacuacgcgaaacggggagccucauaugauuguaagcaggcaggaaaagggaaaaucccuccuuuuuaagaccgagaaugguguuaacaugugcacacugauggcaauggacuugggcgaauuaugugaggauacuaucaccuacaauugcccacugcugcggcaaaacgaaccggaggacauugauuguuggugcaauucuacaucaaccugggugacuuaugggacauguaccgccacgggagagcaccgccgagaaaaacguaguguagcgcucgugccccaugucggcaugggucuggagacuagaaccgaaacauggaugagcuccgagggggcuuggaagcacgcccagaggaucgagacuugggugcuucggcauccuggauucaccauaauggcagccauccuggcuuacacaauuggcaccacguauuuucagcgcaucuugauuuucauccuccugacugcaguuacaccaucuaugaccaugcggugcauaggcauuucgaacagggacuuuguggaaggggucucaggagguagcuggguggauaucguacuggagcacggcaguuguguuacuacaauggccaaaaauaagcccacccucgacuucgaauuaauuaagacggaggcuaaacacccugccacccugcggaaguacugcaucgaagcgaaacuuacaaacacuaccacagcaucccgcuguccaacucagggggagcccucuuugaaugaggaacaagauaagcgauuugugugcaaacauagcauggucgacagaggauggggcaacgguugugggcuguucggaaagggcggcaucgugaccugcgccauguuuacaugcaagaaaaauauggaggggaagauugugcagccugaaaaccuagaguauaccauagucaucacuccacacuccggagaagagaaugcuguugguaacgauacgggcaaacaugggaaggagauuaaagugacaccgcagucaaguaucaccgaagccgagcucacuggauacggcaccguaacaauggaauguagccccaggaccggucuggacuucaaugagauggugcuucugcagauggaaaacaaggcaugguugguccaccggcaaugguuucucgaucugccuuuaccauggcugcccggggcugacacucagggcucuaacuggauacagaaagagacacucgugacguucaagaauccucacgccaagaaacaggauguugugguccuuggaucccaagagggcgcgaugcauaccgcccugacuggggcaacagaaauucagaugucaagcggaaacuugcuauuuaccggucaccugaagugccgucuccgcauggacaaacugcagcuuaagggcaugaguuauucuauguguacagggaaauucaaggugguaaaggagaucgcugaaacucaacauggaaccaucguuauuagagugcaguacgagggcgacgguuccccaugcaaaauccccuucgagauuauggaucuggaaaagaggcacgucuuggggcggcucauaacggugaauccgaucgucaccgagaaagacagcccugugaacauugaagccgagcccccauuuggcgauucguacaucaucauuggaguugaaccuggccagcugaaguuaucuugguucaaaaagggguccucaauaggacagauguuugagacaacuaugcgaggugcuaagcgcauggccauccugggcgacaccgcaugggauuucgggagucuaggaggcguguuuacaagcauugguaaagcccuccaucaaguauucggggcuaucuauggcgcggcauuuuccggagucucuuggacuaugaagauucugaucggcgugguuauaaccuggaucgggaugaauagcagaucaacgagucuuuccgugagcuugguccuggugggaguagugacacucuaccugggcguuaugguccaggccgacucugguuguguggugucauggaaaaacaaggagcuuaaaugcgggaguggaauuuucaucaccgauaauguccacacuuggacagaacaguauaaguuucagcccgagagcccauccaagcuggcuucugccauucaaaaagcacacgaagagggcaucugugguauaaggucgguuacccgguuggaaaaccucauguggaagcagauuacucccgagcugaaucauaucuuaagcgagaacgaagugaaacugaccauuaugacaggcgacaucaaggggauaaugcaggccggaaaacgcucccuaagaccucagccaacggagcucaaguacucauggaaaaccuggggcaaggcuaagaugcugaguacugaacuucacaaucauacauucuugaucgaugggccggagaccgccgaaugccccaacgcaaauagggcguggaacucucuggagguggaggacuauggauuuggcguauucacaacuaauauuuggcucaaacugaaggaacgucaagaugcuuuuugugacagcaaauuaauguccgccgcaaucaaggacaaccgggccguccacgcugauauggguuacuggauugagucagcccugaacgacaccuggaaaaucgaaaaggccagcuucauagaggugaagucuugccacuggccuaaaucccauacgcuuuggaguaaugggguuuuggagagcgaaaugauuaucccaaagaacuucgcuggacccgugucucagcacaauuaucgaccuggcuaccauacacagaccgccgguccauggcaccucggcagacuggagauggauuuugacuucugugaagggacuaccgucgugguuacagaggauugcggaaacaggggccccucccuacgcacuaccacagcgucagggaaacugaucacggaauggugcugucggaguugcacccucccgccucugagauacaggggagaggacggcuguugguaugguauggagauucgcccacuuaaggaaaaagaggaaaauuuggugaacagccugguaacugccgggcauggacagaucgauaauuuuucguuaggcguccucgguauggcucuguuccuugaggaaaugcugcgaacacgggugggcaccaagcacgcaauuuugcucguggccgucuccuuuguuacucugauaacagggaacaugucuuuccgugaccuaggaagagugaugguaauggugggcgcuaccaugacggaugacaucgggauuggagucacuuaccuggcccuccuggcagcguuuaaggugaggcccaccuucgccgcuggccuuuugcugcgcaaauuaacaagcaaggagcucaugaugaccacuaucgguauuacacugcuuucacaaaguaccaucccugagacaauacuggaacuaacugaugcccucgcacuggggaugaugguuuugaaaaucgugcggaauauggagaaguaucagcuggcugucaccauuauggccaucuuaugcgugcccaacgcaguuauucuccagaaugccuggaaaguguccuguacgacacuggcugucguaucugugagcccacuucuguugaccuccucacaacagaaggcggacuggaucccucucgcccugacuauaaagggacuaaaccccaccgcaauuuuucugacaacucuuagcagaaccaguaaaaagaggucuuggccacucaaugaagcuaucauggccguuggcaugguguccauccuggccagcucguugcugaaaaacgauauuccgaugacgggcccuuuagucgcugggggacuccugacagugugcuacguacuuaccggucgaucagcagaccuggaguuggaacgcgccgcggacgugcggugggaggagcaggcugaaauaucuggcaguucccccauccucagcauuacuaucucugaggaugggagcauguccauuaagaaugaagaggaggaacagacacugaccauccuaauaagaacuggacugcuugucaucucaggccucuucccaguuaguauucccaucacagccgcagccugguaucugugggaggugaaaaagcaaagggcugguguguugugggacgucccuagcccacccccuguggggaaagcagaauuagaggauggagccuaccguauuaagcagaagggcauccugggcuauucucagauaggggcgggaguuuacaaagaagguaccuuucacacgauguggcauguaacucgcggcgcugugcucaugcacaaggggaaacggauugagccguccugggccgacgucaagaaagaucugaucucauacggaggcgguuggaaacuugagggggaauggaaggagggagaagaggugcagguucuggcauuggaaccaggcaaaaaccccagagccgugcaaaccaagccuggccuauucaaaacaaguaccgggacaaucggagcugucagccuggacuuuuccccagguacuucuggcucgcccauuguggauaagaaagggaagguagucggacucuauggcaacggugugguuaccaggagcgggacguacgugucagccaucgcacagacagagaaguccauagaggacaauccugaaauugaggaugacaucuucagaaagaagcggcugacuauuauggaucuucauccgggagcuggcaaaaccaagcgcuauuuacccgccaucgucagagaagcgauaaaaaggggccugcggacacucauuuuggccccaacccgagugguugcagcugagauggaagaggcccugagagggcucccuauccgcuaccagacucccgcuaucagggcagagcacaccggacgugaaauuguggaccugaugugucaugccacauucacgaugcggcuucugaguccaaucagagucccuaacuauaauuugauuauaauggaugaggcccacuuuacugaccccgcuucuaucgcggcaagggguuacauuagcacccgcguggaaaugggcgaggccgcugggaucuucaugacagccaccccaccgggaucccgagacccuuuuccccagucaaacgcaccaaucauggaugaggaaagagagauucccgaacggucuuggaauagcggccacgaguggguaacugacuucaaggguaagacagugugguuuguuccuaguauaaaagccgggaacgauaucgcugcgugccuaaggaagaauggcaaaaaggucauucaacugucccgcaaaaccuucgacagcgaauauaucaagacgcguacuaacgauugggacuuuguggugacaaccgauauuucugagaugggcgccaauuucaaggcagagagagucaucgacccacggagguguaugaaacccguaauacucaccgauggcgaagaacgcgugaucuuagcugggccuaugccgguuacucauucauccgccgcacagcgaagaggacggguggguaggaacccaaagaaugaaaacgaccaguacauuuacaugggcgagccccuggaaaaugaugaggacugcgcccacuggaaagaggcuaagaugcuucuggacaacaucaauacaccugaagggauuauccccaguauguuugagccagaacgcgagaaagucgaugccauagacggagaauauagacucaggggcgaggcgcggaagaccuucguggauuugaugcgucgcggugaccugccuguuuggcucgcauaccgaguggccgcugaggggauuaacuaugccgauagaaggugguguuuugacggcgucaaaaacaaucaaauccuggaagagaacguggaaguagagauuuggacaaaggagggagaacggaagaaacuuaagccccgcuggcuagaugcuagaaucuacagcgacccacuggcauugaaagaguucaaggaguucgccgcuggcaggaaaucguuaacucugaaucucauaacggagauggggcggcugccuaccuuuaugacacagaaggugcgaaacgcccuugauaaucuggcaguucuccauacugcggaagccggagguagagcuuauaaccacgccuugucugagcugccggagacccuagaaacacugcuccuucugaccuuauuggcaacugucacgggcgggaucuuccuguuucucauguccggaaagggcguggguaaaaugacccuggggaugugcugcauuaucacagcuagcauucuucugugguacgcccagauccagccccacuggauagcagccucaauuauccucgaguucuuuuugaucgugcuguuaauuccagaaccugagaagcaacgcacuccccaggacaaucagcuaaccuaugucguuaucgcuauacugacagugguagcggccaccauggcaaacgaaaugggcuuccucgagaaaacuaagaaagauuuuggacuuggcaguauuacaacgcagcaaccagagucuaauauccuggacauugauuugaggccugcuuccgccuggacccuguacgccguggcaacuacauucaucacccccaugcuccggcauagcauagaaaacucaagugucaaugugagccugaccgcuaucgccaaccaggcgacaguucuuauggggcucggaaaggguuggccgcuguccaagauggacauuggcgugccauugcuggcuaucggguguuacucucaggucaauccuauuacuuuaacggccgcacuacugcuccuuguagcccacuaugcuaucauuggacccggccugcaggcaaaagccacccgugaggcgcaaaagagaacagcugccgguaucaugaaaaacccaacuguggacgggauaaccguuauugauuuggaccccaucccuuacgauccgaaguuugaaaaacagcugggccaggugaugcuccugguccuuugcgugacacaggucuuaaugaugaggaccacuugggcacugugugaggcccucacguuggcuacaggacccaucagcacccugugggaaggcaauccagggcgcuucuggaacacuaccauugccguguccauggcaaauauauuucggggaucauaucuagcuggcgccggucuacucuucucuaucaugaagaacacagcgaacacucgaagagggaccggaaauacaggcgagacgcuuggugagaaguggaaaaacaggcugaaugccuugggcaagagugaauuucaaauuuacaaaaagucggggauccaggagguugaccgcacccuggcaaaagaaggaauuaagcggggcgagacugaucaucacgcugugagcagaggguccgccaaacuccguugguucguagagaggaaccuggugacaccugaaggaaaggucguugacuuaggcugcgguagaggcggguggucuuauuacugugggggucuuaagaaugugaaagaggucaagggccugaccaaagggggacccggccaugaggaaccuaucccaaugucaacuuauggguggaaccucgugcgccuacagagcggaguagauguguucuuuacacccccugaaaagugcgacacccuguugugugauauaggcgaguccaguccaaaucccacgguugaggcaggucgaacccugagagugcucaaccuugucgaaaauuggcugaacaauaacacacaauucugcaucaaaguguugucuccguacaugccuagcgucauugagaagauggaagcucugcagaggaaguacgggggagcccucgugcggaauccauuaucacgcaacuccacucacgagauguauuggguuaguaaugccagcggcaacaucguaucuuccgugaacaugauuucaagaaugcugaucaauagguuuaccaugcgacacaaaaaggcgacauacgaacccgacgucgaucuuggcagcgggacucggaacauaggaauugagucggagaccccuaaucuggacaucaucgguaaacguauugaaaagauaaaacaggagcaugaaacaucuuggcacuaugaucaggaccauccauacaagaccugggcuuaucacggcaguuacgagacuaagcaaacgggguccgcaagcucaauggugaacggaguugugagacuacucacaaaacccugggacgucaucccgauggugacccagauggccaugacugauaccacaccuuucggccagcagcgcguauuuaaggaaaaaguggacacgaggacccaagagcccaaggaggguacuaaaaagcugaugaagauuacagcugaaugguuguggaaagagcuggggaagaaaaagaccccacggauguguacuagagaagaguucacacgcaaaguuagguccaaugccgcacucggagccaucuuuaccgaugagaacaaguggaaaucugcucgagaagcggucgaggacagcggcuucugggaacuuguggauaaggagcggaaucugcacuuagaaggcaagugcgagacauguguguauaacaugauggggaaaagagagaagaaacugggagaauuugguaaggccaaaggcaguagggcaauuugguacaugugguugggggcucgcuuccucgaguuugaagcccugggauuccuaaaugaggaccauugguuuucccgugaaaacagccuuucuggcgucgagggugaggggcugcacaagcucggauacauccugcgggauguuucaaagaaagaaggcggcgcaauguaugccgacgauacugcugggugggacaccagaauaacguuggaggaucugaagaaugaagagauggugaccaaccauauggaaggagagcacaaaaagcucgccgaggcgaucuucaaacuuacauaccagaauaagguagugaggguccagcgcccuacuccccgagguaccgugauggacauuaucagucggagagaccagaggggcuccgggcaaguugugacauauggacugaacacuuucaccaauauggaagcacaguuaauucgccagauggagggcgaaggugucuuuaagagcauccaacagcugacggugacagaggagauugccgucaaaaacugguugguuaccguggggagagaacggcucucuaggauggcuauaucgggagaugacugcgucgugaagccacuggaugaccguuucgccucagcacuaacugcucuuaacgauaugggcaaagugcgaaaggacauccagcagugggagcccagccgcggcuggaaugauuggacacaagucccuuuuugcucccaucacuuccacgaacugauuaugaaagacgggagaguucucgugguaccaugucggaaccaggaugagcugaucggaagggcccgcaucagucagggugcuggcuggucuuugagagaaaccgccugcuuaggaaagagcuacgcacagauguggucccugauguauuuucaucggagggaccuccgacuugcggccaaugcuauuuguucagccgugccgagucacuggguccccacuucucguaccacauggagcauacaugcaacgcacgaguggaugaccacugaggauaugcugacaguguggaacagaguuuggauccaagaaaauccuuggauggaggacaagaccccaguggaauccugggaggaaauucccuaccuaggaaaacgcgaggaucaguggugcggcucacugaucggucucacuagccgggcuacaugggccaagaacauucagaccgcaaucaaucaggucaggucuuugauagggaacgaggaauauacggacuacaugccuuccaugaaaagauuccgccgggaggaagaggaagccggagugcugugguga

SEQ ID NO: 14961 - RNA, 9876 nt, Artificial Sequence
  derived and/or modified CDS sequence (opt3) from DENV-2__KC762679__SS-prME
accgccggcaucauuauaaugaugauccccacagugauggcuuuccaccugacuacgagaaacggggagccucauaugauugucagcaggcaggaaaagggaaaaucccuccuuuuuaagaccgagaaugguguuaacaugugcacacugauggcaauggacuugggcgaauuaugugaggauacuaucaccuacaauugcccacugcuacggcaaaacgaaccggaggacauugauuguuggugcaauucuacaucaaccugggugacuuaugggacauguaccgccacgggagagcaccgccgagaaaaacguaguguagcgcucgugccccaugucggcaugggucuggagacuagaaccgaaacauggaugagcuccgagggggcuuggaagcacgcccagaggaucgagacuugggugcuucggcauccuggauucaccauaauggcagccauccuggcuuacacaauuggcaccacguauuuucagcgcguuuugaucuucauucuccugacugcaguggccccaucuaugacaaugagaugcaucggcauaucgaacagggacuuugucgaaggggugucaggagguagcuggguagauauuguucuggagcacggcaguugugugaccacuauggcuaaaaauaagcccacacucgacuucgaauuaaucaagaccgaggccaaacacccugcgacgcugcggaaguacugcauugaagcaaaacuuaccaacacaacuaccgccucccgcuguccaacacagggggagcccucuuugaaugaggaacaagauaagcgauuugucugcaaacauagcaugguggacagaggauggggcaacgguugugggcuguucggaaagggcggcaucgugacuugcgcuauguuuaccugcaagaaaaauauggaggggaagaucguccagccugaaaaccuagaguauacaauuguuauaaccccacacuccggagaagagaaugccguggguaacgauacuggcaaacaugggaaggagaucaaaguaacgccgcagucaaguauuacagaagcagagcucaccggauacggcacugugaccauggaauguagccccaggacaggucuggacuucaaugagaugguccuucugcagauggaaaacaaggcuugguuggugcaccggcaaugguuucucgaucugccuuuaccauggcugcccggggccgacacccagggcucuaacuggauccagaaagagacucucguuacauucaagaauccucacgcgaagaaacaggauguggucgugcuuggaucccaagagggcgccaugcauacggcacugaccggggcuacugaaauacagaugucaagcggaaacuugcuauuuacaggucaccugaagugccgucuccgcauggacaaacugcagcuuaagggcaugaguuauucuauguguaccgggaaauucaagguaguuaaggagauugccgaaacacaacauggaacuaucgugaucagaguccaguacgagggcgacgguuccccaugcaaaauucccuucgagaucauggaucuggaaaagagguacguguuggggcggcucauuaccgucaauccgauagugacggagaaagacagcccuguuaacaucgaagcugagcccccauuuggcgauucguauauuaucaucggaguggaaccuggccagcugaaguuaaauugguucaaaaaggggucuuccauuggacagauguuugagaccacaaugcgaggugccaagcgcauggcaauacugggcgacacugccugggauuucgggucacuaggaggcguauuuaccaguaucgguaaagcucuccaccaagucuucggggcgauuuacggcgcagccuuuagcggaguguccuggacaaugaagauccugauuggcguugugaucacuuggauagggaugaacucuagaagcaccucacuuagugucuccuuggugcugguaggagugguuacgcucuaucugggcgucauggugcaggcugacagcgguuguguggucucuuggaaaaauaaggagcuuaaaugcgggucaggaaucuucauuacagauaacguucauaccuggacugaacaguacaaguuucagcccgagaguccaagcaagcuggccuccgcaauccaaaaagcccacgaagagggcauuugugguaucaggucugugacacgguuggaaaaucucauguggaagcagauaacccccgagcugaaccacauuuuaucggagaaugaagugaaacugacuaucaugaccggcgacauuaaggggaucaugcaggcuggaaaacgcagccuaagaccucagccaacagagcucaaguauuccuggaaagccuggggcaaggcaaagaugcugucaacggaacuucauaaccacaccuucuugauagaugggccggagacugcggaaugccccaauacaaacagggcuuggaauagucuggagguagaggacuacggauuuggcgucuucaccacaaacaucuggcucaaacugaaggaacgucaagauguguuuugugacucuaaauuaaugagcgccgcaauuaaggacucccgggccguucaugcugauauggguuauuggaucgagucagcccugaacgacacuuggaaaauugaaaaggcaagcuucaucgaggugaagucuugccacuggccuaaaucccacacccuuuggaguaauggggucuuggagagcgaaaugauaauuccaaagaacuucgcuggacccgugucucagcauaauuaccgaccuggcuaccacacgcagacagccgguccauggcaucucggcagacuggagauggauuuugacuucugugaagggaccacuguugugguaaccgaggauugcggaaacaggggccccucccuacgcacaacuaccgcgucagggaaacugaucacagaauggugcugucggaguugcacgcucccgccucugagauauaggggagaggacggcuguugguacgguauggagauccgcccacuuaaggaaaaagaggaaaauuuggucaacagccuggugaccgccgggcacggacagauugauaauuuuucguuaggcgugcucgguauggcucuguuccuugaggaaaugcugcgaacucgggucggcacaaagcaugcaaucuugcucguugccguguccuuuguaacccugauuacugggaacaugucuuuccgugaccuaggaagagugauggucauggugggcgcuacaaugaccgaugacauagggaugggaguuacguaucuggcccuccuggcagcguuuaaggugaggcccacuuucgccgcuggccuuuugcugcgcaaauuaaccagcaaggagcucaugaugacaaccaucgguauuguccugcuuucacaagccacuaucccugagacaauucuggaacuaaccgaugcacucgcucuggggaugaugguguugaaaaucguucggaauauggagaaguaccagcuggccgugacaauaauggcaaucuuaugcguccccaacgccguaauucuccagaaugcuuggaaagugaguuguacuacccuggcgguuguguccgucucuccacuucuguugacgagcucccaacagaaggccgacuggaucccucucgcacugacaauuaagggacuaaaccccaccgcuaucuuucugacuacccuuucaagaacaagcaaaaagaggaguuggccacucaaugaagccauaauggccgugggcaugguaucuauucuggcuuccagcuugcugaaaaacgauaucccgaugacuggcccuuuaguggcagggggacuccugaccgucugcuauguucuuacgggucgaucggccgaccuggaguuggaacgcgcggcugacgugcggugggaggagcaggccgaaaucucaggcucuagucccauucucuccauaacaaucagcgaggaugggucuaugagcauuaagaaugaagaggaggaacagacccugacuauccuaauuagaacaggacugcuugugaucuccggccucuucccagucucaauacccaucaccgcagccgcuugguaccugugggaggugaaaaagcaaagggcagguguuuugugggacguaccuaguccacccccuguggggaaagccgaauuagaggauggagcguaucguauuaagcagaagggcauccugggcuacagccagauuggggcuggagucuacaaagaagguacuuuucacacaauguggcacgugacccgcggcgccguucucaugcauaaggggaaacggaucgagccgucuugggcagacgugaagaaagaucugauauccuauggaggcgguuggaagcuugagggggaauggaaggagggagaagagguccaggugcuggccuuggaaccaggcaaaaaccccagagcuguacaaacgaagccuggccuauucaaaacuaacaccgggacaauuggagccgucucacuggacuuuaguccagguaccagcggcucccccaucguggauaagaaagggaagguugugggacucuacggcaauggugucgugacaaggucugggacuuauguuucggcaaucgcucagaccgagaagagcauugaggacaacccugaaaucgaggaugacauauuccgaaaaaagcggcugacgauuauggaucuucacccgggagccggcaaaacaaagcgcuacuuacccgcgaucgugagagaagccauuaaaaggggccugcggacucucaucuuggcaccaacccgagucguggcugccgagauggaagaggcucugagagggcucccuauacgcuaucagacacccgcaauuagggccgagcauaccggacgugaaaucguagaccugaugugucacgccacuuucaccaugcggcuucugucaccaaucagagugccuaauuacaacuugauuaucauggaugaggcucauuuuacagaccccgcguccauugcagccagggguuauauaaguacgcgcguugaaaugggcgaggcugccgggaucuucaugacugcaaccccaccgggaucucgagacccuuuuccccagagcaaugccccaauuauggaugaggaaagagagauccccgaacgguccuggaacucaggccacgagugggucacagacuucaaggguaagaccgugugguuugugccuucuaucaaagcugggaaugauauugcggccugccuaaggaagaacggaaaaaaggucauacaacugagccgcaaaacuuucgacagugaauacaucaagacacguaccaaugauugggacuuuguagugacgacugauauuuccgagaugggcgcaaacuucaaggcugagagaguuaucgacccacggagguguaugaaacccgugauucucacagauggcgaagagcgcgucaucuuagccgggccuaugccggugacccacagcucugcagcccagcgaagaggacggguugguaggaauccaaagaacgaaaaugaccaguacauauauaugggcgagccccuggaaaacgaugaggacugcgcucauuggaaagaggccaagaugcuucuggacaauaucaacaccccugaagggauuauccccucaauguuugagccagaacgcgagaaaguggaugcgauugacggagaauacagacucaggggcgaggcacggaagacuuucgucgauuugaugcgucgcggugaccugccuguguggcucgccuaucgaguagcugccgaggggaucaacuacgcugauagaaggugguguuuugacggcgugaaaaauaaccaaauacuggaagagaauguugaagucgagauuuggacaaaggagggagaacggaagaaacuuaagccccgcuggcuagaugcaagaaucuauuccgacccacuggccuugaaagaguucaaggaauucgcugccggcaggaaaaguuuaacccugaaccucauuacagagauggggcggcugccuacuuuuaugacgcagaaggcacgaaaugcgcuugauaaccuggccgugcuccacaccgcugaagccggagguagagcauacaaucaugcuuugagcgagcugccggagacacuagaaacucugcuccuucugaccuuauuggccacagugaccggcgggaucuuccuguuucucaugucgggaaagggcauagguaaaaugacucuggggaugugcugcaucauuacggcaucuauccuucugugguaugcccagauucagccccacuggaucgcugcguccauaauucucgaguucuuuuugaucguccuguuaaucccagaaccugagaagcaacgcaccccccaggacaaccagcuaacauacguugugauugccauccugacuguaguggcagcuaccauggccaaugaaaugggcuuccucgagaaaacaaagaaagauuuuggacuuggcagcauaaccacucagcaaccagagucaaacauucuggacaucgauuugaggccugccagugcauggacacuguacgcugucgccacgaccuucauuacucccaugcuccggcacucuaucgaaaauuccagcgugaacguuucacugacagcgauagcuaaucaggccaccgugcuuauggggcucggaaaggguuggccgcugaguaagauggacaucggcgucccauugcuggcaauuggguguuauagccagguaaacccuaucaccuuaacagccgcucuacugcuccuuguggcacauuacgccauuaucggacccggccugcaggcgaaagcuacucgugaggcccaaaagagagcagccgcugguauuaugaaaaauccaacgguugacgggaucaccgugauagauuuggaccccauuccuuaugauccgaaguuugaaaaacagcugggccaggucaugcuccuggugcuuugcgucacacagguguuaaugaugaggacuaccugggcccugugugaggcacucacauuggcuaccggacccaucuccacucugugggaaggcaacccagggcgcuucuggaauacgacaaucgccguuucuauggcgaacauuuuucggggaagcuaccuagccggcgcaggucugcucuucuccauaaugaagaacaccgcuaauacucgaagagggaccggaaacacaggcgagacucuuggugagaaguggaaaaauaggcugaacgccuugggcaagucagaauuucaaaucuauaaaaagucugggauucaggagguggaccgcacccuggcaaaagaaggaaucaagcggggcgagacagaucaccaugcuguaaguagagggucggccaaacuccguugguucguggagaggaaucuggucacgccugaaggaaagguuguggacuuaggcugcggucgggggggauggagcuacuauuguggcggucuuaagaacgucaaagaggugaagggccugaccaaagggggacccggccacgaagagccuauuccaauguccacuuacggguggaaucucguacgccuacagucuggaguggauguuuucuuuacacccccugaaaagugcgacacccuguugugugauaucggcgagucaagcccaaaccccacuguggaggccggucgaacacugagaguccucaaucuuguggaaaacuggcugaauaacaauacccaauucugcauaaaagucuugaacccguacaugccuuccgugaucgagaagauggaagcgcugcagaggaaguaugggggagcucucguucggaauccauuaagucgcaacucuacgcaugagauguacuggguaagcaacgcaucaggcaauauuguguccagugucaacaugaucagcagaaugcugauuaauagguuuaccaugcgacacaaaaaggccacauaugaacccgacguggaucuuggcucugggacucggaacaucggaauagaguccgagaccccuaaucuggacauuaucgguaaacguaucgaaaagauuaaacaggagcacgaaacaucauggcauuacgaucaggaccacccauauaagacuugggcuuaccauggcagcuaugagaccaagcaaacagggucggccucuaguaugguuaacggaguggucagacuacucaccaaacccugggacgugauaccgaugguaacucagauggcaaugacggauacaaccccuuucggccagcagcgcguguuuaaggaaaaaguugacacuaggacccaagagcccaaggaggguacaaaaaagcugaugaagaucacggccgaaugguuguggaaagagcuggggaagaaaaagaccccacggauguguacuagagaagaguucacacgcaaagucagguccaaugcugcgcucggagccauuuuuaccgaugagaacaaguggaaaagcgcacgagaagcuguggaggacucaggcuucugggaacuuguggauaaggagcggaaucugcacuuagaaggcaagugcgagacuugugucuacaacaugauggggaaaagagagaagaaacugggagaauuugguaaggccaaaggcuccagggcaaucugguacaugugguugggggcccgcuuccucgaguuugaagcucugggauuccuaaaugaggaccacugguuuucucgugaaaacagccuuaguggcguugagggugaggggcugcauaagcucggauauauucugcgggauguguccaugaaggaaggcggcgccauguacgcggacgauacagcagggugggacaccagaaucacauuggaggaucugaaaaaugaagagaugguaacuaaccacauggaaggagagcauaagaaacucgccgaggcuauauucaagcuuaccuaucagaauaaaguggucagggugcagcgcccuacgccccgagguaccguuauggacaucauuagccggagagaccagaggggcucugggcaaguggucacauacggacugaacacuuucaccaacauggaagcccaguuaauccgccagauggagggcgaagguguguuuaagucaauucaacagcugacaguaacugaggagaucgcaguuaagaauugguuggugagagucgggcgggaaaggcucagucguauggcuauuuccggagaugacugcguggugaaaccacuggaugaccgauucgccagcgcucuaaccgcccuuaacgauaugggcaagguccgcaaagacauacagcagugggagcccucuagaggcuggaaugauuggacgcaaguuccuuuuugcucgcaccauuuccacgaacugaucaugaaggacgggcgggugcucguagugccauguaggaaccaggaugagcugauuggacgcgcaagaaucucacagggugcgggcuggagcuugcgggaaacagccugcuuagggaaauccuaugcucagauguggagucugauguacuuucacaggcgagaccuccgucuugccgcaaaugcuaucuguucugccgucccgagccauugggugcccaccuccagaacuacauggucaauucacgcaacccaugaguggaugacuaccgaggauaugcugacaguuuggaaccgcguguggauacaagaaaauccuuggauggaggacaagacgccagucgaaaguugggaggaaauccccuaucuaggaaagcgggaggaucaguggugcggcucucugauuggucucaccagcagggccacuugggcgaaaaacauccagacagcuauuaaucaggugagauccuugaucgggaacgaggaauacaccgacuacaugccuucaaugaagcgcuuccggagggaggaagaggaagccggaguacugugguga

SEQ ID NO: 14962 - RNA, 9876 nt, Artificial Sequence
  derived and/or modified CDS sequence (opt3) from DENV-2__KC762680__SS-prME
accgcaggaaucauuauaaugaugauccccacagugauggcuuuccaccugacuacgagaaacggggagccucauaugauugucagcaggcaggaaaagggaaaaucccuccuuuuuaagaccgagaaugguguuaacaugugcacacugauggcaauggacuugggcgaauuaugugaggauacuaucaccuacaauugcccacugcuacggcaaaacgaaccggaggacauugauuguuggugcaauucuacaucaaccugggugacuuaugggacauguaccgcaacgggagagcaccgccgagaaaaacguaguguagcgcucgugccccaugucggcaugggucuggagacucggaccgaaacauggaugagcuccgagggggcuuggaagcacgcccagaggaucgagacuugggugcuucggcauccuggauucaccauaauggcagccauccuggcuuacacaauuggcaccacguauuuucagcgcguuuugaucuucauucuccugacugcaguggccccaucuaugacaaugagaugcaucggcauaucgaacagggacuuugucgaaggggugucaggagguagcuggguugauauuguucuggagcacggcaguugugugaccacuauggcuaaaaauaagcccacacucgacuucgaauuaaucaagaccgaggccaaacacccugcgacgcugcggaaguacugcauugaagcaaaacuuaccaacacaacuaccgccucccgcuguccaacacagggggagcccucuuugaaugaggaacaagauaagcgauuugucugcaaacauagcaugguggacagaggauggggcaacgguugugggcuguucggaaagggcggcaucgugacuugcgcuauguuuaccugcaagaaaaauauggaggggaagaucguccagccugaaaaccuagaguauacaauuguuauaaccccacacuccggagaagagaaugccguggguaacgauacuggcaaacaugggaaggagaucaaaguaacgccgcagucaaguauuacagaagcagagcucaccggauacggcacugugaccauggaauguagccccaggacaggucuggacuucaaugagaugguccuucugcagauggaaaacaaggcuugguuggugcaccggcaaugguuucucgaucugccuuuaccauggcugcccggggccgacacccagggcucuaacuggauccagaaagagacucucguuacauucaagaauccucacgcgaagaaacaggauguggucgugcuuggaucccaagagggcgccaugcauacggcacugaccggggcuacugaaauacagaugucaagcggaaacuugcuauuuacaggucaccugaagugccgucuccgcauggacaaacugcagcuuaagggcaugaguuauucuauguguaccgggaaauucaagguaguuaaggagauugccgaaacacaacauggaacuaucgugaucagaguccaguacgagggcgacgguuccccaugcaaaauucccuucgagaucauggaucuggaaaagagguacguguuggggcggcucauuaccgucaauccgauagugacggagaaagacagcccuguuaacaucgaagcugagcccccauuuggcgauucguauauuaucaucggaguggaaccuggccagcugaaguuaaauugguucaaaaaggggucuuccauuggacagauguuugagaccacaaugcgaggugccaagcgcauggcaauacugggcgacacugccugggauuucgggucacuaggaggcguauuuaccaguaucgguaaagcucuccaccaagucuucggggcgauuuacggcgcagccuuuagcggaguguccuggacaaugaagauccugauuggcguugugaucacuuggauagggaugaacucuagaagcaccucacuuagugucuccuuggugcugguaggagugguuacgcucuaucugggcgucauggugcaggcugacagcgguuguguggucucuuggaaaaauaaggagcuuaaaugcgggucaggaaucuucauuacagauaacguucauaccuggacugaacaguacaaguuucagcccgagaguccaagcaagcuggccuccgcaauccaaaaagcccacgaagagggcauuugugguaucaggucugugacacgguuggaaaaucucauguggaagcagauaacccccgagcugaaccacauuuuaucggagaaugaagugaaacugacuaucaugaccggcgacauuaaggggaucaugcaggcuggaaaacgcagccuaagaccucagccaacagagcucaaguauuccuggaaagccuggggcaaggcaaagaugcugucaacggaacuucauaaccacaccuucuugauagaugggccggagacugcggaaugccccaauacaaacagggcuuggaauagucuggagguagaggacuacggauuuggcgucuucaccacaaacaucuggcucaaacugaaggaacgucaagauguguuuugugacucuaaauuaaugagcgccgcaauuaaggacucccgggccguucaugcugauauggguuauuggaucgagucagcccugaacgacacuuggaaaauugaaaaggccagcuucaucgaggugaagucuugccacuggccuaaaucccacacccuuuggaguaauggggucuuggagagcgaaaugauaauuccaaagaacuucgcuggacccgugucucagcauaauuaccgaccuggcuaccacacgcagacagccgguccauggcaucucggcagacuggagauggauuuugacuucugugaagggaccacuguugugguaaccgaggauugcggaaacaggggccccucccuacgcacaacuaccgcgucagggaaacugaucacagaauggugcugucggaguugcacgcucccgccucugagauauaggggagaggacggcuguugguacgguauggagauccgcccacuuaaggaaaaagaggaaaauuuggucaacagccuggugaccgccgggcacggacagauugauaauuuuucguuaggcgugcucgguauggcucuguuccuugaggaaaugcugcgaacucgggucggcacaaagcaugcaaucuugcucguugccguguccuuuguaacccugauuacugggaacaugucuuuccgugaccuaggaagagugauggucauggugggcgcuacaaugaccgaugacauagggaugggaguuacguaucuggcccuccuggcagcguuuaaggugaggcccacuuucgccgcuggccuuuugcugcgcaaauuaaccagcaaggagcucaugaugacaaccaucgguauuguccugcuuucacaagccacuaucccugagacaauucuggaacuaaccgaugcacucgcucuggggaugaugguguugaaaaucguucggaauauggagaaguaccagcuggccgugacaauaauggcaaucuuaugcguccccaacgccguaauucuccagaaugcuuggaaagugaguuguacuacccuggcgguuguguccgucucuccacuucuguugacgagcucccaacagaaggccgacuggaucccucucgcacugacaauuaagggacuaaaccccaccgcuaucuuucugacuacccuuucaagaacaagcaaaaagaggaguuggccacucaaugaagccauaauggccgugggcaugguaucuauucuggcuuccagcuugcugaaaaacgauaucccgaugacuggcccuuuaguggcagggggacuccugaccgucugcuauguucuuacgggucgaucggccgaccuggaguuggaacgcgcggcugacgugcggugggaggagcaggccgaaaucucaggcucuagucccauucucuccauaacaaucagcgaggaugggucuaugagcauuaagaaugaagaggaggaacagacccugacuauccuaauuagaacaggacugcuugugaucuccggccucuucccagucucaauacccaucaccgcagccgcuugguaccugugggaggugaaaaagcaaagggccgguguuuugugggacguaccuaguccacccccuguggggaaagccgaauuagaggauggagcguaucguauuaagcagaagggcauccugggcuacagccagauuggggcuggagucuacaaagaagguacuuuucacacaauguggcacgugacccgcggcgccguucucaugcauaaggggaaacggaucgagccgucuugggcagacgugaagaaagaucugauauccuauggaggcgguuggaaacuugagggggaauggaaggagggagaagagguccaggugcuggccuuggaaccaggcaaaaaccccagagcuguacaaacgaagccuggccuauucaaaacuaacaccgggacaauuggagccgucucacuggacuuuaguccagguaccagcggcucccccaucguggauaagaaagggaagguugugggacucuacggcaauggugucgugacaaggucugggacuuauguuucggcaaucgcucagaccgaaaagagcauugaggacaacccugaaaucgaggaugacauauucagaaagaagcggcugacgauuauggaucuucacccgggagccggcaaaacaaagcgcuacuuacccgcgaucgugagagaagccauuaaaaggggccugcggacucucaucuuggcaccaacccgagucguggcugccgagauggaagaggcucugagagggcucccuauacgcuaucagacacccgcaauuagggccgagcauaccggacgugaaaucguagaccugaugugucacgccacuuucaccaugcggcuucugucaccaaucagagugccuaauuacaacuugauuaucauggaugaggcucauuuuacagaccccgcguccauugcagccagggguuauauaaguacgcgcguugaaaugggcgaggcugccgggaucuucaugacugcaaccccaccgggaucucgagacccuuuuccccagagcaaugccccaauuauggaugaggaaagagagauccccgaacgguccuggaacucaggccacgagugggucacagacuucaaggguaagaccgugugguuugugccuucuaucaaagcugggaaugauauugcggccugccuaaggaagaacggcaagaaggucauacaacugagccgcaaaacuuucgacuuugaauacaucaagacacguaccaaugauugggacuucguagugacgacugauauuagugagaugggcgcaaacuuuaaggcugagagaguuaucgacccacggagguguaugaaacccgugauucucacagauggcgaagaacgcgucaucuuagccgggccuaugccggugacccacuccagcgcagcccagcgaagaggacggguugguaggaauccaaagaacgaaaaugaccaguacauauauaugggcgagccccuggaaaacgaugaggacugcgcucauuggaaagaggccaagaugcuucuggacaauaucaacaccccugaagggauuauccccucuauguucgagccagaacgcgagaaaguggaugcgauugacggagaauacagacucaggggcgaggcacggaagacuuuugucgauuugaugcgucgcggugaccugccuguguggcucgccuaucgaguagcugccgaggggaucaacuacgcugauagaaggugguguuucgacggcgugaaaaauaaccaaauacuggaagagaauguugaagucgagauuuggacaaaggagggagaacggaagaaacuuaagccccgcuggcuagaugcaagaaucuauucagacccacuggccuugaaagaguucaaggaauuugcugccggcaggaaauccuuaacccugaaccucauuacagagauggggcggcugccuacuuucaugacgcagaaggcacgaaaugcgcuugauaaccuggccgugcuccacaccgcugaagccggagguagagcauacaaucaugcuuugagugagcugccggagacacuagaaacucugcuccuucugaccuuauuggccacagugaccggcgggaucuuucuguuccucaugagcggaaagggcauagguaaaaugacucuggggaugugcugcaucauuacggcaucgauccuucugugguaugcccagauucagccccacuggaucgcugcgucuauaauucucgaguuuuucuugaucguccuguuaaucccagaaccugagaagcaacgcacaccccaggacaaccagcuaacauacguugugauugccauccugacuguaguggcagcuaccauggccaaugaaaugggcuuucucgagaaaacaaagaaagauuucggacuuggcuccauaaccacucagcaaccagagagcaacauucuggacaucgauuugaggccugccucagcauggacacuguacgcugucgccacgaccuuuauuacucccaugcuccggcacaguaucgaaaauucuuccgugaacguuagccugacagcgauagcuaaucaggccaccgugcuuauggggcucggaaaggguuggccgcugucaaagauggacaucggcgucccauugcuggcaauuggguguuauagucagguaaacccuaucaccuuaacagccgcucuacugcuccuuguggcacauuacgccauuaucggacccggccugcaggcgaaagcuacucgugaggcccaaaagagagcagccgcugguauuaugaaaaauccaacgguugacgggaucaccgugauagauuuggaccccauuccuuaugauccgaaguucgaaaaacagcugggccaggucaugcuccuggugcuuugcgucacacagguguuaaugaugaggacuaccugggcccugugugaggcacucacauuggcuaccggacccaucagcacucugugggaaggcaacccagggcgcuuuuggaauacgacaaucgccguuuccauggcgaacauuuuccggggaucuuaccuagccggcgcaggucugcucuuuagcauaaugaagaacaccgcuaauacucgaagagggaccggaaacacaggcgagacucuuggugagaaguggaaaaauaggcugaacgccuugggcaaguccgaguuccaaaucuauaaaaagucagggauucaggagguggaccgcacccuggcaaaagaaggaaucaagcggggcgagacagaucaccaugcuguaucuagagggagugccaaacuccguugguucguggagaggaaucuggucacgccugaaggaaagguuguggacuuaggcugcgguagagggggauggucguacuauuguggcggucuuaagaacgucaaagaggugaagggccugaccaaagggggacccggccacgaggaaccuauuccaaugagcacuuacggguggaaucucguacgccuacaguccggaguggauguauuuuucacacccccugaaaagugcgacacccuguugugugauaucggcgagucuucaccaaaccccacuguggaggccggucgaacacugagaguccucaaucuuguggaaaacuggcugaauaacaauacccaauuuugcauaaaagucuugaacccguacaugccuagcgugaucgagaagauggaagcgcugcagaggaaguaugggggagcucucguucggaauccauuaucccgcaacaguacgcaugagauguacuggguaucuaacgcaagcggcaauauugugucauccgucaacaugaucaguagaaugcugauuaauagguucaccaugcgacacaaaaaggccacauaugaacccgacguggaucuuggcagcgggacucggaacaucggaauagagucugagaccccuaaucuggacauuaucgguaaacguaucgaaaagauuaaacaggagcacgaaacauccuggcauuacgaucaggaccacccauauaagacuugggcuuaccauggcucauaugagaccaagcaaacagggagcgccucgucuaugguuaacggaguggucagacuacucaccaaacccugggacgugauaccgaugguaacucagauggcaaugacggauacaaccccuuuuggccagcagcgcguguucaaggaaaaaguugacacuaggacccaagagcccaaggaggguaccaaaaagcugaugaagaucacggccgaaugguuguggaaagagcuggggaagaaaaagaccccacggauguguacuagagaagaguuuacacgcaaagucaggaguaaugcugcgcucggagccauuuucaccgaugagaacaaguggaaauccgcacgagaagcuguggaggacagcggcuuuugggaacuuguggauaaggagcggaaucugcacuuagaaggcaagugcgagacuugugucuacaacaugauggggaaaagagagaagaaacugggagaguucgguaaggccaaaggcucaagggcaaucugguacaugugguugggggcccgcuuucucgaguucgaagcucugggauuucuaaaugaggaccacugguucucccgugaaaacucucuuagcggcguugagggugaggggcugcauaagcucggauauauucugcgggaugugaguaugaaggaaggcggcgccauguacgcggacgauacagcagggugggacaccagaaucacauuggaggaucugaaaaaugaagagaugguaacuaaccacauggaaggagagcauaagaaacucgccgaggcuauauucaaacuuaccuaucagaauaaaguggucagggugcagcgcccuacgccccgagguaccguuauggacaucauuucccggagagaccagaggggcagcgggcaaguggucacauacggacugaacacuuuuaccaacauggaagcccaguuaauccgccagauggagggcgaagguguguucaagucuauucaacagcugacaguaacugaggagaucgcaguuaagaauugguuggugagagucgggcgggaaaggcucucacguauggcuauuaguggagaugacugcguggugaaaccacuggaugaccgauuugccuccgcucuaaccgcccuuaacgauaugggcaagguccgcaaagacauacagcagugggagcccagcagaggcuggaaugauuggacgcaaguuccuuucugcucucaccauuuucacgaacugaucaugaaggacgggcgggugcucguagugccauguaggaaccaggaugagcugauuggacgcgcaagaaucucgcagggugcgggcuggucauugcgggaaacagccugcuuagggaaaagcuaugcucagauguggucccugauguacuuccacaggcgagaccuccgucuugccgcaaaugcuaucuguagugccgucccgucucauugggugcccaccagcagaacuacaugguccauucacgcaacccaugaguggaugacuaccgaggauaugcugacaguuuggaaccgcguguggauacaagaaaauccuuggauggaggacaagacgccagucgaaucaugggaggaaauccccuaucuaggaaagcgggaggaucaguggugcggcagucugauuggucucaccucuagggccacuugggcgaaaaacauccagacagcuauuaaucaggugcgcagcuugaaggggaacgaggaauacaccgacuacaugccuuccaugaaacgauuucggagggaggaaggagaggccggcguacugugguga

SEQ ID NO: 14963 - RNA, 9876 nt, Artificial Sequence
  derived and/or modified CDS sequence (opt3) from DENV-2__JQ955624__SS-prME
accgccggagugauaauuaugcugauacccacugcuauggcauuccaccucacuacgcgaaacggggaaccucauaugaucgucucaaggcaggaaaagggaaaaucccuucuguuuaagaccgaagacgguguuaauaugugcacguugauggccauggauuuaggcgaacugugugaggacacuauuaccuacaacugcccacuacuccggcaaaaugaaccggaggauaucgacuguuggugcaacucuaccucaaccugggugacuuaugggacauguaccgcgacgggagagcaccgccgagaaaaacguaguguggcucuggugccccaugucggcaugggucuugagacuagaaccgaaacauggaugagcuccgagggggccuggaagcacgcacagaggauugagacuuggauccugcggcauccuggauucgccauaauggcugcaaucuuggccuacaccauuggcacaacccacuuucagcgcgugcucaucuucauucugcugacggcuguugccccaucuaugacuaugagaugcaucggcauaucgaauagggauuuuguggaaggggucucaggagguagcuggguggacauuguacucgagcacggcaguuguguuacaaccauggcgaaaaacaagcccacuuuagauuucgaacugaucaagacagaggcaaaacagccugccacccuucggaaguauugcauugaagcuaaauugacgaauaccacaacugccucccgcuguccaacccaaggggagcccucucugaacgaggaacaggacaagcgauuugugugcaaacauagcauggucgauagaggauggggcaaugguugugggcuauucggaaagggcggcaucgugacaugcgcaauguuuacuugcaagaaaaacauggaggggaagaucgugcagccugaaaaucucgaguacaccauugucguuacaccacacuccggagaagagaacgcuguggguaaugacaccggcaaacaugggaaggagauaaaaguaacuccgcagucaaguaucacggaagccgagcugacaggauauggcaccgugacuauggaauguagccccaggaccggucuugauuucaacgagaugguccuguugcaaauggaaaauaaggcguggcucgugcaccggcagugguuucuggacuuaccucugccauggcuccccggggccgauacacagggcucuaacuggauucagaaagagacccuuguuacuuucaagaacccucacgcaaagaaacaagacguggucgugcugggaucccaggagggcgcuaugcauacagccuugacgggggcuaccgaaauccagaugucaagcggaaaucuacuguuuacuggucaccucaagugccgucugcgcauggacaaacuucaacugaagggcaugaguuacucuauguguacagggaaauucaagguaguuaaggagauagccgaaacccagcauggaacaauuguggucagagugcaguaugagggcgaugguuccccaugcaaaauccccuucgagaucauggacuuggaaaagaggcacguccucgggcggcugauuacugugaacccgaucguuaccgagaaagauagcccugugaauauugaagcagagcccccauuuggcgacucguacauaaucauuggaguagaaccuggccaguuaaagcugucuugguucaaaaagggguccucaaucggacaaauguuugagacgaccaugcgaggugccaagcgcauggcuauccuaggcgauacagcgugggacuucgggagucucggaggcgucuuuacuagcauugguaaagcacugcaucagguguucggggccauauacggcgcugccuuuuccggaguuucuuggaccaugaagauccuuauuggcguggucaucacauggauugggaugaacagcagaucaacaaguuuguccgugagccugguacucgugggaguugucacccuguaucuuggcgugauggugcaggcagauucugguugugucguuucauggaaaaauaaggagcugaaaugcgggaguggaaucuucauaacggacaacgugcacacauggaccgaacaguacaaguuucaacccgagagcccauccaaguuggccucugcuauccagaaagcccacgaagagggcauuugugguaucaggucggugacucggcucgaaaaucugauguggaagcagauuacacccgaguuaaaccauauccugagcgagaaugaaguaaaacuaaccauaaugacuggcgauauuaaggggaucaugcaggcaggaaaacgcucccucagaccucaaccaaccgagcugaaguauucauggaaaacauggggcaaggcgaagaugcuuaguacggaaucucacaaccagaccuucuugauugacgggccggagacuacagaaugccccaauaccaacagggcuuggaauagccuggaggucgaggauuacggauuuggcguguucacaacuaacaucuggcucaaacugaaggaacgucaggacguauuuugugacuccaaauuaaugucagccgcagugaaggauaaucgggccguccaugcugacauggguuauuggauagagagcgcccugaacgauaccuggaaaaucgaaaaggcaucuuucauugaggugaaguccugccacuggccuaaaagucacacgcuuuggagcaacgggguuuuggagucugaaaugaucauuccaaagaauuucgcuggacccgugucccagcauaacuaccgaccuggcuaucacacacaaaccgccgguccauggcaucucggcaaacuggagauggacuuugauuucugugaagggacuaccguagucgugacagaggacugcggaaauagaggccccucacuaaggacuaccacagcgagugggaagcugaucacggaauggugcugucgcagcugcacccucccgccucugcgguacagaggagaggauggcuguugguacgguauggagauaaggccacuuaaagaaaaggaggaaaacuugguaaauucgcuggucacugccgggcacggacagauugacaacuuuuccuuaggcauccucgguauggcucuguuccuugaggaaaugcugcgcacacgaguuggcaccaagcaugcaguguugcucguagccgugucuuuuaugacucugaucacagggaauaugagcuuccgggaucuaggacgugucauggugaugguuggcgcugccaugaccgacgauauugggaugggagugacguaucuggcacuccuggcggccuuuaaagucagacccacuuucgcugccggccuuuugcugaggaaguuaaccucaaaagagcucaugaugacaaccaucgguauugugcugcuuagucaguccacuauaccugagacaauccuggaacuaaccgacgcacucgcucuggggaugaugguuuugaagauugugcgcaacauggagaaauaccaacuggccgucacaaucauggcaauuuuaugcguacccaaugccgugauccuccagaacgcuuggaagguuucuuguacuauacuggcgguggucagcguguccccacuucuguugaccucaagccagcagaaggccgauuggaucccucucgcacugacgauuaaaggacuaaaucccacagcuaucuuucugaccacucuuagucggaccaacaagaaaagaucuuggccacucaaugaagccauuauggccguaggcaugguguccauccuggcuagcucguugcugaagaacgacauaccgaugacaggcccuuuagucgcagggggacuccugacuguuugcuaugugcuuaccgguaggucagccgaccuggaguuggaacgagcggcugaugugcgcugggaggaccaagccgagauuucuggcaguucccccauccucagcaucacgauuucugaagaugggagcauguccaucaagaaugaggaagaggagcagacacugaccauccuaauucggacuggacugcuugucaucucaggccucuucccagugaguauucccaucacagcagccgcuugguaccugugggaaguuaagaaacagagagccgguguuuugugggacgugccuagcccacccccugucgggaaggcagaguuagaagauggagcguauaggauaaagcagaaaggcauccugggcuacucucaaauuggggcuggaguguauaaggaggguaccuuucacacuauguggcacguuacacguggcgccgugcucaugcauaaagggaagcgcaucgaaccguccugggcagacguccggaaagaucugauuucauacggaggcgguuggaaacuugagggggaguggaaggaaggagaggaagugcagguacuggccuuggagccaggcaaaaaccccagagcuguccagaccaagccuggccuauucaaaacgaacacugggaccaucggagccgugagucuggacuuuagcccagguacauccggcucucccauaguugauaagaaagggaagguggucggacucuacggcaauggugugguuaccaggucggggacauaugugagcgcaauugcucagucagaaaaguccaucgaggacaacccugagaucgaagaugacauuuucagaaagaagcggcugacuaucauggaucuucacccgggagccggcaaaaccaagcgcuacuuacccgcgauagucagagaggccauuaaaaggggccugcggacgcucaucuuggcaccaacacgagugguagcugccgaaauggaggaagcucugagagggcucccuauucgcuaucaaacucccgcaaucagggccgagcauaccggacgugagauaguggaccugaugugucacgccacauucaccaugcggcuucugaguccaguuagagucccuaauuacaacuugauuaucauggacgaagcucauuuuacugaucccgcgucuaucgcagccagggguuauauuagcacccgcguggagaugggcgaagcugccgggaucuucaugacagcaacgccaccgggaucccgagacccuuuuccccagucaaaugccccaauuauggaugaggagagagaaauacccgagcggucuuggaacagcggccacgaaugggugacugacuucaaggguaagaccgucugguuuguaccuaguaucaaagcugggaaugauauugcggccugccuaaggaagaacggcaaaaaggugauccagcugucccgcaaaacauucgacagcgaguacaucaagacccguacuaaugauugggacuuuguugugacaaccgauauuucugaaaugggcgcaaacuucaaggcugagagagucauagacccacggagguguaugaaacccgugauccucacggauggcgaggaacgcguuauuuuagccgggccuaugccggugacucacucauccgcagcccaacgaagaggacggaucgguaggaauccaaagaacgagaaugaccaguauauuuacaugggcgaaccccuggagaacgacgaagauugcgcucauuggaaagaggccaagaugcuucuggacaauaucaacacaccugaggggauaauccccaguauguuugaaccagagcgcgaaaaagucgaugcgauugacggagaguacagacucaggggcgaagcacggaagaccuucguggaguugaugcgucgcggugaucugccuguauggcucgccuaucgaguggcugccgaggggaucaacuacgcugacagaaggugguguuuugauggcauuaaaaauaaccagauccuggaagagaauguugaagucgagauauggaccaaggagggagaacggaagaaacuuaagccccgcuggcuagacgcaagaauuuauagcgauccacuggccuugaaagaguucaaggaguucgcugccggcaggaaaucguuaacucugaaccucaucacagagauggggcggcugccuaccuuuaugacacagaaggcacgaaaugcgcuugacaaccuggccgugcuccacacugcugaagccggagguagagcauacaaucaugcuuugucugagcugccggagacgcuagaaacccugcuccuucugacauuauuggccacugugaccggcgggauuuuccuguuucucauguccggaaagggcaucgguaaaaugacacuggggaugugcugcauaaucaccgcaagcauucuucugugguaugcccaaauccagccccacuggauugcugcgucaaucauacucgaguucuuuuugauuguccuguuaaucccagaaccugagaagcagcgcacuccccaggauaaccaacuaacguacguugugaucgccauucugaccguaguggcagcuacaauggccaaugaaaugggcuuccucgagaaaacuaagaaagacuuuggauucggcaguaucgccacccagcagccagagucuaacauacuugauauugaccugaggccugcauccgcuuggacauuguaugccgucgcgaccacuuuuaucacacccaugcugcggcacagcauugaaaauucaagugugaacguuagccucacggcuaucgccaaucaggcaaccgugcugauggggcuuggaaaggguuggccgcucuccaagauggacauaggcgucccacuguuggccaucggguguuacucucaaguaaacccuauuacucugacagcugcauuacuacugcucguggcccauuacgcgaucauuggacccggccuucaggcuaaagccacccgugaggcacagaagagagccgcugccgguaucaugaaaaauccaaccguugaugggauuacagugaucgaccuggaucccauaccuuaugacccgaaguucgaaaaacaguugggccaagucaugcugcucgugcugugcgucacucaggugcuuaugaugaggacgaccugggcauuaugugaggcucugacacucgccacuggacccauuagcaccuugugggaaggcaacccagggcgcuuuuggaauacaaccaucgcgguuuccauggccaacaucuuccggggaucauaccuggcaggcgcuggucuacuguuuucuauuaugaagaacacuacgaauacacgaagagggaccggaaacacuggcgagacccucggugagaaguggaaaaauaggcuuaacagucugggcaagucggaguuccagauauauaaacgcagcgggauccaagagguggaucggacauuggccaaggaaggaauuaaaagaggcgagacugaccaccaugcaguaucccgugggucugcuaagcugaggugguucguggagcggaaucucgucaccccugaaggaaaaguuauggaucugggcugcggucgcgggggauggucauacuauuguggcgguuuaaagaacgugcgagaggucaagggccuuacaaaagggggacccggccacgaagaaccuaucccaaugagcacguacggguggaaucuggugagacuccaguccggaguagacguguuuuucacacccccugaaaagugcgauacucuacugugugacauuggcgagaguucuccaaaccccacaguugaggccgguaggaccuugcgggugcugaaucucgucgaaaacuggcuuaauaacaauacucaguuuugcaucaaagugcugaacccguauaugccuagcgucauagagaagauggaaacauugcagcgcaaauacgggggagcccuggugagaaauccacucucaaggaacuccacccaugagauguacuggguuaguaacgcgagcggcaauaucguaucuuccgugaacaugauuucacgaauguuaaucaaucgguucacgaugcgucacaagaaggcuaccuaugaacccgaugucgaccugggcagcgggacaagaaacauuggaaucgagucggagacuccuaaucuugauauaauugguaaacgcaucgaaaagaucaaacaagagcacgaaaccucuuggcauuacgaccaggaccacccauauaagacaugggcauaccauggcaguuaugagacuaaacagaccggguccgccagcucaauggugaacggaguugugaggcugcuaacaaagcccugggaugucauuccgauggugacccagauggcuaugacugacacgacaccuuuuggccaacagcggguauucaaggaaaaaguggauaccagaacucaggagcccaaggaggguaccaaaaagcucaugaaaauaacagccgaauggcuguggaaggaguuggggaagaaaaagacgccacgcauguguaccagggaagaguuuacucgaaaaguucgguccaaugcagcccugggagcuaucuucacagacgagaacaaguggaaaucugcgagagaagccgucgaggauagcagguuuugggaacucguggacaaggagcgcaaucuucaccuggaaggcaaaugcgagaccuguguguacaacaugaugggcaagcgugagaagaaaaugggggaguucggaaaggcaaaagguagucgggcuauuugguauaugugguuaggcgccagauuucuggaguucgaagcauugggguuucucaaugaggaucacugguucuccagggaaaacagccugucuggagucgagggcgagggucuacauaaacuuggguacauccugcgcgaaguuagcaaaaaggagggaggcgccauguacgcugacgauacugccggcugggacacacgaauuacccucgaagaucugaagaaugaggaaauggugacaaaccacauggagggggagcauaaaaaguuggcggaagcaaucuucaaacugacuuaucagaauaagguagugcggguccaaagaccuacccccaggggaacggugauggacauaaucagucgcagagaccagcgggguuccggccagguugggaccuacggacucaacacauuuacuaacaugggcgcccaacuuauuaggcagauggagggugaagggguguucaaaagcauccagcaccugaccacaacugaggaggucgcugugcaggauugguuagcccguguaggacgagaacgccugucuagaauggcaauuucgggcgacgauugcguugugaagccauuggacgaucgguuugcuucagcccucaccgcucugaaugacaugggcaaggucaggaaagauauccaacagugggagcccagccgcggguggaacgacuggacacaggugccuuucugcucccaucacuuucacgaacuaauuaugaaggauggaagagugcuugucguuccaugucggaaucaggacgagcugauagguagggcccgaaucagucaaggcgcaggguggucucuccgugaaacagcgugccugggaaaaagcuaugcccagaugugguccuugauguacuuccauagacgcgauuuacggcuggcugccaacgcaauuuguucagcugugccgagucacuggguacccaccucuaggacuacauggagcauccaugccagacacgaguggaugaccacugaggacaugcucaccguguggaaucgcgucuggauccaggaaaacccuuggauggaggauaagacaccaguggaauccugggaggaaauucccuaucuuggcaaacgggaggaccaguggugcgguucacugauagggcuaacgagcagggcaaccugggccaagaauauccaaacugcgauuaaccagguucgaucucugaucggauccgaggaauacacagacuauaugccuaguaugaagagauuucggagggaggaagaggaagcuggcgugcucugguga

SEQ ID NO: 14964 - RNA, 9876 nt, Artificial Sequence
  derived and/or modified CDS sequence (opt3) from DENV-2__KJ918750__SS-prME
accgccggaaugaucauuaugcugauaccaacagugauggcuuuccaccucacuacgagaaacggggagccucauaugaucgucagcagacaggaaaagggaaaaucccuucuguuuaagaccaaagacgguacaaauaugugcacuuugauggcaauggauuuaggcgagcugugugaagacaccauuacauacaagugcccauuccuucggcaaaacgagccggaagauaucgacuguuggugcaauucuaccucaacuuggguuacauaugggaccuguacgacuaccggagagcaccgccgagagaaacguaguguggcccucguaccccaugugggcaugggucuggaaacaagaacugagaccuggaugagcuccgaaggggcguggaagcacgcucagaggauugagaucuggauacuucggcauccuggauuuacaaucauggccgcaauucuggccuacaccaucggcacgacucacuuccagcgcgucuugauuuuuauccuccugacagcuauagcaccaucuaugaccaugagaugcauuggcaucucgaacagggauuucguggaggggguuucaggagguagcuggguggacauuguccuggaacacggcaguugugugacuacaauggccaagaauaaacccacccucgauuuugaguuaaucaagacggaagcuaaacagccugccacccugcggaaguauugcaucgaggcgaaacuuacaaacacuaccacagacucccgcuguccaacucaaggggaacccaccuugaaugaggagcaggauaagcgauucguaugcaagcauucuaugguugacagaggauggggcaacgguugugggcuguuuggaaaaggcggcauugugacaugcgcaauguucacaugcaagaaaauaaugaaggggaaaaucguccagccugaaaaucuagaguacacuguggugauuacgccacacagcggagaggaacaugccgucgguaacgauacaggcaagcacgggaaagaaguuaagaucaccccgcaguccucaauaacugaggcugagcucaccggauauggcacagugaccauggaauguagucccaggacuggucuggacuuuaaugagaugguacuucugcaaauggaagauaaggccugguuggugcaccggcagugguuccucgaccugccuuuaccauggcugcccggggcagacacacagggcagcaacuggauucagaaagagacgcucgucaccuuuaagaauccucaugcuaaaaagcaagaugugguugugcuuggaucucaggaaggcgccaugcacacugcgcugacaggggccaccgagauccagauguccucaggaaacuugcuauucacaggucaucugaaaugccgucuccgcauggacaagcugcaacuuaagggcaugagcuacaguauguguacugggaaauucaaggucgugaaagagaucgcagaaacccagcacggaacgauuguaaucagaguucaguaugagggcgaugguucuccaugcaagauucccuuugaaauaauggaccuggagaaaaggcauguguuggggcggcucaucaccgucaauccgauugugacagagaaggauuccccugucaacaucgaagcugagcccccauucggcgacagcuacaucauuauaggaguggaaccuggccagcugaaguuaaacugguuuaaaaaggggucgucuaucggacaaaugcuggagacuaccaugcgaggugccaaacgcauggcuauucuaggcgauacagccugggacuucgggucccucggaggcguuuuuacuucaaucgguaaggcacugcaccagguguucggggccauuuacggcgcugcguuuaguggaguaagcuggaccaugaaaauccuuacgggcgucauaaucacauggauugggaugaacuccagaucuaccagcuugucagugagucugguucucgugggaaucgucacucuguaucuuggcgugaugguacaggcagauuccgguugugugguuagcuggaagaacaaggaacugaaaugcgggucuggaauuuucgucacagacaaugugcacaccuggacugagcaguacaaguuucaacccgagucaccaaguaaauuggccagcgcuauccagaaggcccaugaagagggcauaugugguauuagguccgugacccggcucgaaaaccugauguggaaacagaucacacccgaguuaaaucacauucugucugaaaacgaggucaagcuaacgaucaugaccggcgauauaaaagggaucaugcagguuggaaagcgcucgcucagaccucaaccaacugagcugagguauagcuggaagacauggggcaaagcaaagaugcuuuccaccgaauugcauaaucagacauuccugauugacgggccggagacugccgaaugccccaacaccaaucgugcuuggaacucacucgagguggaagacuacggauuuggcguguucacgacaaauaucuggcugcgguuacgagagaaacaggauguauuuugugacaguaagcugaugucugccgcaauuaaagauaacagagcgguccacgcugacauggguuauuggaucgagagcgcccuuaaugauaccuggaagauagaaaaggcauccuucauugaggugaaaucaugccacuggccuaagagccauacuuuguggucugacgggguucucgaauccgagauggugauccccaagaauuucgccggacccgucagucagcacaauaacaggccuggcuaccauacccaaacagcugguccauggcaccugggcaagcuagagauggauuuugacuucugugaagggacuaccgugguugugacagaggauugcggaaaccgcggccccagccugcggacgaccacugccucugggaaacucaucacagaauggugcuguagauccugcacccugccgccucuuagguaucgcggagaggacggcuguugguacgguauggaaauucgaccauugaaggagaaggaggaaaaucugguaucaaguuuagucacugcagggcauggacagaucgauaacuuuagccucggcauucuggguauggcucuuuuccuggaggaaauguugcggacacgugugggcaccaaacacgccauacuccugguggcggucucguuuguuacgcuaaucacugggaauauguccuucagagaccugggaagggugaugguaauggugggcgccaccaugacagaugacauugggaugggagucaccuaccucgcucugcuugcagccuuuaaggugcgccccacuuucgcugccggcuugcuguuacggaaacucacaucuaaggagcugaugaugaccacaaucgguauuguucuucugagccagucaaguaucccugaaacuauacuagagcucaccgacgcacuggcguuggggaugauggugcugaaaauggucagaaacauggagaaguaucaauuagccgugacgaucauggcuauucucugcguucccaaugccgugauccugcagaacgcauggaaggucuccuguacaauucuugcucugguaucugugagcccauuguuucucaccuccucacagcagaaagccgauuggaucccucuggcacuaacuauaaagggacugaaucccaccgccauuuuccuuacaacucucagcaggaccaguaaaaagcgaucuuggccacugaacgaagcuaucauggcgguuggcaugguguccaucuuggccagcucgcugcuaaagaaugacauuccgaugacgggcccucucgucgcagggggacugcuuacagugugcuacguacugaccggucgcucagcugauuuggagcucgaacgggccgccgacgugaagugggaugaccaagcugagauaucuggcaguucccccauccugagcauuacuaucucugaagaugggagcauguccauuaaaaacgaggaggaagaacagacacuaaccauccugauaagaacuggacuucucgucaucucaggccuguuuccaguuaguauucccaucacagcagccgcgugguauuugugggaagugaagaagcagagggcugguguguuaugggacgucccuagcccacccccuguggggaaagccgagcuggaggauggagcauaccguauuaagcagaaaggcauccucggcuauucucaaauaggggccggaguuuacaaggaagguaccuuccacacgauguggcauguaacucgcggcgcugugcugaugcacaaagggaagcggauugagccguccugggcagacgucaagaaagaucuuaucucauauggaggcgguuggaagcuggaaggggaguggaaagaaggagaggaggugcagguuuuggcccuagaaccaggcaagaaucccagagcggugcagaccaaaccuggccuguuuaagacaaacaccgggacaaucggagcugucagucucgacuucagcccagguacuuccggcucucccauuguggauaagaaagggaagguagucggacuguacggcaauggugugguuaccaggucgggggccuacgugagcgcaaucgcccagacggagaaaucaauagaagacaacccugagauugaagacgauaucuuccgaaagcggcgccuuacaauuauggacuuacauccgggagcuggcaaaacuaagagauaucugcccgccaucgucagggaggcaauaaagcggggccuccgaaccuugauucuggcuccaacaagagugguugccgcggagauggaagaggcccuccgcgggcugccuaucagguaccaaacccccgcaauccgugcugaacacacuggacgggagauuguggaucuuaugugucaugccaccuuuacaaugagacuguuguccccaaucagggucccuaauuauaaccuaauuauaauggacgaagcucacuucacggaucccgcaaguaucgccgcccgcgguuacauuucuacucgaguggagaugggcgaggcugcggggaucuuuaugaccgcaacaccaccgggaagcagagacccuuucccccaguccaacgccccaaucauggaugaagaacgggaaauucccgagaggucauggaacucuggccacgaguggguaaccgacuuuaaagguaagacugugugguucguuccuagcauaaaaacagggaacgauaucgcugccugccugcgcaagaauggaaaacgugucauucagcucaguagaaagaccuuugacuccgaauaugugaagacgcggacuaacgauugggacuucguggucacaaccgacaucagcgagaugggcgcaaauuuuaaagccgaaaggguaauugauccacgccgauguaugaagcccgugaucuuaaccgacggcgaggaaagaguuauacuggcugggccuaugccggugacucauucuucagcggcccaacggaggggacgcaucgguagaaaccccaaaaaugagaacgaucaguacauuuauaugggcgagccccuugaaaaugacgaggauugcgcacacuggaaggaagcuaaaaugcugcucgacaacaucaauacaccugaggggauuauccccuccauguucgaaccagagagggagaaggucgaugccauagacggagaauaccgguugcguggcgaggcacgcaaaaccuuuguggaucugaugcgaagaggugaccucccuguuuggcuggccuacaagguggcugccgaagggauuaacuaugcggauaggcggugguguuucgacggcacacgcaauaaccagauccuugaggaaaaugucgagguggagauuuggacuaaggaaggagagaggaaaaagcuaaaacccagguggcuggaugcacggaucuacagugacccauuggccuuaaaggaguucaaagaguuugcugccggccgaaagagccugacgcucaaccugauaaccgagauggggagacuuccuacauucaugacucagaaggcucgcgacgcacuggauaaccucgccguauugcauaccgcugaagccggagguaaagcauauaaucacgcgcugucggagcuaccggaaacacuggagacccuccuucuguuaacuuugcuggccacggugaccggcgggaucuuucucuuccugaugucuggaaggggcauugguaagaugacacuugggaugugcugcaucauuacugcuuccauccugcucuggugugcccaaauacagccccacuggauugcagcuagcaucaucuuggaauuuuuccugauuguuuuacuaaucccagagccugagaaacagcggaccccacaggacaaccaacugacauacgucauaauugccauccucaccgugguggcagccacuauggcuaaugaaaugggcuuucuugagaagaccaaaaaggaucugggauugggcaacauugucacgcagcagccagaaucaaauauccuggacauagaucuccguccugcgagugccuggacccuguaugcaguugcuacuacauucaucacccccaugcuuagacauucuauugagaacuccagcgugaauaugucacucaccgccaucgccaaccaggcaacaguacugaugggguugggaaaggguuggccgcugaguaaaauggacauuggcgugccauuacuagcuaucgggugcuguagccaagucaauccuauuacucugacggccgcgcucuuucuucugguggcucacuacgccaucauaggacccggcuugcaggcaaaggccaccagggaagcucagaaacgcgcagccgcggguauuaugaagaacccaacaguugaugggaucacugugaucgaccuggaucccauuccuuaugacccgaaauucgagaagcagcucggccaagucaugcugcuuguauuaugcgugacccagguucugauaaugcggacaaccugggcucucugugaggccuugacucuggcaacgggacccguguccacacuaugggaaggcaauccagggcgauuuuggaacaccacuaucgccgucucuauggcuaauauuuucagaggaagcuaccuggccggcgcaggucuccuauuuugcaucaugaacaauaccacaaggcugcgccgggggacuggacauuugagaaagacccugggcgauaaauguaagucccgucucaacacacuggguaaaucagaguuccagauuuacaagaaaucuggcauccaagaaguggacaggacguuagcuaaggaggggauaaaacggggagaaaccgaucaccaugccgucagucgcggcucggcgaaacuucgaugguucguggagagaaaucugguuacuccugaggggaaggugguagaccucggaugcggcagggguggguggagcuauuacuguggaggccugaaaaaugugcgggaagucaaggguuuaacaaaaggcgggcccggacacgaggaaccuaucccaauguccaccuauggcuggaacuugguucgccugcagucugggguggacgucuuuuucauucccccugagaagugcgauacucuccuuugugacaucggagagucaagcccaaaucccacaguggaagccggcagaacccugaggguauugaaccugguggagaauuggcucaacaauaacacgcaguuuugcauuaaaguuuuaaauccguacaugccuuccgugaucgaaaagauggagacccugcagcgaaaguaugguggggcacuuguccggaacccacugagucguaauucuacacacgaaauguacugggugagcaacgcuucaggaaauauagucuccagugugaacaugauuagcagaaugcuaaucaaucgcuucacuaugaggcauaaaaaggccaccuaugagcccgauguugaccucggcucuggcacacggaacaucgggauugaguccgaaacuccuaaucuggauauaaucggaaaaagaauugagaagaucaaacaagaacacgagaccucauggcauuacgaccaggaucacccauacaagacaugggcauaucacgguagcuacgaaaccaagcagacuggcucggcuucuaguaugguaaacggggugguccgcuugcugacgaaacccugggacgugguuccgauggugacacagauggccaugaccgauacuaccccuuuuggacaacagagggucuucaaggagaaaguggacacacgaacgcaggagcccaaggaaggcaccaaaaagcucaugaagauuacugccgaguggcuuuggaaagaacuggguaagaaaaagacaccacggaugugcaccagagaggaauuuacuaaaaagguaagguccaacgcggcuuuaggggcaaucuucacagaugagaauaaauggaaaagcgcccgcgaggcuguggaagacggacguuuuugggagcugguugacaaggaacggaacuugcaucucgagggcaaaugugagaccugcgucuauaauaugaugggcaagagagagaaaaagcugggggaguucggaaaagccaaggguucaagggcaauaugguacauguggcuaggcgcccgcuuucuugaguucgaggcucugggguuucucaacgaagaucacugguucucccgagaaaauucucugagcggaguggagggcgaagguuugcauaagcugggguauauccuccgggaggugaguaaaaaggaaggaggcgcgauguacgccgacgauacagcaggcugggacacuagaauuaccaucgaggaucuuaaaaacgaagagaugauuacgaaucacauggcuggggagcauaagaaacuggccgaagcaaucuucaaguuaaccuaucagaacaaggucguuagggugcaacgcccuacacccagaggaacuguaauggacauuauaucccggagggaucagcgugguagcggccagguggggaccuacggacugaauacauuuacuaacauggaggcccaauugauccgacagauggaaggcgaggguauuuucaaaucuauccagcaccucaccgcuacggaagagaucgccguccaggacuggcuggcgcgcguggggagagagcggcuaucaaggauggcaauuaguggagaugacuguguugugaagccacuugaugaccgcuuugccagagcucugacagcccucaaugauaugggcaaaguccggaaggacauacaacagugggaacccuccaggggcuggaacgacuggacccaggugccuuucugcagccaccauuuucacgagcugaucaugaaagaugggcgaacuuugguaguuccaugucguaaucaggacgaauuaauuggcagagcacgcaucucucaaggugcuggcuggucgcugcgggagacagccugccucgggaagucauacgcucagauguggagccuuauguauuuccauaggagagaucugcgccuagccgcaaacgcgauuuguuccgccgugccgagucacuggguccccaccucucggacuaccuggagcauccacgcuucccaugaguggaugacaacggaagacaugcugaccguguggaauaggguguggauacaggagaacccuuggauggaagauaagacuccagucgagucaugggaagagauccccuaccucggaaaacgagaggaccaguggugcggcaguuugauuggucugacaucuagagccaccugggcaaagaacauccaaacugcuauuaaucagguucggagccuuaucgggaacgaagaguauacagauuacaugccuuccaugaaaagguuucgccgugaagaggaagaggccggagugcugugguga

SEQ ID NO: 14965 - RNA, 9876 nt, Artificial Sequence
  derived and/or modified CDS sequence (opt3) from DENV-2__KU517845__SS-prME
accgcaggaaucauuauaaugaugauccccacagugauugcuuuccaccugacuacgagaaacggggagccucauaugaucgucagcaggcaggaaaagggaaaaucccuccuuuuuaagaccgagaaugguguuaacaugugcacacugauggcaauggacuugggcgaauuaugugaggauacuauuaccuacaauugcccacugcugcggcaaaacgaaccggaggacaucgauuguuggugcaauucuacaucagccugggugaccuaugggacuuguacagcgaccggagagcaccgccgagaaaaacguaguguagcucucgugccccaugucggcaugggucuggagacgcggacugaaaccuggaugagcuccgagggggccuggaagcacgcacagaggauagagacaugggugcuucggcauccuggauucacuaucauggccgcuauucuggcauacaccaucggcacaaccuauuuucagcgcguuuugauuuucauccuccugacggccgugacuccaucuaugacaaugagaugcauaggcauuucgaacagggacuuugucgaaggggugucaggagguagcuggguagauaucguucuggagcacggcaguugugugaccacuauggcuaaaaauaagcccacacucgacuucgaauuaauuaagaccgaggccaaacacccugcgacgcugcggaaguacugcaucgaagcaaaacuuaccaacacaacuaccgccucccgcuguccaacacagggggagcccucuuugaaugaggaacaagauaagcgauuugucugcaaacauagcaugguggacagaggauggggcaacgguugugggcuguucggaaagggcggcaucgugacuugcgcuauguuuaccugcaagaaaaauauggaggggaagauuguccagccugaaaaccuagaguauacaauaguuaucaccccacacuccggagaagagaaugccguggguaacgauacuggcaaacaugggaaggagauuaaaguaacgccgcagucaaguaucacagaagcagagcucaccggauacggcacugugaccauggaauguagccccaggacaggucuggacuucaaugagaugguccuucugcagauggaaaacaaggcuugguuggugcaccggcaaugguuucucgaucugccuuuaccauggcugcccggggccgacacccagggcucuaacuggauacagaaagagacucucguuacauucaagaauccucacgcgaagaaacaggauguggucgugcuuggaucccaagagggcgccaugcauacggcacugaccggggcuacugaaauucagaugucaagcggaaacuugcuauuuacaggucaccugaagugccgucuccgcauggacaaacugcagcuuaagggcaugaguuauucuauguguaccgggaaauucaagguaguuaaggagaucgccgaaacacaacauggaacuaucgugauuagaguccaguacgagggcgacgguuccccaugcaaaauccccuucgagauuauggaucuggaaaagaggcacguguuggggcggcucauaaccgucaauccgaucgugacggagaaagacagcccuguuaacauugaagcugagcccccauuuggcgauucguacaucaucauuggaguggaaccuggccagcugaaguuaucuugguucaaaaagggguccucaauaggacagauguuugagaccacaaugcgaggugccaagcgcauggcaauccugggcgacacugccugggauuucgggagucuaggaggcguauuuaccagcauugguaaagcucuccaucaagucuucggggcgaucuauggcgcagccuuuuccggagugucuuggacaaugaagauucugaucggcguugugauaacuuggaucgggaugaauagcagaucaaccagucuuuccgucagcuuggugcugguaggagugguuacgcucuaccugggcgucauggugcaggcugacucugguuguguggucucauggaaaaacaaggagcuuaaaugcgggaguggaauuuucaucacagauaauguucacaccuggacugaacaguauaaguuucagcccgagagcccauccaagcuggccucugcaauucaaaaagcccacgaagagggcaucugugguauaaggucggugacacgguuggaaaaccucauguggaagcagauuacccccgagcugaaucauaucuuaagcgagaacgaagugaaacugacuauuauggcuggcgacaucaaggggauaaugcaggccggaaaacgcucccuaagaccucagccaaccgagcucaaguacucauggaaagcauggggcaaggcgaagaugcugaguacagaacuucacaaucauacguucuugaucgaugggccggagaccgcugaaugccccaacacuaauagggccuggaacucucuggagguagaggacuauggauuuggcgucuucacaaccaauauuuggcucaaacugaaggaacgucaagaugcauuuugugacagcaaauuaauguccgccgcuaucaaggacaaccgggccauucacgcagauauggguuacuggaucgagucagcucugaacgacacauggaaaauagaaaaggccagcuucauugaggugaagucuugccacuggccuaaaucccauacucuuuggaguaaugggguuuuggagagcgaaaugaucaucccaaagaacuucgcgggacccgugucucagcacaauuaucgaccuggcuaccauacccagacggccgguccauggcaccucggcagacuggagauggauuuugacuucugugaagggacaaccgucgugguuacugaggauugcggaaacaggggccccucccuacgcaccacaacugcuucagggaaacugauuaccgaauggugcugucggaguugcacacucccgccucugagauacaggggagaggacggcuguugguaugguauggagauccgcccacuuaaggaaaaagaggaaaauuuggugaacagccugguaacggcagggcauggacagauugauaauuuuucguuaggcguccucgguauggcccuguuccuugaggaaaugcugcgaacccgggugggcacuaagcacgcuauauugcucguggccgucuccuuuguuacacugaucaccgggaacaugucuuuccgugaccuaggaagagugaugguaauggugggcgcaacuaugacagaugacauugggaugggagucaccuaccuggcgcuccuggccgcuuuuaaggugaggcccacguucgccgcaggccuuuugcugcgcaaauuaacuagcaaggagcucaugaugaccacaaucgguauuguucugcuuucacaaaguaccaucccugagacuauacuggaacuaacagaugcucucgcccuggggaugaugguguugaaaaucguccggaauauggagaaguaucagcuggcagugaccauuauggccaucuuaugcguucccaacgcugugauucuccagaaugcguggaaagucuccuguacaacucuggccguagugucuguuagcccacuucuguugaccuccucacaacagaaggcagacuggaucccucucgugcugacgauaaagggacuaaaccccacagcuauuuuucugaccacucuuagcagaaccaguaaaaagaggucuuggccacucaaugaagccaucauggccgucggcaugguguccauccuggcuagcucguugcugaaaaacgauauuccgaugacaggcccuuuaguagcagggggacuccugacugugugcuacguccuuaccggucgaucagccgaccuggaguuggaacgcgcggcugacguucggugggaggagcaggccgaaauaucuggcaguucccccauccucagcauuacggugucugaggaugggagcauguccaucaagaaugaagaggaggaacagacacugaccauucuaaucagaacuggacugcuugugauaucaggccucuucccagucaguauccccauuacagcagccgcuugguaucugugggaggugaaaaagcaaagggccgguguuuugugggacguaccuagcccacccccuguggggaaagccgaauuagaggauggagcguaccguaucaagcagaagggcauucugggcuauucucagaucggggcuggagucuacaaagaagguaccuuucacacuauguggcaugugacacgcggcgccguucucaugcacaaggggaaacggauagagccguccugggcagacgugaagaaagaucugauuucauacggaggcgguuggaaacuugagggggaauggaaggagggagaagagguccaggugcuggccuuggaaccaggcaaaaaccccagagcuguacaaaccaagccuggccuauucaaaacgaacacugggaccaucggagccgucagucuggacuuuagcccagguacauccggcucucccaucguggauaagaaagggaagguugugggacucuauggcaauggugucgugaccaggucggggacauacguuagcgcaauugcucagacugagaagucaaucgaggacaacccugaaauagaggaugacauuuucagaaagaaacggcugaccaucauggaucuucauccgggagccggcaaaacgaagcgcuauuuacccgcgauugugagagaagccaucaaaaggggccugcggacacucauauuggcaccaacucgagucguggcugccgagauggaagaggcucugagagggcucccuauucgcuaccagacccccgcaaucagggccgagcacacaggacgugaaaucguagaccugaugugucaugccaccuucacuaugcggcuucuguccccaauuagagugccuaauuauaacuugaucauuauggaugaggcucacuuuaccgaccccgcgaguauagcagccagggguuacaucucuacacgcguugaaaugggcgaggcugccgggauuuucaugacggcaacuccaccgggaagccgagacccuuuuccccaguccaaugccccaaucauggaugaggaaagagagauccccgaacggucauggaacucuggccacgagugggucaccgacuucaaggguaagacagugugguuugugccuagcauuaaagcugggaaugauauagcggccugccuaaggaagaacggcaaaaaggucauccaacugagucgcaaaaccuucgacuccgaauauauuaagacucguacaaaugauugggacuuuguagugaccacggauaucagcgagaugggcgcaaacuucaaggcugagagaguuauugacccacggagguguaugaaacccgugauccucacugauggcgaagaacgcgucauauuagccgggccuaugccggugacacauucuucagcagcccagcgaagaggacggguugguaggaauccaaagaacgaaaaugaccaguacaucuacaugggcgagccccuggaaaacgaugaggacugcgcucacuggaaagaggccaagaugcuucuggacaauauuaacaccccugaagggaucauucccuccauguuugagccagaacgcgagaaaguggaugcgaucgacggagaauauagacucaggggcgaggcacggaagaccuucgucgauuugaugcgucgcggugaccugccuguguggcucgccuaccgaguagcugccgaggggauaaacuaugcugauagaaggugguguuuugacggcgugaaaaauaaccaaauucuggaagagaauguugaagucgagaucuggacuaaggagggagaacggaagaaacuuaagccccgcuggcuagaugcaagaauuuacagugacccacuggccuugaaagaguucaaggaguucgcugccggcaggaagucguuaacacugaaccucaucaccgagauggggcggcugccuacauuuaugacucagaaggcacgaaaugcgcuugauaaccuggccgugcuccauacggcugaagccggagguagagcauauaaucacgcuuugagcgagcugccggagacccuagaaacacugcuccuucugacuuuauuggccaccgugacaggcgggauauuccuguuucucaugucuggaaagggcaucgguaaaaugacccuggggaugugcugcauuaucacugcauccauucuucugugguacgcccagauccagccccacuggauagcugcgagcauuauccucgaguucuuuuugaucguccuguuaauuccagaaccugagaagcaacgcacgccccaggacaaccagcuaaccuauguugugaucgccauacugacaguaguggcagcuacuauggccaaugaaaugggcuuccucgagaaaaccaagaaagauuuuggacuuggcucaauugccaaccagcaaccagagaguaauauccuggacauugauuugaggccugcaucugcuuggacacuguacgccgucgcgaccacuuucaucacacccaugcuccggcauuccauagaaaacagcucagugaauguuagucugacggcuaucgccaaccaggcaaccgugcuuauggggcucggaaaggguuggccgcugagcaagauggacauuggcgucccauugcuggccaucggguguuacucccagguaaauccuauuacuuuaacagcugcacuacugcuccuuguggcccacuaugcgaucauuggacccggccugcaggcuaaagccacccgugaggcacaaaagagagccgcugccgguaucaugaaaaacccaaccguugacgggauaacagugauugauuuggaccccaucccuuacgauccgaaguuugaaaaacagcugggccaggucaugcuccuggugcuuugcgucacucagguguuaaugaugaggacgaccugggcacugugugaggcucucacauuggccacuggacccaucucuacccugugggaaggcaauccagggcgcuucuggaacacaaccauugcgguuagcauggccaacauauuucggggauccuaucuagcaggcgcuggucuacucuucucaaucaugaagaauacugccaacacgcgaagagggacaggaaauaccggcgagacucuuggugagaaguggaaaaacaggcugaaugcauugggcaagucugaauuucaaauuuacaaaaagagugggauccaggagguggaccgcacccuggcuaaagaaggaauuaagcggggcgagacagaucaucacgccguaucgagagggagcgccaaacuccguugguucguggagaggaaccuggucacuccugaaggaaagguuguggacuuaggcugcgguagagggggaugguccuauuacuguggcggucuuaagaaugucaaagaggugaagggccugaccaaagggggacccggccaugaggaaccuaucccaaugucuacauauggguggaaccucguacgccuacagucaggaguggauguuuucuuuacgcccccugaaaagugcgacacccuguugugugauauaggcgagagcuccccaaaucccacuguggaggcgggucgaacacugagaguccucaaccuuguggaaaauuggcugaacaauaacacccaauucugcaucaaagucuugaauccguacaugccuagugugauugagaagauggaagcucugcagaggaaguacgggggagcacucguucggaacccauuaucucgcaacagcacucacgagauguauuggguaucaaaugccuccggcaacaucgugaguagcgucaauaugauuucuagaaugcugaucaacagguuuacaaugcgacacaaaaaggcuaccuacgaacccgacguggaucuuggcuccgggacgcggaauauaggaauugagucagagaccccuaaccuggacaucaucgguaaacguauugaaaagauaaaacaggagcaugaaacaagcuggcacuaugaucaggaccauccauacaagacuugggccuaucacggcucguacgagaccaagcaaacagggucugcaaguuccaugguuaauggaguggucagacuacucacuaaacccugggacgugaucccgaugguaacccagauggccaugacagauaccacuccuuucggccagcagcgcguguuuaaggaaaaaguugacacgaggacacaagagcccaaggaggguaccaaaaagauuaugaagaucacugcugaauggcuguggaaagaguuggggaagaaaaagaccccacggauguguacaagagaagaguucacgcgcaaagucaggagcaacgcggcccugggagcaauuuuuaccgaugagaauaaguggaaaucagcucgagaagccguggaggacuccggcuucugggaacucguggauaaggagcggaaccuucaccuggaaggcaagugcgagacuugugucuauaauaugauggggaaaagagagaagaaauuaggagaauuugguaaggcaaaaggcucuagggccaucugguacauguggcugggggcucgcuucuuggaguuugaagcccucggauuccugaacgaggaccauugguuuagccgugaaaauagucuauccggcguugagggugaggggcuucacaagcugggauacauacuccgggaugugagcaagaaagaaggcggcgcgauguaugcagacgauacagccgggugggacaccagaaucacucuggaggauuugaagaacgaagagaugguaacaucucauaugaaaggagaacacaggaagcuggcugaggccauuuucaaacucaccuaccagaauaaggugguccgcgugcagcgaccuacaccccgggguacuguuauggacaucauuucaagaagggaccagcgcggcagugggcaaguggucaccuauggacuuaacacguucaccaacauggaggcacagcugaucagacagauggaaggcgaggguguguuuaaguccauucaacaguuaacaguaacugaagagauagcuguuaaaaauuggcuggugcgggucgggagggagcguuugagccgaauggccaucucuggagaugacugcguggugaagccacucgaugaccgcuucgcuucggcccugaccgcacuaaacgauaugggcaaagucagaaaggacauucagcagugggaacccucacggggcuggaaugauuggacacaaguuccuuuuugcagccaucacuuccacgagcuuaucaugaaagacgggagggugcugguagugccaugucgcaaccaggaugaacucaucggacgagcgcggauuucccagggugccggcuggagucugagggagacugcuugcuuggggaagucuuacgcccagauguggagcuuaauguauuuucaucgacgugaccugagacucgcagcuaaugccauauguuccgcagucccgucacacugggugcccaccagucgcacgacauggucuauccaugccacccacgaauggaugacuacagaggauaugcuuaccguuuggaaccggguguggauucaagagaauccuuggauggaagacaagacuccagucgagagcugggaagagauccccuaccugggaaaaagggaagaucaguggugcggcucccuaauuggucugaccucaagagcgacaugggcuaagaacauccagacggccauaaaucaggugcgcagccucaucgggaacgaggaguauaccgacuacaugccuucuaugaaacgguucaggcgagaagaggaagaggcaggaguauugugguga

SEQ ID NO: 14966 - RNA, 9876 nt, Artificial Sequence
  derived and/or modified CDS sequence (opt3) from DENV-2__KU517847__SS-prME
accgccggcaucauuauaaugaugauccccacagugauggcuuuccaccugacuacgagaaacggggagccucauaugauugucagcaggcaggaaaagggaaaaucccuccuuuuuaagaccgagaaugguguuaacaugugcacacugauggcaauggacuugggcgaauuaugugaggauacuaucaccuacaauugcccacugcuacggcaaaacgaaccggaggacauugauuguuggugcaauucuacaucaaccugggugacuuaugggacauguaccgccacgggagagcaccgccgagaaaaacguaguguagcgcucgugccccaugucggcaugggucuggagacuagaaccgaaacauggaugagcuccgagggggcuuggaagcacgcccagaggaucgagacuugggugcuucggcauccuggauucaccauaauggcagccauccuggcuuacacaauuggcaccacguauuuucagcgcguuuugaucuucauucuccugacugcaguggccccaucuaugacaaugagaugcaucggcauaucgaacagggacuuugucgaaggggugucaggagguagcuggguagauauuguucuggagcacggcaguugugugaccacuauggcuaaaaauaagcccacacucgacuucgaauuaaucaagaccgaggccaaacacccugcgacgcugcggaaguacugcauugaagcaaaacuuaccaacacaacuaccgccucccgcuguccaacacagggggagcccucuuugaaugaggaacaagauaagcgauuugucugcaaacauagcaugguggacagaggauggggcaacgguugugggcuguucggaaagggcggcaucgugacuugcgcuauguuuaccugcaagaaaaauauggaggggaagaucguccagccugaaaaccuagaguauacaauuguuauaaccccacacuccggagaagagaaugccguggguaacgauacuggcaaacaugggaaggagaucaaaguaacgccgcagucaaguauuacagaagcagagcucaccggauacggcacugugaccauggaauguagccccaggacaggucuggacuucaaugagaugguccuucugcagauggaaaacaaggcuugguuggugcaccggcaaugguuucucgaucugccuuuaccauggcugcccggggccgacacccagggcucuaacuggauccagaaagagacucucguuacauucaagaauccucacgcgaagaaacaggauguggucgugcuuggaucccaagagggcgccaugcauacggcacugaccggggcuacugaaauacagaugucaagcggaaacuugcuauuuacaggucaccugaagugccgucuccgcauggacaaacugcagcuuaagggcaugaguuauucuauguguaccgggaaauucaagguaguuaaggagauugccgaaacacaacauggaacuaucgugaucagaguccaguacgagggcgacgguuccccaugcaaaauucccuucgagaucauggaucuggaaaagaggcacguguuggggcggcucauuaccgucaauccgauagugacggagaaagacagcccuguuaacaucgaagcugagcccccauuuggcgauucguacauuaucaucggaguggaaccuggccagcugaaguuaucuugguucaaaaagggguccucaauuggacagauguuugagaccacaaugcgaggugccaagcgcauggcaauacugggcgacacugccugggauuucgggagucuaggaggcguauuuaccagcaucgguaaagcucuccaucaagucuucggggcgauuuauggcgcagccuuuuccggagugucuuggacaaugaagauccugauuggcguugugaucacuuggauagggaugaauagcagaucaaccagucuuuccgucagcuuggugcugguaggagugguuacgcucuaccugggcgucauggugcaggcugacucugguuguguggucucauggaaaaacaaggagcuuaaaugcgggaguggaaucuucauuacagauaauguucacaccuggacugaacaguauaaguuucagcccgagagcccauccaagcuggccucugcaauccaaaaagcccacgaagagggcauuugugguaucaggucggugacacgguuggaaaaccucauguggaagcagauaacccccgagcugaaucauauuuuaacugagaacgaagugaaacugaccaucaugacaggcgacauuaaggggaucaugcaggcuggaaaacgcagccuaagaccucagccaacggagcucaaguacuccuggaaagccuggggcaaggcaaagguacugucaaccgaacuucacaaucauacuuucuugauagaugggccggagacagcggaaugccccaacaccaauagggcuuggaacagucuggaggucgaggacuauggauuuggcguguucacaacuaauaucuggcucaaacugaaggaacgucaagauguuucuugugacagcaaauuaauguccgccgcaauuaaggacaaccgggccgugcacgcugauauggguuacuggaucgagucagcccugaacgacaccuggaaaauugaaaaggcaagcuuuaucgaggucaagucuugccacuggccuaaaucccauacgcuuuggaguaaugggguguuggagagcgaaaugauaauuccaaagaacuucgcuggacccguuucucagcacaauuaucgaccuggcuaccauacacagaccgccgguccauggcaccucggcagacuggagauggauuucgacuuuugugaagggacuaccgugguagucacagagaacugcggaaauaggggccccucccuacgcacuaccacagcgucagggaaacugaucacggaauggugcugucggaguugcacccucccgccucugagauacaggggagaggauggcuguugguaugguauggagauccgcccacuuaaggaaaaagaggaaaacuuggugaauagccuggugacugccgggcauggacagauugacaacuucucguuaggcguccucgguauggcucuguuucuugaggaaaugcugcgaacacggguuggcaccaagcacgcaaucuugcucguggccguauccuucgugacucugauuacagggaauaugucuuuucgugaucuaggaagagucauggugaugguuggcgcuaccaugacggacgauauagggaugggagugacuuaccuggcccuccuggcagcguucaaggucaggcccaccuuugccgcuggccuuuugcugcgcaaauuaacaagcaaggagcucaugaugaccacuaucgguauugugcugcuuucacaaaguacaaucccugagaccauucuggaacuaacagacgcccucgcacuggggaugaugguuuugaaaaucgugcggaacauggagaaguaucagcuggcugucacuauaauggccaucuuaugcguacccaaugcagugauucuccagaacgccuggaaaguuuccuguaccgcucuggcgguggucucugugagcccacuucuguugacguccucacaacagaagacagauuggaucccucucgcccugaccauuaagggacuaaaucccacugcaaucuuccugaccacacuuagcagaacuaguaaaaagaggucuuggccacucaacgaagcuauaauggccguaggcaugguguccauucuggccagcucguuuuugaaaaaugacaucccgaugaccggcccucuggucgcugggggauuacucacgguuugcuacgugcugacaggucgaucagcagaucuugagcuggaacgcgccgcggacauccggugggaggagcaggcugaaauuucuggcaguucccccauauugagcaucaccauuucugaggacgggagcauguccaucaagaacgaagaggaggaacagacucucacaauucugaucagaaccggacuacuggugauaucaggccuuuucccagccaguauccccauuacugcagccgcuugguaucucugggaggucaaaaagcaaagggcaggugugcugugggauguuccuagcccacccccuguagggcgugccgaauuggaggacggagcguaccgcaucaaacagaagggcauuuuaggcuauucucagaucggggcuggaguguacaaggaagguacauuucacaccauguggcaugucacgcggggcgccgugcugaugcacaaagggaagagaauagagccguccugggcagauguuaaaaaggaccucauuucauacggaggcgguuggaaacuggagggggaauggaaggagggagaagaggugcagguccuugcccuggaaccaggcaagaaccccagggcugugcaaacuaaaccuggcuuguucaagaccaauacagggaccaucggagccguaagucuagauuuuagcccagguacauccggcucucccaucgucgacaaaaaggggaaagugguuggacuguauggcaacgguguggucacucgaucggggaccuacgugagcgcaauugcucagacggagaagucaaucgaggauaauccugaaauagaggacgauauuuuccggaagaaacgccucacaaucauggaccugcauccgggagccggcaagacuaaaagauaucuucccgcgauuguuagggaagccaucaagcggggcuuacgaacccugauacucgcaccaacaagaguggucgcugccgagauggaagaggcuuugcgcgggcugccuauuagguaccagacccccgcaauccgugccgagcacacuggacgggaaaucguggaucucaugugucaugccaccuucacaaugagacugcuuuccccaauuaggguaccuaacuauaaucugaucauuauggacgaggcucacuuuacggaucccgcgaguauagcagcccgcgguuacaucucuacucgaguggaaaugggcgaggcugccgggauuuucaugaccgcaacaccaccgggaagcagagacccuuuuccccaguccaacgccccaaucauggacgaggaacgggagauccccgaaaggucauggaauucuggccacgaguggguuaccgauuucaaagguaagacugucugguuugugccuagcauuaaggcugggaacgacauagcggccugcuugcgcaaaaauggaaagaaagugauccaacuaagucguaagacauucgauuccgaauauauuaaaaccagaacgaacgacugggauuuugucguaacuacagacaucagcgagaugggcgcaaauuucaaggcugagcgggugauugauccaaggcgcuguaugaagcccguuauccugaccgacggcgaagagcgagugauacucgccgggccuaugccggucacccauucuucagcagcccagagacggggaagggugggucgcaacccaaaaaaugaaaacgaucaguacaucuacaugggcgagcccuuagaaaaugacgaggauugcgcucacuggaaggaggccaaaaugcugcuugacaacauuaacacuccugaagggaucauucccuccauguuugagccagaaagagagaagguugacgcgaucgauggagaauauaggcugcggggcgaggcacguaaaacauucguggaccucaugcgccgaggugauuugccugucuggcuggccuacagaguggcugccgaggggauaaauuaugcugacaggcggugguguuuugauggcguaaagaacaaucaaauucucgaagagaacguggaaguugagaucuggaccaaagagggagaacgcaagaagcugaaacccagauggcuugacgcaaggauuuacagugauccacuagcccugaaggaguucaaagaauucgcugccggccggaagagcuugacauuaaaucugaucacugagauggggcgacucccuacguuuaugacccagaaagcaagaaacgcgcuggacaaucuugccguccugcauacagcugaagccggaggucgcgcauauaaccacgcucucucggaguugccggagacucuggaaacccuacugcuccuuacacuguuagccaccgugacuggcgggauauucuuguuucugaugucuggaaagggcaucgguaagaugacgcucgggaugugcugcauugugaccgcauccauccugcuuugguacgcccagauucagccccacuggaucgcugcgagcauaauucuggaguucuuucucaucgucuugcugaucccagaaccugagaaacaaaggacaccccaggauaaucaguuaacuuauguugugauugccauccuaaccguaguggcagcuacaauggccaacgaaaugggcuuccuggagaagaccaaaaaggacuuuggacucggcucaauaacuacacagcaaccagagaguaauauucuugauaucgaccugcggccugccucugcauggacguuguacgcugucgccaccacuuucauuacacccaugcugcgucauuccaucgaaaacagcucagugaauguuagucucaccgcgauagcuaaccaggccaccgugcugauggggcuuggaaaagguuggccgcucagcaagauggauaucggcgucccacuguuggcaauuggguguuacucccagguaaauccuaucacacugacugccgcuuuacuacugcucguggcacacuaugccauuaucggacccggccuucaggcgaaggcuacgagagaggcccaaaaaagggcagccgcugguauuaugaagaacccaaccguugacgggaucacagugauagaccuggaucccauuccuuacgacccgaaauuugaaaagcaguugggccaggucaugcugcucgugcugugcgucacucaggugcuuaugaugcgcaccacaugggccuuaugugaggcacugacccucgcuacuggacccaucucuacguugugggaaggcaauccagggcgguucuggaacacaaccaucgccguuagcauggcgaacauuuuucgaggauccuaucuggccggcgcaggucuacuguucucaauaaugaaaaauacugcuaacaccagaagggggacaggaaauacuggcgagacccucggugagaaguggaagaaccgccuuaaugcccugggcaaaucugaauuucaaaucuacaagaaaagugggauucaggagguggaucggacauuggcaaaggaaggaaucaaaagaggcgagacggaccaucacgcuguaucgcgugggagcgccaagcugaggugguucguggagcggaaccucgucaccccugaaggaaaaguuguggaucugggcugcggucgcgggggaugguccuauuacuguggcgguuuaaagaaugucaaggaggugaaaggccuuacuaaggggggacccggccaugaagagccuauuccaaugucuacauauggguggaaccugguacgacuccagucaggaguggacguuuucuuuacccccccugaaaaaugcgauacucuacugugugacaucggcgagagcuccccaaaucccacaguggaggccgguagaaccuugaggguccugaaccucguggaaaauuggcuuaacaauaacacgcaauucugcauaaagguccugaauccguacaugccuagugugaucgagaaaauggaagcguugcagcggcgcuacgggggagcucugguuagaaacccacccucuaggaacagcacccacgagauguauuggguaucaaaugcauccggcaacauugugaguagcgucaauaugaucucucgaaugcucauuaaccgguuuacaaugcgucacaagaaggccacuuacgaaccugauguggacuuaggcuccgggaccagaaauaucggaauagagucagagguuccaaaccuggauauuaucgguaaacgcaucgaaaagauuaaacaggagcaugaaacaagcuggcacuaugaccaggaucaucccuacaagacuugggcuuaucacggcucguacgagaccaaacaaacagggucugccaguuccauggugaauggagucgugaggcuucugaccaagccgugggacguaauaccuauggugacucagauggcaaugacggacacaacccccuucggccagcagcggguuuuuaaggaaaaagucgauacuagaacccaagagccaaaggaggguacaaaaaagcuaaugaaaaucacggccgaauggcucuggaaggagcuggggaagaaaaagaccccucgcauguguacuagggaagaguucacacgaaaagugcggagcaacgcugcguugggagccauuuuuaccgacgagaauaaguggaaaucagcaagagaagcuguggaggauuccggcuucugggaacuggucgacaaggagaggaaccuccaccuugaaggcaaaugcgagacuuguguuuauaauaugauggggaagcgcgagaagaaacugggagaauuugguaaggccaaaggcucucgugcaaucugguacaugugguuaggggcccgguuccuggaguuugaagcuuugggauuccucaacgaggaucauugguuuagcagagaaaauagucuguccggcguggagggugaggggcuacacaagcuuggauacauucugagggacguaagcaaaaaggaaggcggcgccauguaugcggaugacacagcagggugggauacccgcaucacacucgaggaccugaagaacgaagagauggugacuaaucauauggaaggagagcacaaaaaguuggccgaggcuauauuccgacugaccuaccagaacaaagucgugcggguucagagacccacgccaagggguaccgugauggauaucauuucucgcagagaccagcggggcucagggcaagucgugacauauggacucaacacuuucaccaauauggaagcccagcuuaucaggcagauggagggcgaagguguauuuaagaguauucaacaucugacagcaacugaggagaucgcuguuaaaaacugguuagugcgugucgggcgagaacgccuguccagaauggccauuagcggagacgauugcguggugaagcccuucgacgaucgguuugcuaaugccuugaccgcacucaacgacaugggcaaggucaggaaagauauacagcagugggagccuucucgcggcuggaaugacuggacgcagguuccauucugcucgcaccacuuucaugaacugaucaugaaggaugggagagugcuaguagugccgugucggaaccaagacgagcuuauuggaagggcgcgaaucucacagggugccggcuggagccugcgugaaacagcuugccucgggaaauccuacgcccagauguggagucugauguauuuccacagacgcgauuugcgguuagcagcuaaugccaucuguucugcaguccccagccauugggugccuaccuccaggacuacauggucaauucacgccacccacgaguggaugacuaccgaggacaugcugacaguuuggaacagaguguggauacaggaaaauccauggauggaggauaagacgcccgucgaaaguugggaggaaaucccuuaccucggaaaacgcgaggaccaauggugcggcucucuuauuggucugaccagccgggcgacuugggcuaagaacauccagacagccauuaaucaggugaggucccuaaucgggaacgaggaauauaccgauuacaugccaucaaugaagcgauuuagacgggaggaagaggaagcaggaguacugugguga

SEQ ID NO: 14967 - RNA, 9876 nt, Artificial Sequence
  derived and/or modified CDS sequence (opt3) from DENV-2__JQ955623__SS-prME
accgccggcaugaucauuaugcugauacccacagcuauggcauuccaccucacuacgagaaacggggagccucauaugaucgugagcaggcaggaaaagggaaaaucccuucuguuuaagaccgaggacggugucaauaugugcacauugauggccauggauuuaggcgaacugugugaggacacuauuaccuacaacugcccacuacuccggcaaaaugaaccggaggauaucgacuguuggugcaacucuacaucaaccuggguuacuuaugggacauguaccgcgacgggagagcaccgccgagaaaaacguaguguggcucugguaccccaugugggcaugggucuugagacuagaaccgaaacauggaugagcuccgagggggccuggaagcacgcacagaggauugagacuuggauccugcggcauccuggauucaccauaauggccgcuaucuuggcauacacaauuggcaccacgcacuuucagcgcguccucaucuucauucugcugacugccguggcuccaucuaugacaaugagaugcaucggcauaucgaauagggauuuuguugaaggggugucaggagguagcugggucgacauugugcucgagcacggcaguuguguaaccacuauggccaaaaacaagcccacauuagauuucgaacugaucaagaccgaggcgaaacagccugcaacgcuucggaaguauugcauugaagccaaauugaccaauacaacuaccgcuucccgcuguccaacacaaggggagcccucucugaacgaggaacaggacaagcgauuuguuugcaaacauagcaugguggauagaggauggggcaaugguugugggcuauucggaaagggcggcaucgucacuugcgccauguuuaccugcaagaaaaacauggaggggaagaucgugcagccugaaaaucucgaguacacaauuguggucaccccacacuccggagaagagaacgcaguugguaaugacacuggcaaacaugggaaggagauaaaagugacgccgcagucaaguaucacagaagcugagcugaccggauauggcacuguaaccauggaauguagccccaggacaggucuugauuucaacgagauggugcuguugcaaauggaaaauaaggccuggcucguccaccggcagugguuucuggacuuaccucugccauggcuccccggggcggauacccagggcucuaacuggauucagaaagagacucuugugacauucaagaacccucacgccaagaaacaagacguugugguccugggaucccaggagggcgcaaugcauacggcuuugaccggggccacugaaauccagaugucaagcggaaaucuacuguuuacaggucaccucaagugccgucugcgcauggacaaacuucaacugaagggcaugaguuacucuauguguaccgggaaauucaaggugguaaaggagauagcugaaacacagcauggaacuauuguuaucagagugcaguaugagggcgaugguuccccaugcaaaauccccuucgagauuauggacuuggaaaagaggcacguccucgggcggcugaucaccgugaacccgauugucacggagaaagauagcccugugaauauagaagccgagcccccauuuggcgacucguacaucauuguuggaguggaaccuggccaguuaaagcugucuugguucaaaaagggguccucaaucggacaaauguuugagaccacaaugcgaggugcaaagcgcauggccauccuaggcgauacugcuugggacuucgggagucucggaggcguauuuaccagcauugguaaagcgcugcaucaggucuucggggcaauauacggcgccgcuuuuuccggagugucuuggacaaugaagauccuuauuggcguugugaucacuuggauugggaugaacagcagaucaaccaguuuguccgucagccuggugcucguaggaaucgugacgcuguaucuuggcguuaugguccaggccgauucugguuguguggugucauggaaaaauaaggagcugaaaugcgggaguggaauauucaucacagacaacguccacaccuggacugaacaguacaaguuucaacccgagagcccauccaaguuggcaucugccauucagaaagcucacgaagagggcaucugugguauuaggucgguuacacggcucgaaaaucugauguggaagcagaucacccccgaguuaaaccauauacugagcgagaaugaagugaaacuaacuauuaugaccggcgauaucaaggggauuaugcaggccggaaaacgcucccucagaccucaaccaacagagcugaaguauucauggaaaacguggggcaaggcaaagaugcuuaguaccgaaccgcacaaccagacuuucuugaucgacgggcccgagacagcggaaugcccuaauaccaacagggcuuggaauucucuggagguggaggauuacggauuuggcguauucacaacuaacauauggcucaaacugaaggaacgucaggacgucuuuugugacagcaaauuaauguccgccgcaaucaaggauaaucgggccgugcaugcugacauggguuauuggauugagucagcccugaacgauaccuggaaaaucgaaaaggcaagcuucauugagguuaagucuugccacuggccaaaaucccacacgcuuuggaguaacgggguguuggagagcgaaaugaucauacccaagaauuucgcuggaccugucucucagcauaacuaccgaccaggcuaucacacacaaaccgccggucccuggcaucucggcaaacuggagauggacuuugauuucugugaagggacuaccgugguugugacagaggacugcggaaauagaggcccgucccuaaggacuaccacagcgucagggaagcugauuacggaauggugcugucgcaguugcacccucccuccacugcgguacagaggagaggauggcuguugguacgguauggagaucaggccccuuaaagaaaaggaggaaaacuugguaaauagccuggucacugccgggcacggacagaucgacaacuuuucguuaggcgugcucgguauggcucuguuccuugaggaaaugcugcgcacacgagugggcaccaagcaugcagucuugcucguugccguguccuuuaugacucugauuacagggaauaugucuuuccgggaucuaggacguguaauggugauggucggcgcugccaugaccgacgauaucgggaugggagugacguaucuggcacuccuggcggccuuuaaaguuagaccuacuuucgcugccggccuuuugcugaggaaguuaaccagcaaagagcucaugaugacaaccauugguauagugcugcuuucacagaguacuauccccgagacaauucuggaacuaaccgacgcacucgcucuggggaugaugaucuugaagauuguccgcaacauggagaaauaccaacuggccgugacaaucauggcaauauuaugcguuccaaaugccgugauccuccagaacgcuuggaaggucuccuguacuauucuggcgguagugucuguuagcccucuucuguugaccuccucacagcagaaggccgauuggaucccccucgcacugacgauuaaaggacuaaauccaacagcuaucuuucugaccacucuuagccggaccaacaagaaaagaaguuggccgcucaaugaagccauaauggccgugggcauggucucuauucuggcuuccagcuugcugaagaacgacaucccuaugacaggccccuuaguggcagggggacuccugacuguaugcuaugugcuuaccgguaggucggccgaccuggaguuggaacgagcggcugauguccgcugggaggaccaagccgagaucucaggcucuaguccaauucucuccauaacgaucagcgaagaugggucuaugagcauuaaaaaugaggaagaggagcagacacugaccauccuaauucggacuggacugcuuguuaucuccggccucuuccccgugucaauaccuaucacagcagccgcuugguaccugugggaagugaagaaacagagagcaggugucuugugggacgugccaagucccccuccgguugggaaggccgaguuagaagauggagcguauaggauuaagcagaaaggcauccugggcuacagccaaauuggggcuggaguauauaaggaggguaccuuucacacuauguggcacgugacacguggcgccguccucaugcauaaagggaagcgcaucgaaccaucuugggcagacgugcggaaagaucugauauccuacggaggcgguuggaagcuugagggggaguggaaggaaggagaggaaguucaggugcuggccuuggagcccggcaaaaacccuagagcuguccagaccaagccaggccuauucaaaacgaacacugggaccauuggagccgugucacuggacuuuagucccgguacaagcggcuccccuaucguagauaagaaagggaaggucgugggacucuacggcaaugguguugugaccaggucugggacauaugucucggcaaucgcucagacugaaaagagcauugaggacaacccggagaucgaagaugacauauuccgaaaaaagcggcugaccauuauggaucuucaccccggagccggcaaaacgaagcgcuacuuaccagcgaucgugagagaggccauuaaaaggggccugcggacacucaucuuggcaccuacucgaguuguggcugccgaaauggaggaagcucugagagggcuccccauacgcuaucaaaccccagcaauuagggccgagcauacaggacgugagaucgucgaccugaugugucacgccaccuucacuaugcggcuucugucaccugugagaguacccaauuacaacuugaucauuauggacgaagcucauuuuaccgauccagcguccaucgcagccagggguuauauuaguacacgcguggagaugggcgaagcugccgggauauucaugacggcaacuccgccuggaucucgagaccccuuuccacagagcaaugcccccaucauggaugaggagagagaaauuccugagcgguccuggaacucaggccacgaauggguuaccgacuucaaggguaagacagucugguuugugccaucuaucaaagcugggaaugauaucgcggccugccuaaggaagaacggaaaaaaggugauucagcugagccgcaaaaccuucgacagugaguacauaaagacucguacaaaugauugggacuuugucguaaccacggauaucuccgaaaugggcgcaaacuucaaggcugagagagugauugacccccggagguguaugaaaccuguuauccucacugauggcgaggaacgcgugauuuuagccgggccgaugccagucacacacagcucugcagcccaacgaagaggacggaucgguaggaaucccaagaacgagaaugaccaguauauauacaugggcgaaccucuggagaacgacgaagauugcgcucauuggaaagaggccaagaugcuucuggacaauaucaacacccccgaggggauuaucccaucaauguuugaaccugagcgcgaaaaaguggaugcgauugacggagaguacagacucaggggcgaagcacggaagaccuucguugauuugaugcgucgcggugaccugcccguguggcucgccuaucgagucgcugccgaggggaucaacuacgcugauagaaggugguguuuugacggcauaaaaaauaaccagauucuggaggaaaauguggagguagaaaucuggacuaaggagggagagcggaagaaacuuaagccacgcuggcuagaugcaagaauuuauuccgacccucuggccuugaaagaauucaaggaguucgcugccggcaggaaaaguuuaacacugaaccucaucaccgaaauggggcggcugccgacauuuaugacucagaaggcacgaaaugcgcuugauaaccuggccgugcuccacacggcugaggccggagguagagcauacaaucaugcuuugagcgaacugcccgagacccuagagacacugcuccuucugacuuuauuggccaccguuacaggcgggauauuccuguuucucaugucgggaaagggcaucgguaaaaugacccuggggaugugcugcauuaucacugcaucuauucuucugugguaugcccaaauccagccacacuggauagcugcguccauuauccucgaauucuuuuugaucguccuguuaauuccugagcccgaaaagcagcgcacgccacaggacaaccaacuaaccuacguggugaucgccauacugacagucguugcagcuacuauggccaaugagaugggcuuccucgaaaaaaccaagaaagauuuuggacuuggcagcauugccacacagcagcuggagucaaacaucuuggacauugaccugaggccugcaagugcuuggacccucuaugccguggcgacuacauucaucacgcccaugcugcggcacucuauagagaauuccagcguaaacgugucacuuaccgcuaucgccaaucaggcaacuguccucauggggcugggaaaggguuggccguugaguaagauggauauuggcgugccacuguuagccaucggguguuacagccaaguuaacccuauuacacuaaccgcugcacugcuccuucugguggcccauuacgcgaucauuggacccggcuugcaggcuaaagccacccgugaagcacagaagagagccgcugccgguaucaugaaaaauccaacagucgacgggauaacuguaauugaucuggaccccaucccuuaugauccgaaguuugagaaacagcucggccaagugaugcugcuuguuuuaugcgugacgcagguccugaugaugaggaccacaugggcacucugugaagcuuugacucuggccaccggacccaucuccacacuaugggagggcaacccagggcgcuucuggaauaccacuauugcggugucuauggccaacauauuucggggaagcuaccuggcaggcgcuggucuccuuuucuccaucaugaagaacacgacaaauacccgaagagggacuggaaacaccggcgaaacacugggugagaaguggaaaaauagguugaacucacugggcaagucugaguuucagauuuauaaacgcagugggauccaagaagucgaccggacucucgccaaggagggaauuaaaagaggcgaaaccgaucaccaugcagugucgcgugggagcgcuaagcugaggugguucguugagcggaauuuagugacaccugagggaaaaguaguggaccuuggcugcggucgcgggggaugguccuacuauuguggcggucugaagaacguccgagaaguuaagggccucacgaaagggggacccggccacgaggaaccuaucccaaugucuaccuacggguggaaucuagugagacugcagucaggagucgauguguucuuuacucccccugagaagugcgacacauugcugugugauauaggcgaaagcuccccaaaccccaccguagaggccgguaggacucuccgggugcuuaaucugguugagaacugguugaauaacgacacacaguucugcaucaaagugcugaauccguauaugccuagugucauugaaaagauggaggcccuccagcgcaaauacgggggagcguuagugagaaacccacugucuaggaauagcacccaugaaauguacugggucucaaacgcuuccggcaacaucgugaguagcguuaauaugauuucucgaaugcuuaucaaccgguuuacgaugcgucacaagaaggcaaccuaugagcccgauguagaccugggcuccgggacaagaaauauaggaauugaaucagagacuccuaaccuagacaucaucgguaaacgcauugagaagauaaaacaagaacacgagaccagcuggcauuacgaucaggaccacccauauaagacaugggccuaccauggcucguaugaaacuaaacagaccgggucugcuaguuccauggugaauggagucgugaggcuccugacaaagcccugggauguuaucccgauggugacccagauggccaugacugacacgacaccuuucggccaacagcgggucuuuaaggagaaaguggauaccagaacucaggaacccaaggaggguaccaaaaaguugaugaaaauuacagcagaguggcuguggaaggaacucgggaagaaaaagacgccacgcauguguaccagggaggaauucacucgaaaaguacggagcaacgccgcucuuggagcgaucuuuacagacgagaauaaguggaaaucagccagagaggcaguggaagauuccagguucugggagcugguuaacaaggaacgcaauuuacaccuggagggcaaaugcgaaaccugugucuacaacaugaugggcaagcgugagaagaaaauuggggaguuuggaaaggcuaaagguucucgggccaucugguauaugugguugggcgcaagauuccucgaauuugaggcccugggguuccuaaaugaagaccacugguuuagcagggagaacagucuuuccggaguggaaggcgagggucugcauaagcucggguacauacugcgcgaggugagcaaaaaggaaggaggcgcuauguacgccgaugacacugcgggcugggauacacgaaucaccuuggaggaccugaagaaugaagagauggucacaaaccacauggaaggggagcauaaaaagcucgcagaggccauuuucaaacuuacuuaucagaauaagguugugcggguacaaagaccuacccccaggggaacggugauggacaucauuucucgcagagaucagcgggguucaggccaggucgggaccuacggacugaacacauucacuaacaugggcgcucaauuaaucaggcagauggaaggugaggggguguuuaaaggaauucagcaccugaccgccacagaagagacugcaguucaugacugguuggcucgugugggccgagagcgccucaguagaauggccauauccggcgaugacugcgucgugaagccacuggaugaccgguucgcuagcgcccuaaccgcacuuaaugauauggggaagguaaggaaagacauccagcaaugggaacccucucgcggauggaacgauuggacgcagguuccuuuuugcucgcaccacuuccaugagcugauuaugaaggacgguagagugcucgucgugccaugucggaaucaggaugaacugaucggcagggcgcgaaucucacagggggccggauggagcuugcgugagacagcuugcuuaggcaaauccuaugcccaaauguggagucugauguacuuucacagacgcgaccuccggcuugcagcuaacgccauuuguucugcagugccgagccauuggguccccaccuccaggacuacauggucaauacacgccagacacgaauggaugaccacugaggauaugcugaccguuuggaaucgcguguggauccaggagaacccuuggauggaagacaagacaccaguagagaguugggaagagauucccuaucuagguaaacgggaagaccaguggugcgggucucugaucggacucacgagcagggcgaccugggcuaagaauauucagacugccaucaaccaagugcgauccuugauaggcucagaggaguacacagauuauaugccuagcaugaagagauuccggagggaagaggaagaggcaggcguccugugguga

SEQ ID NO: 14968 - RNA, 9876 nt, Artificial Sequence
  derived and/or modified CDS sequence (opt3) from DENV-2__KR779782__SS-prME
accgccggaaucauuauaaugaugauccccacagugauggcuuuccaccugacuacgcgaaacggggaaccucauaugauugucagcaggcaggaaaagggaaaaucccuccuuuuuaagaccgaaaaugguguuaacaugugcacacugauggcaauggacuugggcgaauuaugugaggauacuaucaccuacaauugcccacugcugcggcaaaacgaaccggaggacauugauuguuggugcaauucuacaucaaccugggugacuuaugggacauguaccgccacgggagagcaccgccgagaaaaacguaguguugcgcucgugccccaugucggcaugggucuggagacuagaaccgaaacauggaugagcuccgagggggcuuggaagcacgcccagaggaucgagacuuggauacuucggcauccuggauucaccaucauggcagccauucuggcuuacacaaucggcaccacguauuuucagcgcguguugauuuucauccuccugacugcaguuacaccaucuauggccaugaggugcauaggcauuucgaacagggacuuuguggaaggggucucaggagguagcuggguggauaucguacuggagcacggcaguuguguuaccacuauggcuaaaaauaagcccacacucgacuucgaauuaauuaagaccgaggccaaacacccugcgacgcugcggaaguacugcguggaagcaaaacuuaccaacacaacuaccgccucccgcuguccaacacagggggagcccucuuugaaugaggaacaagauaagcgauuugucugcaaacauagcaugguggacagaggauggggcaacgguugugggcuguucggaaagggcggcaucgugacuugcgcuauguuuaccugcaagaaaaauauggaggggaaggucguucagccugaaaaccuagaguauacaaucgugauuaccccacacuccggagaagagaaugccguagguaacgauacuggcaaacaugggaaggagauaaaagugacgccgcagucaaguaucacagaagcagagcucaccggauacggcacugucaccauggaauguagccccaggacaggucuggacuucaaugagauggugcuucugcagauggaaaacaaggcuugguugguucaccggcaaugguuucucgaucugccuuuaccauggcugcccggggccgacacccagggcucuaacuggauucagaaagagacucucgugacauucaagaauccucacgcgaagaaacaggaugucgugguacuuggaucccaagagggcgccaugcauacggcacugaccggggcuacugaaauccagaugucaagcggaaacuugcuauuuacaggucaccugaagugccgucuccgcauggacaaacugcagcuuaagggcaugaguuauucuauguguaccgggaaauucaagguugugaaggagauagccgaaacacaacauggaacuauugucaucagagugcaguacgagggcgacgguuccccaugcaaaauccccuucgagauuauggaucuggaaaagaggcacgucuuggggcggcucaucaccgugaauccgauuguuacggagaaagacagcccugugaacauagaagcugagcccccauuuggcgauucguacaucauuaucggaguagaaccuggccagcugaaguuaucuugguucaaaaagggguccucaaucggacagauguuugagaccacaaugcgaggugccaagcgcauggcaauucugggcgacacugccugggauuucgggagucuaggaggcgucuuuaccagcauagguaaagcucuccaucaaguguucggggcgaucuauggcgcagccuuuuccggaguuucuuggacaaugaagauucugaucggcguggucauuacuuggaucgggaugaauagcagaucaaccagucuuuccgugagcuugguacuggugggaguugucacgcucuaccugggcgugauggugcaggcugacucugguugugucguuucauggaaaaacaaggagcuuaaaugcgggaguggaauauucaucacagauaaugugcacaccuggacugaacaguauaaguuucagcccgagagcccauccaagcuggccucugcaauucaaaaagcccacgaacagggcaucugugguauuaggucggugacacgguuggagaaccucauguggaagcagaucacccccgaacugaaucauauauuaacugagaacgagguaaaacugaccauuaugacaggcgacaucaaggggauuaugcaggcuggaaaacgcagccuaagaccucaaccaacggaacucaaguacuccuggaaagccuggggcaaggcaaagaugcugucaaccgagcuucacaaucauacuuucuugaucgaugggccggaaacagcggagugccccaacaccaauagggcuuggaacagucuggaagucgaggacuauggauuuggcguguucacaacuaauauauggcucaaacugaaggagcgucaggauguauuuugugacucuaaauuaaugagcgccgcaaucaaggacaaccgggccgugcacgcugauauggguuacuggauugaauccgcccugaacgacaccuggaaaaucgagaaggcaucauucauugaagucaagagcugccacuggccuaaaucucauacgcuuugguccaaugggguguuggagagugagaugaucauaccaaagaacuucgcuggacccguuagccagcacaauuaucgaccuggcuaccauacacagaccgccgguccauggcaccucggcagacuggaaauggauuuugacuucugugaggggacuaccgugguagucacagaagauugcggaaacaggggccccucucuacgcacuaccacagcguccgggaaacugauuacggaguggugcugucggucaugcacccucccgccucugagauacaggggagaagacggcuguugguaugguauggagauccgcccacuuaaggagaaagaagagaauuuggugaacagucuggugacugccgggcauggacaaaucgauaauuuuagcuuaggcguccucgguauggcucuguuccuugaagagaugcugcgaacacggguuggcaccaagcacgcaauuuugcucguggccguaucguuugugacucugaucacagggaacauguccuuccgugaccuaggaagagucauggugaugguuggcgcuaccaugacggaugacauugggaugggagugacuuaccuggcccuccuggcagcguuuaaggucaggcccaccuucgccgcuggccuuuugcugcgcaaauuaacaucuaaggaacucaugaugaccacuauagguaucgugcugcuuagccagucaacaauuccugagaguauccuggagcuaaccgaugcccucgcacuggggaugaugguuuugaaaauugugcggaauauggaaaaguaucagcuggcugucacaaucauggccauauuaugcguacccaacgcagugauccuccaaaaugccuggaaaguuuccuguacuacccuggcuguggucucugugagcccacuucuguugacguccucacagcagaaggcggacuggauuccucucgcccugacaaucaagggacuaaaccccaccgcaauuuuucugacuacccuuagcagaacaaguaaaaagaggucuuggccacucaaugaggcuaucauggccguaggcaugguguccauacuggccagcucguugcugaaaaacgauauuccgaugacuggcccuuuagucgcugggggacuccugaccguuugcuacgugcuuacgggucgaucagcagaccuggaauuggagcgcgccgcggacgugcggugggaagaacaggcugagaucucuggcaguucccccauccucagcauuacaauaucugaagaugggagcauguccaucaagaaugaggaagaggagcaaacccugacuauucuaaucagaacaggacugcuugucauuucaggccucuucccagugaguauccccauaaccgccgcagccugguaucugugggaaguuaaaaagcagagggcugguguauugugggacgugccuagcccacccccugucgggaaagcagaguuagaagauggagccuaccguaucaagcagaagggcauucugggcuauucucagaucggggcgggaguguacaaagaggguacuuuucacacaauguggcauguuacccgcggcgcugugcucaugcacaaggggaaacggauugaaccguccugggccgacgucaagaaagaucugaucucauacggaggcgguuggaaacuugagggggaguggaaggaaggagaggaagugcaaguacuggcauuggagccaggcaaaaaccccagagccguccagacgaagccuggccuauucaaaacuaacaccgggacaauaggagcugugagucuggacuuuagcccagguaccuccggcucucccauuguugauaagaaagggaagguggucggacucuauggcaauggugugguuacaaggucggggacuuacgugagcgccaucgcacagaccgaaaagucaaucgaggacaacccugagauugaagaugacaucuucagaaagaaacggcugacgauaauggaucuucauccgggagcuggcaaaacaaagcgcuauuuacccgccauugucagagaggcgaucaaaaggggccugcggacucucauuuuggccccaacccgagugguagcagcugaaauggaggaagcccugagagggcucccuauccgcuaccagacacccgcuauaagggcagagcacaccggacgugagauuguggaccugaugugucaugccacuuucaccaugcggcuucuguccccaaucagaguuccuaauuauaacuugaucauuauggaugaagcccacuuuacagaccccgcuaguaucgcggcaagggguuacauuucuacgcgcgucgagaugggcgaagccgcugggauauucaugacugccaccccaccgggaagccgagacccuuuuccccaauccaaugcaccaaucauggaugaggagagagaaauucccgagcggucauggaacucuggccacgaaugggugacagacuucaaggguaagaccgugugguuugucccuagcaucaaagccgggaaugauaucgcugcgugccuaaggaagaacggcaagaagguaauucagcugagucgcaaaacuuucgacuccgaguauauaaagacacguaccaaugauugggacuuugugguuacgacugauaucagcgaaaugggcgccaacuucaaggcagagagagugauugacccacggagguguaugaaacccgucauccucacagauggcgaggaacgcgugauuuuagcugggccuaugccgguuacccauucuucagccgcacagcgaagaggacggguggguaggaauccaaagaacgagaaugaccaauacaucuacaugggcgaaccccuggagaacgaugaagacugcgcccacuggaaagaggcuaagaugcuucuggacaauauaaacaccccugaggggaucauucccuccauguuugaaccagagcgcgaaaaagucgaugccaucgacggagaguauagacucaggggcgaagcgcggaagacuuucguggauuugaugcgucgcggugaccugccuguauggcucgcauaccgaguggccgcugaggggauuaacuaugccgauagaaggugguguuuugacggcguuaaaaauaaccagauccuggaggaaaaugucgagguggaaauauggacaaaggagggagagcggaagaaacuuaagccccgcuggcuagaugcuagaauuuacagugacccacuggcauugaaagaguucaaggaguucgccgcuggcaggaagucguuaacccugaaccucaucacagaaauggggcggcugccuacuuuuaugacgcagaaggccaagaaugcacuugauaaccuggcggugcuccauaccgccgaggcuggaggucgagccuauaaucacgcauugagcgaacugccggagacacuagagacucugcuccuucugaccuuauuggcuacagucaccggcgggauuuuccuguuucucaugucuggaaaaggcaucgguaagaugacucuggggaugugcugcauaaucacggccuccauucuucugugguacgcacagauccaaccccacuggauugccgcuagcaucauacucgaguucuuuuugauuguucuguuaaucccagagccugaaaaacagagaacaccccaggacaaccagcuaacauaugugguaaucgcgauucugacuguggucgccgcaaccauggcuaaugagaugggcuuccucgaaaagaccaagaaggauuuuggacuuggcucaaucaccacucaacagccagagaguaacauacuggacauugauuugcgcccugccucugccuggacacuguacgcaguggcuacgaccuucaucacucccaugcucaggcauuccauugagaauagcucaguuaacgugagucugacagccaucgcgaaucaggcuaccguccuuauggggcucggaaaggguuggccgcugagcaaaauggacauaggcguaccauugcuggccaucggguguuacucccaggugaacccuauuaccuuaacagcagcccuacugcuccuuguugcucacuaugcaaucauuggacccggccugcaagccaaggcgacucgggaagcucagaaacgugccgcagccgguaucaugaagaauccaacgguggacgggaugaccgucauugauuuggaccccaucccuuacgauccgaaauuugagaagcagcugggccaggugaugcuccugguccuuugcgugacacaaguuuuaaugaugagaacuaccugggcucugugugaagcccucacauuggcaaccggacccauaucuacucugugggagggcaacccagggagguucuggaauacgacaauugcugugagcauggccaacaucuuucgcggauccuaucuagcgggcgccggucuacucuucucaaucaugaagaacaccgcaaauacucggcgagggaccggaaacacaggcgaaacucuuggugagaaauggaagaauagacugaacgcuuugggcaaaucugaguuucagauuuacaagaaaagugggauacaggaaguagacaggacccuggccaaggagggaaucaaacgcggcgaaacagaucaucacgcagugucgcgggggagcgcuaagcucagaugguucgucgagcguaaucugguuacgccugagggaaagguggucgacuuaggcugcgguagagggggaugguccuauuacuguggcggucuuaaaaacgugaaggaaguaaaaggccugaccaaagggggacccggccaugaggaaccuauuccaaugucuacuuauggguggaaucucgugcggcuacaaucaggaguugauguguucuuuacacccccugagaaaugcgacacccuguugugugauaucggcgaaagcuccccaaaccccacugucgaggccggucgcacacugcgagugcucaaucuugucgagaacuggcugaauaacaauacccaguucugcauuaagguguugaacccguacaugccuaguguuaucgaaaagauggaggcccugcagagaaaauacgggggagcgcucguaaggaauccauuaucucggaacagcacgcacgaaauguauugggugucaaacgcuuccggcaauauagucaguagcgugaacaugaucucucgcaugcugauuaauagauuuaccaugaggcacaagaaagcaacauacgagcccgacguugaucuuggcuccgggacucgaaacaucggaauugaaucagagaccccuaaucuggacaucauagguaagcggauugagaaaaucaagcaggaacaugagacaagcuggcacuaugaucaagaccauccauacaagacuugggccuaucacggcucguacgaaaccaaacagacagggucugcuaguuccauggugaacggagucgugcgucuacucaccaagcccugggacguaaucccgauggugacucagauggccaugacggauacaaccccuuucggccagcaaagaguuuuuaaagagaaggucgacacucgcacccaggaacccaaagaggguacaaagaagcugaugaaaauuacggcagagugguuguggaaggaacuggggaaaaagaaaaccccaaggauguguacucgggaggaguucacaagaaaggugcgcagcaaugccgcucucggagcgauauuuaccgaugagaacaaauggaagucagccagggaggcaguggaagacuccggcuucugggagcuugucgauaaggaacgaaaucugcacuuagagggcaaaugcgaaacuuguguuuauaacaugauggggaagcgggagaaaaagcugggagaguuugguaaagcuaagggcucuagagccaucugguacaugugguugggggcaagguuccucgaauuugaggcccugggauuccuaaaugaagaccauugguuuagccgcgagaacagucuuuccggcguggaaggugaggggcugcacaagcucggauacauucugcgugauguaagcaaaaaggagggcggcgcuauguaugccgacgauacagcggggugggacacccggaucacauuggaagaucugaaaaaugaggaaauggugacuaaccauauggagggagaacacaagaaacucgcagaggccauuuucaaacuuaccuaccagaauaaggucgugagaguucagaggccuacgccccgcgguaccgugauggacaucauaucucgacgggaccaaagaggcucagggcaggucgugacauauggacugaacacuuucaccaacauggaggcucaguuaaucaggcaaauggaaggcgaggguguauuuaaaaguauucagcagcugacaguuaaggaagagaucgccgugaaaaauugguugauucgcgucgggagagagcggcucuccaggauggcaaucagcggagaugacugcguggugaagccacuggaugaccguuucgcuucugcccuaacugcucuuaacgauaugggcaaaguccgaaaggacauucagcaaugggaacccucgcgcggcuggaaugauuggacccagguuccuuuuugcucacaucacuuccacgagcugauaaugaaggacgggagagugcucguagugccaugucggaaccaggaugaacugaucggaagggcccgcauuagccagggugcaggcugguccuugagagagacggcgugcuuagggaaaaguuacgcccaaauguggucucugauguauuuucaucggagggaccuccgacuugcugccaaugcaaucuguagcgcugucccgucccacugggugcccacaucacguaccacuuggaguauccaugccacacacgaauggaugaccacugaggauaugcugaccguuuggaacagaguguggauucaggagaauccuuggauggaagacaagacaccagucgagucuugggaagagauacccuaccuaggaaaacgcgaagaucaguggugcggcagccugaucggucucacgucccgggcaaccugggccaagaacauucagacugcgaucaaucaagugaggucauugauugggaacgaggaguauacagacuacaugccuagcaugaaaagauuccgccgggaagaggaagaggcuggaguacugugguga

SEQ ID NO: 14969 - RNA, 9876 nt, Artificial Sequence
  derived and/or modified CDS sequence (opt3) from DENV-2__KM279608__SS-prME
accgcaggcaucauuauaaugaugaucccaacagugauggcuuuccaccugacuacgagaaauggggagccucauaugauugucagcaggcaggaaaagggaaaaucccuccuuuuuaagaccgagaaugguguuaauaugugcacacugauggcaauggacuugggcgaauuaugugaggauacuaucaccuacaauugcccacugcuacggcaaaacgaaccggaggacauugauuguuggugcaauucuacaucaaccugggugacuuaugggacauguaccgugacgggagagcaccgccgagaaaaacguaguguggcccucgucccccaugugggcaugggucuggagacuagaaccgaaacauggaugagcuccgagggggcguggaagcacgcucagaggaucgagacuuggauacuucggcauccuggauucaccaucauggccgcaauucuggccuacacaaucggcaccacguauuugcagcgcguucucauuuuuauccugcugacugcugugacaccaucuauggcaaugagaugcauaggcauuucgaacagggacuucgucgaaggggugucaggagguagcuggguagauaucguucucgagcacggcaguugugugaccacuauggccaaaaauaagcccacauuagacuuugaacugauuaagaccgaggcuaaacacccugccacgcuucggaaguacugcgucgaagcgaaauugaccaacacaacuaccgcaucccgcuguccaacacagggggagcccucucugaaugaggaacaagauaagcgauucgugugcaaacauagcaugguggacagaggauggggcaacgguugugggcuauuuggaaagggcggcaucgucacuugcgccauguucacaugcaagaaaaauauggaggggaagguugugcagccugaaaaccucgaguauacaaucguaauuaccccacacuccggagaagagaaugcuguggguaacgauacuggcaaacaugggaaggagauaaaagucacgccgcagucaaguaucacagaagccgagcugaccggauacggcacugugaccauggaauguagccccaggacaggucuugacuuuaaugagaugguucuguugcagauggaaaacaaggcauggcucgugcaccggcaaugguuccuggauuuaccucugccauggcuccccggggcugacacccagggcucuaacuggauucagaaagagacucuugucacauuuaagaauccucacgccaagaaacaggaugugguaguucugggaucccaagagggcgcgaugcauacggccuugaccggggcaacugaaauccagaugucaagcggaaaccuacuguucacaggucaccucaagugccgucugcgcauggacaaacuucagcugaagggcaugaguuauucuauguguaccgggaaauuuaagguggucaaggagauagcugaaacacaacauggaacuauugugaucagaguccaguacgagggcgacgguuccccaugcaaaauccccuucgagauuauggauuuggaaaagaggcacgugcucgggcggcugaucaccguuaauccgauugugacggagaaagacaacccuguaaauauagaagccgagcccccauucggcgauagcuacaucauuaucggagucgaaccuggccaguuaaagcugucgugguauaaaaaggggucuuccaucggacagauguuugagaccacaaugcgaggugcuaagcgcauggccauucuaggcgacacugcaugggauuucgggucacucggaggcguguuuaccaguauagguaaagcccugcaucaaguuuucggggcuaucuacggcgcggcauuuagcggaguguccuggacaaugaagauucuuaucggcgucgugauuacuuggaucgggaugaacucuagaagcaccucauugaguguaucccuggugcucguuggagucgugacgcuguaucuuggcgugaugguccaggccgacagcgguuguguugugucuuggaggaauaaagagcugaagugcgggucaggaauauucaucacagauaacgugcacaccuggacugaacaguacaaauuucagcccgagaguccaagcaaguuggcuuccgccauucaaaaggcacacgaagagggcaucugugguauucggucuguaacacgccucgaaaaucugauguggaaacagaucacccccgaguuaaaccauauacugacugagaaugaagucaagcuaaccauuaugacaggcgacaucaaagggauuaugcaggccggaaagagaucgcucaggccucagccaacggagcugaaauauagcuggaaggcuuggggcaaagccaagaugcuuuccaccgaauugcacaaccauacuuuccugaucgaugggccggagacagcagaaugccccaauaccaaccgugcguggaacucacucgagguggaggacuacggauuuggcguuuucacaacuaacauauggcugaaguuaaaagaacggcaagauguguuuugugacaguaagcugaugucugcugccaucaaagacaaccgagcaguccacgccgauauggguuauuggauugagagcgcucuuaaugacaccuggaagaucgaaaaagccuccuucauugaggugaagucaugccacuggccuaagagccauacguuguggucuaacgggguucucgaguccgaaaugaucauacccaagaauuuugcaggacccgugagucagcacaacuacagaccuggcuaccauacacagaccgcugguccauggcaccugggcaggcuagagauggauuucgacuucugugaagggacuaccguagucgugacagaggauugcggaaaucgcggccccagccugcggacuaccacagccucugggaagcucauuacggaauggugcuguagauccugcacccugccgccucuuagguaucgcggagaggacggcuguugguacgguauggagauccgaccauugaaagaaaaggaggaaaaccugguaaauucauuagucacugcggggcauggacagaucgauaacuuuagucucggcguucuggguauggcccuuuuccuggaggaaauguugcggacacgugugggcaccaaacacgcuauucuccugguagcagugagcuuugucacucuaaucacagggaauaugucguucagagaccugggaagggugaugguuauggugggcgccaccaugacggaugacauugggaugggagucacuuaucucgcucugcuugccgcauuuaaggugcgccccaccuucgcggccggcuugcuguuacggaagcucacauccaaagagcugaugaugaccacuauagguaucguucuucugucucaaagcacaauuccugagucaauccuagaacucaccgaugcucuggccuuggggaugauggugcugaagauugucagaaacauggagaaauaccaguuagcaguaacaaucauggcuauacucugcgugcccaaugccguuauccuggaaaacgcauggaaggugaguuguacuacccuugccgucguguccguaucuccacuguugcucacgagcucccagcaaaaagcugacuggauuccucuggcgcuaacaaucaagggacugaaucccaccgccauuuuucuuacuacccucucaaggacaagcaagaaacgaaguuggccacugaacgaggcaaucauggcugugggcauggucucuauauuggccuccagccuguuaaagaaugauauuccgaugacuggcccucucguugccgggggacugcuuaccgugugcuaugugcugacgggucgcucggcugacuuggaacucgagcgggcagccgacgucagaugggaggaacaggcggagaucucaggcucuagucccauccuguccauuacaauaagcgaagaugggucuaugagcaucaaaaacgaggaggaagaacagacccuaacuauucugaucaggacaggacuucucgugauuuccggccuguucccaguuucaauccccauaaccgcugccgcaugguacuugugggaaguaaagaaacagcgugccgguguguuaugggacgucccuaguccacccccuguggggaaggcugagcuggaagauggagcauaucgcaucaaacaaaagggcauucucggcuacagccagaucggggccggaguuuacaaggaggguacuuuucacacaauguggcaugugacccggggcgcgguccugaugcacaaagggaagagaauugagccgucuugggcugacgugaaaaaggaucuuaucuccuauggaggcgguuggaaacuggaaggggaguggaaggaaggagaggaaguacaggucuuggcccuagagccaggcaagaaccccagggcagugcagacgaaaccuggccuguucaagacuaauaccgggacaauaggagccguuucacucgacuuuaguccagguaccagcggcucccccauuguggauaaaaaggggaaagucgugggacuguacggcaacgguguugugacacgaucugggacuuaugucucggcuaucgcccaaaccgaaaagagcaucgaagacaauccugagauugaagaugacaucuuccggaagaaacgccuuacgauaauggauuuacauccgggagcaggcaagacaaaaagauaccugcccgcuauugugagggaggccaucaagcggggccuccgaacuuugauucuggcgccaaccagaguaguggccgcagaaauggaggaggcucuccgcgggcugccuaucagguaucagacacccgccauacgugcugaacacaccggacgggagauuguugaccuuaugugucaugcaacuuuuaccaugagacuguugucaccaaucagggucccuaacuacaaucuaaucauuauggaugaagcccacuucacagaccccgccuccaucgcugcgcgcgguuauauuaguacgcgaguggagaugggcgaggcagccgggauauucaugacugcuaccccaccgggaucuagagacccuuuuccccagagcaacgccccaaucauggaugaagaacgggaaauucccgagagguccuggaacucaggccacgaaugggugacagacuucaaagguaagaccgucugguuuguaccuucuaucaaggcagggaacgauaucgccgcuugccugcgcaaaaauggaaagaaagugauucagcucagccguaagacuuucgacagugaguacauaaaaacaagaaccaacgauugggacuuuguugugacgacugauaucuccgagaugggcgcgaauuucaaggccgaacgggucauugacccaaggcgcuguaugaagcccgugaucuuaacagauggcgaggaacgaguuauucuggcagggccuaugccggugacccauagcucugcugcccaaagacggggaagggucggucgcaaccccaagaaugagaacgaccaguacaucuauaugggcgaaccccuugagaaugaugaggacugcgcacacuggaaggaagccaaaaugcugcucgacaacauaaacaccccugaggggaucauucccucaauguuugaaccagagagagaaaagguggaugcuaucgacggagaguacagguugcggggcgaggcccguaaaacuuucguagaucugaugcgccgaggugaccucccuguguggcuggcguauaagguugcagccgaagggauuaauuacgcugauagaaggugguguuuugacggcgucaaaaacaaucagauccuugaggaaaacguggagguggagauauggacaaaggaaggagagcggaagaaacuaaagccccgcuggcuggaugccagaauuuauuccgacccauuggcuuuaaaagaguucaaggaguuugcagccggcaggaaaagucugacccucaaucugaucacagaaauggggcggcuuccuacuuucaugacgcaaaaggcuaagaacgcccuggauaaucucgcagucuugcauaccgcggaggccggaggucgagcuuacaaccacgcccugagcgagcuaccggaaacacuggagacucuccuucuguuaaccuugcuggcaacaguuaccggcgggauuuuccucuuucugaugucgggaaaaggcaucgguaagaugacucuugggaugugcugcauaaucacggcuucuauucugcucugguaugcccagauccagccccacuggauugcagccuccaucauauuggaguucuuucugauuguguuacuaaucccagagccugaaaaacagagaaccccacaagacaaucagcugacauacguagugaucgcuauucucacugucguggcggccaccauggcaaacgagaugggcuuccuugagaagaccaagaaggauuuuggacugggcagcaucaccacucagcagccagaaucaaauauauuggacauugaucugcgcccugcuagugccuggacacucuacgccguugcaacgaccuucaucacucccaugcugaggcauucuauugagaacuccagcgugaaugucucacuuacagcuaucgccaaccaagcgaccguacucauggggcugggaaaggguuggccguugaguaaaauggacauaggcgugccacuguuagcuaucggguguuauagccagguuaauccuauuacccuaacagccgcacugcuccuucugguggcccacuacgcuaucauuggacccggcuugcaggcaaaggccacucgggaagcgcagaaacgugcugccgcagguaucaugaagaacccaacggucgacgggauuaccgugaucgaucuggaccccauaccuuaugauccgaaauuugagaagcaacucggccaggucaugcugcuuguguuaugcguuacacaggugcugaugaugagaacuaccugggcccucugugaggcuuugacacuggccaccggacccauuuccacucuaugggagggcaauccagggagguucuggaacacgacaaucgcaguaucuauggcuaacaucuuucgcggaagcuaccuggccggcgcgggucuccuuuucuccauuaugaagaauaccgccaacacucggcgagggaccggaaauacaggcgagacucugggugaaaaauggaagaacagauugaaugcacugggcaaaucagaguuucagauauauaagaaaucugggauccaagaaguggacaggacccucgcuaaggagggaauuaaacgcggcgagacagaucaucacgccgucagucgggggucggcaaagcugagaugguucguugaacguaacuuagugacgccugagggaaaggucguggaccuuggcugcgguaggggaggguggagcuacuauuguggcggucugaaaaauguaaaggaagugaaaggccucaccaaaggcgggcccgggcaugaggaaccuaucccaauguccacuuacggguggaaccuaguucggcugcagucuggaguggaugucuuuuucacacccccugagaaaugcgacaccuugcugugugauauuggcgagucaagcccaaaucccacuguggaagcuggucgcacacuccgaguccuuaaccugguggagaauugguugaacaauaacacccaguucugcaucaagguucugaauccguacaugccuuccguaauagaaaagauggaggcccuccaaagaaaauaugggggagccuuagugaggaacccacugagucggaacucuacgcacgaaauguacugggucagcaaugcgucaggcaacaucguguccaguguuaauaugauuagccgcaugcuuaucaacagauuuaccaugaggcacaagaaagcuacauaugagcccgacguggaucugggcucugggacucgaaauauuggaaucgaguccgaaaccccuaaccuagacauaauugguaagcggaucaaaaagaucaagcaggagcaugaaacaucauggcacuacgaucaggaccauccauauaaaacuugggcauaccacggcagcuaugagaccaagcagacagggucggccucuaguauggucaauggagugguacgucuccugaccaaacccugggacgugauuccgaugguuacucaaauggcuaugacggauacaaccccuuucggccagcagagagucuuuaaggaaaaaguggacacucgcacccaggagcccaaggaggguacaaagaaauugaugaagauaacggccgaauggcuguggaaagagcucgggaagaaaaagaccccaaggauguguacucgggaagaguucacaagaaaagugcgcuccaacgcagcccuuggagcuaucuuuaccgaugagaauaaguggaaaagcgcgagggaagccgucgaggacucaggcuucugggaacugguugauaaagagcgaaacuuacaccuggaaggcaagugcgagacuuguguguacaauaugauggggaaacgggagaagaaauugggagaauuugguaaggcaaagggcuccagagcuauuugguacauguggcucggggccagguuccuggaguuugaagcacuaggauuccuuaacgaggaccauugguuuucucgcgaaaauagccugaguggcguagagggugaggggcuccacaaacugggauauaucuugcgugauguguccaagaaagaaggcggcgccauguacgcugacgauacagccgggugggacacccggauuacacuggaggaucucaagaacgaagagauggucacuaaucauauggaaggagagcacaagaaacuugcggaggcaaucuucaaacugaccuaucaaaacaaagugguuagagugcagaggccuacgccccgcgguaccgucauggacauaaucagccgacgggaccagagaggcucuggacaggugguaacauacggauuaaacacuuuuaccaauauggaagcccaacugauuaggcagauggagggcgaagguguuuucaagucaauccagcaauugacagugaaagaggagauugcugucaagaacuggcucauccgcguggggagagaacggcugaguaggauggccauuuccggagaugacugcguggucaaaccacuagaugaccguuucgcaagcgcucuuacugcccugaaugauaugggcaagguucgaaaggacauacagcagugggagcccucucgcggcuggaacgauuggacccaggugccuuuuugcucgcaucacuuccacgaacucaucaugaaagacgggagaguacugguggucccaugucggaaucaagaugaguugauuggaagggcucgcaucucacagggugccggcuggagcuuaagagaaacggcaugccuggggaaguccuaugcgcagauguggagucucauguacuuucaucggagggaccuucgacuggccgcuaacgccaucuguucugcagugccgagccacuggguucccacaucccguaccacuuggucaauucaugcuacacacgaguggaugaccacugaggauaugcuaaccguguggaauagagucuggauacaggaaaacccuuggauggaggacaaaacaccaguggaaaguugggaggaaauccccuaucugggaaagcgcgaggaucaauggugcggcucucucauugguuugacgagccgggccaccugggccaaaaauauccagacugccauuaaccagguaaggucccugaucgggaaugaggaauacacagacuacaugccuucaaugaagagauuccgccgggaggaagaggaagcgggaguucuuugguga

SEQ ID NO: 14970 - RNA, 9876 nt, Artificial Sequence
  derived and/or modified CDS sequence (opt3) from DENV-2__KM279605__SS-prME
accgccggaaucauuauaaugaugauccccaccgugauggcuuuccaccugacuacgcgaaauggggaaccucauaugauugucagcaggcaggaaaagggaaagucccuccuuuuuaagaccgagaaugguguuaauaugugcacacugauggcaauggacuugggcgaauuaugugaggauacuaucaccuacaauugcccacugcugcggcaaaacgaaccggaggacauugauuguuggugcaauucuacaucaaccugggugacuuaugggacauguaccgccacgggagagcaccgccgagaaaaacguaguguggcgcucgugccccaugucggcaugggucuggagacuagaaccgaaacauggaugagcuccgagggggcuuggaagcacgcccagaggaucgagacuuggauacuucggcauccuggauucaccaucauggcagccauucuggcuuacacaaucggcaccacguauuuucagcgcguguugauuuucauccuccugacugcaguuacaccaucuauggccaugagaugcauaggcauuucgaacagggacuuuguggaaggggucucaggagguagcuggguggauaucguacuggagcacggcaguuguguuaccacuauggcuaaaaauaagcccacacucgacuucgaauuaauuaagaccgaggccaaacacccugcgacgcugcggaaguacugcguggaagcaaaacuuaccaacacaacuaccgccucccgcuguccaacacagggggagcccucuuugaaugaggaacaagauaagcgauuugucugcaaacauagcaugguggacagaggauggggcaacgguugugggcuguucggaaagggcggcaucgugacuugcgcuauguuuaccugcaagaaaaauauggaggggaaggucguucagccugaaaaccuagaguauacaaucgugauuaccccacacuccggagaagagaaugccguagguaacgauacuggcaaacaugggaaggagauaaaagugacgccgcagucaaguaucacagaagcagagcucaccggauacggcacugucaccauggaauguagccccaggacaggucuggacuucaaugagauggugcuucugcagauggaaaacaaggcuugguugguucaccggcaaugguuucucgaucugccuuuaccauggcugcccggggccgacacccagggcucuaacuggauucagaaagagacucucgugacauucaagaauccucacgcgaagaaacaggaugucgugguacuuggaucccaagagggcgccaugcauacggcacugaccggggcuacugaaauccagaugucaagcggaaacuugcuauuuacaggucaccugaagugccgucuccgcauggacaaacugcagcuuaagggcaugaguuauucuauguguaccgggaaauucaagguugugaaggagauagccgaaacacaacauggaacuauugucaucagagugcaguacgagggcgacgguuccccaugcaaaauccccuucgagauuauggaucuggaaaagaggcacgucuuggggcggcucaucaccgugaauccgauuguuacggagaaagacaacccugugaauauagaagcugagcccccauuuggcgauagcuacaucauuaucggaguagaaccuggccagcugaaguuaucgugguucaaaaaggggucuuccaucggacagauguuugagaccacaaugcgaggugccaagcgcauggcaauucugggcgacacugccugggauuucgggucacuaggaggcgucuuuaccaguauagguaaagcucuccaucaaguguucggggcgaucuauggcgcagccuuuagcggaguuuccuggacaaugaagauucugaucggcguggucauuacuuggaucgggaugaacucuagaagcaccucacuuaguguguccuugguacuggugggaguugucacgcucuaccugggcgugauggugcaggcugacagcgguugugucguuucuuggaaaaauaaggagcuuaaaugcgggucaggaauauucaucacagauaacgugcacaccuggacugaacaguauaaguuucagcccgagaguccaagcaagcuggccuccgcaauucaaaaagcccacgaagagggcaucugugguauuaggucugugacacgguuggaaaaucucauguggaagcagaucacccccgagcugaaccauauauuaacugagaaugaaguaaaacugaccauuaugacaggcgacaucaaggggauuaugcaggcuggaaaacgcucgcuaagaccucagccaacggagcucaaguacagcuggaaagccuggggcaaggcaaagaugcuguccaccgaacuucacaaccauacuuucuugaucgaugggccggagacagcggaaugccccaauaccaacagggcuuggaacucacuggaggucgaggacuauggauuuggcguguucacaacuaacauauggcucaaacugaaggaacgucaagauguauuuugugacaguaaauuaaugucugccgcaaucaaggacaaccgggccgugcacgcugauauggguuacuggauugagagcgcccugaaugacaccuggaaaaucgaaaaggcauccuucauugaggucaagucaugccacuggccuaaaagccauacgcuuuggucuaacgggguguuggaguccgaaaugaucauaccaaagaauuucgcuggacccguuagucagcacaacuaucgaccuggcuaccauacacagaccgccgguccauggcaccucggcagacuggagauggauuuugacuucugugaagggacuaccgugguagucacagaggauugcggaaauaggggccccagccuacgcacuaccacagcgucugggaaacugauuacggaauggugcugucgguccugcacccucccgccucugagauacaggggagaggacggcuguugguaugguauggagauccgcccacuuaaggaaaaagaggaaaacuugguaaauucacuggugacugccgggcauggacagaucgauaacuuuaguuuaggcguccucgguauggcucuguuccuugaggaaaugcugcgaacacggguuggcaccaagcacgcaauuuugcucguggccguuagcuuugugacucugaucacagggaauaugucguuccgugaccuaggaagagucauggugaugguuggcgcuaccaugacggaugacauugggaugggagugacuuaccuggcccuccuggcagcguuuaaggucaggcccaccuucgccgcuggccuuuugcugcgcaaauuaacauccaaggagcucaugaugaccacuauagguaucgugcugcuuucucaaagcacaauuccugagucaauccuggaacuaaccgaugcccucgcacuggggaugaugguuuugaaaauugugcggaacauggagaaguaucagcuggcugucacaaucauggccauauuaugcguacccaaugcagugauccucgaaaacgccuggaaaguuaguuguacuacccuggcuguggucuccgugucuccacuucuguugacgagcucccagcaaaaggcggacuggauuccucucgcccugacaaucaagggacuaaaucccaccgcaauuuuucugacuacccuuucaagaacaagcaaaaagaggaguuggccacucaacgaggcuaucauggccguaggcauggugucuauacuggccuccagcuugcugaaaaaugauauuccgaugacuggcccuuuagucgcugggggacuccugaccguuugcuacgugcuuacgggucgaucggcagaccuggaauuggagcgcgccgcggacgugcggugggaggaacaggcugagaucucaggcucuagucccauccucuccauuacaauaagcgaagaugggucuaugagcaucaagaacgaggaggaagaacagacccugacuauucuaaucagaacaggacugcuugucauuuccggccucuucccagugucaauccccauaaccgccgcagccugguaucugugggaaguuaaaaagcagagggcugguguauugugggacgugccuaguccacccccugucgggaaagcagaguuagaagauggagccuaccguaucaagcaaaagggcauucugggcuauagccagaucggggcgggaguguacaaagaggguacuuuucacacaauguggcauguuacccgcggcgcugugcucaugcacaaggggaaacggauugagccgucuugggccgacgucaagaaagaucugaucuccuacggaggcgguuggaaacuugaaggggaguggaaggaaggagaggaagugcagguacuggcauuggagccaggcaaaaaccccagagccguccagacgaagccuggccuauucaaaacuaauaccgggacaauaggagcugugucacuggacuuuaguccagguaccagcggcucccccauuguugauaagaaagggaagguggucggacucuauggcaacggugugguuacaaggucugggacuuacgugucggccaucgcacaaaccgaaaagagcaucgaagacaauccugagauugaagaugacaucuucagaaagaagcggcugacgauaauggaucuucauccgggagcuggcaaaacaaagcgcuauuuacccgccauugucagagaggcgaucaaaaggggccugcggacucucauuuuggccccaacccgagugguagcagcugaaauggaggaggcccugagagggcucccuauccgcuaccagacacccgcuauaagggcagaacacaccggacgugagauuguggaccugaugugucaugccacuuucaccaugcggcuucugucaccaaucagaguuccuaacuauaauuugaucauuauggaugaagcccacuuuacagaccccgcuuccaucgcggcaagggguuacauuaguacgcgcgucgagaugggcgaggccgcugggauauucaugacugccaccccaccgggaucucgagacccuuuuccccagagcaacgcaccaaucauggaugaagagagagaaauucccgagcgguccuggaacucaggccacgaaugggugacagacuucaaggguaagaccgugugguuugucccuucuaucaaagccgggaacgauaucgcugcgugccuaaggaagaauggcaagaagguaauucagcugagccgcaaaacuuucgacagugaguauauaaagacacguaccaacgauugggacuuugugguuacgacugauaucuccgagaugggcgccaauuucaaggcagaaagagugauugacccacggagguguaugaaacccgucauccucacagauggcgaggaacgcgugauuuuagcugggccuaugccgguuacccauagcucugccgcacaacgaagaggacggguggguaggaacccaaagaaugagaacgaccaguacaucuacaugggcgaaccccuggagaaugaugaggacugcgcccacuggaaagaagcuaagaugcuucuggacaacauaaacaccccugaggggaucauucccucaauguuugaaccagagcgcgaaaaagucgaugccaucgacggagaguauagacucaggggcgaggcgcggaagacuuucguggauuugaugcgucgcggugaccugccuguauggcucgcauacaaaguggccgcugaagggauuaauuaugccgaucgaagaugguguuuugacggcguuaagaacaaucagauccuggaggaaaacgucgagguggagauauggacaaaggaaggagagaggaagaaacuuaaaccccgguggcuagaugcucgcauuuacuccgacccacuggcauugaaagaguucaaagaguucgccgcuggcagaaagaguuuaacccugaaucucaucacagaaauggggaggcugccuacuuuuaugacgcaaaaggccaaaaacgcacuugauaaucuggcggugcuccauaccgccgaggcuggaggucgggccuauaaccacgcauugagcgagcugccggaaacacuagagacucugcuccuucugaccuuauuggcuacagucaccggcgggauuuuccuguuucucaugucgggaaagggcaucgguaaaaugacucuggggaugugcugcauaaucacggccucuauucuucugugguacgcacagauccagccccacuggauugccgcuuccaucauacucgaguucuuuuugauuguucuguuaaucccagagccugaaaagcagcgaacaccccaagacaaucagcuaacauaugugguaaucgcgauucugacuguggucgccgcaaccauggcuaacgagaugggcuuccucgagaaaacaaagaaggauuuuggacuuggcagcaucaccacucagcagccagaaucaaauauacuggacauugauuugagaccugccagugccuggacacuguacgcaguggcuacgaccuucaucacucccaugcuccgccauucuauugagaacuccagcguuaaugugucacugacagccaucgcgaaccaagcuaccguccuuauggggcucggaaaagguuggccgcugaguaagauggacauaggcguaccauugcuggccaucggguguuacagccaggugaauccuauuaccuuaacagcagcccuacugcuccuuguugcucacuaugcaaucauuggacccggccugcaggccaaagcgacuagggaagcucagaagcgggccgcagccgguaucaugaaaaacccaacgguggacgggauuaccgucaucgauuuggaccccauaccuuacgauccgaaguuugagaagcaacugggccaggugaugcuccugguccuuugcgugacacagguuuuaaugaugcguacuaccugggcucugugugaagcccucacauuggcaaccggacccauuuccacucugugggagggcaauccagggagauucuggaacacgacaaucgcugugucuauggccaacaucuuuaggggaagcuaucuagcgggcgccggucuacucuucuccauuaugaaaaauaccgcaaacacucgccgggggaccggaaauacaggcgagacucuuggugaaaaguggaaaaaccgacugaaugcuuugggcaagucagaguuucagauauacaaaaagucugggauccaagaaguagacagaacccuggccaaagagggaauuaagaggggcgagacagaucaucacgcagugagucgcgggucggcuaagcuccggugguucgucgaaagaaaccugguuacgccugagggaaaaguggucgacuuaggcugcggucgugggggauggagcuauuacuguggcggucuuaagaaugugaaagaaguaaagggccugaccaaagggggacccggccaugaggaaccuaucccaauguccacuuauggguggaaccucgugaggcuacagucuggaguugauguguucuuuacacccccugagaagugcgacacccuguugugugauauuggcgagucaagcccaaaucccacugucgaagccggucggacacugcgcgugcucaaccuugucgagaauuggcugaacaauaacacccaguucugcaucaagguguugaauccguacaugccuuccguuauagagaagauggaggcccugcaacgaaaguacgggggagcgcucguaagaaacccauuaaguaggaacucuacgcacgaaauguauugggugagcaaugcuucaggcaacaucgucuccagugugaauaugauuagccggaugcugaucaaccgcuuuaccaugagacacaaaaaggcaacauacgagcccgacguugaucuuggcucugggacuaggaauauuggaaucgaguccgaaaccccuaaccuggacauaauugguaaacgaaucgagaagaucaagcaggaacaugagacaucauggcacuaugaucaggaccauccauacaaaacuugggccuaucacggcagcuacgaaaccaagcagacagggucggcuucuaguauggugaauggagucgugcggcuacucaccaaacccugggacguaauuccgauggugacucaaauggccaugacggauacaaccccuuucggccagcagcguguuuuuaaggagaaagucgacacuagaacccaggagcccaaggaagguacaaagaaacugaugaagauaacggcagagugguuguggaaagaacuggggaagaaaaagaccccacgcauguguacuagggaggaguucacacggaaagugagauccaacgccgcucucggagcgaucuuuaccgaugaaaauaaguggaaaagcgcccgcgaggcaguggaagacucaggcuucugggagcuugucgauaaagaaaggaaccugcacuuagagggcaagugcgagacuuguguuuauaauaugauggggaaacgagaaaagaaacugggagaguuugguaaggcuaagggcucccgggccauuugguacaugugguugggggcaagauuccucgaauuugaggcccugggauuccuaaacgaagaccauugguuuucuagggagaauagccuuaguggcguggagggugaagggcugcacaaacucggauacauccugcgcgauguauccaagaaagagggcggcgcuauguaugccgacgauacagcggggugggacacccguauuacauuggaagaucugaagaacgaggaaauggugacuaaucauauggagggagagcacaaaaagcucgcagaagccaucuucaaacuuaccuaccaaaacaaagucgugcggguucagagaccuacgcccagggguaccgugauggacauaaucagccgccgagaccagcggggcucugggcaggucgugacauauggacugaacacuuucaccaauauggaggcucaauuaauuagacagauggaaggcgaggguguauuuaagucaauccagcaacugacaguuaaagaggaaauugccgugaagaacugguugaucagggucgggcgcgagagacucagucggauggcaauuuccggagaugacugcguggugaaaccacuggaugacagguucgcuagcgcccuaacugcucuuaaugauaugggcaagguccguaaggacauacagcagugggaacccucucgaggcuggaacgauuggacccagguuccuuuuugcucgcaucacuuccacgagcugaucaugaaagacgggcgcgugcucguagugccauguagaaaucaagaugaacugauuggacgggccaggaucucacagggugcaggcuggagcuugcgcgagacggcgugcuuagggaaguccuacgcccagauguggagucugauguauuuucauagacgggaccucaggcuugcugccaacgcaaucuguucugcugucccgagccacugggugcccacaucccgaaccacuuggucaauucaugccacacacgaguggaugaccacugaagauaugcugaccguuuggaaucguguguggauacaggagaacccuuggauggaagacaaaacaccagucgagaguugggaagagauccccuaccuaggaaagagagaggaucaauggugcggcucucugauuggucucacgagccgcgcaaccugggccaaaaauauccagacugcgauuaaccaggugcgguccuugaucgggaaugaagaguauacagacuacaugccuucaaugaagagguucagacgcgaagaggaagaggcuggaguacugugguga

SEQ ID NO: 14971 - RNA, 9876 nt, Artificial Sequence
  derived and/or modified CDS sequence (opt3) from DENV-2__KM279609__SS-prME
accgccggaaucauuauaaugaugauccccacagugauggcuuuccaccugacuacgcgaaacggggagccucauaugauugucagcaggcaggaaaagggaaaaucccuccuuuuuaagaccgagaaugguguuaacaugugcacacugauggcaauggacuugggcgaauuaugugaggauacuaucaccuacaauugcccacuguuacggcaaaacgaaccggaggacauugauuguuggugcaauucuacaucaaccugggugacuuaugggacauguaccgccacgggagagcaccgccgagaaaaacguaguguugcgcucgugccccaugucggcaugggucuggagacuagaaccgaaacauggaugagcuccgagggggcuuggaagcacgcccagaggaucgagacuuggauacuucggcauccuggauucaccaucauggcagccauucuggcuuacacaaucggcaccacguauuuucagcgcguguugauuuucauccuccugacugcaguuacaccaucuauggccaugaggugcauaggcauuucgaacagggacuuuguggaaggggucucaggagguagcuggguggauaucguacuggagcacggcaguuguguuaccacuauggcuaaaaauaagcccacacucgacuucgaauuaauuaagaccgaggccaaacaccuggcgacgcuucggaaguacugcguggaagcaaaauugaccaacacaacuaccgccucccgcuguccuacacagggggagccaucucugaaugaggaacaagauaagcgauuugucugcaaacauagcaugguggacagaggauggggcaacgguugugggcuauucggaaagggcggcaucgugacuugcgcuauguuuaccugcaagaaaaauauggaggggaaggucguucagcccgaaaaccucgaguauacaaucgugauuaccccucacuccggagaagagaaugccguagguaacgauacuggcaaacaugggaaggagauaaaagugacgccacagucaaguaucacagaagcagagcugaccggauacggcacugucaccauggaauguagcccgaggacaggucuugacuucaaugagauggugcuguugcagauggaaaacaaggcuuggcucguucaccggcaaugguuucuggauuuaccccugccuuggcucccaggggccgacacccagggcucuaacuggauucagaaagagacucuugugacauucaagaauccccacgcgaagaaacaggaugucgugguacugggaucccaagagggcgccaugcauacggcauugaccggggcuacugaaauccagaugucaagcggaaaccuacuguuuacaggucaccucaagugccgucugcgcauggacaaacuucagcugaagggcaugaguuauucuauguguaccgggaaauucaagguugugaaggagauagccgaaacacaacauggaacuauugucaucagagugcaguacgagggcgacgguuccccuugcaaaaucccauucgagauuauggauuuggaaaagaggcacguccucgggcggcugaucaccgugaaucccauuguuacggagaaagacagcccggugaacauagaagcugagccucccuuuggcgauucguacaucauuaucggaguagaaccaggccaguuaaagcugucuugguucaaaaagggguccucaaucggacagauguuugagaccacaaugcgaggugccaagcgcauggcaauucuaggcgacacugccugggauuucgggagucucggaggcgucuuuaccagcauagguaaagcucugcaucaaguguucggggcgaucuauggcgcagccuuuuccggaguuucuuggacaaugaagauucuuaucggcguggucauuacuuggaucgggaugaauagcagaucaaccaguuuguccgugagccugguacucgugggaguugucacgcuguaccuuggcgugauggugcaggcugacucugguugugucguuucauggaaaaacaaggagcugaaaugcgggaguggaauauucaucacagauaaugugcacaccuggacugaacaguauaaguuucagccugagagccccuccaaguuggccucugcaauucaaaaagcccacgaagagggcaucugugguauuaggucggugacacggcucgaaaaccugauguggaagcagaucaccccagaguuaaaucauauacugacugagaacgaaguaaaacuaaccauuaugacaggcgacaucaaggggauuaugcaggcuggaaaacgcagccucagaccccagccuacggagcugaaguacuccuggaaagccuggggcaaggcaaagaugcuuucaaccgaauugcacaaucauacuuuccugaucgaugggccagagacagcggaaugcccgaacaccaauagggcuuggaacagucucgaggucgaggacuauggauuuggcguguucacaacuaauauauggcugaaauuaaaggaacgucaagauguauuuugugacucuaaacugaugagcgccgcaaucaaggacaaccgggccgugcacgcugauauggguuacuggauugaguccgcccuuaacgacaccuggaaaaucgaaaaggcaucauucauugaggucaagagcugccacuggcccaaaucucauacguugugguccaauggggugcucgagagugaaaugaucauaccuaagaacuucgcuggaccaguuagccagcacaauuaucgacccggcuaccauacacagaccgccgguccuuggcaccugggcagacuagagauggauuuugacuucugugaagggacuaccgugguagucacagaggauugcggaaacaggggcccaucucugcgcacuaccacagcguccgggaaacucauuacggaauggugcugucggucaugcacccugcccccgcuuagauacaggggagaggacggcuguugguaugguauggagauccgcccuuugaaggaaaaagaggaaaaucuggugaacaguuuagugacugccgggcauggacagaucgauaauuuuagccucggcguccuggguauggcucuuuuccuggaggaaauguugcgaacacggguuggcaccaagcacgcaauucuccugguggccguaucguuugugacucuaaucacagggaacauguccuuccgugaccugggaagagucauggugaugguuggcgcuaccaugacggaugacauugggaugggagugacuuaccucgcccugcuugcagcguuuaaggucaggccaaccuucgccgcuggcuugcuguuacgcaaacucacaucuaaggagcugaugaugaccacuauagguaucgugcuucugagccaaucaacaauucccgagaguauccuagaacucaccgaugcccuggcauuggggaugaugguucugaaaauugugcggaauauggagaaguaucaguuagcugucacaaucauggccauacucugcguaccuaacgcagugauccugcagaaugccuggaaaguuuccuguacuacccuugcuguggucucugugagcccccuguugcucacguccucacaacagaaggcggacuggauuccacuggcccuaacaaucaagggacugaacccuaccgcaauuuuucuuacuacccucagcagaacaaguaaaaagaggucuuggccccugaaugaagcuaucauggccguaggcaugguguccauauuggccagcucgcugcuaaagaacgauauuccaaugacuggcccgcucgucgcugggggacugcuuaccguuugcuacgugcugacgggucgaucagcagacuuggagcucgaacgcgccgcggacgugcggugggaggagcaggcugaaaucucuggcaguuccccuauccugagcauuacaauaucugaggaugggagcauguccaucaagaaugaagaggaggaacagacccuaacuauucugaucagaacaggacuucucgucauuucaggccuguuccccgugaguaucccaauaaccgccgcagccugguauuugugggagguuaaaaagcaaagggcugguguauuaugggacgugcccagcccuccacccgucgggaaagcagaacuggaggauggagccuaccguaucaagcagaagggcauucucggcuauucucagaucggggcgggaguguacaaagaagguacuuuucacacaauguggcauguuacccgcggcgcugugcugaugcacaaggggaaacggauugagccuuccugggccgacgucaagaaagaucuuaucucauacggaggcgguuggaagcuggagggggaauggaaggagggagaagaggugcagguauuggcacuagaaccgggcaaaaacccaagagccguccaaacgaagcccggccuguucaaaacuaacaccgggacaauaggagcugugagucucgacuuuagcccugguaccuccggcucuccaauuguugauaagaaagggaagguggucggacuguauggcaauggugugguuacaaggucggggacuuacgugagcgccaucgcacagaccgagaagucaaucgaggacaaccccgaaauugaggaugacaucuuccggaaaaagagacuuacgauaauggauuuacauccuggagcuggcaaaacaaagcgcuaucugccggccauugucagagaagcgaucaaaaggggccuccggacuuugauucuggcccccacccgagugguagcagcugagauggaagaggcccucagagggcugccaauccgcuaccagaccccugcuauaagggcagagcacaccggacgugaaauuguggaccuuaugugucaugccacuuucaccaugcggcuguugucccccaucagaguuccaaauuauaaccuaaucauuauggaugaggcccacuuuacagacccugcuaguaucgcggcaagggguuacauuucuacgcgcgucgaaaugggcgaggccgcugggauauucaugacugccacacccccaggaagccgagacccguuuccucaguccaaugcacccaucauggaugaggaaagagagauuccagaacggucauggaacucuggccacgagugggugacagacuucaaggguaagaccgugugguuuguccccagcaucaaagccgggaaugauaucgcugcgugccugaggaagaacggcaaaaagguaauucaacucagucgcaaaacuuucgacuccgaauauauaaagacacguaccaaugauugggacuuugugguuacgacugauaucagcgagaugggcgccaacuucaaggcagagagagugauugacccucggagguguaugaaaccagucaucuuaacagauggcgaagaacgcgugauucuggcugggcccaugccuguuacccauucuucagccgcacagcgaagaggacggguggguaggaauccgaagaacgaaaaugaccaguacaucuacaugggcgagccacuugaaaacgaugaggacugcgcccacuggaaagaggcuaagaugcugcucgacaauauaaacacccccgaagggaucauuccuuccauguuugagcccgaacgcgagaaagucgaugccaucgacggagaauauagauugaggggcgaggcgcggaagacuuucguggaucugaugcgucgcggugaccucccaguauggcuggcauaccgaguggccgcugaggggauuaacuaugccgauagaaggugguguuuugacggcguuaaaaauaaccaaauccuugaagagaaugucgaaguggagauauggacaaaggagggagaacggaagaaacuaaagccucgcuggcuggaugcuagaauuuacagugaccccuuggcauuaaaagaguucaaggaguucgccgcuggcaggaaaagccugacccucaaccugaucacagagauggggcggcuuccaacuuuuaugacgcagaaggccaagaaugcacuggauaaccucgcgguguugcauaccgccgaagcuggaggucgagccuauaaucacgcacugucggagcuaccugagacacuggaaacucuccuucuguuaaccuugcuggcuacagucaccggcgggauuuuccucuuucugaugucuggaaaaggcaucgguaagaugacucuugggaugugcugcauaaucacggccuccauucugcucugguacgcacagauccagccgcacuggauugccgcuagcaucauauuggaguucuuucugauuguuuuacuaauccccgaaccagagaaacaaagaaccccucaggacaaccagcugacauaugugguaaucgcgauucucacuguggucgccgcaaccauggcuaaugaaaugggcuuccuugagaagaccaaaaaggauuuuggacugggcucaaucaccacucagcaacccgagaguaacauauuggacauugaucugcgcccagccucugccuggacacucuacgcaguggcuacgaccuucaucacuccuaugcugaggcauuccauugaaaauagcucaguuaacgugagucuuacagccaucgcgaaucaggcuaccguccucauggggcugggaaaggguuggcccuugagcaaaauggacauaggcguaccgcuguuagccaucggguguuacucccaggugaacccaauuacccuaacagcagcccugcuccuucugguugcucacuaugcaaucauuggaccuggcuugcaggccaaggcgacucgggaggcucaaaaacgugccgcagccgguaucaugaagaaucccacgguggacgggaugaccgucauugaucuggacccaauccccuacgauccuaaauuugaaaagcagcucggccaggugaugcugcuugucuuaugcgugacacagguucugaugaugagaacuaccugggcucucugugaggccuugacacuggcaaccggaccgauaucuacucuaugggaaggcaaccccgggagguucuggaauacgacaauugcugugagcauggccaacaucuuucgcggauccuaucuggcgggcgccggucuccuuuucucaaucaugaagaacaccgcaaauacucggcgagggaccggaaacacaggcgagacucugggugagaaauggaagaauagauugaacgcucugggcaaaucugaauuucaaauuuacaagaaaagugggauacaggagguagacaggacccucgccaaggaaggaaucaaacgcggcgagacagaucaucacgcagugucgcgggggagcgcuaagcugagaugguucgucgagcguaauuuaguuacgccagaaggaaagguggucgaccuuggcugcgguagagggggaugguccuauuacuguggcggucugaaaaacgugaaggagguaaaaggccucaccaaagggggaccuggccaugaagaacccauuccuaugucuacuuauggguggaaucuagugcggcugcagucaggaguugauguguucuuuacaccacccgaaaaaugcgacaccuugcugugugauaucggcgagagcuccccuaacccaacugucgaggccggucgcacacuccgagugcuuaaucuggucgaaaacugguugaauaacaauacccaauucugcauuaaggugcugaaccccuacaugccgaguguuaucgagaagauggaagcccuccagagaaaauacgggggagcguuaguaaggaauccucugucucggaacagcacgcacgagauguauugggugucaaacgcuuccggcaauauagucaguagcgugaacaugaucucucgcaugcuuauuaauagauuuaccaugaggcacaagaaagcaacauacgaaccagacguugaucugggcuccgggacucgaaacaucggaauugagucagagacccccaaucuagacaucauagguaagcggauugagaaaaucaagcaggagcaugaaacaagcuggcacuaugaucaggaccauccuuacaagacuugggccuaucacggcucguacgagaccaaacaaacagggucugcuaguuccauggugaacggagucgugcgucuccugaccaagccaugggacguaauccccauggugacucagauggccaugacggauacaaccccguucggccagcagagaguuuuuaaagaaaaggucgacacucgcacccaagagccuaaagaggguacaaagaaguugaugaaaauuacggcagaauggcuguggaaggagcucgggaaaaagaaaacccccaggauguguacucgggaagaguucacaagaaaggugcgcagcaaugccgcucuuggagcgauauuuaccgaugagaacaaauggaagucagccagggaagcaguggaggacuccggcuucugggaacuggucgauaaggagcgaaauuuacaccuggaaggcaaaugcgagacuuguguuuauaacaugauggggaagcgggagaaaaaguugggagaauuugguaaagcuaagggcucuagagccaucugguacauguggcucggggcaagguuccuggaguuugaagcccuaggauuccuuaaugaggaccauugguuuagccgcgaaaacagucuguccggcguggagggugaggggcuccacaagcugggauacauuuugcgugauguaagcaaaaaggaaggcggcgcuauguaugccgacgauacagcggggugggacacccggaucacacuggaggaucucaaaaaugaagagauggugacuaaccauauggaaggagagcacaagaaacuugcagaggccauuuucaagcugaccuaccagaauaaggucgugagaguucagaggccaacgccucgcgguaccgugauggacaucauaucucgacgggaccagagaggcucagggcaagucgugacauauggauuaaacacuuucaccaacauggaagcucagcugaucaggcagauggagggcgaagguguauuuaaaaguauucaacaguugacaguuaaggaggagaucgccgugaaaaauuggcucauucgcgucgggagagaacggcuguccaggauggcaaucagcggagaugacugcguggugaagccccuagaugaccguuucgcuucugcccuuacugcucugaacgauaugggcaaaguccgaaaggacauucagcagugggagccaucgcgcggcuggaaugauuggacccaaguucccuuuugcucacaucacuuccacgaacucauaaugaaggacgggagagugcugguagugccuugucggaaccaggaugaguugaucggaagggcccgcauuagccagggugcaggcugguccuuaagagaaacggcgugccuggggaaaaguuacgcccagauguggucucucauguauuuucaucggagggaccuucgacuggcugccaaugcaaucuguagcgcugucccaucccacuggaucccgacaucacguaccacuuggaguauucaugccacacacgaguggaugaccacugaggauaugcuaaccguguggaacagaguuuggauacaagaaaaucccuggauggaggacaagacaccuguggaaucuugggaggaaaucccauaccugggaaaacgcgaggaucaguggugcggcagccucauugguuugacgucccgggcaaccugggccaagaacauccagacugcgauuaaucaggucaggucacugaucgggaacgaggaauauacagacuacaugcccagcaugaaaagauuccgccgggaggaagaggaagcuggagugcuuugguga

SEQ ID NO: 14972 - RNA, 9876 nt, Artificial Sequence
  derived and/or modified CDS sequence (opt3) from DENV-2__KM279607__SS-prME
accgccggaaucauuauaaugaugauccccaccgugauggcuuuccaccugacuacgagaaauggggaaccucauaugauugucagcaggcaggaaaagggaaaaucccuccuuuuuaagaccgaaaaugguguuaauaugugcacacugauggcaauggacuugggcgaauuaugugaggauacuaucaccuacaauugcccacuguuacggcaaaacgaaccggaggacauugauuguuggugcaauucuacaucaaccugggugacuuaugggacauguaccgccacgggagagcaccgccgagaaaaacguaguguggcgcucgugccccaugucggcaugggucuggagacuagaaccgaaacauggaugagcuccgagggggcuuggaagcacgcccagaggaucgagacuuggauacuucggcauccuggauucaccaucauggcagccauucuggcuuacacaaucggcaccacguauuugcagcgcgugcucauuuuuauccugcugacugcaguuacaccaucuauggccaugagaugcauaggcauuucgaacagggacuucguggaaggggucucaggagguagcuggguggauaucguacucgagcacggcaguuguguuaccacuauggcuaaaaauaagcccacauuagacuuugaacugauuaagaccgaggccaaacacccugcgacgcuucggaaguacugcguggaagcaaaauugaccaacacaacuaccgccucccgcuguccaacacagggggagcccucucugaaugaggaacaagauaagcgauucgucugcaaacauagcaugguggacagaggauggggcaacgguugugggcuauuuggaaagggcggcaucgugacuugcgcuauguucacaugcaagaaaaauauggaggggaaggucguucagccugaaaaccucgaguauacaaucgugauuaccccacacuccggagaagagaaugccguagguaacgauacuggcaaacaugggaaggagauaaaagugacgccgcagucaaguaucacagaagcagagcugaccggauacggcacugucaccauggaauguagccccaggacaggucuugacuuuaaugagauggugcuguugcagauggaaaacaaggcuuggcucguucaccggcaaugguuccuggauuuaccucugccauggcuccccggggccgacacccagggcucuaacuggauucagaaagagacucuugugacauuuaagaauccucacgcgaagaaacaggaugucgugguacugggaucccaagagggcgccaugcauacggcauugaccggggcuacugaaauccagaugucaagcggaaaccuacuguucacaggucaccucaagugccgucugcgcauggacaaacuucagcugaagggcaugaguuauucuauguguaccgggaaauuuaagguugugaaggagauagccgaaacacaacauggaacuauugucaucagagugcaguacgagggcgacgguuccccaugcaaaauccccuucgagauuauggauuuggaaaagaggcacguccucgggcggcugaucaccgugaauccgauuguuacggagaaagacaacccugugaauauagaagcugagcccccauucggcgauagcuacaucauuaucggaguagaaccuggccaguuaaagcugucgugguauaaaaaggggucuuccaucggacagauguuugagaccacaaugcgaggugccaagcgcauggcaauucuaggcgacacugccugggauuucgggucacucggaggcgucuuuaccaguauagguaaagcucugcaucaaguguucggggcgaucuacggcgcagccuuuagcggaguuuccuggacaaugaagauucuuaucggcguggucauuacuuggaucgggaugaacucuagaagcaccucauugagugugucccugguacucgugggaguugucacgcuguaucuuggcgugauggugcaggcugacagcgguugugucguuucuuggaaaaauaaggagcugaaaugcgggucaggaauauucaucacagauaacgugcacaccuggacugaacaguacaaguuucagcccgagaguccaagcaaguuggccuccgcaauucaaaaagcccacgaagagggcaucugugguauuaggucugugacacggcucgaaaaucugauguggaagcagaucacccccgaguuaaaccauauacugacugagaaugaaguaaaacuaaccauuaugacaggcgacaucaaggggauuaugcaggcuggaaaacgcucgcucagaccucagccaacggagcugaaguauagcuggaaagccuggggcaaggcaaagaugcuuuccaccgaauugcacaaccauacuuuccugaucgaugggccggagacagcggaaugccccaauaccaacagggcuuggaacucacucgaggucgaggacuacggauuuggcguguucacaacuaacauauggcugaaauuaaaggaacgucaagauguauuuugugacaguaaacugaugucugccgcaaucaaggacaaccgggccgugcacgcugauauggguuauuggauugagagcgcccuuaaugacaccuggaaaaucgaaaaggcauccuucauugaggucaagucaugccacuggccuaaaagccauacguuguggucuaacggggugcucgaguccgaaaugaucauaccaaagaauuuugcuggacccguuagucagcacaacuaccgaccuggcuaccauacacagaccgccgguccauggcaccugggcagacuagagauggauuucgacuucugugaagggacuaccgugguagucacagaggauugcggaaauaggggccccagccugcgcacuaccacagcgucugggaaacucauuacggaauggugcugucgguccugcacccugccgccucuuagauauaggggagaggacggcuguugguacgguauggagauccgcccauugaaggaaaaagaggaaaaccugguaaauucauuagugacugccgggcauggacagaucgauaacuuuagucucggcguccuggguauggcucuuuuccuggaggaaauguugcgaacacggguuggcaccaagcacgcaauucuccugguggccguuagcuuugugacucuaaucacagggaauaugucguuccgugaccugggaagagucauggugaugguuggcgcuaccaugacggaugacauugggaugggagugacuuaucucgcccugcuugcagcguuuaaggucaggcccaccuucgccgcuggcuugcuguuacgcaaacucacauccaaggagcugaugaugaccacuauagguaucgugcuucugucucaaagcacaauuccugagucaauccuagaacucaccgaugcccuggcauuggggaugaugguucugaaaauugugcggaacauggagaaguaccaguuagcugucacaaucauggccauacucugcguacccaaugcagugauccuggaaaacgccuggaaaguuaguuguacuacccuugcuguggucuccgugucuccacuguugcucacgagcucccagcaaaaggcggacuggauuccucuggcccuaacaaucaagggacugaaucccaccgcaauuuuucuuacuacccucucaagaacaagcaaaaagaggaguuggccacugaacgaggcuaucauggccguaggcauggugucuauauuggccuccagccugcuaaagaaugauauuccgaugacuggcccucucgucgcugggggacugcuuaccguuugcuaugugcugacgggucgaucggcagacuuggaacucgagcgcgccgcggacgugcggugggaggaacaggcugagaucucaggcucuagucccauccuguccauuacaauaagcgaagaugggucuaugagcaucaagaacgaggaggaagaacagacccuaacuauucugaucagaacaggacuucucgucauuuccggccuguucccagugucaauccccauaaccgccgcagccugguacuugugggaaguuaaaaagcagagggcugguguauuaugggacgugccuaguccacccccugucgggaaagcagagcuggaagauggagccuaucguaucaagcaaaagggcauucucggcuacagccagaucggggcgggaguguacaaagaggguacuuuucacacaauguggcauguuacccgcggcgcugugcugaugcacaaggggaaacggauugagccgucuugggccgacgucaagaaagaucuuaucuccuauggaggcgguuggaagcuggaaggggaguggaaggaaggagaggaagugcagguauuggcacuagagccaggcaaaaaccccagagccguccagacgaagccuggccuguucaaaacuaauaccgggacaauaggagcugugucacucgacuuuaguccagguaccagcggcucccccauuguugauaagaaagggaagguggucggacuguacggcaacggugugguuacaaggucugggacuuaugugucggccaucgcacaaaccgaaaagagcaucgaagacaauccugagauugaagaugacaucuuccggaaaaagagacuuacgauaauggauuuacauccgggagcuggcaaaacaaagcgcuaccugcccgccauugucagagaggcgaucaaaaggggccuccggacuuugauucuggccccaacccgagugguagcagcugaaauggaggaggcccucagagggcugccuauccgcuaucagacacccgcuauaagggcagaacacaccggacgugagauuguggaccuuaugugucaugccacuuuuaccaugcggcuguugucaccaaucagaguuccuaacuacaaucuaaucauuauggaugaagcccacuucacagaccccgcuuccaucgcggcaagggguuauauuaguacgcgcgucgagaugggcgaggccgcugggauauucaugacugccaccccaccgggaucucgagacccuuuuccccagagcaacgcaccaaucauggaugaagagagagaaauucccgagcgguccuggaacucaggccacgaaugggugacagacuucaaggguaagaccgugugguuugucccuucuaucaaagccgggaacgauaucgcugcgugccugaggaagaauggcaaaaagguaauucagcucagccgcaaaacuuucgacagugaguacauaaagacacguaccaacgauugggacuuugugguuacgacugauaucuccgagaugggcgccaauuucaaggcagaaagagugauugacccacggagguguaugaaacccgucaucuuaacagauggcgaggaacgcgugauucuggcugggccuaugccgguuacccauagcucugccgcacaacgaagaggacggguggguaggaacccaaagaaugagaacgaccaguacaucuauaugggcgaaccccuugagaaugaugaggacugcgcccacuggaaagaagcuaagaugcugcucgacaacauaaacaccccugaggggaucauucccucaauguuugaaccagagcgcgaaaaagucgaugccaucgacggagaguacagauugaggggcgaggcgcggaagacuuucguggaucugaugcgucgcggugaccucccuguauggcuggcauauaaaguggccgcugaagggauuaauuacgccgaucgaagaugguguuuugacggcguuaagaacaaucagauccuugaggaaaacgucgagguggagauauggacaaaggaaggagagaggaaaaagcuaaaaccccgguggcuggaugcucgcauuuauuccgacccauuggcauuaaaggaguucaaagaguuugccgcuggcagaaagagucugacccucaaucugaucacagaaauggggaggcuuccuacuuucaugacgcaaaaggccaaaaacgcacuggauaaucucgcgguguugcauaccgccgaggcuggaggucgggccuacaaccacgcacugagcgagcuaccggaaacacuggagacucuccuucuguuaaccuugcuggcuacagucaccggcgggauuuuccucuuucugaugucgggaaagggcaucgguaaaaugacucuugggaugugcugcauaaucacggccucuauucugcucugguaugcacagauccagccccacuggauugccgcuuccaucauauuggaguucuuucugauuguuuuacuaaucccagagccugaaaagcagcgaacaccccaagacaaucagcugacauacgugguaaucgcgauucucacuguggucgccgcaaccauggcuaacgagaugggcuuccuugagaaaacaaagaaggauuuuggacugggcagcaucaccacucagcagccagaaucaaauauauuggacauugaucugagaccugccagugccuggacacucuacgcaguggcuacgaccuucaucacucccaugcugcgccauucuauugagaacuccagcguuaaugugucacuuacagccaucgcgaaccaagcuaccguccucauggggcugggaaaagguuggccguugaguaagauggacauaggcguaccacuguuagccaucggguguuauagccaggugaauccuauuacccuaacagcagcccugcuccuucugguugcucacuacgcaaucauuggacccggcuugcaggccaaagcgacuagggaagcucagaagcgggccgcagccgguaucaugaaaaacccaacgguggacgggauuaccgucaucgaucuggaccccauaccuuaugauccgaaguuugagaagcaacucggccaggugaugcugcuugucuuaugcgugacacagguucugaugaugcguacuaccugggcucucugugaagccuugacacuggcaaccggacccauuuccacucuaugggagggcaauccagggagauucuggaacacgacaaucgcugugucuauggccaacaucuuuaggggaagcuaccuggcgggcgccggucuccuuuucuccauuaugaaaaauaccgcaaacacucgccgggggaccggaaauacaggcgagacucugggugaaaaguggaaaaaccgauugaaugcucugggcaagucagaguuucagauauauaaaaagucugggauccaagaaguagacagaacccucgccaaagagggaauuaagaggggcgagacagaucaucacgcagugagucgcgggucggcuaagcugcggugguucgucgaaagaaacuuaguuacgccugagggaaaaguggucgaccuuggcugcggucgugggggauggagcuacuauuguggcggucugaagaaugugaaagaaguaaagggccucaccaaagggggacccggccaugaggaaccuaucccaauguccacuuacggguggaaccuagugaggcugcagucuggaguugauguguuuuucacacccccugagaagugcgacaccuugcugugugauauuggcgagucaagcccaaaucccacugucgaagccggucggacacuccgcgugcuuaaccuggucgagaauugguugaacaauaacacccaguucugcaucaaggugcugaauccguacaugccuuccguuauagagaaaauggaggcccuccaacgaaaguaugggggagcguuaguaagaaacccacugaguaggaacucuacgcacgaaauguacugggugagcaaugcuucaggcaacaucgucuccagugugaauaugauuagccggaugcuuaucaaccgcuuuaccaugagacacaaaaaggcaacauaugagcccgacguugaucugggcucugggacuaggaauauuggaaucgaguccgaaaccccuaaccuagacauaauugguaaacgaaucgagaagaucaagcaggaacaugagacaucauggcacuacgaucaggaccauccauauaaaacuugggccuaccacggcagcuaugaaaccaagcagacagggucggcuucuaguauggugaauggagucgugaaacuccugaccaagcccugggacguaauuccgauggugacucaaauggccaugacggauacaaccccuuucggccagcagcggguuuuuaaagagaaggucgacacucguacccaggagcccaaggaagguaccaaaaaguugaugaaaauaacggcagaguggcuguggaaggaacucgggaaaaagaaaaccccaagaauguguacucgcgaggaguucacaaggaaggugcgguccaacgccgcucuuggagcgaucuuuaccgaugaaaauaaguggaaaagcgccagagaggcaguggaagacucaggcuucugggagcuggucgauaaggaacgcaacuuacaccuggagggcaaaugcgagacuuguguuuacaauaugauggggaagagggagaaaaaguugggagaguuugguaaggcuaaaggcucccgagccauuugguacauguggcucggggcacgguuccuggaauuugaggcccuaggauuccuuaacgaagaccauugguuuucuagagagaauagccugaguggcguggagggugaagggcuccacaagcugggauauaucuugagggauguauccaaaaaggagggcggcgcuauguacgccgacgauacagcggggugggacacccgcauuacacuggaagaucucaaaaacgaggaaauggugacuaaucauauggagggagagcacaagaaacuugcagaagccaucuucaaacugaccuaucaaaacaaggucgugcguguucagcggccuacgcccagagguaccgugauggacauaaucagcaggcgcgaccagcgaggcucugggcaggucgugacauacggauuaaacacuuuuaccaauauggaggcucaacugauucggcagauggaaggcgaggguguauucaaaucaauccagcaauugacaguuaaggaggaaauugccgugaaaaacuggcucaucagagucgggagggagcgccugaguagaauggcaauuuccggagaugacugcguggugaagccacuagaugaccgguucgcuagcgcccuuacugcucugaaugauaugggcaaggucaggaaagacauacagcagugggaacccucucguggcuggaacgauuggacccagguuccuuuuugcucgcaucacuuccacgagcucaucaugaaggacgggcgagugcugguagugccaugucgcaaucaagaugaauugauuggacgagcccggaucucacagggugcaggcuggagcuuaagggagacggcgugccuggggaaauccuaugcccagauguggagucucauguacuuucaucgcagagaccuucggcuggcugccaacgcaaucuguucugcugucccgagccacugggugcccacauccaggaccacuuggucaauucaugccacacacgaguggaugaccacugaagauaugcuaaccguuuggaaucgaguguggauacaggagaacccuuggauggaagacaagacaccagucgagaguugggaagagauccccuaucugggaaaacgugaggaucaauggugcggcucucucauugguuugacgagcagagcaaccugggccaagaauauccagacugcgauuaaccaggugcgcucccugaucgggaaugaagaguacacagacuacaugccuucaaugaagcgguucaggagagaagaggaagaggcuggaguacuuugguga

SEQ ID NO: 14973 - RNA, 9876 nt, Artificial Sequence
  derived and/or modified CDS sequence (opt3) from DENV-2__KM279606__SS-prME
accgccggaaucauuauaaugaugauccccaccgugauggcuuuccaccugacuacgcgaaauggggagccucauaugauuguaagcaggcaggaaaaggggaagucccuccuuuuuaagaccgagaaugguguuaauaugugcacucugauggcaauggacuugggcgaauuaugugaggauacuaucaccuacaauugcccacugcuacggcaaaacgaaccggaggacauugauuguuggugcaauucuacaucaaccugggugacuuaugggacauguaccgccacgggagagcaccgccgagaaaaacguaguguggcgcucgugccccaugucggcaugggucuggagacuagaaccgaaacauggaugagcuccgagggggcuuggaagcacgcccagaggaucgagacuuggauacuucggcauccuggauucaccaucauggcagccauucuggcuuacacaaucggcaccacguauuuucagcgcguguugauuuucauccuccugacugcaguuacaccaucuauggccaugagaugcauaggcauuucgaacagggacuuuguggaaggggucucaggagguagcuggguggauaucguacuggagcacggcaguuguguuaccacuauggcuaaaaauaagcccacacucgacuucgaauuaauuaagaccgaggccaaacacccugcgacgcugcggaaguacugcguggaagcaaaacuuaccaacacaacuaccgccucccgcuguccaacacagggggagcccucuuugaaugaggaacaagauaagcgauuugucugcaaacauagcaugguggacagaggauggggcaacgguugugggcuguucggaaagggcggcaucgugacuugcgcuauguuuaccugcaagaaaaauauggaggggaaggucguucagccugaaaaccuagaguauacaaucgugauuaccccacacuccggagaagagaaugccguagguaacgauacuggcaaacaugggaaggagauaaaagugacgccgcagucaaguaucacagaagcagagcucaccggauacggcacugucaccauggaauguagccccaggacaggucuggacuucaaugagauggugcuucugcagauggaaaacaaggcuugguugguucaccggcaaugguuucucgaucugccuuuaccauggcugcccggggccgacacccagggcucuaacuggauucagaaagagacucucgugacauucaagaauccucacgcgaagaaacaggaugucgugguacuuggaucccaagagggcgccaugcauacggcacugaccggggcuacugaaauccagaugucaagcggaaacuugcuauuuacaggucaccugaagugccgucuccgcauggacaaacugcagcuuaagggcaugaguuauucuauguguaccgggaaauucaagguugugaaggagauagccgaaacacaacauggaacuauugucaucagagugcaguacgagggcgacgguuccccaugcaaaauccccuucgagauuauggaucuggaaaagaggcacgucuuggggcggcucaucaccgugaauccgauuguuacggagaaagacaacccugugaauauagaagcugagcccccauuuggcgauagcuacaucauuaucggaguagaaccuggccagcugaaguuaucgugguauaaaaaggggucuuccaucggacagauguucgagaccacaaugcgaggugccaagcgcauggcaauucugggcgacacugccugggauuuugggucacuaggaggcgucuucaccaguauagguaaagcucuccaucaaguguuuggggcgaucuacggcgcagccuucagcggaguuuccuggacaaugaagauucugaucggcguggucauuacuuggaucgggaugaacucuagaagcaccucacuuaguguguccuugguacuggugggaguugucacgcucuaucugggcgugauggugcaggcugacagcgguugugucguuucuuggaaaaauaaggagcuuaaaugcgggucaggaauauuuaucacagauaacgugcacaccuggacugaacaguacaaguuccagcccgagaguccaagcaagcuggccuccgcaauucaaaaagcccacgaagagggcaucugugguauuaggucugugacacgguuggaaaaucucauguggaagcagaucacccccgagcugaaccauauauuaacugagaaugaaguaaaacugaccauuaugacaggcgacaucaaggggauuaugcaggcuggaaaacgcucgcuaagaccucagccaacggagcucaaguauagcuggaaagccuggggcaaggcaaagaugcuguccaccgaacuucacaaccauacauuuuugaucgaugggccggagacagcggaaugccccaauaccaacagggcuuggaacucacuggaggucgaggacuacggauucggcguguuuacaacuaacauauggcucaaacugaaggaacgucaagauguuuucugugacaguaaauuaaugucugccgcaaucaaggacaaccgggccgugcacgcugauauggguuauuggauugagagcgcccugaaugacaccuggaaaaucgaaaaggcauccuuuauugaggucaagucaugccacuggccuaaaagccauacgcuuuggucuaacgggguguuggaguccgaaaugaucauaccaaagaauuucgcuggacccguuagucagcacaacuaccgaccuggcuaccauacacagaccgccgguccauggcaccucggcagacuggagauggauuucgacuuuugugaagggacuaccgugguagucacagaggauugcggaaauaggggccccagccuacgcacuaccacagcgucugggaaacugauuacggaauggugcugucgguccugcacccucccgccucugagauauaggggagaggacggcuguugguacgguauggagauccgcccacuuaaggaaaaagaggaaaacuugguaaauucacuggugacugccgggcauggacagaucgauaacuucaguuuaggcguccucgguauggcucuguuucuugaggaaaugcugcgaacacggguuggcaccaagcacgcaauuuugcucguggccgucagcuucgugacucugaucacagggaauaugucguuucgugaccuaggaagagucauggugaugguuggcgcuaccaugacggaugacauugggaugggagugacuuaucuggcccuccuggcagcguucaaggucaggcccaccuuugccgcuggccuuuugcugcgcaaauuaacauccaaggagcucaugaugaccacuauagguaucgugcugcuuucucaaagcacaauuccugagucaauccuggaacuaaccgaugcccucgcacuggggaugaugguuuugaaaauugugcggaacauggagaaguaccagcuggcugucacaaucauggccauauuaugcguacccaaugcagugauccucgaaaacgccuggaaaguuaguuguacuacccuggcuguggucuccgugucuccacuucuguugacgagcucccagcaaaaggcggacuggauuccucucgcccugacaaucaagggacuaaaucccaccgcaauuuuccugacuacccuuucaagaacaagcaaaaagaggaguuggccacucaacgaggcuaucauggccguaggcauggugucuauacuggccuccagcuugcugaaaaaugauauuccgaugacuggcccuuuagucgcugggggacuccugaccguuugcuaugugcuuacgggucgaucggcagaccuggaauuggagcgcgccgcggacgugcggugggaggaacaggcugagaucucaggcucuagucccauccucuccauuacaauaagcgaagaugggucuaugagcaucaagaacgaggaggaagaacagacccugacuauucuaaucagaacaggacugcuugucauuuccggccucuuuccagugucaauccccauaaccgccgcagccugguaccugugggaaguuaaaaagcagagggcugguguauugugggacgugccuaguccacccccugucgggaaagcagaguuagaagauggagccuaucguaucaagcaaaagggcauucugggcuacagccagaucggggcgggaguguacaaagaggguacuuuccacacaauguggcauguuacccgcggcgcugugcucaugcacaaggggaaacggauugagccgucuugggccgacgucaagaaagaucugaucuccuauggaggcgguuggaaacuugaaggggaguggaaggaaggagaggaagugcagguacuggcauuggagccaggcaaaaaccccagagccguccagacgaagccuggccuauuuaaaacuaauaccgggacaauaggagcugugucacuggacuucaguccagguaccagcggcucccccauuguugauaagaaagggaagguggucggacucuacggcaacggugugguuacaaggucugggacuuaugugucggccaucgcacaaaccgaaaagagcaucgaagacaauccugagauugaagaugacaucuuuagaaagaagcggcugacgauaauggaucuucauccgggagcuggcaaaacaaagcgcuacuuacccgccauugucagagaggcgaucaaaaggggccugcggacucucauuuuggccccaacccgagugguagcagcugaaauggaggaggcccugagagggcucccuauccgcuaucagacacccgcuauaagggcagaacacaccggacgugagauuguggaccugaugugucaugccacuuucaccaugcggcuucugucaccaaucagaguuccuaacuacaauuugaucauuauggaugaagcccacuucacagaccccgcuuccaucgcggcaagggguuauauuaguacgcgcgucgagaugggcgaggccgcugggauauuuaugacugccaccccaccgggaucucgagacccuuucccccagagcaacgcaccaaucauggaugaagagagagaaauucccgagcgguccuggaacucaggccacgaaugggugacagacuuuaaggguaagaccgugugguucgucccuucuaucaaagccgggaacgauaucgcugcgugccuaaggaagaauggcaagaagguaauucagcugagccgcaaaacuuuugacagugaguacauaaagacacguaccaacgauugggacuucgugguuacgacugauaucuccgagaugggcgccaauuuuaaggcagaaagagugauugacccacggagguguaugaaacccgucauccucacagauggcgaggaacgcgugauuuuagcugggccuaugccgguuacccauagcucugccgcacaacgaagaggacggguggguaggaacccaaagaaugagaacgaccaguacaucuauaugggcgaaccccuggagaaugaugaggacugcgcccacuggaaagaagcuaagaugcuucuggacaacauaaacaccccugaggggaucauucccucaauguucgaaccagagcgcgaaaaagucgaugccaucgacggagaguacagacucaggggcgaggcgcggaagacuuuuguggauuugaugcgucgcggugaccugccuguauggcucgcauauaaaguggccgcugaagggauuaauuacgccgaucgaagaugguguuucgacggcguuaagaacaaucagauccuggaggaaaacgucgagguggagauauggacaaaggaaggagagaggaagaaacuuaaaccccgguggcuagaugcucgcauuuauuccgacccacuggcauugaaagaauuuaaagaguucgccgcuggcagaaagaguuuaacccugaaucucaucacagaaauggggaggcugccuacuuucaugacgcaaaaggccaaaaacgcacuugauaaucuggcggugcuccauaccgccgaggcuggaggucgggccuacaaccacgcauugagcgagcugccggaaacacuagagacucugcuccuucugaccuuauuggcuacagucaccggcgggauuuuucuguuccucaugucgggaaagggcaucgguaaaaugacucuggggaugugcugcauaaucacggccucuauucuucugugguaugcacagauccagccccacuggauugccgcuuccaucauacucgaauuuuucuugauuguucuguuaaucccagagccugaaaagcagcgaacaccccaagacaaucagcuaacauacgugguaaucgcgauucugacuguggucgccgcaaccauggcuaacgagaugggcuuucucgagaaaacaaagaaggauuucggacuuggcagcaucaccacucagcagccagaaucaaauauacuggacauugauuugagaccugccagugccuggacacuguacgcaguggcuacgaccuuuaucacucccaugcuccgccauucuauugagaacuccagcguuaaugugucacugacagccaucgcgaaccaagcuaccguccuuauggggcucggaaaagguuggccgcugaguaagauggacauaggcguaccauugcuggccaucggguguuauagccaggugaauccuauuaccuuaacagcagcccuacugcuccuuguugcucacuacgcaaucauuggacccggccugcaggccaaagcgacuagggaagcucagaagcgggccgcagccgguaucaugaaaaacccaacgguggacgggauuaccgucaucgauuuggaccccauaccuuaugauccgaaguucgagaagcaacugggccaggugaugcuccugguccuuugcgugacacagguuuuaaugaugcguacuaccugggcucugugugaagcccucacauuggcaaccggacccauuuccacucugugggagggcaauccagggagauuuuggaacacgacaaucgcugugucuauggccaacaucuucaggggaagcuaccuagcgggcgccggucugcucuuuuccauuaugaaaaauaccgcaaacacucgccgggggaccggaaauacaggcgagacucuuggugaaaaguggaaaaaccgacugaaugcuuugggcaagucagaguuccagauauauaaaaagucugggauccaagaaguagacagaacccuggccaaagagggaauuaagaggggcgagacagaucaucacgcagugagucgcgggucggcuaagcuccggugguuugucgaaagaaaccugguuacgccugagggaaaaguggucgacuuaggcugcggucgugggggauggagcuacuauuguggcggucuuaagaaugugaaagaaguaaagggccugaccaaagggggacccggccaugaggaaccuaucccaauguccacuuacggguggaaccucgugaggcuacagucuggaguugauguguucuucacacccccugagaagugcgacacccuguugugugauauuggcgagucaagcccaaaucccacugucgaagccggucggacacugcgcgugcucaaccuugccgagaauuggcugaacaauaacacccaguuuugcaucaaggucuugaauccguacaugccuuccgugauagagaagauggaggcgcugcaacgaaaguaugggggagcucucguuagaaacccauuaaguaggaacucuacgcacgaaauguacuggguaagcaaugcaucaggcaacaucguguccagugucaauaugauuagccggaugcugaucaaccgcuucaccaugagacacaaaaaggccacauaugagcccgacguggaucuuggcucugggacuaggaauauuggaaucgaguccgaaaccccuaaccuggacauaauugguaaacgaaucgagaagaucaagcaggaacaugagacaucauggcacuacgaucaggaccauccauauaaaacuugggcuuaccacggcagcuaugaaaccaagcagacagggucggccucuaguaugguuaauggagugguccggcuacucaccaaacccugggacgugauuccgaugguaacucaaauggcaaugacggauacaaccccuuuuggccagcagcguguguucaaggagaaaguugacacuagaacccaggagcccaaggaagguacaaagaaacugaugaagauaacggccgagugguuguggaaagaacuggggaagaaaaagaccccacgcauguguacuagggaggaguuuacacggaaagucagauccaacgcugcgcucggagccaucuucaccgaugaaaauaaguggaaaagcgcacgcgaggcuguggaagacucaggcuuuugggagcuuguggauaaagaaaggaaccugcacuuagagggcaagugcgagacuugugucuacaauaugauggggaaacgagaaaagaaacugggagaguucgguaaggccaagggcucccgggcaauuugguacaugugguugggggccagauuucucgaguucgaggcucugggauuucuaaacgaagaccauugguucucuagggagaauagccuuaguggcguugagggugaagggcugcacaaacucggauauauccugcgcgauguguccaagaaagagggcggcgccauguacgcggacgauacagcagggugggacacccguauuacauuggaagaucugaagaacgaggaaaugguaacuaaucauauggagggagagcacaaaaagcucgccgaagcuaucuuuaaacuuaccuaucaaaacaaagugguccgggugcagagaccuacgcccagggguaccguuauggacauaaucagccgccgagaccagcggggcucuggacagguggucacauacggacugaacacuuucaccaauauggaggcccaauuaauuagacagauggaaggcgaggguguguucaagucaauccagcaacugacaguaaaagaggaaauugcaguuaagaacugguugaucaggguggggcgcgagagacucagucggauggcuauuuccggagaugacugcgucgugaaaccacuggaugacagguuugccagcgcucuaacugcccuuaaugauaugggcaaggugcguaaggacauacagcagugggaacccucucgaggcuggaacgauuggacccaggucccuuucugcucgcaucacuuucacgagcugaucaugaaagacgggcgcguucucgugguaccauguagaaaucaagaugaacugauuggacgggcaaggaucucacagggugcgggcuggagcuugcgcgagacggccugcuuagggaaguccuaugcucagauguggagucugauguacuuccauagacgggaccucaggcuugccgcaaacgcuaucuguucugccgugccgagccacuggguccccacaucccgaaccacuuggucaauucaugcaacacacgaguggaugaccacugaagauaugcugaccguguggaaucguguuuggauacaggagaacccuuggauggaagacaaaacaccaguggagaguugggaagagauccccuaucuaggaaagagagaggaucaauggugcggcucucugauuggucucacgagccgcgccaccugggcgaaaaauauccagacugcuauuaaccagguccgguccuugaucgggaaugaagaguacacagacuacaugccuucaaugaagagguuuagacgcgaagaggaagaggccggagugcugugguga

SEQ ID NO: 14974 - RNA, 9876 nt, Artificial Sequence
  derived and/or modified CDS sequence (opt3) from DENV-2__JN851113__SS-prME
accgccggaaucauuauaaugaugauccccacagugauggcuuuccaccugacuacgcgaaacggggagccucauaugauugucagcaggcaggaaaagggaaaaucccuccuuuuuaagaccgagaaugguguuaacaugugcacacugauggcaauggacuugggcgaauuaugugaggauacuaucaccuacaauugcccacugcugcggcaaaacgaaccggaggacauugauuguuggugcaauucuacaucaaccugggugacuuaugggacauguaccgccacgggagagcaccgccgagaaaaacguaguguugcgcucgugccccaugucggcaugggucuggagacuagaaccgaaacauggaugagcuccgagggggcuuggaagcacgcccagaggaucgagacuuggauacuucggcauccuggauucaccaucauggcagccauucuggcuuacacaaucggcaccacguauuuucagcgcguguugauuuucauccuccugacugcaguuacaccaucuauggccaugaggugcauaggcauuucgaacagggacuuuguggaaggggucucaggagguagcuggguggauaucguacuggagcacggcaguuguguuaccacuauggcuaaaaauaagcccacacucgacuucgaauuaauuaagaccgaggccaaacacccugcgacgcugcggaaguacugcguggaagcaaaacuuaccaacacaacuaccgccucccgcuguccaacacagggggagcccucuuugaaugaggaacaagauaagcgauuugucugcaaacauagcaugguggacagaggauggggcaacgguugugggcuguucggaaagggcggcaucgugacuugcgcuauguuuaccugcaagaaaaauauggaggggaaggucguucagccugaaaaccuagaguauacaaucgugauuaccccacacuccggagaagagaaugccguagguaacgauacuggcaaacaugggaaggagauaaaagugacgccgcagucaaguaucacagaagcagagcucaccggauacggcacugucaccauggaauguagccccaggacaggucuggacuucaaugagauggugcuucugcagauggaaaacaaggcuugguugguucaccggcaaugguuucucgaucugccuuuaccauggcugcccggggccgacacccagggcucuaacuggauucagaaagagacucucgugacauucaagaauccucacgcgaagaaacaggaugucgugguacuuggaucccaagagggcgccaugcauacggcacugaccggggcuacugaaauccagaugucaagcggaaacuugcuauuuacaggucaccugaagugccgucuccgcauggacaaacugcagcuuaagggcaugaguuauucuauguguaccgggaaauucaagguugugaaggagauagccgaaacacaacauggaacuauugucaucagagugcaguacgagggcgacgguuccccaugcaaaauccccuucgagauuauggaucuggaaaagaggcacgucuuggggcggcucaucaccgugaauccgauuguuacggagaaagacagcccugugaacauagaagcugagcccccauuuggcgauucguacaucauuaucggaguagaaccuggccagcugaaguuaucuugguucaaaaagggguccucaaucggacagauguuugagaccacaaugcgaggugccaagcgcauggcaauucugggcgacacugccugggauuucgggagucuaggaggcgucuuuaccagcauagguaaagcucuccaucaaguguucggggcgaucuauggcgcagccuuuuccggaguuucuuggacaaugaagauucugaucggcguggucauuacuuggaucgggaugaauagcagaucaaccagucuuuccgugagcuugguacuggugggaguugucacgcucuaccugggcgugauggugcaggcugacucugguugugucguuucauggaaaaacaaggagcuuaaaugcgggaguggaauauucaucacagauaaugugcacaccuggacugaacaguauaaguuucagcccgagagcccauccaagcuggccucugcaauucaaaaagcccacgaagagggcaucugugguauuaggucggugacacgguuggaaaaccucauguggaagcagaucacccccgagcugaaucauauauuaacugagaacgaaguaaaacugaccauuaugacaggcgacaucaaggggauuaugcaggcuggaaaacgcagccuaagaccucagccaacggagcucaaguacuccuggaaagccuggggcaaggcaaagaugcugucaaccgaacuucacaaucauacuuucuugaucgaugggccggagacagcggaaugccccaacaccaauagggcuuggaacagucuggaggucgaggacuauggauuuggcguguucacaacuaauauauggcucaaacugaaggaacgucaagauguauuuugugacucuaaauuaaugagcgccgcaaucaaggacaaccgggccgugcacgcugauauggguuacuggauugaguccgcccugaacgacaccuggaaaaucgaaaaggcaucauucauugaggucaagagcugccacuggccuaaaucucauacgcuuugguccaaugggguguuggagagugaaaugaucauaccaaagaacuucgcuggacccguuagccagcacaauuaucgaccuggcuaccauacacagaccgccgguccauggcaccucggcagacuggagauggauuuugacuucugugaagggacuaccgugguagucacagaggauugcggaaacaggggccccucucuacgcacuaccacagcguccgggaaacugauuacggaauggugcugucggucaugcacccucccgccucugagauacaggggagaggacggcuguugguaugguauggagauccgcccacuuaaggaaaaagaggaaaauuuggugaacagucuggugacugccgggcauggacagaucgauaauuuuagcuuaggcguccucgguauggcucuguuccuugaggaaaugcugcgaacacggguuggcaccaagcacgcaauuuugcucguggccguaucguuugugacucugaucacagggaacauguccuuccgugaccuaggaagagucauggugaugguuggcgcuaccaugacggaugacauugggaugggagugacuuaccuggcccuccuggcagcguuuaaggucaggcccaccuucgccgcuggccuuuugcugcgcaaauuaacaucuaaggagcucaugaugaccacuauagguaucgugcugcuuagccaaucaacaauuccugagaguauccuggaacuaaccgaugcccucgcacuggggaugaugguuuugaaaauugugcggaauauggagaaguaucagcuggcugucacaaucauggccauauuaugcguacccaacgcagugauccuccagaaugccuggaaaguuuccuguacuacccuggcuguggucucugugagcccacuucuguugacguccucacaacagaaggcggacuggauuccucucgcccugacaaucaagggacuaaaccccaccgcaauuuuucugacuacccuuagcagaacaaguaaaaagaggucuuggccacucaaugaagcuaucauggccguaggcaugguguccauacuggccagcucguugcugaaaaacgauauuccgaugacuggcccuuuagucgcugggggacuccugaccguuugcuacgugcuuacgggucgaucagcagaccuggaguuggaacgcgccgcggacgugcggugggaggagcaggcugaaaucucuggcaguucccccauccucagcauuacaauaucugaggaugggagcauguccaucaagaaugaagaggaggaacagacccugacuauucuaaucagaacaggacugcuugucauuucaggccucuucccagugaguauccccauaaccgccgcagccugguaucugugggagguuaaaaagcaaagggcugguguauugugggacgugccuagcccacccccugucgggaaagcagaauuagaggauggagccuaccguaucaagcagaagggcauucugggcuauucucagaucggggcgggaguguacaaagaagguacuuuucacacaauguggcauguuacccgcggcgcugugcucaugcacaaggggaaacggauugagccguccugggccgacgucaagaaagaucugaucucauacggaggcgguuggaaacuugagggggaauggaaggagggagaagaggugcagguacuggcauuggaaccaggcaaaaaccccagagccguccaaacgaagccuggccuauucaaaacuaacaccgggacaauaggagcugugagucuggacuuuagcccagguaccuccggcucucccauuguugauaagaaagggaagguggucggacucuauggcaauggugugguuacaaggucggggacuuacgugagcgccaucgcacagaccgagaagucaaucgaggacaacccugaaauugaggaugacaucuucagaaagaaacggcugacgauaauggaucuucauccgggagcuggcaaaacaaagcgcuauuuacccgccauugucagagaagcgaucaaaaggggccugcggacucucauuuuggccccaacccgagugguagcagcugagauggaagaggcccugagagggcucccuauccgcuaccagacacccgcuauaagggcagagcacaccggacgugaaauuguggaccugaugugucaugccacuuucaccaugcggcuucuguccccaaucagaguuccuaauuauaacuugaucauuauggaugaggcccacuuuacagaccccgcuaguaucgcggcaagggguuacauuucuacgcgcgucgaaaugggcgaggccgcugggauauucaugacugccaccccaccgggaagccgagacccuuuuccccaguccaaugcaccaaucauggaugaggaaagagagauucccgaacggucauggaacucuggccacgagugggugacagacuucaaggguaagaccgugugguuugucccuagcaucaaagccgggaaugauaucgcugcgugccuaaggaagaacggcaagaagguaauucaacugagucgcaaaacuuucgacuccgaauauauaaagacacguaccaaugauugggacuuugugguuacgacugauaucagcgagaugggcgccaacuucaaggcagagagagugauugacccacggagguguaugaaacccgucauccucacagauggcgaagaacgcgugauuuuagcugggccuaugccgguuacccauucuucagccgcacagcgaagaggacggguggguaggaauccaaagaacgaaaaugaccaguacaucuacaugggcgagccccuggaaaacgaugaggacugcgcccacuggaaagaggcuaagaugcuucuggacaauauaaacaccccugaagggaucauucccuccauguuugagccagaacgcgagaaagucgaugccaucgacggagaauauagacucaggggcgaggcgcggaagacuuucguggauuugaugcgucgcggugaccugccuguauggcucgcauaccgaguggccgcugaggggauuaacuaugccgauagaaggugguguuuugacggcguuaaaaauaaccaaauccuggaagagaaugucgaaguggagauauggacaaaggagggagaacggaagaaacuuaagccccgcuggcuagaugcuagaauuuacagugacccacuggcauugaaagaguucaaggaguucgccgcuggcaggaagucguuaacccugaaccucaucacagagauggggcggcugccuacuuuuaugacgcagaaggccaagaaugcacuugauaaccuggcggugcuccauaccgccgaagcuggaggucgagccuauaaucacgcauugagcgagcugccggagacacuagaaacucugcuccuucugaccuuauuggcuacagucaccggcgggauuuuccuguuucucaugucuggaaaaggcaucgguaagaugacucuggggaugugcugcauaaucacggccuccauucuucugugguacgcacagauccagccccacuggauugccgcuagcaucauacucgaguucuuuuugauuguucuguuaaucccagaaccugagaaacaaagaacaccccaggacaaccagcuaacauaugugguaaucgcgauucugacuguggucgccgcaaccauggcuaaugaaaugggcuuccucgagaagaccaagaaggauuuuggacuuggcucaaucaccacucagcaaccagagaguaacauacuggacauugauuugcgcccugccucugccuggacacuguacgcaguggcuacgaccuucaucacucccaugcucaggcauuccauugaaaauagcucaguuaacgugagucugacagccaucgcgaaucaggcuaccguccuuauggggcucggaaaggguuggccgcugagcaaaauggacauaggcguaccauugcuggccaucggguguuacucccaggugaacccuauuaccuuaacagcagcccuacugcuccuuguugcucacuaugcaaucauuggacccggccugcaggccaaggcgacucgggaggcucaaaaacgugccgcagccgguaucaugaagaauccaacgguggacgggaugaccgucauugauuuggaccccaucccuuacgauccgaaauuugaaaagcagcugggccaggugaugcuccugguccuuugcgugacacagguuuuaaugaugagaacuaccugggcucugugugaggcccucacauuggcaaccggacccauaucuacucugugggaaggcaacccagggagguucuggaauacgacaauugcugugagcauggccaacaucuuucgcggauccuaucuagcgggcgccggucuacucuucucaaucaugaagaacaccgcaaauacucggcgagggaccggaaacacaggcgagacucuuggugagaaauggaagaauagacugaacgcuuugggcaaaucugaauuucaaauuuacaagaaaagugggauacaggagguagacaggacccuggccaaggaaggaaucaaacgcggcgagacagaucaucacgcagugucgcgggggagcgcuaagcucagaugguucgucgagcguaaucugguuacgccugaaggaaagguggucgacuuaggcugcgguagagggggaugguccuauuacuguggcggucuuaaaaacgugaaggagguaaaaggccugaccaaagggggacccggccaugaagaaccuauuccaaugucuacuuauggguggaaucucgugcggcuacagucaggaguugauguguucuuuacacccccugaaaaaugcgacacccuguugugugauaucggcgagagcuccccaaaccccacugucgaggccggucgcacacugcgagugcucaaucuugucgaaaacuggcugaauaacaauacccaauucugcauuaagguguugaacccguacaugccuaguguuaucgagaagauggaagcccugcagagaaaauacgggggagcgcucguaaggaauccauuaucucggaacagcacgcacgagauguauugggugucaaacgcuuccggcaauauagucaguagcgugaacaugaucucucgcaugcugauuaauagauuuaccaugaggcacaagaaagcaacauacgaacccgacguugaucuuggcuccgggacucgaaacaucggaauugagucagagaccccuaaucuggacaucauagguaagcggauugagaaaaucaagcaggagcaugaaacaagcuggcacuaugaucaggaccauccauacaagacuugggccuaucacggcucguacgagaccaaacaaacagggucugcuaguuccauggugaacggagucgugcgucuacucaccaagcccugggacguaaucccgauggugacucagauggccaugacggauacaaccccuuucggccagcagagaguuuuuaaagaaaaggucgacacucgcacccaagagcccaaagaggguacaaagaagcugaugaaaauuacggcagaaugguuguggaaggagcuggggaaaaagaaaaccccaaggauguguacucgggaagaguucacaagaaaggugcgcagcaaugccgcucucggagcgauauuuaccgaugagaacaaauggaagucagccagggaagcaguggaggacuccggcuucugggaacuugucgauaaggagcgaaaucugcacuuagaaggcaaaugcgagacuuguguuuauaacaugauggggaagcgggagaaaaagcugggagaauuugguaaagcuaagggcucuagagccaucugguacaugugguugggggcaagguuccucgaguuugaagcccugggauuccuaaaugaggaccauugguuuagccgcgaaaacagucuuuccggcguggagggugaggggcugcacaagcucggauacauucugcgugauguaagcaaaaaggaaggcggcgcuauguaugccgacgauacagcggggugggacacccggaucacauuggaggaucugaaaaaugaagagauggugacuaaccauauggaaggagagcacaagaaacucgcagaggccauuuucaaacuuaccuaccagaauaaggucgugagaguucagaggccuacgccccgcgguaccgugauggacaucauaucucgacgggaccagagaggcucagggcaagucgugacauauggacugaacacuuucaccaacauggaagcucaguuaaucaggcagauggagggcgaagguguauuuaaaaguauucaacagcugacaguuaaggaggagaucgccgugaaaaauugguugauucgcgucgggagagaacggcucuccaggauggcaaucagcggagaugacugcguggugaagccacuggaugaccguuucgcuucugcccuaacugcucuuaacgauaugggcaaaguccgaaaggacauucagcagugggagcccucgcgcggcuggaaugauuggacccaaguuccuuuuugcucacaucacuuccacgaacugauaaugaaggacgggagagugcucguagugccaugucggaaccaggaugagcugaucggaagggcccgcauuagccagggugcaggcugguccuugagagaaacggcgugcuuagggaaaaguuacgcccagauguggucucugauguauuuucaucggagggaccuccgacuugcugccaaugcaaucuguagcgcugucccgucccacugggugcccacaucacguaccacuuggaguauccaugccacacacgaguggaugaccacugaggauaugcugaccguuuggaacagaguguggauucaagaaaauccuuggauggaggacaagacaccagucgaaucuugggaggaaauacccuaccuaggaaaacgcgaggaucaguggugcggcagccugaucggucucacgucccgggcaaccugggccaagaacauucagacugcgaucaaucaggugaggucauugauugggaacgaggaauauacagacuacaugccuagcaugaaaagauuccgccgggaggaagaggaagcuggaguacugugguga

SEQ ID NO: 14975 - RNA, 9876 nt, Artificial Sequence
  derived and/or modified CDS sequence (opt3) from DENV-2__GU370050__SS-prME
accgccggaaucauuauaaugaugauccccacagugauggcuuuccaccugacuacgcgaaacggggaaccucauaugauugucagcaggcaggaaaagggaaaaucccuccuuuuuaagaccgagaaugguguuaacaugugcacacugauggcaauggacuugggcgaauuaugugaggauacuaucaccuacaauugcccacugcugcggcaaaacgaaccggaggacauugauuguuggugcaauucuacaucaaccugggugacuuaugggacauguaccgccacgggagagcaccgccgagaaaaacguaguguugcgcucgugccccaugucggcaugggucuggagacuagaaccgaaacauggaugagcuccgagggggcuuggaagcacgcccagaggaucgagacuuggauacuucggcauccuggauucaccaucauggcagccauucuggcuuacacaaucggcaccacguauuuucagcgcguguugauuuucauccuccugacugcaguuacaccaucuauggccaugaggugcauaggcauuucgaacagggacuuuguggaaggggucucaggagguagcuggguggauaucguacuggagcacggcaguuguguuaccacuauggcuaaaaauaagcccacacucgacuucgaauuaauuaagaccgaggccaaacacccugcgacgcugcggaaguacugcguggaagcaaaacuuaccaacacaacuaccgccucccgcuguccaacacagggggagcccucuuugaaugaggaacaagauaagcgauuugucugcaaacauagcaugguggacagaggauggggcaacgguugugggcuguucggaaagggcggcaucgugacuugcgcuauguuuaccugcaagaaaaauauggaggggaaggucguucagccugaaaaccuagaguauacaaucgugauuaccccacacuccggagaagagaaugccguagguaacgauacuggcaaacaugggaaggagauaaaagugacgccgcagucaaguaucacagaagcagagcucaccggauacggcacugucaccauggaauguagccccaggacaggucuggacuucaaugagauggugcuucugcagauggaaaacaaggcuugguugguucaccggcaaugguuucucgaucugccuuuaccauggcugcccggggccgacacccagggcucuaacuggauucagaaagagacucucgugacauucaagaauccucacgcgaagaaacaggaugucgugguacuuggaucccaagagggcgccaugcauacggcacugaccggggcuacugaaauccagaugucaagcggaaacuugcuauuuacaggucaccugaagugccgucuccgcauggacaaacugcagcuuaagggcaugaguuauucuauguguaccgggaaauucaagguugugaaggagauagccgaaacacaacauggaacuauugucaucagagugcaguacgagggcgacgguuccccaugcaaaauccccuucgagauuauggaucuggaaaagaggcacgucuuggggcggcucaucaccgugaauccgauuguuacggagaaagacagcccugugaacauagaagcugagcccccauuuggcgauucguacaucauuaucggaguagaaccuggccagcugaaguuaucuugguucaaaaagggguccucaaucggacagauguuugagaccacaaugcgaggugccaagcgcauggcaauucugggcgacacugccugggauuucgggagucuaggaggcgucuuuaccagcauagguaaagcucuccaucaaguguucggggcgaucuauggcgcagccuuuuccggaguuucuuggacaaugaagauucugaucggcguggucauuacuuggaucgggaugaauagcagaucaaccagucuuuccgugagcuugguacuggugggaguugucacgcucuaccugggcgugauggugcaggcugacucugguugugucguuucauggaaaaacaaggagcuuaaaugcgggaguggaauauucaucacagauaaugugcacaccuggacugaacaguauaaguuucagcccgagagcccauccaagcuggccucugcaauucaaaaagcccacgaagagggcaucugugguauuaggucggugacacgguuggaaaaccucauguggaagcagaucacccccgagcugaaucauauauuaacugagaacgaaguaaaacugaccauuaugacaggcgacaucaaggggauuaugcaggcuggaaaacgcagccuaagaccucagccaacggagcucaaguacuccuggaaagccuggggcaaggcaaagaugcugucaaccgaacuucacaaucauacuuucuugaucgaugggccggagacagcggaaugccccaacaccaauagggcuuggaacagucuggaggucgaggacuauggauuuggcguguucacaacuaauauauggcucaaacugaaggaacgucaagauguauuuugugacucuaaauuaaugagcgccgcaaucaaggacaaccgggccgugcacgcugauauggguuacuggauugaguccgcccugaacgacaccuggaaaaucgaaaaggcaucauucauugaggucaagagcugccacuggccuaaaucucauacgcuuugguccaaugggguguuggagagugaaaugaucauaccaaagaacuucgcuggacccguuagccagcacaauuaucgaccuggcuaccauacacagaccgccgguccauggcaccucggcagacuggagauggauuuugacuucugugaagggacuaccgugguagucacagaggauugcggaaacaggggccccucucuacgcacuaccacagcguccgggaaacugauuacggaauggugcugucggucaugcacccucccgccucugagauacaggggagaggacggcuguugguaugguauggagauccgcccacuuaaggaaaaagaggaaaauuuggugaacagucuggugacugccgggcauggacagaucgauaauuuuagcuuaggcguccucgguauggcucuguuccuugaggaaaugcugcgaacacggguuggcaccaagcacgcaauuuugcucguggccguaucguuugugacucugaucacagggaacauguccuuccgugaccuaggaagagucauggugaugguuggcgcuaccaugacggaugacauugggaugggagugacuuaccuggcccuccuggcagcguuuaaggucaggcccaccuucgccgcuggccuuuugcugcgcaaauuaacaucuaaggagcucaugaugaccacuauagguaucgugcugcuuagccaaucaacaauuccugagaguauccuggaacuaaccgaugcccucgcacuggggaugaugguuuugaaaauugugcggaauauggagaaguaucagcuggcugucacaaucauggccauauuaugcguacccaacgcagugauccuccagaaugccuggaaaguuuccuguacuacccuggcuguggucucugugagcccacuucuguugacguccucacaacagaaggcggacuggauuccucucgcccugacaaucaagggacuaaaccccaccgcaauuuuucugacuacccuuagcagaacaaguaaaaagaggucuuggccacucaaugaagcuaucauggccguaggcaugguguccauacuggccagcucguugcugaaaaacgauauuccgaugacuggcccuuuagucgcugggggacuccugaccguuugcuacgugcuuacgggucgaucagcagaccuggaguuggaacgcgccgcggacgugcggugggaggagcaggcugaaaucucuggcaguucccccauccucagcauuacaauaucugaggaugggagcauguccaucaagaaugaagaggaggaacagacccugacuauucuaaucagaacaggacugcuugucauuucaggccucuucccagugaguauccccauaaccgccgcagccugguaucugugggagguuaaaaagcaaagggcugguguauugugggacgugccuagcccacccccugucgggaaagcagaauuagaggauggagccuaccguaucaagcagaagggcauucugggcuauucucagaucggggcgggaguguacaaagaagguacuuuucacacaauguggcauguuacccgcggcgcugugcucaugcacaaggggaaacggauugagccguccugggccgacgucaagaaagaucugaucucauacggaggcgguuggaaacuugagggggaauggaaggagggagaagaggugcagguacuggcauuggaaccaggcaaaaaccccagagccguccaaacgaagccuggccuauucaaaacuaacaccgggacaauaggagcugugagucuggacuuuagcccagguaccuccggcucucccauuguugauaagaaagggaagguggucggacucuauggcaauggugugguuacaaggucggggacuuacgugagcgccaucgcacagaccgagaagucaaucgaggacaacccugaaauugaggaugacaucuucagaaagaaacggcugacgauaauggaucuucauccgggagcuggcaaaacaaagcgcuauuuacccgccauugucagagaagcgaucaaaaggggccugcggacucucauuuuggccccaacccgagugguagcagcugagauggaagaggcccugagagggcucccuauccgcuaccagacacccgcuauaagggcagagcacaccggacgugaaauuguggaccugaugugucaugccacuuucaccaugcggcuucuguccccaaucagaguuccuaauuauaacuugaucauuauggaugaggcccacuuuacagaccccgcuaguaucgcggcaagggguuacauuucuacgcgcgucgaaaugggcgaggccgcugggauauucaugacugccaccccaccgggaagccgagacccuuuuccccaguccaaugcaccaaucauggaugaggaaagagagauucccgaacggucauggaacucuggccacgagugggugacagacuucaaggguaagaccgugugguuugucccuagcaucaaagccgggaaugauaucgcugcgugccuaaggaagaacggcaagaagguaauucaacugagucgcaaaacuuucgacuccgaauauauaaagacacguaccaaugauugggacuuugugguuacgacugauaucagcgagaugggcgccaacuucaaggcagagagagugauugacccacggagguguaugaaacccgucauccucacagauggcgaagaacgcgugauuuuagcugggccuaugccgguuacccauucuucagccgcacagcgaagaggacggguggguaggaauccaaagaacgaaaaugaccaguacaucuacaugggcgagccccuggaaaacgaugaggacugcgcccacuggaaagaggcuaagaugcuucuggacaauauaaacaccccugaagggaucauucccuccauguuugagccagaacgcgagaaagucgaugccaucgacggagaauauagacucaggggcgaggcgcggaagacuuucguggauuugaugcgucgcggugaccugccuguauggcucgcauaccgaguggccgcugaggggauuaacuaugccgauagaaggugguguuuugacggcguuaaaaauaaccaaauccuggaagagaaugucgaaguggagauauggacaaaggagggagaacggaagaaacuuaagccccgcuggcuagaugcuagaauuuacagugacccacuggcauugaaagaguucaaggaguucgccgcuggcaggaagucguuaacccugaaccucaucacagagauggggcggcugccuacuuuuaugacgcagaaggccaagaaugcacuugauaaccuggcggugcuccauaccgccgaagcuggaggucgagccuauaaucacgcauugagcgagcugccggagacacuagaaacucugcuccuucugaccuuauuggcuacagucaccggcgggauuuuccuguuucucaugucuggaaaaggcaucgguaagaugacucuggggaugugcugcauaaucacggccuccauucuucugugguacgcacagauccagccccacuggauugccgcuagcaucauacucgaguucuuuuugauuguucuguuaaucccagaaccugagaaacaaagaacaccccaggacaaccagcuaacauaugugguaaucgcgauucugacuguggucgccgcaaccauggcuaaugaaaugggcuuccucgagaagaccaaaaaggauuuuggacuuggcucaaucaccacucagcaaccagagaguaacauacuggacauugauuugcgcccugccucugccuggacacuguacgcaguggcuacgaccuucaucacucccauucucaggcauuccaucgaaaauagcucaguuaacgugagucugacagccauagcgaaucaggcuaccguccuuauggggcucggaaaggguuggccgcugagcaaaauggacaucggcguaccauugcuggccauuggguguuacucccaggugaacccuaucaccuuaacagcagcccuacugcuccuuguugcucacuaugcaauuaucggacccggccugcaggccaaggcgacucgggaggcucaaaaacgugccgcagccgguauuaugaagaauccaacgguggacgggaugaccgucaucgauuuggaccccauaccuuacgauccgaaauuugaaaagcagcugggccaggugaugcuccugguccuuugcgugacacagguuuuaaugaugagaacuaccugggcucugugugaggcccucacauuggcaaccggacccauuucuacucugugggaaggcaacccagggagguucuggaauacgacaaucgcugugagcauggccaacaucuuucgcggauccuaucuagcgggcgccggucuacucuucucaauuaugaagaacaccgcaaauacucggcgagggaccggaaacacaggcgagacucuuggugagaaauggaagaauagacugaacgcuuugggcaaaucugaauuucaaauauacaagaaaagugggauccaggagguagacaggacccuggccaaggaaggaauuaaacgcggcgagacagaucaucacgcagugucgcgggggagcgcuaagcucagaugguucgucgagcguaaucugguuacgccugaaggaaagguggucgacuuaggcugcgguagagggggaugguccuauuacuguggcggucuuaaaaacgugaaggagguaaaaggccugaccaaagggggacccggccaugaagaaccuaucccaaugucuacuuauggguggaaucucgugcggcuacagucaggaguugauguguucuuuacacccccugaaaaaugcgacacccuguugugugauauuggcgagagcuccccaaaccccacugucgaggccggucgcacacugcgagugcucaaucuugucgaaaacuggcugaauaacaauacccaauucugcaucaagguguugaacccguacaugccuaguguuauagagaagauggaagcccugcagagaaaauacgggggagcgcucguaaggaauccauuaucucggaacagcacgcacgagauguauugggugucaaacgcuuccggcaauaucgucaguagcgugaacaugauuucucgcaugcugaucaauagauuuaccaugaggcacaagaaagcaacauacgaacccgacguugaucuuggcuccgggacucgaaacauuggaaucgagucagagaccccuaaucuggacauaauugguaagcggaucgagaaaaucaagcaggagcauaagacaagcuggcacuaugaucaggaccauccauacaaaacuugggccuaucacggcucguacgaaaccaagcaaacagggucugcuaguuccauggugaacggagucgugcgucuacucaccaaacccugggacguaauuccgauggugacucagauggccaugacggauacaaccccuuucggccagcagagaguuuuuaaggagaaagucgacacucgcacccaagaacccaaggaggguacaaagaaacugaugaagauaacggcagagugguuguggaaagaacuggggaagaaaaagaccccaaggauguguacucgggaggaguucacaagaaaagugcgcagcaaugccgcucucggagcgaucuuuaccgaugagaacaaguggaagucagccagggaggcaguggaagacuccggcuucugggagcuugucgauaaagaacgaaaucugcacuuagagggcaagugcgaaacuuguguuuauaacaugauggggaaacgggagaagaaacugggagaguuugguaaggcuaagggcucuagagccauuugguacaugugguugggggcaagguuccucgaauuugaggcccugggauuccuaaaugaagaccauugguuuagccgcgagaacagucuuuccggcguggaaggugaggggcugcacaaacucggauacauccugcgugauguaagcaagaaagagggcggcgcuauguaugccgacgauacagcggggugggacacccggauuacauuggaagaucugaagaaugaggaaauggugacuaaccauauggagggagaacacaaaaagcucgcagaggccaucuucagacuuaccuaccagaauaaggucgugaggguucagcgcccuacgccccgagguaccgugauggacauaaucucucggagagaccagaggggcucagggcaagucgugacauauggacugaacacuuucaccaacauggaggcucaguuaauucgccagauggaaggcgaggguguauuuaaaaguauccaacagcugacaguuaaggaagagauugccgugaaaaauugguugaucagagucgggcgggagaggcucucccguauggcaauuagcggagaugacugcguggugaagccacuggaugaccgauucgcuucugcccuaacugcucuuaacgauaugggcaaaguccgcaaggacauacagcagugggaacccucgagaggcuggaaugauuggacccaaguuccuuuuugcucacaucacuuccacgagcugaucaugaaggacgggcgggugcucguagugccauguaggaaccaggaugaacugauuggacgcgccagaaucagccagggugcaggcugguccuugcgggagacggcgugcuuagggaaaaguuacgcccagauguggucucugauguauuuucauaggcgagaccuccgucuugcugccaaugcaaucuguagcgcugucccgucccacugggugcccacaucaagaaccacuuggaguauucaugccacacacgaauggaugaccacugaggauaugcugaccguuuggaaccgcguguggauacaagagaauccuuggauggaagacaagacaccagucgagucuugggaagagauccccuaccuaggaaaacgggaagaucaguggugcggcagccugauuggucucacguccagggcaaccugggccaagaacauccagacugcgauuaaucaggugagaucauugaucgggaacgaggaguauacagacuacaugccuagcaugaaacgcuuccggagggaagaggaagaggcuggaguacugugguga

SEQ ID NO: 14976 - RNA, 9876 nt, Artificial Sequence
  derived and/or modified CDS sequence (opt3) from DENV-2__JN851129__SS-prME
accgccggaaucauuauaaugaugauccccacagugauggcuuuccaccugacuacgcgaaacggggagccucauaugauuguaagcaggcaggaaaagggaaaaucccuccuuuuuaagaccgagaaugguguuaacaugugcacacugauggcaauggacuugggcgaauuaugugaggauacuaucaccuacaauugcccacuguuacggcaaaacgaaccggaggacauugauuguuggugcaauucuacaucaaccugggugacuuaugggacauguaccgccacgggagagcaccgccgagaaaaacguaguguagcgcucgugccccaugucggcaugggucuggagacuagaaccgaaacauggaugagcuccgagggggcuuggaagcacgcccagaggaucgagacuugggugcuucggcauccuggauucaccauaauggcagccauccuggcuuacacaauuggcaccacguauuuucagcgcguuuugaucuucauucuccugacugcaguggccccaucuaugacaaugcggugcaucggcauaucgaacagggacuuugucgaaggggugucaggagguagcuggguagauauuguucuggagcacggcaguugugugaccacuauggcuaaaaauaagcccacacucgacuucgaauuaaucaagaccgaggccaaacacccugcgacgcugcggaaguacugcauugaagcaaaacuuaccaacacaacuaccgccucccgcuguccaacacagggggagcccucuuugagcgaggaacaagauaagcgauuugucugcaaacauuccaugguggacagaggauggggcaaugguugugggcuguucggaaagggcggcaucgugacuugcgcuauguuuaccugcaagaaaaacauggaggggaaggucguucagccugaaaaucuagaguauacaaucgugauuaccccacacucaggagaagagaacgccguagguaaugauacuggcaaacaugggaaggagauaaaagugacgccgcagaguagcaucacagaagcagagcucaccggauacggcacugucaccauggaauguucucccaggacaggucuggacuucaacgagauggugcuucugcagauggaaaauaaggcuugguugguucaccggcaaugguuucucgaucugccuuuaccauggcugcccggggccgacacccagggcuccaacuggauucagaaagagacucucgugacauucaagaacccucacgcgaagaaacaggaugucgugguacuuggaucacaagagggcgccaugcauacggcacugaccggggcuacugaaauccagaugagcaguggaaauuugcuauuuacaggucaccugaagugccgucuccgcauggacaaacugcagcuuaagggcaugucuuauuccauguguaccgggaaauucaagguugugaaggagauagccgaaacacaacauggaacuauugucaucagagugcaguacgagggcgacgguagcccaugcaaaauccccuucgagauuauggaucuggaaaagaggcacgucuuggggcggcucaucaccgugaacccgauuguuacggagaaagacucgccugugaauauagaagcugagcccccauuuggcgauucuuacaucauuaucggaguagaaccuggccagcugaaguuauccugguucaaaaaggggucaaguaucggacagauguuugagaccacaaugcgaggugccaagcgcauggcaauucugggcgacacugccugggauuucgggagccuaggaggcgucuuuaccuccauagguaaagcucuccaucaaguguucggggcgaucuauggcgcagccuuuucuggaguuagcuggacaaugaagauucugaucggcguggucauuacuuggaucgggaugaacucaagaaguaccucccuuagcgugucuuugguacuggugggaguugucacgcucuaccugggcgugauggugcaggcugacucagguugugucguuaguuggaaaaauaaggagcuuaaaugcgggagcggaauauucaucacagauaacgugcacaccuggacugaacaguauaaguuucagcccgaguccccaucuaagcuggccucggcaauucaaaaagcccacgaagagggcaucugugguauuaggagcgugacacgguuggaaaaucucauguggaagcagaucacccccgagcugaaccauauauuauccgagaaugaaguaaaacugacuauuaugaccggcgacaucaaggggauuaugcaggcuggaaaacgcucacuaagaccucagccaacagagcucaaguacaguuggaaagccuggggcaaggcaaagaugcugucuacggaacuucacaaccauaccuucuugaucgaugggccggagacugcggaaugccccaauacaaacagggcuuggaauagccuggaggucgaggacuauggauuuggcguguucaccacaaaccucuggcugaaauuaaaggaacgucaagauguauuuugugacuccaaacugaugucagccgcaauaaaggacaaucgggccgugcacgcugauauggguuacuggaucgagagcgcccuuaacgacacuuggaaaauugaaaaggcaucuuucaucgaggucaaguccugccacuggccuaaaagucauaccuuguggagcaacggggugcucgagucugaaaugauuaucccaaaguccuucgcuggacccguuucacagcacaauuaucgaccuggcuaccauacgcagacagccgguccauggcaccugggcagacuagagauggauuuugacuucugugaagggaccacugugguagucaccgaggauugcggaaacaggggccccagucugcgcacaacuaccgcgagcgggaaacucauaacagaauggugcugucggucgugcacgcugccgccucuuagauacaggggagaggacggcuguugguaugguauggagauucgcccauugaaggaaaaagaggaaaaucuggugaacuccuuagugaccgccgggcauggacagaucgauaauuuuucucucggcguccuggguauggcucuuuuccuggaggaaauguugcgaacucggguuggcacaaagcacgcaauccuccugguggccguuagcuuugugacccuaauuacugggaacaugucauuccgugaccugggaagagucauggugaugguuggcgcuacaaugaccgaugacaucgggaugggagugacguaccucgcccugcuugcagcguuuaaggucaggcccacuuucgccgcuggcuugcuguuacgcaaacucaccaguaaggagcugaugaugacaaccauugguauagugcuucugucccaaucuacuaucccugagacaauucuagaacucaccgaugcccuggcauuggggaugaugguucugaaaaucgugcggaauauggagaaguaucaguuagcugucacaauuauggccauccucugcguacccaacgcagugauacugcagaaugccuggaaaguuagcuguacuacccuugcuguggucuccgugucaccacuguugcucacgagcagucaacagaaggcggacuggaucccucuggcccuaacaauuaagggacugaaccccaccgcaaucuuucuuacuacccucucuagaacauccaaaaagaggagcuggccacugaaugaagcuauuauggccguaggcauggugucgaucuuggccucaucucugcuaaagaacgauauaccgaugacuggcccucucgucgcugggggacugcuuaccguuugcuacgugcugacgggucgaagugcagacuuggagcucgaacgcgccgcggacgugcggugggaggagcaggcugaaauuuccggcagcucucccauccugagcaucacaauuuccgaggaugggucaaugaguauaaagaaugaagaggaggaacagacccuaacuauccugauuagaacaggacuucucgucaucagcggccuguucccagugucuauucccaucaccgccgcagccugguauuugugggagguuaaaaagcaaagggcugguguauuaugggacgugccuuccccacccccugucgggaaagcagaacuggaggauggagccuaccguauaaagcagaagggcauccucggcuauucacagauuggggcgggaguguacaaagaagguacuuuucacacaauguggcauguuacccgcggcgcugugcugaugcacaaggggaaacggaucgagccgaguugggccgacgucaagaaagaucuuauuagcuacggaggcgguuggaagcuggagggggaauggaaggagggagaagaggugcagguauuggcacuagaaccaggcaaaaaccccagagccguccaaacgaagccuggccuguucaaaacuaauaccgggacaaucggagcugugucccucgacuuuucuccagguaccucgggcagccccauaguugauaagaaagggaagguggucggacuguauggcaacggugugguuacaaggucagggacuuacguguccgccauugcacagaccgagaagaguaucgaggacaacccugaaaucgaggaugacauuuuccggaaaaagagacuuacgaucauggauuuacauccgggagcuggcaaaacaaagcgcuaucugcccgccauagucagagaagcgauuaaaaggggccuccggacuuugauccuggccccaacccgagugguagcagcugagauggaagaggcccucagagggcugccuauucgcuaccagacacccgcuaucagggcagagcacaccggacgugaaauaguggaccuuaugugucaugccacuuucaccaugcggcuguugucuccaauuagaguuccuaauuauaaccuaaucaucauggaugaggcccacuuuacagaccccgcuagcauugcggcaagggguuacaucuccacgcgcgucgaaaugggcgaggccgcugggauuuucaugacugccaccccaccgggaucacgagacccuuuuccccagucuaaugcaccaauaauggaugaggaaagagagauccccgaacggagcuggaacaguggccacgagugggugacagacuucaaggguaagaccgugugguuugucccuuccauuaaagccgggaaugauaucgcugcgugccugaggaagaacggcaaaaagguaauccaacucagccgcaaaacuuucgacucugaauauauuaagacacguaccaaugauugggacuuugugguuacgacugauauaucagagaugggcgccaacuucaaggcagagagagugaucgacccacggagguguaugaaacccgucauuuuaacagauggcgaagaacgcgugauccuggcugggccuaugccgguuacccauuccagugccgcacagcgaagaggacggguggguaggaauccaaagaacgaaaaugaccaguacauuuacaugggcgagccccuugaaaacgaugaggacugcgcccacuggaaagaggcuaagaugcugcucgacaauaucaacaccccugaagggauaauccccagcauguuugagccagaacgcgagaaagucgaugccauugacggagaauauagauugaggggcgaggcgcggaagacuuucguggaucugaugcgucgcggugaccucccuguauggcuggcauaccgaguggccgcugaggggaucaauuaugccgauagaaggugguguuuugacggcauuaaaaacaaccaaauccuugaagagaauguugaagucgagauauggacaaaggagggagaacggaagaaacuaaagccccgcuggcuggaugcuagaauuuacucggacccauuggcauuaaaagaguucaaggaguucgccgcuggcaggaaaucucugacccucaaccugaucacagagauggggcggcuuccuacuuuuaugacgcagaaggcccgaaaugcacuggauaaccucgcgguguugcauaccgccgaagcuggagguagagccuauaaucacgcacuguccgagcuaccggagacacuggaaacucuccuucuguuaaccuugcuggcuacagugaccggcgggauuuuccucuuucugaugagcggaaagggcaucgguaaaaugacucuugggaugugcugcauaaucacggccucaauucugcucugguacgcacagauccagccccacuggauugccgcuaguaucauauuggaguucuuucugauugucuuacuaaucccagaaccugagaagcaacgcacaccccaggacaaccagcugacauauguugugaucgcgauucucacuguaguggccgcaaccauggcuaaugaaaugggcuuccuugagaaaacaaagaaagauuuuggacugggcucuaucaccacucagcaaccagaguccaacauauuggacauugaucugaggccugccagcgccuggacacucuacgcagucgcuacgaccuucaucacucccaugcugcggcauucaauugaaaauaguagcgugaacguuucccuuacagccaucgcgaaucaggcuaccgugcucauggggcugggaaaggguuggccguugucuaagauggacauaggcgucccacuguuagccaucggguguuacagccagguaaacccuauuacccuaacagcagcccugcuccuucugguggcucacuaugcaaucauuggacccggcuugcaggccaaagcgacucgugaggcucaaaagagagccgcagccgguaucaugaaaaauccaacgguugacgggauuaccgugaucgaucuggaccccauaccuuacgauccgaaguuugaaaaacagcucggccaggucaugcugcuuguguuaugcgucacacaggugcugaugaugaggacuaccugggcucucugugaggccuugacacuggcaaccggacccauuuccacucuaugggaaggcaacccagggcgcuucuggaauacgacaaucgcuguuucaauggccaacaucuuucggggaucuuaucuggcgggcgccggucuccuuuucaguauuaugaagaauaccgcaaacacucgaagagggaccggaaacacaggcgagacucugggugagaaguggaaaaauagguugaacgcucugggcaagucggaauuucaaauauacaaaaagagcgggauccaggagguggaccgcacccucgccaaagaaggaauuaagcggggcgagacagaucaucacgcaguauccagagggucugcuaaacugcguugguucguggagaggaauuuagucacgccugaaggaaagguuguggaccuuggcugcgguagaggcggguggucauauuacugugggggucugaagaacgucaaagaggugaagggccucaccaaagggggacccggccaugaggaaccuaucccaaugagcacuuauggguggaaucuaguacgccugcaguccggaguggauguuuucuuuacacccccugaaaagugcgacaccuugcugugugauauuggcgagaguucuccaaaccccacuguggaggccggucgaacacucagaguccuuaaucugguggaaaacugguugaauaacaauacccaauucugcaucaaaguccugaacccguacaugccuagcgugauagagaagauggaagcccuccagaggaaguacgggggagcguuaguucggaauccacugucacgcaacuccacgcacgagauguauuggguaaguaaugcuagcggcaacaucgugucuuccgucaacaugauuucaagaaugcuuaucaauagguuuaccaugcgacacaaaaaggcaacauacgaacccgacguggaucugggcagcgggacucggaacauuggaaucgagucggagaccccuaaucuagacauaauugguaaacguaucgaaaagaucaaacaggagcaugaaacaucuuggcacuaugaucaggaccauccauacaagacuugggccuaucacggcaguuacgagaccaagcaaacaggguccgcuagcucaaugguuaacggaguggucagacuccugaccaaacccugggacauuauaccgauggugacucagauggccaugacggauacaaccccuuucggccagcagcgcguauuuaaggaaaaaguggacacuaggacccaagagcccaaggaggguaccaaaaaguugaugaagaucacggcagaauggcuguggaaagagcucgggaagaaaaagaccccacggauguguacuagagaagaguucacacgcaaaguuagguccaaugccgcucuuggagcgauuuuuaccgaugagaacaaguggaaaucugcccgagaagcagucgaggacagcggcuucugggaacugguggauaaggagcggaauuuacaccuggaaggcaagugcgagacuuguguguauaacaugauggggaaaagagagaagaaauugggagaauuugguaaggcuaaaggcaguagggccaucugguacauguggcucggggcacgcuuccuggaguuugaagcccuaggauuccuuaaugaggaccauugguuuucccgugaaaacagccugucuggcgucgagggugaggggcuccacaagcugggauacauuuugcgggauguuucaaagaaagaaggcggcgcuauguaugccgacgauacagcggggugggacaccagaaucacacuggaggaucucaagaaugaagagauggugacuaaccauauggaaggagagcacaagaaacuugcagaggccauauucaaacugaccuaccagaauaaaguagugaggguccagcgcccuacgccccgagguaccgugauggacaucauuagucggagagaccagaggggcuccgggcaaguugugacauauggauuaaacacuuucaccaauauggaagcucagcugauccgccagauggagggcgaaggugucuuuaagagcauucaacaguugacagugacugaggagaucgccgucaaaaacuggcucguuagaguggggcgggaaaggcugucucguauggcaauuucgggagaugacugcgucgugaagccacuagaugaccgauucgcuucagcccuuaccgcucugaacgauaugggcaaagugcgcaaggacauacagcagugggagcccagcagaggcuggaaugauuggacgcaagucccuuuuugcucccaucacuuccacgaacucaucaugaaagacgggcggguucuggugguaccauguaggaaccaggaugaguugauuggacgcgccagaaucagucagggugcaggcuggucuuuacgggaaacagcgugccugggaaagagcuacgcccagauguggucccucauguauuuucauaggcgagaccuucgucuggcugccaaugcaaucuguucagcugugccgagucacuggguccccaccucuagaacuacauggagcauucaugccacccacgaguggaugacuaccgaggauaugcuaacaguguggaaccgcguuuggauacaagaaaauccuuggauggaggacaagacgcugguggaauccugggaggaaaucccauaccucggaaaacgggaggaucaguggugcggcucauugauuggucugaccagcagggcaacuugggccaagaacauccagacagcgauuaaucaggucagaucucuuaucgggaacgaggaauauaccgacuacaugcccuccaugaaacgcuuccggagggaggaagaggaagcuggagugcugugguga

SEQ ID NO: 14977 - RNA, 9876 nt, Artificial Sequence
  derived and/or modified CDS sequence (opt3) from DENV-2__JN851128__SS-prME
accgccggcaucauuauaaugaugauccccacagugauggcuuuccaccugacuacgagaaacggggagccucauaugauugucagcaggcaggaaaagggaaaaucccuccuuuuuaagaccgagaaugguguuaacaugugcacacugauggcaauggacuugggcgaauuaugugaggauacuaucaccuacaauugcccacugcuacggcaaaacgaaccggaggacauugauuguuggugcaauucuacaucaaccugggugacuuaugggacauguaccgccacgggagagcaccgccgagaaaaacguaguguagcgcucgugccccaugucggcaugggucuggagacuagaaccgaaacauggaugagcuccgagggggcuuggaagcacgcccagaggaucgagacuugggugcuucggcauccuggauucaccauaauggcagccauccuggcuuacacaauuggcaccacguauuuucagcgcguuuugaucuucauucuccugacugcaguggccccaucuaugacaaugagaugcaucggcauaucgaacagggacuuugucgaaggggugucaggagguagcuggguagauauuguucuggagcacggcaguugugugaccacuauggcuaaaaauaagcccacacucgacuucgaauuaaucaagaccgaggccaaccacccugcgacgcugcggaaauacugcauugaagcaaagcuuaccaauacaacuaccgccucccgcuguccaacacagggggagcccucuuugagcgaggaacaagauaaacgauuugucugcaagcauuccaugguggacagaggauggggcaacgguugugggcuguucggaaaaggcggcaucgugacuugcgcuauguuuaccugcaagaagaauauggaggggaaagucguucagccugaaaaccuagaguauacaaucgugauuaccccacacucaggagaagagaaugccguagguaacgauacuggcaagcaugggaaagagauaaaggugacgccgcagaguagcaucacagaagcagagcucaccggauacggcacugucaccauggaauguucucccaggacaggucuggacuucaaugagauggugcuucugcagauggaaaacaaagcuugguugguucaccggcaaugguuucucgaucugccuuuaccauggcugcccggggccgacacccagggcuccaacuggauucagaaggagacucucgugacauucaaaaauccucacgcgaagaagcaggaugucgugguacuuggaucacaagagggcgccaugcauacggcacugaccggggcuacugaaauccagaugagcaguggaaacuugcuauuuacaggucaccugaaaugccgucuccgcauggacaagcugcagcuuaaaggcaugucuuauuccauguguaccgggaaguucaaaguugugaaggagauagccgaaacacaacauggaacuauugucaucagagugcaguacgagggcgacgguagcccaugcaagauccccuucgagauuauggaucuggaaaaaaggcacgucuuggggcggcucaucaccgugaauccgauuguuacggagaaggacucgccugugaacauagaagcugagcccccauuuggcgauucuuacaucauuaucggaguagaaccuggccagcugaaauuauccugguucaagaaagggucaaguaucggacagauguuugagaccacaaugcgaggugccaagcgcauggcaauucugggcgacacugccugggauuucgggagccuaggaggcgucuuuaccuccauagguaaggcucuccaucaaguguucggggcgaucuauggcgcagccuuuucuggaguuagcuggacaaugaaaauucugaucggcguggucauuacuuggaucgggaugaauucaagaaguaccucccuuagcgugucuuugguacuggugggaguugucacgcucuaccugggcgugauggugcaggcugacucagguugugucguuaguuggaagaacaaagagcuuaagugcgggagcggaauauucaucacagauaaugugcacaccuggacugaacaguauaaauuucagcccgaguccccaucuaagcuggccucggcaauucaaaaggcccacgaagagggcaucugugguauuaggagcgugacacgguuggaaaaccucauguggaaacagaucacccccgagcugaaucauauauuauccgagaacgaaguaaagcugacuauuaugaccggcgacaucaaagggauuaugcaggcuggaaagcgcucacuaagaccucagccaacagagcucaaauacaguuggaaggccuggggcaaagcaaagaugcugucuacggaacuucacaaucauaccuucuugaucgaugggccggagacugcggaaugccccaacacaaauagggcuuggaacagccuggaggucgaggacuauggauuuggcguguucaccacaaaucucuggcugaaguuaaaagaacgucaagauguuuuuugugacuccaagcugaugucagccgcaauaaaagacaaccgggccgugcacgcugauauggguuacuggaucgagagcgccauuaacgacacuuggaagaucgaaaaagcaucuuucauugaggucaaguccugccacuggccuaagagucauacccuuuggagcaaugggguguuggagucugaaaugaucauaccaaaaaacuucgcuggacccguuucccagcacaauuaucgaccuggcuaccauacgcagacagccgguccauggcaccucggcagacuggagauggauuuugacuucugugaagggaccacugugguagucaccgaggauugcggaaacaggggccccucacuacgcacaacuaccgcgagugggaagcugauuacagaauggugcugucggagcugcacgcucccgccucugagauacaggggagaggacggcuguugguaugguauggagauccgcccacuuaaagaaaaggaggaaaauuuggugaacucgcuggugaccgccgggcauggacagaucgauaauuuuuccuuaggcguccucgguauggcucuguuccuugaggaaaugcugcgaacucggguuggcacaaaacacgcaauuuugcucguggccguaucuuuugugacccugaucacugggaacaugagcuuccgugaccuaggaagagucauggugaugguuggcgcuacaaugaccgaugacauugggaugggagugacguaccuggcccuccuggcagcguuuaaggucaggcccacuuucgccgcuggccuuuugcugcgcaaguuaaccucaaaagagcucaugaugacaaccauagguaucgugcugcuuagucaauccacuauuccugagacaauccuggaacuaaccgaugcccucgcacuggggaugaugauuuugaagaucguucggaauauggagaaauaucagcuggcugugacaauaauggccaucuuaugcguccccaacgcaguaauucuccagaaugccuggaaggugucuuguacuacccuggcuguugugagcgucuccccacuucuguugacgucaagccaacagaaagcggacuggaucccucucgcccugacaauuaagggacuaaaccccaccgcaaucuuucugacuacccuuaguagaacaucuaagaaaagguccuggccacucaaugaagcuauaauggccgugggcaugguaagcauucuggccucgucauugcugaagaacgauaucccgaugacuggcccuuuaguggcugggggacuccugaccgucugcuacguucuuacgggucgaucugcagaccuggaguuggaacgcgccgcggacgugcggugggaggagcaggcugaaaucaguggcuccagccccauucucucuauaacaaucagcgaggauggguccaugucaauuaaaaaugaagaggaggaacagacccugacuauccuaauuagaacaggacugcuugugaucaguggccucuucccagucagcauacccaucaccgccgcagccugguaucugugggaggugaagaaacaaagggcugguguuuugugggacguaccuucuccacccccuguggggaaggcagaauuagaggauggagccuaccguauuaaacagaagggcauccugggcuauucccagauuggggcgggagucuacaaggaagguacuuuucacacaauguggcaugugacccgcggcgcuguucucaugcacaaagggaagcggaucgagccgucaugggccgacgugaaaaaggaucugauaaguuacggaggcgguuggaaacuugagggggaauggaaggagggagaagagguccaggugcuggcauuggaaccaggcaagaaccccagagccguacaaacgaaaccuggccuauucaagacuaacaccgggacaauuggagcugucagccuggacuuuuccccagguaccucuggcucgcccaucguggauaaaaaggggaaaguugugggacucuauggcaauggugucgugacaaggagcgggacuuacguuucagccaucgcacagaccgagaaguccauugaggacaacccugaaaucgaggaugacauauuccgaaagaaacggcugacgauuauggaucuucauccgggagcuggcaagacaaaacgcuauuuacccgccaucgugagagaagcgauuaagaggggccugcggacucucaucuuggccccaacccgagucguggcagcugagauggaagaggcccugagagggcucccuauacgcuaccagacacccgcuauuagggcagagcacaccggacgugaaaucguagaccugaugugucaugccacuuucaccaugcggcuucugaguccaaucagagugccuaauuauaacuugauuaucauggaugaggcccacuuuacagaccccgcuucuauugcggcaagggguuacauaagcacgcgcguugaaaugggcgaggccgcugggaucuucaugacugccaccccaccgggaucccgagacccuuuuccccagucaaaugcaccaauuauggaugaggaaagagagauccccgaacggucuuggaacagcggccacgagugggucacagacuucaaagguaagaccgugugguuugugccuaguaucaaggccgggaaugauauugcugcgugccuaaggaaaaacggaaagaaagucauacaacugucccgcaagacuuucgacagcgaauauaucaaaacacguaccaaugauugggacuuuguagugacgacugauauuucugagaugggcgccaacuucaaggcagagagaguuaucgacccacggagguguaugaagcccgugauucucacagauggcgaagagcgcgucaucuuagcugggccuaugccggugacccauucauccgccgcacagcgaagaggacggguugguaggaauccaaaaaacgaaaaugaccaguacauauacaugggcgagccccuggaaaacgaugaggacugcgcccacuggaaggaggcuaaaaugcuucuggacaauaucaacaccccugaagggauuauccccaguauguuugagccagaacgcgagaagguggaugccauugacggagaauauagacucaggggcgaggcgcggaaaacuuucgucgauuugaugcgucgcggugaccugccuguguggcucgcauaccgaguagccgcugaggggaucaacuaugccgauagaaggugguguuuugacggcgugaagaauaaccaaauacuggaagagaauguugaagucgagauuuggacaaaagagggagaacggaagaagcuuaaaccccgcuggcuagaugcuagaaucuacagcgacccacuggcauugaaggaguucaaagaauucgccgcuggcaggaagucguuaacccugaaccucauuacagagauggggcggcugccuacuuuuaugacgcagaaagcccgaaaugcacuugauaaccuggcggugcuccauaccgccgaagcuggagguagagccuauaaucacgcauugucugagcugccggagacacuagaaacucugcuccuucugaccuuauuggcuacagugaccggcgggaucuuccuguuucucauguccggaaagggcauagguaagaugacucuggggaugugcugcaucauuacggccagcauccuucugugguacgcacagauucagccccacuggaucgccgcuucaauaauucucgaguucuuuuugaucguccuguuaaucccagaaccugagaaacaacgcaccccccaggacaaccagcuaacauauguugugauugcgauccugacuguaguggccgcaaccauggcuaaugaaaugggcuuccucgagaagacaaaaaaggauuuuggacuuggcaguauaaccacucagcaaccagagucuaacauucuggacaucgauuugaggccugccuccgccuggacacuguacgcagucgcuacgaccuucauuacucccaugcuccggcauagcaucgaaaauucaagugugaacguuagccugacagccauagcgaaucaggcuaccgugcuuauggggcucggaaaagguuggccgcuguccaagauggacaucggcgucccauugcuggccauuggguguuacucucagguaaacccuaucaccuuaacagcagcccuacugcuccuuguggcucacuaugcaauuaucggacccggccugcaggccaaggcgacucgugaggcucaaaaaagagccgcagccgguauuaugaagaauccaacgguugacgggaucaccgugauagauuuggaccccauuccuuacgauccgaaauuugaaaagcagcugggccaggucaugcuccuggugcuuugcgucacacagguguuaaugaugaggacuaccugggcucugugugaggcccucacauuggcaaccggacccaucagcacucugugggaaggcaacccagggcgcuucuggaauacgacaaucgcuguuuccauggccaacauuuuucggggaucauaucuagcgggcgccggucugcucuucucuauaaugaaaaacaccgcaaauacucgaagagggaccggaaacacaggcgagacucuuggugagaaguggaagaauaggcugaacgcuuugggcaaaagugaauuucaaaucuacaagaaaucggggauucaggagguggaccgcacccuggccaaggaaggaaucaaacggggcgagacagaucaucacgcaguaagcagaggguccgcuaagcuccguugguucguggagaggaaucuggucacgccugaaggaaaaguuguggacuuaggcugcggucgggggggauggucuuauuacuguggcggucuuaagaacgucaaggaggugaaaggccugaccaaggggggacccggccaugaagagccuauuccaaugucaacuuauggguggaaucucguacgccuacagagcggaguggauguuuucuuuacacccccugaaaaaugcgacacccuguugugugauaucggcgaguccaguccaaaccccacuguggaggccggucgaacacugagaguccucaaucuuguggaaaacuggcugaauaacaauacccaauucugcauaaaggucuugaacccguacaugccuucugugaucgagaaaauggaagcccugcagaggaaguacgggggagcgcucguucggaauccauuaagccgcaacucaacgcacgagauguauuggguauccaacgcuaguggcaauauugugagcucugucaacaugaucuccagaaugcugauuaauagguuuaccaugcgacacaagaaagcaacauacgaacccgacguggaucuuggcucagggacucggaacaucggaauagagagcgagaccccuaaucuggacauuaucgguaagcguaucgaaaaaauuaagcaggagcaugaaacaucguggcacuaugaucaggaccauccauacaaaacuugggccuaucacggcucuuacgagaccaagcaaacagggagugcuuccagcaugguuaacggaguggucagacuacucaccaagcccugggacauaaucccgauggugacucagauggccaugacggauacaaccccuuucggccagcagcgcguauuuaaagaaaagguggacacuaggacccaagagcccaaagaggguacaaagaaacugaugaagauuacggcagaaugguuguggaaggagcuggggaaaaagaaaaccccacggauguguacuagagaagaguucacacgcaagguuaggucaaaugccgcucucggagcgaucuuuaccgaugagaacaaauggaaguccgcccgagaagcagucgaggacucuggcuucugggaacuuguggauaaagagcggaaucugcacuuagaaggcaagugcgagacuuguguguauaacaugauggggaagagagagaaaaagcugggagaauuugguaaagcuaagggcagcagggccauuugguacaugugguugggggcacgcuuccucgaguuugaagcccugggauuccuaaaugaggaccauugguuuagucgugaaaacucccuuagcggcgucgagggugaggggcugcacaaacucggauacauccugcgggauguuucuaagaaggaaggcggcgcuauguaugccgacgauacagcggggugggacaccagaauaacauuggaggaucugaaaaaugaagagauggugacuaaccauauggaaggagagcacaagaaacucgcagaggccaucuucaagcuuaccuaccagaauaaaguagugaggguccagcgcccuacgccccgagguaccgugauggacauuaucucacggagagaccagaggggcagugggcaaguugugacauauggacugaacacuuucaccaacauggaagcucaguuaauucgccagauggagggcgaaggugucuuuaaguccauccaacagcugacagugacugaggagauugccguaaagaauugguugguuagaguggggcgggaaaggcucagccguauggcaauaucuggagaugacugcgucgugaaaccacuggaugaccgauucgcuucggcccuaaccgcucuuaacgauaugggcaaggugcgcaaagacauccagcagugggagcccucaagaggcuggaaugauuggacgcaagucccuuuuugcagccaucacuuccacgaacugauuaugaaggacgggcggguucucgugguaccauguaggaaccaggaugagcugaucggacgcgccagaaucucccagggugcaggcuggaguuugcgggaaacagcgugcuuagggaaaucuuacgcccagauguggagccugauguauuuucauaggcgagaccuccgucuugcugccaaugcaauuuguuccgcugugccgucacacuggguccccaccaguagaacuacauggucuauacaugccacccacgaguggaugacuaccgaggauaugcugacaguguggaaccgcguuuggauccaagaaaauccuuggauggaggacaagacgcuaguggaaagcugggaggaaauuccauaccugggaaagcgggaggaucaguggugcggcucccucaucgguuugaccucaagggcaacuugggccaaaaacauucagacagcgaucaaucaggucagaagccugauagggaacgaggaauauaccgacuacaugcccucuaugaagcgcuuccggagggaggaagaggaagcuggagugcuuugguga

SEQ ID NO: 14978 - RNA, 9876 nt, Artificial Sequence
  derived and/or modified CDS sequence (opt3) from DENV-2__JN851130__SS-prME
accgccggaaucauuauaaugaugauccccacagugauggcuuuccaccugacuacgcgaaacggggagccucauaugauuguaagcaggcaggaaaagggaaaaucccuccuuuuuaagaccgagaaugguguuaacaugugcacccugauggcaauggacuugggcgaauuaugugaggauacuaucaccuacaauugcccacugcugcggcaaaacgaaccggaggacauugauuguuggugcaauucuacaucaaccugggugacuuaugggacauguaccgccacgggagagcaccgccgagaaaaacguaguguagcgcucgugccccauguaggcaugggucuggagacuagaaccgaaacauggaugagcuccgagggggcuuggaagcacgcccagaggaucgagacuugggugcuucggcauccuggauucaccauaauggcagccauccuggcuuacacaauuggcaccacguauuuucagcgcguuuugaucuucauucuccugacugcaguggccccaucuaugacaaugcggugcaucggcauaucgaacagggacuuugucgaaggggugucaggagguagcuggguagauauuguucuggagcacggcaguugugugaccacuauggcuaaaaauaagcccacacucgacuucgaauuaaucaagaccgaggccaaacacccugcgacgcugcggaaguacugcauugaagcaaaacuuaccaacacaacuaccgccucccgcuguccaacacagggggagcccucuuugaaugaggaacaagauaagcgauuugucugcaaacauagcaugguggacagaggauggggcaacgguugugggcuguucggaaagggcggcaucgugacuugcgcuauguuuaccugcaagaaaaauauggaggggaagaucguccagccugaaaaccuagaguauacaauuguuauaaccccacacuccggagaagagaaugccguggguaacgauacuggcaaacaugggaaggagaucaaaguaacgccgcagucaaguauuacagaagcagagcucaccggauacggcacugugaccauggaauguagccccaggacaggucuggacuucaaugagaugguccuucugcagauggaaaacaaggcuugguuggugcaccggcaaugguuucucgaucugccuuuaccauggcugcccggggccgacacccagggcucuaacuggauccagaaagagacucucguuacauucaagaauccucacgcgaagaaacaggauguggucgugcuuggaucccaagagggcgccaugcauacggcacugaccggggcuacugaaauacagaugucaagcggaaacuugcuauuuacaggucaccugaagugccgucuccgcauggacaaacugcagcuuaagggcaugaguuauucuauguguaccgggaaauucaagguaguuaaggagauugccgaaacacaacauggaacuaucgugaucagaguccaguacgagggcgacgguuccccaugcaaaauucccuucgagaucauggaucuggaaaagaggcacguguuggggcggcucauuaccgucaauccgauagugacggagaaagacagcccuguuaacaucgaagcugagcccccauuuggcgauucguacauuaucaucggaguggaaccuggccagcugaaguuaucuugguucaaaaagggguccucaauuggacagauguuugagaccacaaugcgaggugccaagcgcauggcaauacugggcgacacugccugggauuucgggagucuaggaggcguauuuaccagcaucgguaaagcucuccaucaagucuucggggcgauuuauggcgcagccuuuuccggagugucuuggacaaugaagauccugauuggcguugugaucacuuggauagggaugaauagcagaucaaccagucuuuccgucagcuuggugcugguaggagugguuacgcucuaccugggcgucauggugcaggcugacucugguuguguggucucauggaaaaacaaggagcuuaaaugcgggaguggaaucuucauuacagauaauguucacaccuggacugaacaguauaaguuucagcccgagagcccauccaagcuggccucugcaauccaaaaagcccacgaagagggcauuugugguaucaggucggugacacgguuggaaaaccucauguggaagcagauaacccccgagcugaaucauauuuuaagcgagaacgaagugaaacugacuaucaugaccggcgacauuaaggggaucaugcaggcuggaaaacgcucccuaagaccucagccaacagagcucaaguacucauggaaaacguggggcaaggccaagaugcugaguaccgaacuucacaaucauacuuucuugauagaugggccggagacagcagaaugccccaacaccaauagggcguggaacucucuggagguagaggacuauggauuuggcgucuucacaacuaauaucuggcucaaacugaaggaacgucaagauguguuuugugacagcaaauuaauguccgcugccauuaaggacaaccgggcaguucacgccgauauggguuacuggaucgagucagcucugaacgacaccuggaaaauugaaaaggccagcuucaucgaggugaagucuugcuauuggccuaaaucccacacgcuuuggaguaauggggucuuggagagcgaaaugauaauuccaaagaacuucgcaggacccgugucucagcauaauuaccgaccuggcuaccacacacagaccgcugguccauggcaucucggcagacuggagauggauuuugacuucugugaagggacuaccguugugguaacagaggauugcggaaacaggggccccucccuacgcacuaccacagccucagggaaacugaucacggaauggugcugucggaguugcacccucccgccucugagauauaggggagaggacggcuguugguacgguauggagauccgcccacuuaaggaaaaagaggaaaauuuggucaacagccuggugacugcggggcacggacagauugauaauuuuucguuaggcgugcucgguauggcccuguuccuugaggaaaugcugcgaacacgggucggcaccaagcaugcuaucuugcucguugcaguguccuuuguaacucugauuacagggaacaugucuuuccgugaccuaggaagagugauggucauggugggcgccaccaugacggaugacauagggaugggaguuacuuaucuggcucuccuggccgcauuuaaggugaggcccaccuucgcggccggccuuuugcugcgcaaauuaacaagcaaggagcucaugaugaccacuaucgguauuguccugcuuucacaaaguacaaucccugagaccauucuggaacuaacagaugcucucgcccuggggaugauggcauugaaaaucgugcggaauauggagaaguaccagcuggcuguuacuauaauggccaucuuaugcgugcccaacgcagucauucuccagaaugccuggaaaguauccuguaccacgcuggcugugguuucugugagcccacuucuguugacauccucacaacagaaggcggacuggaucccucucgcccugaccauuaagggacuaaaccccacugcaaucuuucugaccacacuuagcagaacaaguaaaaagaggucuuggccacucaaugaagcuauaauggccgucggcaugguguccauucuggccagcucguugcugaaaaacgauaucccgaugaccggcccuuuaguagcugggggacuccugacggugugcuauguccuuacaggucgaucagcagaccuggaguuggaacgcgccgcggacguucggugggaggagcaggcugaaaucucuggcaguucccccauucucagcauaaccaucucugaggaugggagcauguccauuaagaaugaagaggaggaacagacucugacaauccuaauuagaaccggacugcuugugaucucaggccucuucccagugaguauacccaucacugccgcagccugguaccugugggaggucaaaaagcaaagggcugguguguugugggacguuccuagcccacccccuguagggaaagcagaauuagaggauggagccuaucguauuaagcagaagggcauccugggcuacucucagauuggggcgggaguguacaaagaagguacauuucacaccauguggcacgucacgcgcggcgcugugcucaugcauaaggggaaacggaucgagccguccugggccgacguuaagaaagaucugauaucauauggaggcgguuggaaacuugagggggaauggaaggagggagaagaggugcagguccuggcauuggaaccaggcaaaaaccccagagccgugcaaacuaagccuggccuauucaaaaccaacacagggaccauuggagcuguaagucuggacuuuagcccagguacauccggcucucccaucgucgauaagaaagggaaggugguuggacucuacggcaaugguguggucacuaggucggggaccuaugugagcgccaucgcacagacggagaagucaauugaggacaacccugaaaucgaggaugacauauucagaaagaaacggcugacaauuauggaucuucacccgggagcuggcaaaacuaagcgcuacuuacccgccaucguuagagaagcgauuaaaaggggccugcggacccucaucuuggccccaacacgaguggucgcagcugagauggaagaggcccugagagggcucccuauacgcuaucagacccccgcuauuagggcagagcauacuggacgugaaaucguggaccugaugugucacgccaccuucacaaugcggcuucuguccccaaucagaguaccuaauuacaacuugauuaucauggaugaggcccauuuuacggaccccgcuaguauugcggcaagggguuauauaucuacucgcguggaaaugggcgaggccgcugggaucuucaugaccgccacaccaccgggaagccgagacccuuuuccccaguccaaugcaccaauuauggaugaggaaagagagauccccgaacggucauggaacucuggccacgaguggguuaccgacuucaaggguaagacugucugguuugugccuagcaucaaagccgggaaugauauugcugcgugccuaaggaagaacggcaaaaaggugauacaacugagucgcaaaacauucgacuccgaauacaucaagacccguacgaaugauugggacuuugucguaacuacagauauuagcgagaugggcgccaacuucaaggcagagagagugaucgacccacggagguguaugaaacccguuauucucaccgauggcgaagaacgcgugaucuuagcugggccuaugccggucacccacucuucagccgcacagcgaagaggacggguggguaggaauccaaagaacgaaaaugaccaguacauauauaugggcgagccccuggaaaacgaugaggacugcgcccauuggaaagaggcuaagaugcuucuggacaauaucaacacuccugaagggauuauccccuccauguuugagccagaacgcgagaaaguugaugccauugacggagaauacagacucaggggcgaggcgcggaagacauucguggauuugaugcgucgcggugaccugccugucuggcucgcauaucgaguggccgcugaggggaucaacuacgccgauagaaggugguguuuugacggcgucaaaaauaaccaaauacuggaagagaauguggaaguugagauuuggaccaaggagggagaacggaagaaacuuaagccccgcuggcuagaugcuagaaucuauagugacccacuggcauugaaagaguucaaggaguucgccgcuggcaggaagucguuaacacugaaccucauuacugagauggggcggcugccuacguuuaugacccagaaggcccgaaaugcacuugauaaccuggcgguccuccacacagccgaagcuggagguagagccuacaaucaugcauugagcgagcugccggagacucuagaaacccugcuccuucugacauuauuggcuaccgugacuggcgggaucuuccuguuucucaugucuggaaagggcauagguaaaaugacgcuggggaugugcugcaucauuaccgccuccauccuucugugguaugcacagauucagccccacuggaucgccgcuagcauaauucucgaguucuuuuugaucgugcuguuaaucccagaaccugagaagcaacgcacaccccaggacaaccagcuaacuuacgucguuauugcgauccugaccgugguagccgcaacaauggcuaaugaaaugggcuuccucgagaaaaccaagaaagauuuuggacuuggcucaauaacuacacagcaaccagagaguaacauucuggacaucgauuugaggccugccucugccuggacgcuguacgcaguggcuaccacuuucauuacacccaugcuccggcacuccaucgaaaauagcucagucaacgugagucugaccgccauagcgaaucaggcuaccguucuuauggggcucggaaaggguuggccgcugagcaagauggacaucggcgugccauugcuggccauuggguguuauucccaggucaacccuaucacauuaacugcagcccuacugcuccuuguagcucauuacgcaauuaucggacccggccugcaggccaaagcgacgcgugaggcucaaaagagagccgcagccgguauuaugaaaaauccaaccguggacgggaucacaguuauagauuuggaccccauuccuuaugauccgaaguuugaaaaacagcugggccaggugaugcuccugguccuuugcgugacucaggucuuaaugaugaggaccacaugggcucugugugaggcccucaccuuggcaacuggacccaucucuacgcugugggaaggcaacccagggcgcuucuggaauacaaccaucgcugugagcauggccaacauuuuucggggauccuaccuagcgggcgccggucuacucuucucaauaaugaagaacacugcaaauacccgaagagggacaggaaacacuggcgagacccuuggugagaaguggaaaaauaggcugaacgcuuugggcaagucugaauuucaaaucuauaaaaagagugggauucaggagguugaccgcacacuggccaaagaaggaaucaagcggggcgagacggaucaccaugcagugucgagagggagcgcuaaacuccguugguucguagagaggaaucuggugaccccugaaggaaaggucguugacuuaggcugcgguagagggggaugguccuacuauuguggcggucuuaagaacgugaaagaggucaagggccugacuaaagggggacccggccacgaggaaccuauuccaaugucuacauacggguggaaucucgugcgccuacagucaggaguagauguguucuuuacacccccugaaaagugcgacacucuguugugugauaucggcgagagcuccccaaaccccacaguugaggccggucgaacccugagagugcucaaucuugucgaaaacuggcugaauaacaauacgcaauucugcauaaaaguguugaacccguacaugccuagugucaucgagaagauggaagcccugcagaggaaguaugggggagcgcucgugcggaauccauuaucucgcaacagcacccaugagauguacuggguuucaaacgcuuccggcaauauuguaaguagcgugaacaugaucucuagaaugcugauuaauagguuuacaaugcgacacaaaaaggcaacuuaugaacccgacgucgaucuuggcuccgggacccggaacaucggaauagagucagagauuccuaaucuggacaucaucgguaaacguauugaaaagauaaaacaggagcacgaaacaagcuggcauuacgaucaggaccacccauauaagacuugggccuaccauggcucguaugagaccaagcaaacagggucugcuaguuccauggugaacggaguugugagacuacucaccaaacccugggacgucaucccgauggugacucagauggccaugacggauacaaccccuuucggccagcagcgcguauuuaaggaaaaaguggacacuaggacccaagagcccaaggaggguacuaaaaagcugaugaagauuacggcagaaugguuguggaaagagcuggggaagaaaaagaccccacggauguguacuagagaagaguucacacgcaaaguuaggagcaaugccgcucucggagcgaucuuuaccgaugagaacaaguggaaaucagcccgagaagcagucgaggacuccggcuucugggaacuuguggauaaggagcggaaucugcacuuagaaggcaagugcgagacuuguguguacaacaugauggggaaaagagagaagaaacugggagaauuugguaaggcuaaaggcucuagggccauuugguacaugugguugggggcacgcuuccucgaguuugaagcccugggauuccuaaaugaggaccacugguuuagccgugaaaacagucuuuccggcgucgagggugaggggcugcauaagcucggauauauccugcgggauguuagcaagaaagaaggcggcgcuauguacgccgacgauacagcggggugggacaccagaauaacauuggaggaucugaagaaugaagagauggugacuaaccacauggaaggagagcauaaaaagcucgcagaggccaucuucaaacuuaccuaucagaauaagguagugaggguccagcgcccuacgccccgagguaccgugauggacauuaucucucggagagaccagaggggcucagggcaaguugugacauacggacugaacacuuucaccaacauggaagcucaguuaauucgccagauggagggcgaaggugucuuuaagaguauccaacagcugacagugacugaggagauugccgucaaaaauugguugguuagaguggggcgggaaaggcucucccguauggcaauaagcggagaugacugcgucgugaagccacuggaugaccgauucgcuucugcccuaaccgcucuuaacgauaugggcaaagugcgcaaggacauccagcagugggagcccucgagaggcuggaaugauuggacgcaagucccuuuuugcucacaccauuuccacgaacugauuaugaaagacgggcggguucucgugguaccauguaggaaccaggaugagcugaucggacgcgccagaaucagccagggugcaggcugguccuugcgggaaacagcgugcuuagggaagaguuaugcccagauguggucucugauguacuuucacaggcgagaccuccgucuugcugccaaugcaauuuguagcgcugugccgucccauuggguccccaccucaagaacuacauggaguauacacgccacccaugaguggaugacuaccgaggauaugcugacaguguggaaccgcguuuggauccaagaaaauccuuggauggaggacaagacgccaguggaaucuugggaggaaauucccuaucuaggaaaacgggaggaucaguggugcggcagccugaucggucucaccuccagggcaacuugggccaagaacauucagacagcgaucaaucaggucagaucauugauagggaacgaggaauacaccgacuacaugccuagcaugaaacgcuuccggagggaggaagaggaagcuggagugcugugguga

SEQ ID NO: 14979 - RNA, 9876 nt, Artificial Sequence
  derived and/or modified CDS sequence (opt3) from DENV-2__JN851125__SS-prME
accgccggcaucauuauaaugaugauccccacagugauggcuuuccaccugacuacgagaaacggggagccucauaugauugucagcaggcaggaaaagggaaaaucccuccuuuuuaagaccgagaaugguguuaacaugugcacacugauggcaauggacuugggcgaauuaugugaggauacuaucaccuacaauugcccacugcuaaaacaaaacgaaccggaggacauugauuguuggugcaauucuacaucaaccugggugacuuaugggacauguaccgccacgggagagcaccggcgcgaaaagcgaaguguagcgcucgugccccaugucggcaugggucuggagacucguaccgaaacauggaugagcuccgagggggcuuggaaacacgcccagagaaucgagacuugggugcuuaggcauccuggauucaccguuauggcagccauacuggcuuacacaaucggcaccacguauuuucagcggguguugauuuucauccuccugacugcagucgccccaucuaugacaaugcgcugcauuggcaucucgaacagagacuuuguggaagggguaucaggagguagcuggguugauauagugcuggagcacggcaguugugucaccacuauggcuaagaauaagcccacacucgacuucgaauuaauuaaaaccgaggccaagcacccugcgacgcugaggaaauacugcaucgaagcaaagcuuaccaacacaacuaccgccucccgguguccaacacagggggagcccucuuugaaugaggaacaagauaaacgcuuugugugcaagcauagcaugguggaccgaggauggggcaacgguugugggcuguucggaaagggcggcauugucacuugcgcuauguuuaccugcaaaaagaauauggaggggaaaguugugcagccugaaaaccuagaguauacaaucguaaucaccccacacuccggagaagagaaugccguggguaacgauacuggcaagcaugggaaagagauuaaggucacgccgcagucaaguauaacagaagcagagcucaccggauacggcacugugaccauggaauguagccccagaacaggucuggacuucaaugagaugguucuucugcagauggaaaacaaagcuugguuggugcacaggcaaugguuucucgaucugccuuuaccauggcugcccggggccgacacccagggcucuaacuggauccagaaggagacucucgucacauucaagaauccucacgcgaaaaagcaggaugugguaguucuuggaucccaagagggcgccaugcauacggcacugaccggggcuacugaaauucagaugucaagcggaaacuugcuauuuacaggucaccugaaaugccggcuccguauggacaagcugcagcuuaaaggcaugaguuauucuauguguaccgggaaguucaagguggucaaagagaucgccgaaacacaacauggaacuauagugauucgcguccaguacgagggcgacgguuccccaugcaagauccccuucgagaucauggaucuggaaaaaagacacguguuggggaggcucauuaccguuaauccgaucgugacggagaaggacagcccuguaaacauugaagcugagcccccauuuggcgauucguacauaaucauuggagucgaaccuggccagcugaaauuaucuugguucaagaagggguccucaaucggacagauguuugagaccacaaugcggggugccaaacgaauggcaauccugggcgacacugccugggauuucgggagucuaggaggcguguuuaccagcauugguaaggcucuccaucaaguuuucggggcgauauauggcgcagccuuuuccggagugucuuggacaaugaaaauccugauuggcgucgugaucacuuggauugggaugaauagccgcucaaccagucuuuccguaagcuuggugcugguuggagucgugacgcucuaccugggcgugaugguccaggcugacucugguuguguugugucauggaagaacaaagagcuuaagugcgggaguggaaucuucauaacagauaaugugcacaccuggacugaacaguauaaguuucagcccgagagcccauccaaacuggccucugcaauccaaaaggcccacgaagagggcauuugugguaucagaucgguaacaagguuggaaaaccucauguggaaacagauuacccccgagcugaaucauaucuuaagcgagaacgaagucaagaugacuauaaugaccggcgacauuaaagggaucaugcaggcuggaaagcggucccugcgcccucagccaacagagcuaaaauacucauggaaggccuggggcaaggcaaaaaugcucaguacggaacugcacaaucauaccuuccuuauugaugggccggagacugcggaaugccccaacacaaauagagcuuggaacucuuuggagguggaggacuauggauuuggcguuuucaccacaaauaucuggcugaagcucaaagaaaggcaagaugugagcugugacuccaagcugaugucagccgcaauaaaagacaaccgugccguccacgcugauauggguuacuggaucgagagcgccuuaaacgacacuuggaagauugaaaaggcaucuuuuaucgaggugaaauccugccacuggccuaagagucauacccuguggagcaaugggguucuugagucugaaaugauuaucccaaaaaacuucgcuggacccgugucccagcacaauuaucggccuggcuaccauacgcagacagccgguccauggcacuugggccgacucgagauggauuucgacuuuugugaagggaccacuguagucgugaccgaggauugcggaaacagaggccccucacugaggacaacuaccgcgagugggaagcuaauaacagaauggugcugucgcagcugcacgcugccgccucuccgguacagaggagaggacggcuguugguaugguauggagauuaggccacugaaagaaaaggaggaaaaucuugugaacucguuggucaccgccgggcauggacagaucgauaauuucucccugggcguuuuagguauggcucucuuucuggaggaaaugcuucgcacucgagugggcacaaagcacgcaauccuguugguagccgugucuuucgucacccucauuacugggaacaugagcuuucgggaccugggacgugugaugguuauggugggcgcuacaaugaccgaugacaucgggaugggagucacguaccuagcccugcucgcagcguucaaagugagacccacuuuugccgcuggccugcuuuugaggaagcugaccucaaaagaguuaaugaugacaaccauugguauaguucuccugagucaauccacuaucccugagacaauucuugaacugaccgaugcccuagcacucgggaugauggugcugaaggucguacgcaauauggagaaauaucaguuggcugugacaaucauggccauucugugcguucccaacgcagugaucuuacagaaugccuggaaggucucuuguacuacccucgcugugguaagcguguucccacugcuucugacguccucacaacagaaggcggacuggauaccuuuggcccucacaaucaaaggacugaaccccaccgcaauuuuucuaacuacccugagccggacaaguaagaaaagaucuuggccacuuaaugaagcuaucauggccgucggcaugguuuccauucucgccagcucgcuguugaagaacgauaucccgaugacuggcccucugguggcugggggauuacucaccgugugcuacguccugacggguaggucagcagaccuugagcuggaacgagccgcggacgugcgcugggaggagcaggcugaaauaucuggcaguucccccauuuugagcaucacaaucucugaggaugggagcauguccauuaaaaaugaagaggaggaacagacccucacuauacugauccggacaggacuacugguuauuucaggccuuuucccaguaaguauccccauuaccgccgcagccugguaucucugggaggugaagaaacaaagagcugguguccugugggacgugccuagcccacccccuguugggaaggcagaauuggaggauggagccuacaggaucaagcagaaaggcauauuaggcuauucucagaucggggcgggaguguacaaggaagguacuuuucacacaauguggcaugucacccguggcgcugugcugaugcacaaagggaagcgcauugagccguccugggccgacguaaaaaaggaucucaucucauacggaggcgguuggaagcuggagggggaauggaaagagggagaagagguccaggugcuugcacuggaaccaggcaagaacccccgggccguucaaacgaaaccuggcuuguucaagacuaacaccgggacaauuggagcugugagucuagacuuuagcccagguaccuccggcucucccaucgucgauaaaaaggggaaggugguuggacuguauggcaaugguguggucacaagaucggggacuuacgugagcgccauagcacagaccgagaaaucaauugaggacaacccugaaaucgaggaugacaucuucaggaagaaacgacucacgauuauggaucugcauccgggagcuggcaagacaaaacgguaucuucccgccaucguacgcgaagcgauaaagagaggcuuaaggacucugauucucgccccaacccgggugguugcagcugagauggaagaggccuugcgagggcugccuaucagauaccagacacccgcuauucgcgcagagcacaccggaagggaaaucgucgaccucaugugucaugccacuuucaccaugcgucugcuuuccccaauacgggugccuaauuauaaccugauuaucauggaugaggcccacuuuacagaccccgcuaguaucgcggcaagagguuacauuucuacgaggguggaaaugggcgaggccgcugggaucuucaugacugccaccccaccgggaagccgcgacccuuuuccccaguccaaugcaccaauuauggaugaggaacgagagauacccgaaagaucauggaacucuggccacgagugggucacagacuucaaggguaaaaccguaugguuugugccuagcaucaaggccgggaaugauauugcugcgugcuugcggaaaaacggaaagaaaguuauccaacuaaguaggaagacuuucgacuccgaauauaucaagacacgcaccaaugauugggacuuuguggucacgacugauauuagcgagaugggcgccaacuucaaagcagagcgugugauagacccaagacgguguaugaagcccguuauccugacagauggcgaagagagggugauucucgcugggccuaugccggucacccauucuucagccgcacagcgccgaggaagagugggucggaauccaaaaaacgaauccgaccaguacaucuacaugggcgagcccuuagaaaaugaugaggacugcgcccacuggaaggaggcuaaaaugcugcuugacaacauuaauaccccugaagggaucauacccaguauguuugagccagaaagggagaagguagaugccaucgacggagaauaucgccugagaggcgaggcgaggaaaacuuucguggaucucaugcggcguggugacuugccuguuuggcuggcauaccgcgucgccgcugaggggauuaacuaugccgaucgaagaugguguuuugacggcgugaagaacaaucaaauccucgaagagaacguggaagucgagauuuggacaaaggagggagaaaggaaaaagcugaaaccccgguggcuugaugcucgcaucuacagcgacccacuagcacugaaggaguucaaagaauucgccgcuggcagaaagucguugaccuuaaaucugauaacagagauggggaggcucccuacuuuuaugacgcagaaggcccggaacgcacuggauaaucuugcgguucugcauaccgccgaagcuggaggucgagccuauaaccacgcacucucugaguugccggagacacuggaaacucuacugcuccuuacccuguuagcuacagugaccggcgggauuuucuuguuucugauguccggaaaaggcaucgguaagaugacucucgggaugugcugcauuaucacggccagcauacugcuuugguacgcacagauccagccccacuggauugccgcuucaaucauucuggaguucuuucucaucguauugcugauaccagaaccugagaaacaaagaaccccccaggacaaucaguuaacauauguggucauugcgauccuaacugugguugccgcaaccauggcuaacgaaaugggcuuccuggagaagacaaaaaaggauuuuggacucggcaguucuaccacucagcaacaugaguccaauauccuugacauugaucugcgcccagccagcgccuggacauuguacgcaguggcuacgaccuucaucacuccuaugcugaggcacucaauagaaaacaguagcgucaauguaucccucacagccauugcgaaccaggcuaccgugcugauggggcuuggaaaggguuggccccucucuaaaauggacaucggcguuccgcuguuggccauuggguguuacagccaggugaauccaaucacccugacagcagccuuacuaucccuggucgcucauuaugcaauaaucggaccuggccuccaggccaaggcgacucgggaggcucaaaaacgugccgcagccgguauuaugaagaaccccacgguggacgggaucaccgucauugaucuugacccaauccccuacgauccuaaauuugaaaagcagcugggccaggugauguugcugguucucugcgugacacagguacugaugaugagaacuaccugggcucuuugugaggccuuaacacuggcaaccggaccgauuucaacucucugggaaggcaaucccgggagguucuggaacacgacaaucgcugugucuauggccaauauauuucgcggaaguuauuuggcgggcgccggucugcuauucucgauuaugaagaacaccgcaaacacucggcgagggaccggaaauacaggcgagacucugggugagaaauggaagaacagacucaaugcucuuggcaaaagcgaauuucaaaucuacaagaaauccgggauccaggaggucgacaggacccuggccaaggaaggaauuaaacgcggcgagacagaucaccaugcaguuucucgggggucagcuaaguugagaugguucguggagcguaaccuggucacgccagaaggaaaggugguagaccucggcugcgguagggggggauggagcuauuacuguggcggucugaaaaaugugaaggagguuaaaggcuuaaccaaggggggaccuggccacgaagagcccauaccuauguccacuuauggguggaaccuugugcggcugcagaguggagucgauguguucuuuacaccacccgaaaaaugcgacacccuccuaugugauaucggcgagucuagcccuaauccaacugucgaggccggucgcacacugcgaguguugaaccugguugaaaauuggcucaacaauaacacccaauucugcauuaagguacuuaaucccuacaugccgucagugaucgagaagauggaagcccugcagagaaaauacgggggagcguuggucaggaacccucugucccggaauaguacgcacgagauguauugggugagcaacgcuucuggcaacauuguuuccucagugaauaugaucagccgcaugcucauaaacagauuuaccaugaggcauaagaaagcaacauacgaaccagacgucgauuuaggcucggggacucgaaauaucggaauugagucugagacccccaaccuggacaucauugguaagcggaucgaaaaaauaaagcaggagcacgaaacaaguuggcauuaugaucaggaccacccuuacaagacuugggccuaucacggcuccuacgagaccaaacaaacagggagcgcuucauccauggugaauggaguagugcgucuucugaccaagccaugggacguuauucccauggucacucagauggccaugacggauacaaccccguucggccagcagagaguguuuaaagaaaagguggacacucgcacccaagagccuaaagaggguacaaagaagcuaaugaaaaucacggcagaauggcucuggaaggagcuggggaaaaagaaaacccccaggauguguacucgggaagaguucacaagaaagguccgcucuaacgccgcuuugggagcgaucuuuaccgaugagaauaaauggaagagcgccagggaagcaguugaggacaguggcuucugggaacugguggauaaggagcgaaaccuccaucuugaaggcaaaugcgagacuuguguauauaauaugauggggaagcgggagaaaaagcugggagaauuugguaaagcuaagggcuccagagccauuugguacaugugguuaggggcaagguuccuggaguuugaagccuugggauuccucaacgaggaccacugguuuagccgcgaaaauucucugucaggcguggagggugaggggcuacauaagcuuggauacauacugcgugaugucaguaaaaaggaaggcggcgcuauguaugccgacgauacagcggggugggacacccggaucacacucgaggaucugaaaaacgaagagauggugacuaaucacauggaaggagagcauaagaaauuggcagaggccauuuucaagcugaccuaccagaacaagguugugagaguccagaggccaacgccucgcgguaccgugauggacaucauuucccgacgggaccagagaggcagcgggcaaguaguuacauauggacucaauacuuucaccaacauggaagcucagcuuaucaggcagauggagggcgaagguguguuuaaaucuauacaacagcugacagccacugaggagaucgcagucaagaacugguuagugcgcguggggagagaacggcugucgaggauggcuauuucaggagaugacugcgucguuaaacccuuggaugaccguuucgccagcgcucucaccgcccugaaugauaugggcaaggugcgaaaagacauccagcagugggagccaucccgcggcuggaacgauuggacgcaaguacccuuuugcagucaccacuuccaugaacuaauuaugaaggacgggagagugcuugucgugccuugucggaaucaggaugagcugaucggaagggcacgcauuucucagggugcgggcuggagccucagagaaacagccugccuggggaaguccuacgcucagauguggucauugauguauuuucaccggagggacuuacgacuggccgcaaacgcuauauguagugccguuccaucucauugggugccgaccagccguacuacaugguccauccacgcaacccacgaguggaugacuaccgaggauaugcucacagucuggaauagaguguggauucaagaaaaccccuggauggaggacaaaacgccuguagaaucaugggaggaaaucccauaccuuggaaagcgcgaggaucaguggugcggcagccugaucggucuaaccucucgggccacuugggcgaaaaauauucagacagcuauaaaccagguuaggucccugaucgggaaugaggaauauaccgacuacaugcccaguaugaagagauuccgccgggaggaagaggaagccggagugcucugguga

SEQ ID NO: 14980 - RNA, 9876 nt, Artificial Sequence
  derived and/or modified CDS sequence (opt3) from DENV-2__JN851123__SS-prME
accgcaggcaucauuauaaugaugaucccaacggugauggcuuuccaccugacuacgaggaacggggaaccucauaugauugucagcaggcaggaaaagggaaaaucccuccuuuuuaagaccgagaaugguguuaacaugugcacacugauggcaauggacuugggcgaauuaugugaggauacuaucaccuacaauugcccacugcugaaacaaaacgaaccggaggacauugauuguuggugcaauucuacaucaaccugggugacuuaugggacauguaccgccacgggagagcaccggcgcgaaaagcgaaguguagcgcucgugccccaugucggcaugggucuggagacucguaccgaaacauggaugagcuccgagggggcuuggaaacacgcccagagaaucgagacuugggugcuuaggcauccuggauucaccauaauggcagccauccuggcuuacacaauuggcaccacguauuuucagcggguuuugaucuucauucuccugacugcaguggccccaucuaugacaaugcgcugcaucggcauaucgaacagagacuuugucgaaggggugucaggagguagcuggguagauauuguucuggagcacggcaguugugugaccacuauggcuaagaauaagcccacacucgacuucgaauuaaucaaaaccgaggccaagcacccugcgacgcugaggaaauacugcauugaagcaaaacuuaccaacacaacuaccgccucccgguguccaacacagggggagcccucuuugaaugaggaacaagauaaacgcuuugucugcaagcauagcaugguggaccgaggauggggcaacgguugugggcuguucggaaagggcggcaucgugacuugcgcuauguuuaccugcaaaaagaauauggaggggaaaaucguccagccugaaaaccuagaguauacaauuguuauaaccccacacuccggagaagagaaugccguggguaacgauacuggcaagcaugggaaagagaucaagguaacgccgcagucaaguauuacagaagcagagcucaccggauacggcacugugaccauggaauguagccccagaacaggucuggacuucaaugagaugguccuucugcagauggaaaacaaggcuugguuggugcacaggcaaugguuucucgaucugccuuuaccauggcugcccggggccgacacccagggcucuaacuggauccagaaggagacucucguuacauucaagaauccucacgcgaaaaagcaggauguggucgugcuuggaucccaagagggcgccaugcauacggcacugaccggggcuacugaaauacagaugucaagcggaaacuugcuauuuacaggucaccugaaaugccggcuccguauggacaagcugcagcuuaaaggcaugaguuauucuauguguaccgggaaguucaagguaguuaaagagauugccgaaacacaacauggaacuaucgugauccgcguccaguacgagggcgacgguuccccaugcaagauucccuucgagaucauggaucuggagaagagacacguguuggggaggcucauuaccgucaauccgauagugacggagaaggacagcccuguuaacaucgaagcugagcccccauuuggcgauucguacauuaucaucggaguggaaccuggccagcugaaauuaucuugguucaagaagggguccucaauuggacagauguuugagaccacaaugcggggugccaaacgaauggcaauacugggcgacacugccugggauuucgggagucuaggaggcguauuuaccagcaucgguaaggcucuccaucaagucuucggggcgauuuauggcgcagccuuuuccggagugucuuggacaaugaaaauccugauuggcguugugaucacuuggauagggaugaauagccgcucaaccagucuuuccgucagcuuggugcugguaggagugguuacgcucuaccugggcgucauggugcaggcugacucugguuguguggucucauggaagaacaaagagcuuaagugcgggaguggaaucuucauuacagauaauguucacaccuggacugaacaguauaaguuucagcccgagagcccauccaaacuggccucugcaauccaaaaggcccacgaagagggcauuugugguaucagaucggugacaagguuggaaaaccucauguggaaacagauaacccccgagcugaaucauauuuuaagcgagaacgaaaucaagcugacuauuaugaccggcgacaucaaagggauaaugcaggcuggaaagcggucccuacgcccucagccaacagagcucaaauacucauggaaggccuggggcaaggcaaaaaugcugaguacggaacuucacaaucauaccuucuugaucgaugggccggagacugcggaaugccccaacacaaauagagcuuggaacucucuggagguggaggacuauggauuuggcguauucaccacaaauauuuggcucaagcugaaagaaaggcaagaugucuuuugugacagcaaguuaauguccgccgcaaucaaagacaaccgugccgugcacgcugauauggguuacuggauugagucagcccugaacgacacuuggaagaucgaaaaggccagcuucauagagguuaaaucuugccacuggccuaagucccauacccuuuggaguaaugggguguuggagagcgaaaugauuauccccaagaacuucgcuggacccgucucucagcacaauuaucggccuggcuaccauacgcagacagccgguccauggcaccucggccgacuggagauggauuuugacuucugugaagggaccacugugguugugaccgaggauugcggaaacagaggccccucccuaaggacaacuaccgcgucagggaagcugaucacagaauggugcugucgcaguugcacgcucccgccucugcgguacagaggagaggacggcuguugguaugguauggagauuaggccacuuaaagaaaaggaggaaaauuugguaaacagccuggucaccgccgggcauggacagaucgauaauuuuucguuaggcgugcucgguauggcucuguuccuugaggaaaugcugcgcacucgagugggcacaaagcacgcaauuuugcucgucgccguuuccuuugugacccugauaacugggaacaugucuuuccgggaccuaggacguguaauggugauggucggcgcuacaaugaccgaugacaucgggaugggagugacguaccuggcccuccuggcagcguuuaaaguuagacccacuuucgccgcuggccuuuugcugaggaaguuaaccagcaaagagcucaugaugacaaccauugguaucgugcugcuuucacaaaguacuauuccugagacaauccuggaacuaaccgaugcccucgcacuggggaugauggucuugaagauagugcgcaauauggagaaauaucagcuggcuguuacaaucauggccauuuuaugcgugcccaacgcagucauccuccagaaugccuggaagguauccuguacuacccuggcugugguuucugugagcccacuucuguugacguccucacaacagaaggcggacuggauuccucucgcccugacaaucaaaggacuaaaccccaccgcaauauuucugacuacccuuagccggacaaguaagaaaagaucuuggccacucaaugaagcuauuauggccgucggcaugguguccauccuggccagcucguugcugaagaacgauaucccgaugacuggcccuuuaguagcugggggacuccugaccgugugcuacguccuuacggguaggucagcagaccuggaguuggaacgagccgcggacguucgcugggaggagcaggcugaaauuucuggcaguucccccauacucagcaucacaauuucugaggaugggagcauguccaucaaaaaugaagaggaggaacagacccugacuauucuaauccggacaggacugcuugugauaucaggccucuucccagugaguauccccauuaccgccgcagccugguaucugugggaggucaagaaacaaagagcugguguguugugggacguuccuagcccacccccuguagggaaggcagaauuagaggauggagccuacaggaucaagcagaaaggcauucugggcuauucucagaucggggcgggaguguacaaggaagguacuuuucacacaauguggcaugucacccguggcgcugugcucaugcacaaagggaagcgcauagagccguccugggccgacguuaaaaaggaucugauuucauacggaggcgguuggaaacuugagggggaauggaaagagggagaagaggugcagguccuggcauuggaaccaggcaagaacccccgggccgugcaaacgaaaccuggccuauucaagacuaacaccgggacaaucggagcuguaagucuggacuuuagcccagguaccuccggcucucccaucgucgauaaaaaggggaaggugguuggacucuauggcaaugguguggucacaagaucggggacuuacgugagcgccauugcacagaccgagaaaucaaucgaggacaacccugaaauagaggaugacauuuucaggaagaaacgacugacgaucauggaucuucauccgggagcuggcaagacaaaacgguauuuacccgccauuguucgcgaagcgaucaagagaggccugaggacucucauauuggccccaacccggguggucgcagcugagauggaagaggcccugcgagggcucccuauuagauaccagacacccgcuauccgcgcagagcacaccggaagggaaaucguggaccugaugugucaugccacuuucaccaugcgucuucuguccccaauucggguaccuaauuauaacuugaucauuauggaugaggcccacuuuacagaccccgcuaguauagcggcaagagguuacaucucuacgaggguggaaaugggcgaggccgcugggauuuucaugacugccaccccaccgggaagccgcgacccuuuuccccaguccaaugcaccaaucauggaugaggaacgagagauccccgaaagaucauggaacucuggccacgaguggguuacagacuucaaggguaaaaccgucugguuugugccuagcauuaaggccgggaaugauauagcugcgugccuacggaaaaacggaaagaaagugauccaacugaguaggaagacuuucgacuccgaauauauuaagacacgcaccaaugauugggacuuugucguaacgacugauaucagcgagaugggcgccaacuucaaagcagagcgugugauugacccaagacgguguaugaagcccguuauccucacagauggcgaagagagggugauauuagcugggccuaugccggucacccauucuucagccgcacagcgccgaggaagagugggucggaaucccaagaacgaaaaugaccaguacaucuacaugggcgagccccuggaaaacgaugaggacugcgcccacuggaaggaggcuaaaaugcuucuggacaauauuaacaccccugaagggaucauucccuccauguuugagccagaaagggagaagguugaugccaucgacggagaauaucgccucagaggcgaggcgaggaaaacuuucguggauuugaugcggcguggugaccugccugucuggcucgcauaccgcguggccgcugaggggauaaacuaugccgaucgaagaugguguuuugacggcguaaagaauaaccaaauucuggaagagaauguggaaguugagaucuggacaaaggagggagaaaggaagaaacuuaaaccccgguggcuagaugcucgcauuuacagugacccacuggcauugaaagaguucaaagaguucgccgcuggcagaaagagcuuaacccugaaccucaucacagagauggggaggcugccuacuuuuaugacgcagaaggcccggaaugcacuugauaaccuggcgguccuccauaccgccgaagcuggaggucgagccuauaaucacgcauugucggagcugccggagacacuagaaacucugcuccuucugaccuuauuggcuacagugaccggcgggauauuccuguuucucaugucuggaaaaggcaucgguaagaugacucuggggaugugcugcauuaucacggccuccauucuucugugguacgcacagauccagccccacuggauagccgcuagcauuauccucgaguucuuuuugaucgugcuguuaauuccagaaccugagaaacaaagaacaccacaggacaaccagcuaacauaugucguuaucgcgauacugacugugguagccgcaaccauggcuaaugaaaugggcuuccucgagaagaccaaaaaggauuuuggacuuggcucaauuaccacucagcaaccagagaguaacauccuggacauugauuugcgcccugccucugccuggacacuguacgcaguggcuacgaccuucaucacucccaugcucaggcauuccauagaaaauagcucagucaacgugagucugacagccaucgcgaaucaggcuaccguucuuauggggcucggaaaggguuggccgcugagcaaaauggacauuggcgugccauugcuggccaucggguguuacucccaggucaacccuauuaccuuaacagcagcccuacugcuccuuguagcucacuaugcaaucauuggacccggccugcaggccaaggcgacucgggaggcucaaaaacgugccgcagccgguaucaugaagaauccaacgguggacgggauaaccguuauugauuuggaccccaucccuuacgauccgaaauuugaaaagcagcugggccaggugaugcuccugguccuuugcgugacacaggucuuaaugaugagaacuaccugggcucugugugaggcccucacauuggcaaccggacccaucucuacucugugggaaggcaacccagggagguucuggaauacgacaauugcugugagcauggccaacauauuucgcggauccuaucuagcgggcgccggucuacucuucucaaucaugaagaacaccgcaaauacucggcgagggaccggaaacacaggcgagacucuuggugagaaauggaagaauagacugaacgcuuugggcaaaucugaauuucaaauuuacaagaaaagugggauccaggagguugacaggacccuggccaaggaaggaauuaaacgcggcgagacagaucaucacgcagugucgcgggggagcgcuaagcucagaugguucaucgagcguaaucugguaacgccugaaggaaagguggucgacuuaggcugcgguagagggggaugguccuauuacuguggcggucuuaaaaacguuaaggaggugaaaggccugaccaaagggggacccggccaugaagaaccuauaccaaugucuacuuauggguggaaucucguccggcuacagucaggaguggauguauucuuuacacccccugaaaaaugcgacacccuguugugugauaucggcgagagcuccccaaaccccacuguggaggccggucgcacacugcgaguucucaaucuuguggaaaacuggcugaauaacaauacccaauucugcauuaaggucuugaacccguacaugccuagugugaucgagaagauggaagcccugcagagaaaauacgggggagcgcucgucaggaauccauuaucucggaacagcacgcacgagauguauugggugucaaacgcuuccggcaauauuguuaguagcguaaacaugaucucucgcaugcugauaaauagauuuaccaugaggcacaagaaagcaacauacgaacccgacguggaucuuggcuccgggacucgaaacauuggaaucgagucagagaccccuaaucuggacaucauugguaagcggauagagaaaaucaagcaggaacaugaaacaagcuggcacuaugaucaggaccauccauacaagacuugggccuaucacggcucguacgagaccaaacaaacagggucugcuaguuccauggucaacggagugguucgucuacucaccaagcccugggacgugauuccgauggucacucagauggccaugacggauacaaccccuuucggccagcagagaguguuuaaagaaaagguagacacucgcacccaagagcccaaagaggguacaaagaagcugaugaaaaucacggcagaaugguuguggaaggagcuggggaaaaagaaaaccccaaggauguguacucgggaagaguucacaagaaaggugcgcagcaaugccgcucucggagcgauuuuuaccgaugagaacaaauggaagucagccagggaagcaguugaggacuccggcuucugggaacuugucgauaaggagcgaaaucugcacuuagaaggcaaaugcgagacuuguguguauaacaugauggggaagcgggagaaaaagcugggagaauuugguaaagcuaagggcucuagagccaucugguacaugugguugggggcaagguuccucgaguuugaagcccugggauuccuaaaugaggaccauugguuuagccgcgaaaacagucuuuccggcguggagggugaggggcugcacaagcucggauacauacugcgugaugucagcaaaaaggaaggcggcgcuauguaugccgacgauacagcggggugggacacccggaucacauuggaggaucugaaaaaugaagagaugguuacuaaccauauggaaggagagcacaagaaacucgcagaggccauuuucagacuuaccuaccagaauaaggugguaagggugcagcgcccuacgccccgagguaccgucauggacaucauuucucggagagaccagaggggcucagggcaagugguuacauauggacugaacacuuucaccaacauggaagcucaguuaauccgccagauggagggcgaagguguguuuaagaguauucaacaucugacagucacugaggagauagccgugaaaaauugguugguaagaguugggcgggaaaggcucucccguauggcaaucagcggagaugacugcguggucaagccacuggaugaccgauucgcuucugcccuaaccgcucuuaacgauaugggcaaagugcgcaaggacauucagcagugggagcccucgagaggcuggaaugauuggacacaggugccuuuuugcucacaccacuuccaugaacugaucaugaaagacgggcggguccucguugugccauguaggaaccaagaugagcugaucggacgcgccagaauuagccagggugcaggcugguccuugcgggaaacagcgugcuuagggaagaguuacgcccagauguggucucugauguauuuucacaggcgagaccuccgucuugcugccaaugcaauauguagcgcuguaccgucccauugggugcccaccucaagaacuacauggaguauccacgccacccacgaguggaugacuaccgaggauaugcugacagucuggaaccgcguguggauucaggaaaauccuuggauggaggacaagacgccaaucgaaucuugggaggaaauucccuaccuaggaaaacgggaggaucaauggugcggcagccugaucggucucaccuccagggcaacuugggccaagaacauacagacagcgaucaaucagguuagaucauugauugggaacgaggaauauaccgacuacaugccuagcaugaaacgcuuccggagggaggaagaggaagcuggagugcugugguga

SEQ ID NO: 14981 - RNA, 9876 nt, Artificial Sequence
  derived and/or modified CDS sequence (opt3) from DENV-2__JN851118__SS-prME
accgccggaaucauuauaaugaugauccccacagugauggcuuuccaccugacuacgcgaaacggggagccucauaugauugucagcaggcaggaaaagggaaaaucccuccuuuuuaagaccgagaaugguguuaacaugugcacacugauggcaauggacuugggcgaauuaugugaggauacuaucaccuacaauugcccacugcugcggcaaaacgaaccggaggacauugauuguuggugcaauucuacaucaaccugggugacuuaugggacauguaccgccacgggagagcaccgccgagaaaaacguaguguugcgcucgugccccaugucggcaugggucuggagacuagaaccgaaacauggaugagcuccgagggggcuuggaagcacgcccagaggaucgagacuuggauacuucggcauccuggauucaccaucauggcagccauucuggcuuacacaaucggcaccacguauuuucagcgcguguugauuuucauccuccugacugcaguuacaccaucuauggccaugaggugcauaggcauuucgaacagggacuuuguggaaggggucucaggagguagcuggguggauaucguacuggagcacggcaguuguguuaccacuauggcuaaaaauaagcccacacucgacuucgaauuaauuaagaccgaggccaaacacccugcgacgcugcggaaguacugcguggaagcaaaacuuaccaacacaacuaccgccucccgcuguccaacacagggggagcccucuuugaaugaggaacaagauaagcgauuugucugcaaacauagcaugguggacagaggauggggcaacgguugugggcuguucggaaagggcggcaucgugacuugcgcuauguuuaccugcaagaaaaauauggaggggaaggucguucagccugaaaaccuagaguauacaaucgugauuaccccacacuccggagaagagaaugccguagguaacgauacuggcaaacaugggaaggagauaaaagugacgccgcagucaaguaucacagaagcagagcucaccggauacggcacugucaccauggaauguagccccaggacaggucuggacuucaaugagauggugcuucugcagauggaaaacaaggcuugguugguucaccggcaaugguuucucgaucugccuuuaccauggcugcccggggccgacacccagggcucuaacuggauucagaaagagacucucgugacauucaagaauccucacgcgaagaaacaggaugucgugguacuuggaucccaagagggcgccaugcauacggcacugaccggggcuacugaaauccagaugucaagcggaaacuugcuauuuacaggucaccugaagugccgucuccgcauggacaaacugcagcuuaagggcaugaguuauucuauguguaccgggaaauucaagguugugaaggagauagccgaaacacaacauggaacuauugucaucagagugcaguacgagggcgacgguuccccaugcaaaauccccuucgagauuauggaucuggaaaagaggcacgucuuggggcggcucaucaccgugaauccgauuguuacggagaaagacagcccugugaacauagaagcugagcccccauuuggcgauucguacaucauuaucggaguagaaccuggccagcugaaguuaucuugguucaaaaagggguccucaaucggacagauguuugagaccacaaugcgaggugccaagcgcauggcaauucugggcgacacugccugggauuucgggagucuaggaggcgucuuuaccagcauagguaaagcucuccaucaaguguucggggcgaucuauggcgcagccuuuuccggaguuucuuggacaaugaagauucugaucggcguggucauuacuuggaucgggaugaauagcagaucaaccagucuuuccgugagcuugguacuggugggaguugucacgcucuaccugggcgugauggugcaggcugacucugguugugucguuucauggaaaaacaaggagcuuaaaugcgggaguggaauauucaucacagauaaugugcacaccuggacugaacaguauaaguuucagcccgagagcccauccaagcuggccucugcaauucaaaaagcccacgaagagggcaucugugguauuaggucggugacacgguuggaaaaccucauguggaagcagaucacccccgagcugaaucauauauuaacugagaacgaaguaaaacugaccauuaugacaggcgacaucaaggggauuaugcaggcuggaaaacgcagccuaagaccucagccaacggagcucaaguacuccuggaaagccuggggcaaggcaaagaugcugucaaccgaacuucacaaucauacuuucuugaucgaugggccggagacagcggaaugccccaacaccaauagggcuuggaacagucuggaggucgaggacuauggauuuggcguguucacaacuaauauauggcucaaacugaaggaacgucaagauguauuuugugacucuaaauuaaugagcgccgcaaucaaggacaaccgggccgugcacgcugauauggguuacuggauugaguccgcccugaacgacaccuggaaaaucgaaaaggcaucauucauugaggucaagagcugccacuggccuaaaucucauacgcuuugguccaaugggguguuggagagugaaaugaucauaccaaagaacuucgcuggacccguuagccagcacaauuaucgaccuggcuaccauacacagaccgccgguccauggcaccucggcagacuggagauggauuuugacuucugugaagggacuaccgugguagucacagaggauugcggaaacaggggccccucucuacgcacuaccacagcguccgggaaacugauuacggaauggugcugucggucaugcacccucccgccucugagauacaggggagaggacggcuguugguaugguauggagauccgcccacuuaaggaaaaagaggaaaauuuggugaacagucuggugacugccgggcauggacagaucgauaauuuuagcuuaggcguccucgguauggcucuguuccuugaggaaaugcugcgaacacggguuggcaccaagcacgcaauuuugcucguggccguaucguuugugacucugaucacagggaacauguccuuccgugaccuaggaagagucauggugaugguuggcgcuaccaugacggaugacauugggaugggagugacuuaccuggcccuccuggcagcguuuaaggucaggcccaccuucgccgcuggccuuuugcugcgcaaauuaacaucuaaggagcucaugaugaccacuauagguaucgugcugcuuagccaaucaacaauuccugagaguauccuggaacuaaccgaugcccucgcacuggggaugaugguuuugaaaauugugcggaauauggagaaguaucagcuggcugucacaaucauggccauauuaugcguacccaacgcagugauccuccagaaugccuggaaaguuuccuguacuacccuggcuguggucucugugagcccacuucuguugacguccucacaacagaaggcggacuggauuccucucgcccugacaaucaagggacuaaaccccaccgcaauuuuucugacuacccuuagcagaacaaguaaaaagaggucuuggccacucaaugaagcuaucauggccguaggcaugguguccauacuggccagcucguugcugaaaaacgauauuccgaugacuggcccuuuagucgcugggggacuccugaccguuugcuacgugcuuacgggucgaucagcagaccuggaguuggaacgcgccgcggacgugcggugggaggagcaggcugaaaucucuggcaguucccccauccucagcauuacaauaucugaggaugggagcauguccaucaagaaugaagaggaggaacagacccugacuauucuaaucagaacaggacugcuugucauuucaggccucuucccagugaguauccccauaaccgccgcagccugguaucugugggagguuaaaaagcaaagggcugguguauugugggacgugccuagcccacccccugucgggaaagcagaauuagaggauggagccuaccguaucaagcagaagggcauucugggcuauucucagaucggggcgggaguguacaaagaagguacuuuucacacaauguggcauguuacccgcggcgcugugcucaugcacaaggggaaacggauugagccguccugggccgacgucaagaaagaucugaucucauacggaggcgguuggaaacuugagggggaauggaaggagggagaagaggugcagguacuggcauuggaaccaggcaaaaaccccagagccguccaaacgaagccuggccuauucaaaacuaacaccgggacaauaggagcugugagucuggacuuuagcccagguaccuccggcucucccauuguugauaagaaagggaagguggucggacucuauggcaauggugugguuacaaggucggggacuuacgugagcgccaucgcacagaccgagaagucaaucgaggacaacccugaaauugaggaugacaucuucagaaagaaacggcugacgauaauggaucuucauccgggagcuggcaaaacaaagcgcuauuuacccgccauugucagagaagcgaucaaaaggggccugcggacucucauuuuggccccaacccgagugguagcagcugagauggaagaggcccugagagggcucccuauccgcuaccagacacccgcuauaagggcagagcacaccggacgugaaauuguggaccugaugugucaugccacuuucaccaugcggcuucuguccccaaucagaguuccuaauuauaacuugaucauuauggaugaggcccacuuuacagaccccgcuaguaucgcggcaagggguuacauuucuacgcgcgucgaaaugggcgaggccgcugggauauucaugacugccaccccaccgggaagccgagacccuuuuccccaguccaaugcaccaaucauggaugaggaaagagagauucccgaacggucauggaacucuggccacgagugggugacagacuucaaggguaagaccgugugguuugucccuagcaucaaagccgggaaugauaucgcugcgugccuaaggaagaacggcaagaagguaauucaacugagucgcaaaacuuucgacuccgaauauauaaagacacguaccaaugauugggacuuugugguuacgacugauaucagcgagaugggcgccaacuucaaggcagagagagugauugacccacggagguguaugaaacccgucauccucacagauggcgaagaacgcgugauuuuagcugggccuaugccgguuacccauucuucagccgcacagcgaagaggacggguggguaggaauccaaagaacgaaaaugaccaguacaucuacaugggcgagccccuggaaaacgaugaggacugcgcccacuggaaagaggcuaagaugcuucuggacaauauaaacaccccugaagggaucauucccuccauguuugagccagaacgcgagaaagucgaugccaucgacggagaauauagacucaggggcgaggcgcggaagacuuucguggauuugaugcgucgcggugaccugccuguauggcucgcauaccgaguggccgcugaggggauuaacuaugccgauagaaggugguguuuugacggcguuaaaaauaaccaaauccuggaagagaaugucgaaguggagauauggacaaaggagggagaacggaagaaacuuaagccccgcuggcuagaugcuagaauuuacagugacccacuggcauugaaagaguucaaggaguucgccgcuggcaggaagucguuaacccugaaccucaucacagagauggggcggcugccuacuuuuaugacgcagaaggccaagaaugcacuugauaaccuggcggugcuccauaccgccgaagcuggaggucgagccuauaaucacgcauugagcgagcugccggagacacuagaaacucugcuccuucugaccuuauuggcuacagucaccggcgggauuuuccuguuucucaugucuggaaaaggcaucgguaagaugacucuggggaugugcugcauaaucacggccuccauucuucugugguacgcacagauccagccccacuggauugccgcuagcaucauacucgaguucuuuuugauuguucuguuaaucccagaaccugagaaacaaagaacaccccaggacaaccagcuaacauaugugguaaucgcgauucugacuguggucgccgcaaccauggcuaaugaaaugggcuuccucgagaagaccaagaaggauuuuggacuuggcucaaucaccacucagcaaccagagaguaacauacuggacauugauuugcgcccugccucugccuggacacuguacgcaguggcuacgaccuucaucacucccaugcucaggcauuccauugaaaauagcucaguuaacgugagucugacagccaucgcgaaucaggcuaccguccuuauggggcucggaaaggguuggccgcugagcaaaauggacauaggcguaccauugcuggccaucggguguuacucccaggugaacccuauuaccuuaacagcagcccuacugcuccuuguugcucacuaugcaaucauuggacccggccugcaggccaaggcgacucgggaggcucaaaaacgugccgcagccgguaucaugaagaauccaacgguggacgggaugaccgucauugauuuggaccccaucccuuacgauccgaaauuugaaaagcagcugggccaggugaugcuccugguccuuugcgugacacagguuuuaaugaugagaacuaccugggcucugugugaggcccucacauuggcaaccggacccauaucuacucugugggaaggcaacccagggagguucuggaauacgacaauugcugugagcauggccaacaucuuucgcggauccuaucuagcgggcgccggucuacucuucucaaucaugaagaacaccgcaaauacucggcgagggaccggaaacacaggcgagacucuuggugagaaauggaagaauagacugaacgcuuugggcaaaucugaauuucaaauuuacaagaaaagugggauacaggagguagacaggacccuggccaaggaaggaaucaaacgcggcgagacagaucaucacgcagugucgcgggggagcgcuaagcucagaugguucgucgagcguaaucugguuacgccugaaggaaagguggucgacuuaggcugcgguagagggggaugguccuauuacuguggcggucuuaaaaacgugaaggagguaaaaggccugaccaaagggggacccggccaugaagaaccuauuccaaugucuacuuauggguggaaucucgugcggcuacagucaggaguugauguguucuuuacacccccugaaaaaugcgacacccuguugugugauaucggcgagagcuccccaaaccccacugucgaggccggucgcacacugcgagugcucaaucuugucgaaaacuggcugaauaacaauacccaauucugcauuaagguguugaacccguacaugccuaguguuaucgagaagauggaagcccugcagagaaaauacgggggagcgcucguaaggaauccauuaucucggaacagcacgcacgagauguauugggugucaaacgcuuccggcaauauagucaguagcgugaacaugaucucucgcaugcugauuaauagauuuaccaugaggcacaagaaagcaacauacgaacccgacguugaucuuggcuccgggacucgaaacaucggaauugagucagagaccccuaaucuggacaucauagguaagcggauugagaaaaucaagcaggagcaugaaacaagcuggcacuaugaucaggaccauccauacaagacuugggccuaucacggcucguacgagaccaaacaaacagggucugcuaguuccauggugaacggagucgugcgucuacucaccaagcccugggacguaaucccgauggugacucagauggccaugacggauacaaccccuuucggccagcagagaguuuuuaaagaaaaggucgacacucgcacccaagagcccaaagaggguacaaagaagcugaugaaaauuacggcagaaugguuguggaaggagcuggggaaaaagaaaaccccaaggauguguacucgggaagaguucacaagaaaggugcgcagcaaugccgcucucggagcgauauuuaccgaugagaacaaauggaagucagccagggaagcaguggaggacuccggcuucugggaacuugucgauaaggagcgaaaucugcacuuagaaggcaaaugcgagacuuguguuuauaacaugauggggaagcgggagaaaaagcugggagaauuugguaaagcuaagggcucuagagccaucugguacaugugguugggggcaagguuccucgaguuugaagcccugggauuccuaaaugaggaccauugguuuagccgcgaaaacagucuuuccggcguggagggugaggggcugcacaagcucggauacauucugcgugauguaagcaaaaaggaaggcggcgcuauguaugccgacgauacagcggggugggacacccggaucacauuggaggaucugaaaaaugaagagauggugacuaaccauauggaaggagagcacaagaaacucgcagaggccauuuucaaacuuaccuaccagaauaaggucgugagaguucagaggccuacgccccgcgguaccgugauggacaucauaucucgacgggaccagagaggcucagggcaagucgugacauauggacugaacacuuucaccaacauggaagcucaguuaaucaggcagauggagggcgaagguguauuuaaaaguauucaacagcugacaguuaaggaggagaucgccgugaaaaauugguugauucgcgucgggagagaacggcucuccaggauggcaaucagcggagaugacugcguggugaagccacuggaugaccguuucgcuucugcccuaacugcucuuaacgauaugggcaaaguccgaaaggacauucagcagugggagcccucgcgcggcuggaaugauuggacccaaguuccuuuuugcucacaucacuuccacgaacugauaaugaaggacgggagagugcucguagugccaugucggaaccaggaugagcugaucggaagggcccgcauuagccagggugcaggcugguccuugagagaaacggcgugcuuagggaaaaguuacgcccagauguggucucugauguauuuucaucggagggaccuccgacuugcugccaaugcaaucuguagcgcugucccgucccacuggauccccacaucacguaccacuuggaguauucaugccacacacgaguggaugaccacugaggauaugcugaccguguggaacagaguuuggauacaagaaaauccuuggauggaggacaagacaccaguggaaucuugggaggaaauccccuaccuaggaaaacgcgaggaucaguggugcggcagccugauuggucucacgucccgggcaaccugggccaagaacauccagacugcgauuaaucaggucaggucauugaucgggaacgaggaauauacagacuacaugccuagcaugaaaagauuccgccgggaggaagaggaagcuggagugcugugguga

SEQ ID NO: 14982 - RNA, 9876 nt, Artificial Sequence
  derived and/or modified CDS sequence (opt3) from DENV-2__JN851124__SS-prME
accgccggcaucauuauuaugaugauccccacagugauggcuuuccaccugacuacgaggaacggggaaccucauaugauugucucaaggcaggaaaagggaaaaucccuccuuuuuaagaccgaaaaugguguuaacaugugcacacugauggcaauggacuugggcgaauuaugugaagauacuaucaccuacaauugcccacugcuaaaacaaaacgaaccggaagacauugauuguuggugcaauucuacaucaaccugggugacuuaugggacauguaccgccacgggagagcaccggcgcgaaaagcgaaguguagcgcucgugccccaugucggcaugggucuggagacucguaccgaaacauggaugagcuccgagggggcuuggaaacacgcccagagaaucgagacuugggugaugaggcauccuggauucaccguuauggcagccauacuugcuuacacaaucggcaccacguauuuucagcgggugcugauuuucaucuugcucacugcagucgccccaucuaugacaaugcgcugcauuggcaucucgaacagagacuuuguggaagggguaucaggagguagcuggguugauauagugcuggagcacggcaguugugucaccacuauggcuaagaauaagcccacacuggacuucgaacucauuaaaaccgaggccaagcacccugcgacguuaaggaaauacugcaucgaagcaaagcugaccaacacaacuaccgccucccgguguccaacacagggggagcccucucuuaaugaggaacaagauaaacgcuuugugugcaagcauagcaugguggaccgaggauggggcaacgguuguggguuguucggaaagggcggcauugucacuugcgcuauguuuaccugcaaaaagaauauggaggggaaaguugugcagccugaaaaccuggaguauacaaucguaaucaccccacacuccggagaagagaaugccguggguaacgauacuggcaagcaugggaaagagauuaaggucacgccgcagucaaguauaacagaagcagagcuaaccggauacggcacugugaccauggaauguagccccagaacaggucucgacuucaaugagaugguucugcuucagauggaaaacaaggcuuggcuggugcacaggcaaugguuuuuggaucucccucugccaugguuacccggggccgacacccagggcucuaacuggauccagaaggagacucuggucacauucaagaauccucacgcgaaaaagcaggaugugguaguucucggaucccaagagggcgccaugcauacggcacuuaccggggcuacugaaauucagaugucaagcggaaaccuguuguuuacaggucaccuaaaaugccggcugcguauggacaagcuccagcugaaaggcaugaguuauucuauguguaccgggaaguucaagguggucaaagagaucgccgaaacacaacauggaacuauagugauucgcguccaguacgagggcgacgguuccccaugcaagauccccuucgagaucauggaucuugagaagagacacgugcuggggagguugauuaccguuaauccgaucgugacggagaaggacagcccuguaaacauugaagcugagcccccauuuggcgauucguacauaaucauuggagucgaaccuggccagcucaaacugucuugguucaagaagggguccucaaucggacagauguuugagaccacaaugcggggugccaaacgaauggcaaucuuaggcgacacugccugggauuucgggagucugggaggcguguuuaccagcauugguaaggcucuacaucaaguuuucggggcgauauauggcgcagccuuuuccggagugucuuggacaaugaaaauccucauuggcgucgugaucacuuggauugggaugaauagccgcucaaccagucuguccguaagccuuguguugguuggagucgugacgcuguaccucggcgugaugguccaggcugacucugguuguguugugucauggaagaacaaagagcugaagugcgggaguggaaucuucauaacagauaaugugcacaccuggacugaacaguauaaguuucagcccgagagcccauccaaacuugccucugcaauccaaaaggcccacgaagagggcauuugugguaucagaucgguaacaaggcuggaaaacuugauguggaaacagauuacccccgagcucaaucauauccugagcgagaacgaagucaagaugacuauaaugaccggcgacauuaaagggaucaugcaggcuggaaagcgguccuuacgcccucagccaacagagcugaaauacucauggaaggccuggggcaaggcaaaaaugcuaaguacggaacuccacaaucauaccuuccugauugaugggccggagacugcggaaugccccaacacaaauagagcuuggaacucucuugagguggaggacuauggauuuggcguuuucaccacaaauaucugguugaagcugaaagaaaggcaagaugugagcugugacuccaagcucaugucagccgcaauaaaagacaaccgugccguccacgcugauauggguuacuggaucgagagcgcccugaacgacacuuggaagauugaaaaggcaucuuuuaucgaggugaaauccugccacuggccuaagagucauaccuuauggagcaaugggguucuggagucugaaaugauuauccccaaaaacuucgcuggacccgugucccagcacaauuaucggccuggcuaccauacgcagacagccgguccauggcaccuuggccgauuggagauggauuucgacuuuugugaagggaccacuguagucgugaccgaggauugcggaaacagaggccccucacucaggacaacuaccgcgagugggaagcugauaacagaauggugcugucgcagcugcacgcuaccgccucugcgguacagaggagaggacggcuguugguaugguauggagauuaggccacucaaagaaaaggaggaaaaucuggugaacucgcuugucaccgccgggcauggacagaucgauaauuucuccuugggcguucuggguauggcuuuauuucucgaggaaaugcugcgcacucgagugggcacaaagcacgcaauccuucugguagccgugucuuucgucaccuugauuacugggaacaugagcuuucgggaccucggacgugugaugguuauggugggcgcuacaaugaccgaugacaucgggaugggagucacguaccuggcccuacuggcagcguucaaagugagacccacuuuugccgcuggccuccugcuuaggaaguugaccucaaaagagcugaugaugacaaccauugguauaguuuuacucagucaauccacuaucccugagacaauucuggaacuuaccgaugcccuggcacuagggaugauggugcucaaggucguacgcaauauggagaaauaucagcuggcugugacaaucauggccauuuugugcguucccaacgcagugauccugcagaaugccuggaaggucucuuguacuaccuuagcugugguaagcguguccccacuccugcuuacgucaagccaacagaaggcggacuggauaccucuggccuugacaaucaaaggacucaaccccaccgcaauuuuccugacuacccuaagucggacaucuaagaaaagauccuggccacugaaugaagcuaucauggccgucggcaugguuagcauucuugccucgucacuccugaagaacgauaucccgaugacuggcccuuugguggcugggggacuguuaaccgugugcuacguccucacggguaggucugcagaccuggagcuugaacgagccgcggacgugcgcugggaggagcaggcugaaauaaguggcuccagccccauucugucuaucacaaucagcgaggauggguccaugucaauuaaaaaugaagaggaggaacagaccuugacuauacucauccggacaggacugcuaguuauuaguggccuguuuccaguaagcauccccauuaccgccgcagccugguaucuuugggaggugaagaaacaaagagcugguguccucugggacgugccuucuccacccccuguugggaaggcagaacuggaggauggagccuacaggaucaagcagaaaggcauauugggcuauucccagaucggggcgggaguguacaaggaagguacuuuccacacaauguggcaugucacccguggcgcuguguuaaugcacaaagggaagcgcauugagccgucaugggccgacgucaaaaaggaucugaucaguuacggaggcgguuggaagcucgagggggaauggaaagagggagaagagguccaggugcuggcacuugaaccaggcaagaacccccgggccguucaaacgaaaccuggccuguuuaagacuaacaccgggacaauuggagcugugagcuuggacuucuccccagguaccucuggcucgcccaucgucgauaaaaaggggaaggugguuggacuauauggcaaugguguggucacaagaagcgggacuuacgugucagccauagcacagaccgagaaauccauugaggacaacccugaaaucgaggaugacaucuuuaggaagaaacgacugacgauuauggaucuccauccgggagcuggcaagacaaaacgguaucugcccgccaucguacgcgaagcgauaaagagaggccuuaggacuuuaauucuggccccaacccgggugguugcagcugagauggaagaggcccuccgaggguugccuaucagauaccagacacccgcuauucgcgcagagcacaccggaagggaaaucgucgaccugaugugucaugccacuuucaccaugcgucuccugaguccaauacgggugccuaauuauaaccuuauuaucauggaugaggcccacuucacagaccccgcuucuaucgcggcaagagguuacauuagcacgaggguggaaaugggcgaggccgcugggaucuuuaugacugccaccccaccgggaucccgcgacccuuucccccagucaaaugcaccaauuauggaugaggaacgagagauacccgaaagaucuuggaacagcggccacgagugggucacagacuuuaaggguaaaaccguaugguucgugccuaguaucaaggccgggaaugauauugcugcgugccugcggaaaaacggaaagaaaguuauccaauuguccaggaagacuuuugacagcgaauauaucaagacacgcaccaaugauugggacuucguggucacgacugauauuucugagaugggcgccaacuuuaaagcagagcgugugauagacccaagacgguguaugaagcccguuauccuaacagauggcgaagagagggugauucuggcugggccuaugccggucacccauucauccgccgcacagcgccgaggaagagugggucggaaucccaaaaacgaaagugaccaguacaucuacaugggcgagccccucgaaaaugaugaggacugcgcccacuggaaggaggcuaaaauguuacuggacaacauuaauaccccugaagggaucauacccagcauguucgagccagaaagggagaagguagaugccaucgacggagaauaucgccuuagaggcgaggcgaggaaaacuuuuguggaucugaugcggcguggugaccucccuguuugguuggcauaccgcgucgccgcugaggggauuaacuaugccgaucgaagaugguguuucgacggcgugaagaacaaucaaauccuggaagagaacguggaagucgagauuuggacaaaggagggagaaaggaaaaagcucaaaccccgguggcuggaugcucgcaucuacucggacccacuugcacuaaaggaguuuaaagaguucgccgcuggcagaaagucucugaccuugaauuuaauaacagagauggggaggcugccuacuuucaugacgcagaaggcccggaacgcacucgauaaucuggcgguucuucauaccgccgaagcuggaggucgagccuauaaccacgcacuguccgagcucccggagacauuggaaacucugcuacugcucacccuucuggcuacagugaccggcgggauauuuuuauucuugaugagcggaaaaggcaucgguaagaugacucuggggaugugcugcauuaucacggccucaauacuccugugguacgcacagauccagccccacuggauugccgcuaguaucauucuugaguuuuuccugaucguacucuugauaccagaaccugagaaacaaagaacaccacaggacaaucagcugacauauguggucauugcgaucuuaacugugguugccgcaaccauggcuaacgaaaugggcuuucuagagaagaccaaaaaggauuucggacugggaucuuccaccacucagcaacaugagagcaauauccucgacauugaucuucgcccagccucagccuggacacuguacgcaguggcuacgaccuuuaucacuccuauguugaggcacaguauagaaaacagcuccgucaauguaucucugacagccauugcgaaccaggcuaccgugcucauggggcugggaaaggguuggccccuuagcaaaauggacaucggcguuccgcuccuggccauuggguguuacucccaggugaauccaaucaccuugacagcagcccuguuaagccuaguagcucauuaugcaauaaucggaccuggccugcaggccaaggcgacucgggaggcucaaaaacgugccgcagccgguauuaugaagaaccccacgguggacgggaucaccgucauugaucucgacccaauccccuacgauccuaaauucgaaaagcagcuuggccaggugaugcuguugguucugugcgugacacagguacucaugaugagaacuaccugggcucugugugaggcccuuacauuagcaaccggaccgauuucuacucugugggaaggcaaucccgggagguuuuggaacacgacaaucgcugugaguauggccaauauauuccgcggaucguaucucgcgggcgccgguuugcuguuuagcauuaugaagaacaccgcaaacacucggcgagggaccggaaauacaggcgagacucuaggugagaaauggaagaacagacugaaugcucucggcaaauccgaguuccaaaucuacaagaaaucugggauccaggaggucgacaggacccuugccaaggaaggaauuaaacgcggcgagacagaucaccaugcaguuucacgggggagcgcuaagcugagaugguuuguggagcguaacuuggucacgccagaaggaaaggugguagaccugggcugcgguagagggggcugguccuauuacuguggcggucucaaaaaugugaaggagguuaaaggccugaccaaagggggaccuggccacgaagaaccaauaccuaugaguacuuauggguggaacuuagugcggcuucagucuggagucgauguguucuucacaccacccgaaaaaugcgacacccugcucugugauaucggcgagagcucaccuaauccaacugucgaggccggucgcacacuacgagugcugaacuugguugaaaauuggcugaacaauaacacccaauuuugcauuaagguacucaaucccuacaugccguccgugaucgagaagauggaagcccuucagagaaaauacgggggagcgcuggucaggaacccuuugagucggaauagcacgcacgagauguauugggugucuaacgcuuccggcaacauuguuucaagcgugaauaugaucucgcgcaugcugauaaacagauucaccaugaggcauaagaaagucacauacgaaccagacguggaucucggcucugggacucgaaauaucggaauugagagugagacccccaacuuagacaucauugguaagcggaucgagaaaauaaagcaggagcacgaaacauccuggcauuaugaucaggaccacccuuacaagacuugggcauaucacggcagcuacgagaccaaacaaacagggucagccuccucuaugguaaauggagugguucgucugcuuaccaagccaugggacgucauucccauggugacucagauggcuaugacggauacaaccccguuuggccagcagagaguguucaaagaaaaggucgacacucgcacccaagagccuaaagaggguacaaagaagcugaugaaaaucacggccgaauggcuauggaaggagcucgggaaaaagaaaacccccaggauguguacucgggaagaguuuacaagaaagguucgcagcaacgcagcccugggagcuaucuucaccgaugagaauaaauggaagagugcgagggaagccguggaggacuccggcuuuugggaauugguagauaaggagcgaaaccugcaucucgaaggcaaaugcgagacuuguguguauaauaugauggggaagcgggagaagaaacuuggagaguucgguaaagcaaaaggcagcagagcuauuugguacauguggcugggggccagguuuuuagaguucgaagcacugggauuuuugaacgaggaccacugguucucucgcgaaaauucacucaguggcgucgagggugaggggcugcauaagcuaggauacauacuucgugauguguccaaaaaggaaggcggcgccauguaugcugacgauacagccgggugggacacccggaucacacuggaggaucucaaaaacgaagagaugguuacuaaucacauggaaggagagcauaagaaacuggcggaggcaauuuuuaaguugaccuaccagaacaagguggucagagugcagaggccaacgccucgcgguaccguaauggacaucauuagccgacgggaccagagaggcucugggcaaguugugacauauggacugaauacuuucaccaacauggaagcccagcucaucaggcagauggagggcgaaggugucuucaaaucgauacaacagcuuacagcuacugaggagaucgccgugaagaacuggcuggugcgcgucgggagagaacgguuaucaaggauggcaauuagcggagaugacugcguugugaaaccccuggaugaccguuuugcuuccgccuugaccgcucucaaugauaugggcaagguacgaaaagacauccagcagugggagccaagucgcggcuggaacgauuggacgcaagugcccuucugcucucaccacuuucaugaacugauuaugaaggacgggagaguccuagugguuccuugucggaaucaggaugagcuuaucggaagggcccgcauuagccagggugcaggcuggucccugagagaaacagcgugccucgggaagucauacgcccagauguggagucugauguauuuccaccggagggacuugcgauuagcugccaacgcaauauguucugcugugccaagccauugggucccgaccucccguacuacauggucaauccacgccacccacgaguggaugacuaccgaggauaugcugacaguguggaauagaguauggauucaagaaaaccccuggauggaggacaaaacgccuguugaaagcugggaggaaaucccauaccucggaaagcgcgaggaucaguggugcggcucucuuaucggucugaccucccgggcaacuugggccaaaaauauucagacagcgauaaaccaggugaggagucuaaucgggaaugaggaauauaccgacuacaugcccagcaugaagagauuucgccgggaggaagaggaagcuggaguccugugguga

SEQ ID NO: 14983 - RNA, 9876 nt, Artificial Sequence
  derived and/or modified CDS sequence (opt3) from DENV-2__JN851114__SS-prME
accgccggaaucauuauaaugaugauccccacagugauggcuuuccaccugacuacgcgaaacggggaaccucauaugauugucagcaggcaggaaaaggggaaaucccuccuuuuuaagaccgaaaaugguguuaacaugugcacacugauggcaauggacuugggagaauuaugugaagauacuaucaccuacaauugcccacugcugcggcaaaacgaaccggaggacauugauuguuggugcaauucuacaucaaccugggugacuuaugggacauguaccgccacgggagagcaccgccgagaaaaacguaguguugcgcucgugccccaugucggcaugggucuggagacuagaaccgaaacauggaugagcuccgagggggcuuggaagcacgcccagaggaucgagacuuggauacuucggcauccuggauucaccaucauggcagccauucuggcuuacacaaucggcaccacguauuuucagcgcguguugauuuucauccuccugacugcaguuacaccaucuauggccaugagaugcauaggcauuucgaacagggacuuuguggaaggggucucaggagguagcuggguggauaucguacuggagcacggcaguuguguuaccacuauggcuaaaaauaagcccacacucgacuucgaauuaauuaagaccgaggccaaacacccugcgacgcugcggaaguacugcguggaagcaaaacuuaccaacacaacuaccgccucccgcuguccaacacagggggagcccucuuugaaugaggaacaagauaagcgauuugucugcaaacauagcaugguggacagaggauggggcaacgguugugggcuguucggaaagggcggcaucgugacuugcgcuauguuuaccugcaagaaaaauauggaggggaaggucguucagccugaaaaccuagaguauacaaucgugauuaccccacacuccggagaagagaaugccguagguaacgauacuggcaaacaugggaaggagauaaaagugacgccgcagucaaguaucacagaagcagagcucaccggauacggcacugucaccauggaauguagccccaggacaggucuggacuucaaugagauggugcuucugcagauggaaaacaaggcuugguugguucaccggcaaugguuucucgaucugccuuuaccauggcugcccggggccgacacccagggcucuaacuggauucagaaagagacucucgugacauucaagaauccucacgcgaagaaacaggaugucgugguacuuggaucccaagagggcgccaugcauacggcacugaccggggcuacugaaauccagaugucaagcggaaacuugcuauuuacaggucaccugaagugccgucuccgcauggacaaacugcagcuuaagggcaugaguuauucuauguguaccgggaaauucaagguugugaaggagauagccgaaacacaacauggaacuauugucaucagagugcaguacgagggcgacgguuccccaugcaaaauccccuucgagauuauggaucuggaaaagaggcacgucuuggggcggcucaucaccgugaauccgauuguuacggagaaagacagcccugugaacauagaagcugagcccccauuuggcgauucguacaucauuaucggaguagaaccuggccagcugaaguuaucuugguucaaaaagggguccucaaucggacagauguuugagaccacaaugcgaggugccaagcgcauggcaauucugggcgacacugccugggauuucgggagucuaggaggcgucuuuaccagcauagguaaagcucuccaucaaguguucggggcgaucuauggcgcagccuuuuccggaguuucuuggacaaugaagauucugaucggcguggucauuacuuggaucgggaugaauagcagaucaaccagucuuuccgugagcuugguacuggugggaguugucacgcucuaccugggcgugauggugcaggcugacucugguugugucguuucauggaaaaacaaggagcuuaaaugcgggaguggaauauucaucacagauaaugugcacaccuggacugaacaguauaaguuucagcccgagagcccauccaagcuggccucugcaauucaaaaagcccacgaagagggcaucugugguauuaggucggugacacgguuggaaaaccucauguggaagcagaucacccccgagcugaaucauauauuaacugagaacgaaguaaaacugaccauuaugacaggcgacaucaaggggauuaugcaggcuggaaaacgcagccuaagaccucagccaacggagcucaaguacuccuggaaagccuggggcaaggcaaagaugcugucaaccgaacuucacaaucauacuuucuugaucgaugggccggagacagcggaaugccccaacaccaauagggcuuggaacagucuggaggucgaggacuauggauuuggcguguucacaacuaauauauggcucaaacugaaggaacgucaagauguauuuugugacucuaaauuaaugagcgccgcaaucaaggacaaccgggccgugcacgcugauauggguuacuggauugaguccgcccugaacgacaccuggaaaaucgaaaaggcaucauucauugaggucaagagcugccacuggccuaaaucucauacgcuuugguccaaugggguguuggagagugaaaugaucauaccaaagaacuucgcuggacccguuagccagcacaauuaucgaccuggcuaccauacacagaccgccgguccauggcaccucggcagacuggagauggauuuugacuucugugaagggacuaccgugguagucacagaggauugcggaaacaggggccccucucuacgcacuaccacagcguccgggaaacugauuacggaauggugcugucggucaugcacccucccgccucugagauacaggggagaggacggcuguugguaugguauggagauccgcccacuuaaggaaaaagaggaaaauuuggugaacagucuggugacugccgggcauggacagaucgauaauuuuagcuuaggcguccucgguauggcucuguuccuugaggaaaugcugcgaacacggguuggcaccaagcacgcaauuuugcucguggccguaucguuugugacucugaucacagggaacauguccuuccgugaccuaggaagagucauggugaugguuggcgcuaccaugacggaugacauugggaugggagugacuuaccuggcccuccuggcagcguuuaaggucaggcccaccuucgccgcuggccuuuugcugcgcaaauuaacaucuaaggagcucaugaugaccacuauagguaucgugcugcuuagccaaucaacaauuccugagaguauccuggaacuaaccgaugcccucgcacuggggaugaugguuuugaaaauugugcggaauauggagaaguaucagcuggcugucacaaucauggccauauuaugcguacccaacgcagugauccuccagaaugccuggaaaguuuccuguacuacccuggcuguggucucugugagcccacuucuguugacguccucacaacagaaggcggacuggauuccucucgcccugacaaucaagggacuaaaccccaccgcaauuuuucugacuacccuuagcagaacaaguaaaaagaggucuuggccacucaaugaagcuaucauggccguaggcaugguguccauacuggccagcucguugcugaaaaacgauauuccgaugacuggcccuuuagucgcugggggacuccugaccguuugcuacgugcuuacgggucgaucagcagaccuggaguuggaacgcgccgcggacgugcggugggaggagcaggcugaaaucucuggcaguucccccauccucagcauuacaauaucugaggaugggagcauguccaucaagaaugaagaggaggaacagacccugacuauucuaaucagaacaggacugcuugucauuucaggccucuucccagugaguauccccauaaccgccgcagccugguaucugugggagguuaaaaagcaaagggcugguguauugugggacgugccuagcccacccccugucgaaaaagcagaguuagaagauggggccuaccguaucaagcagaagggcauucugggcuauucucagaucggcgcggggguguacaaagagggaacuuuucacacaauguggcauguuacccgcggugcugugcucaugcacaagggcaaacggauugagccguccugggccgacgucaagaaagaucugaucucauacgggggaggcuggaaacuugaaggugaguggaaggaaggggaggaagugcagguacuggcauuggagccaggcaagaaccccagagccguccaaacgaagccuggccuauucaaaacuaacaccggcacaauaggggcugugagucuggacuuuagcccaggaaccuccgguucucccauuguugauaagaaaggcaagguggucgggcucuauggaaauggcgugguuacaaggucggguacuuacgugagcgccaucgcacagaccgagaagucaaucgaagacaacccugagauugaagaugacaucuucagaaagaaacggcugacgauaauggaucuucauccgggggcuggaaaaacaaagcgcuauuuacccgccauugucagagaggcgaucaaaaggggccugcggacucucauuuuggccccaacccgagugguagcagcugaaauggaggaggcccugagaggccucccuauccgcuaccagacacccgcuauaagggcagaacacaccgggcgugagauuguggaccugaugugucaugccacuuucaccaugcggcuucuguccccaaucagaguuccuaauuauaacuugaucauuauggaugaagcccacuuuacagaccccgcuaguaucgcggcaaggggauacauuucuacgcgcgucgagaugggugaggccgcuggcauauucaugacugccaccccaccggggagccgagacccuuuuccccaguccaaugcaccaaucauggaugaagagagagaaauucccgagcggucauggaacucuggacacgaaugggugacagacuucaagggcaagaccgugugguuugucccuagcaucaaagccgguaaugauaucgcugcgugccuaaggaagaacgggaaaaagguaauucaacugagucgcaaaacuuucgacuccgaguauauaaagacacguaccaaugauugggacuuugugguuacgacugauaucagcgagaugggagccaacuucaaggcagaaagagugauugacccacggagguguaugaaacccgucauccucacagauggcgaggaacgcgugauuuuagcuggcccuaugccgguuacccauucuucagccgcacagcgaagagggcgggugggaaggaauccaaagaacgagaaugaccaguacaucuacaugggugaaccccuggagaacgaugaggacugcgcccacuggaaagaagcuaagaugcuucuggacaauauaaacaccccugagggcaucauucccuccauguuugaaccagagcgcgaaaaagucgaugccaucgacggggaguauagacucaggggagaggcgcggaagacuuucguggauuugaugcgucgcggcgaccugccuguauggcucgcauaccgaguggccgcugaagguauuaacuaugccgauagaaggugguguuuugacgggguuaaaaauaaccaaauccuggaggaaaaugucgagguggagauauggacaaaggaaggcgagcggaagaaacuuaagccccgcuggcuagaugcuagaauuuacagugacccacuggcauugaaagaguucaaggaguucgccgcuggaaggaagucguuaacccugaaccucaucacagaaaugggccggcugccuacuuuuaugacgcagaaggccaagaaugcacuugauaaccuggcggugcuccauaccgccgaggcugggggacgagccuauaaucacgcauugagcgagcugccggaaacacuagagacucugcuccuucugaccuuauuggcuacagucaccgguggcauuuuccuguuucucaugucugggaaaggaaucggcaagaugacucuggguaugugcugcauaaucacggccuccauucuucugugguacgcacagauccagccccacuggauugccgcuagcaucauacucgaguucuuuuugauuguucuguuaaucccagagccugaaaaacaaagaacaccccaggacaaccagcuaacauaugugguaaucgcgauucugacuguggucgccgcaaccauggcuaaugagaugggguuccucgagaagaccaaaaaggauuuuggccuuggaucaaucaccacucagcaaccagaaaguaacauacuggacauugauuugcgcccugccucugccuggacacuguacgcaguggcuacgaccuucaucacucccaugcucaggcauuccauugagaauagcucaguuaacgugagucugacagccaucgcgaaucaggcuaccguccuuaugggccucgggaagggauggccgcugagcaaaauggacauagguguaccauugcuggccaucggcuguuacucccaggugaacccuauuaccuuaacagcagcccuacugcuccuuguugcucacuaugcaaucauugggcccggacugcaggccaaggcgacucgggaagcucaaaaacgugccgcagccggcaucaugaagaauccaacgguggacgguaugaccgucauugauuuggaccccaucccuuacgauccgaaauuugagaagcagcugggacaggugaugcuccugguccuuugcgugacacagguuuuaaugaugagaacuaccugggcucugugugaagcccucacauuggcaaccggccccauaucuacucugugggagggaaacccaggcagguucuggaauacgacaauugcugugagcauggccaacaucuuucgcggguccuaucuagcgggagccggccuacucuucucaaucaugaagaacaccgcaaauacucggcgagguaccgggaacacaggagagacucuuggcgaaaaauggaagaauagacugaacgcuuuggguaaaucugaguuucaaauuuacaagaaaaguggcauacaggaaguagacaggacccuggccaaggaggggaucaaacgcggagagacagaucaucacgcagugucgcggggcagcgcuaagcucagaugguucgucgaacguaaucugguuacgccugaggggaagguggucgacuuaggaugcggcaggggugggugguccuauuacuguggaggccuuaaaaacgugaaggaaguaaaaggucugaccaagggcgggcccggacaugaggaaccuauuccaaugucuacuuauggcuggaaucucgugcggcuacagucagggguugauguguucuuuacacccccugagaaaugcgacacccuguugugugauaucggagagagcuccccaaaccccacugucgaagccggccgcacacugcgagugcucaaucuugucgagaacuggcugaauaacaauacccaauucugcauuaagguguugaacccguacaugccuaguguuaucgaaaagauggaggcccugcagagaaaauacgguggggcgcucguaaggaauccauuaucucggaacagcacgcacgaaauguauugggugucaaacgcuuccggaaauauagucaguagcgugaacaugaucucucgcaugcugauuaauagauuuaccaugaggcacaagaaagcaacauacgagcccgacguugaucuuggcuccggcacucgaaacaucgggauugagucagaaaccccuaaucuggacaucauaggaaagcggauugagaaaaucaagcaggaacaugagacaagcuggcacuaugaucaggaccauccauacaagacuugggccuaucacgguucguacgaaaccaaacaaacaggcucugcuaguuccauggugaacggggucgugcgucuacucaccaagcccugggacguaaucccgauggugacucagauggccaugacggauacaaccccuuucggacagcagagaguuuuuaaagagaaggucgacacucgcacccaagagcccaaagaaggcacaaagaagcugaugaaaauuacggcagagugguuguggaaggaacuggguaaaaagaaaaccccaaggauguguacucgggaggaguucacaagaaaggugcgcagcaaugccgcucucggggcgauauuuaccgaugaaaacaaauggaagucagccagggaggcaguggaagacuccggauucugggagcuugucgauaaggaacgaaaucugcacuuagagggcaaaugcgagacuuguguuuauaacaugaugggcaagcgggagaaaaagcugggggaguuuggaaaagcuaaggguucuagagccaucugguacaugugguugggcgcaagguuccucgaauuugaggcccugggguuccuaaaugaagaccauugguuuagccgcgagaacagucuuuccggaguggagggcgaaggucugcacaagcucggguacauucugcgugauguaagcaaaaaggagggaggcgcuauguaugccgacgauacagcgggcugggacacccggaucacauuggaagaucugaaaaaugaggaaauggugacuaaccauauggagggggagcacaagaaacucgcagaagccauuuucaaacuuaccuaccagaauaaggucgugagaguucagaggccuacgccccgcggaaccgugauggacaucauaucucgacgggaccagagagguucaggccaagucgugacauaugggcugaacacuuucaccaacauggaggcucaguuaaucaggcagauggaaggagagggcguauuuaaaaguauucaacagcugacaguuaaggaggaaaucgccgugaaaaauugguugauucgcgucgguagagagcggcucuccaggauggcaaucagcggggaugacugcguggugaagccacuggaugaccguuucgcuucugcccuaacugcucuuaacgauaugggaaaaguccgaaaggacauucagcagugggaacccucgcgcggcuggaaugauuggacccaaguuccuuuuugcucacaucacuuccacgagcugauaaugaaggacggcagagugcucguagugccaugucggaaccaggaugaacugaucgggagggcccgcauuagccagggagcagguugguccuugagagagacggcgugcuuaggcaaaaguuacgcccagauguggucucugauguauuuucaucggagggaccuccgacuugcugccaaugcaaucuguagcgcugucccgucccacugggugcccacaucacguaccacuuggaguauccaugccacacacgaguggaugaccacugaagauaugcugaccguuuggaacagaguguggauucaagagaauccuuggauggaagacaagacaccagucgagucuugggaagagauacccuaccuagggaaacgcgaggaucaguggugcggaagccugaucggccucacgucccgggcaaccugggccaagaacauucagacugcgaucaaucaggugaggucauugauugguaacgaagaguauacagacuacaugccuagcaugaaaagauuccgccgggaagaggaagaggcugggguacugugguga

SEQ ID NO: 14984 - RNA, 9876 nt, Artificial Sequence
  derived and/or modified CDS sequence (opt3) from DENV-2__JN851126__SS-prME
accgccggcaucauuauaaugaugauccccacagugauggcuuuccaccugacuacgagaaacggggagccucauaugauugucagcaggcaggaaaagggaaaaucccuccuuuuuaagaccgagaaugguguuaacaugugcacacugauggcaauggacuugggcgaauuaugugaggauacuaucaccuacaauugcccacugcuaaaacaaaacgaaccggaggacauugauuguuggugcaauucuacaucaaccugggugacuuaugggacauguaccgccacgggagagcaccggcgcgaaaagcgaaguguagcgcucgugccccaugucggcaugggucuggagacucguaccgaaacauggaugagcuccgagggggcuuggaaacacgcccagagaaucgagacuugggugcuuaggcauccuggauucaccauaauggcagccauccuggcuuacacaauuggcaccacguauuuucagcggguuuugaucuucauucuccugacugcaguggccccaucuaugacaaugcgcugcaucggcauaucgaacagagacuuugucgaaggggugucaggagguagcuggguagauauuguucuggagcacggcaguugugugaccacuauggcuaagaauaagcccacacucgacuucgaauuaaucaaaaccgaggccaagcacccugcgacgcugaggaaauacugcauugaagcaaagcuuaccaacacaacuaccgccucccgguguccaacacagggggagcccucuuugaaugaggaacaagauaaacgcuuugucugcaagcauagcaugguggaccgaggauggggcaacgguugugggcuguucggaaagggcggcaucgugacuugcgcuauguuuaccugcaaaaagaauauggaggggaaaaucguccagccugaaaaccuagaguauacaauuguuauaaccccacacuccggagaagagaaugccguggguaacgauacuggcaagcaugggaaagagaucaagguaacgccgcagucaaguauuacagaagcagagcucaccggauacggcacugugaccauggaauguagccccagaacaggucuggacuucaaugagaugguccuucugcagauggaaaacaaagcuugguuggugcacaggcaaugguuucucgaucugccuuuaccauggcugcccggggccgacacccagggcucuaacuggauccagaaggagacucucguuacauucaagaauccucacgcgaaaaagcaggauguggucgugcuuggaucccaagagggcgccaugcauacggcacugaccggggcuacugaaauacagaugucaagcggaaacuugcuauuuacaggucaccugaaaugccggcuccguauggacaagcugcagcuuaaaggcaugaguuauucuauguguaccgggaaguucaagguaguuaaagagauugccgaaacacaacauggaacuaucgugauccgcguccaguacgagggcgacgguuccccaugcaagauucccuucgagaucauggaucuggaaaaaagacacguguuggggaggcucauuaccgucaauccgauagugacggagaaggacagcccuguuaacaucgaagcugagcccccauuuggcgauucguacauuaucaucggaguggaaccuggccagcugaaauuaucuugguucaagaagggguccucaauuggacagauguuugagaccacaaugcggggugccaaacgaauggcaauacugggcgacacugccugggauuucgggagucuaggaggcguauuuaccagcaucgguaaggcucuccaucaagucuucggggcgauuuauggcgcagccuuuuccggagugucuuggacaaugaaaauccugauuggcguugugaucacuuggauagggaugaauagccgcucaaccagucuuuccgucagcuuggugcugguaggagugguuacgcucuaccugggcgucauggugcaggcugacucugguuguguggucucauggaagaacaaagagcuuaagugcgggaguggaaucuucauuacagauaauguucacaccuggacugaacaguauaaguuucagcccgagagcccauccaaacuggccucugcaauccaaaaggcccacgaagagggcauuugugguaucagaucggugacaagguuggaaaaccucauguggaaacagauaacccccgagcugaaucauauuuuaagcgagaacgaaaucaagcugacuauuaugaccggcgacaucaaagggauaaugcaggcuggaaagcggucccuacgcccucagccaacagagcucaaauacucauggaaggccuggggcaaggcaaaaaugcugaguacggaacuucacaaucauaccuucuugaucgaugggccggagacugcggaaugccccaacacaaauagagcuuggaacucucuggagguggaggacuauggauuuggcguauucaccacaaauauuuggcucaagcugaaagaaaggcaagaugucuuuugugacagcaaguuaauguccgccgcaaucaaagacaaccgugccgugcacgcugauauggguuacuggauugagucagcccugaacgacacuuggaagaucgaaaaggcaagcuucauagagguuaaaucuugccacuggccuaagucccauacccuuuggaguaaugggguguuggagagcgaaaugauuaucccaaaaaacuucgcuggacccgucucucagcacaauuaucggccuggcuaccauacgcagacagccgguccauggcaccucggccgacuggagauggauuuugacuucugugaagggaccacugugguugugaccgaggauugcggaaacagaggccccucccuaaggacaacuaccgcgucagggaagcugaucacagaauggugcugucgcaguugcacgcucccgccucugcgguacagaggagaggacggcuguugguaugguauggagauuaggccacuuaaagaaaaggaggaaaauuugguaaacagccuggucaccgccgggcauggacagaucgauaauuuuucguuaggcgugcucgguauggcucuguuccuugaggaaaugcugcgcacucgagugggcacaaagcacaccauuuugcucgucgcaguuuccuuugugacucugauaacagggaacaugucuuuccgggaccuaggacguguaguggucauggugggcgccaccaugacggaugacaucgggaugggaguuacuuaccuggcucuccuggccgcauuuaaagugagacccaccuucgcggccggccuuuugcugaggaaguuaacaagcaaagagcucaugaugaccacuauugguaucguccugcuuucacaaaguacaauuccugagaccauccuggaacuaacagaugcucucgcccuggggaugaugguguugaagauaguucgcaauauggagaaauaucagcuggcagugacuaucauggcuauuuuaugcguccccaacgccguaauccuccagaaugcauggaagguguccuguaccgcccuggcuguugugucugucagcccacuucuguugacguccucacaacagaaggcggacuggauuccucucgcccugacaaucaaaggacuaaaccccaccgcaauauuucugacuacccuuagccggacaaguaagaaaagaucuuggccacucaaugaagcuauuauggccgugggcaugguauccauccuggccagcucguugcugaagaacgauaucccgaugacuggcccuuuaguggcugggggacuccugaccgucugcuacguucuuacggguaggucagcagaccuggaguuggaacgagccgcggacgugcgcugggaggagcaggcugaaauuucuggcaguucccccauacucagcaucacaauuucugaggaugggagcauguccaucaaaaaugaagaggaggaacagacccugacuauucuaauccggacaggacugcuugugauaucaggccucuucccagucaguauccccauuaccgccgcagccugguaucugugggaggugaagaaacaaagagcugguguuuugugggacguaccuagcccacccccuguggggaaggcagaauuagaggauggagccuacaggaucaagcagaaaggcauucugggcuauucucagaucggggcgggagucuacaaggaagguacuuuucacacaauguggcaugugacccguggcgcuguucucaugcacaaagggaagcgcauagagccguccugggccgacgugaaaaaggaucugauuucauacggaggcgguuggaagcuugagggggaauggaaagagggagaagagguccaggugcuggcauuggaaccaggcaagaacccccgggccguacaaacgaaaccuggccuauucaagacuaacaccgggacaaucggagcugucagucuggacuuuagcccagguaccuccggcucucccaucguggauaaaaaggggaagguugugggacucuauggcaauggugucgugacaagaucggggacuuacguuagcgccauugcacagaccgagaaaucaaucgaggacaacccugaaauagaggaugacauuuucaggaagaaacgacugacgaucauggaucuucauccgggagcuggcaagacaaaacgguauuuacccgccauugugcgcgaagcgaucaagagaggccugaggacucucauauuggccccaacccgggucguggcagcugagauggaagaggcccugcgagggcucccuauuagauaccagacacccgcuauccgcgcagagcacaccggaagggaaaucguagaccugaugugucaugccacuuucaccaugcgucuucuguccccaauucgggugccuaauuauaacuugaucauuauggaugaggcccacuuuacagaccccgcuaguauagcggcaagagguuacaucucuacgaggguugaaaugggcgaggccgcugggauuuucaugacugccaccccaccgggaagccgcgacccuuuuccccaguccaaugcaccaaucauggaugaggaaaaggagauccccgaacgaucauggaacucuggccacgagugggucacagacuucaaagguaagaccgugugguuugugccuagcauuaaagccgggaaugauauagcugcgugccuaagaaagaacggaaaaaaggucauccaacugagucggaagacuuucgacuccgaauauauuaaaacaaggaccaaugauugggacuuuguagugacgacugauaucagcgagaugggcgccaacuucaaggcagagcgcguuauugacccacguagaugugugaaacccgucauccucacagauggcgaagagcgggugauauuagcugggccuaugccgguuacccauucuucagccgcacagaggcgcggacgaguggguagaaauccaaagaacgaaaaugaccaguacaucuacaugggcgagccccuggaaaacgaugaggacugcgcccacuggaaagaggcuaagaugcuucuggacaauauuaacaccccugaagggaucauucccuccauguuugagccagaacgggagaaagucgaugccaucgacggagaauauaggcuccgcggcgaggcgagaaagacuuucguggauuugaugaggcggggugaccugccuguauggcucgcauaccguguggccgcugaggggauaaacuaugccgaucgccgaugguguuuugacggcguuaagaauaaccaaauucuggaagagaaugucgaaguggagaucuggacaaaagagggagaaagaaagaaacuuaagcccagguggcuagaugcucggauuuacagugacccacuggcauugaaagaguucaaggaauucgccgcuggccgcaagagcuuaacccugaaccucaucacagagauggggagacugccuacuuuuaugacgcagaaagccaggaaugcacuugauaaccuggcggugcuccauaccgccgaagcuggaggucgggccuauaaucacgcauugucggagcugccggagacacuagaaacucugcuccuucugaccuuauuggcuacagucaccggcgggauauuccuguuucucaugucuggaaagggcaucgguaaaaugacucuggggaugugcugcauuaucacggccuccauucuucugugguacgcacagauccagccccacuggauagccgcuagcauuauccucgaguucuuuuugaucguucuguuaauuccagaaccugagaagcaacgaaccccccaggacaaccagcuaacauaugugguaaucgcgauacugacuguggucgccgcaaccauggcuaaugaaaugggcuuccucgagaaaacaaagaaggauuuuggacuuggcucaauuaccacucagcaaccagagaguaacauccuggacauugauuugagaccugccucugccuggacacuguacgcaguggcuacgaccuucaucacucccaugcuccgccauuccauagaaaauagcucaguuaacgugagucugacagccaucgcgaaucaggcuaccguccuuauggggcucggaaaagguuggccgcugagcaagauggacauuggcguaccauugcuggccaucggguguuacucccaggugaacccuauuaccuuaacagcagcccuacugcuccuuguugcucacuaugcaaucauuggacccggccugcaggccaaagcgacuagggaggcucaaaagcgggccgcagccgguaucaugaaaaauccaacgguggacgggauaaccgucauugauuuggaccccaucccuuacgauccgaaguuugaaaagcagcugggccaggugaugcuccugguccuuugcgugacacagguuuuaaugaugcguacuaccugggcucugugugaggcccucacauuggcaaccggacccaucucuacucugugggaaggcaacccagggagauucuggaauacgacaauugcugugagcauggccaacauauuuaggggauccuaucuagcgggcgccggucugcucuucucaaucaugaaaaacaccgcaaauacucgccgggggaccggaaacacaggcgagacucuuggugagaaguggaaaaaucgacugaacgcuuugggcaagucugaauuucaaaccuacaaaaagagugggauucaggagguagacagaacacuggccaaagaaggaaucaagaggggcgagacggaucaucacgcagugucgcgcgggagcgcuaagcuccggugguucgucgagagaaaucugguuaccccugaaggaaaaguggucgacuuaggcugcggucgugggggaugguccuauuacuguggcggucuuaagaacgugaaagagguaaagggccugacuaaagggggacccggccaugaagagccuauuccaaugucuacauauggguggaaucucgugaggcuacagucaggaguugauguguucuuuacccccccugaaaagugcgacacucuguugugugauaucggcgagagcuccccaaaccccacagucgaggccggucggacccugcgcgugcucaaucuugucgaaaacuggcugaauaacaauacgcaauucugcauaaagguguugaacccguacaugccuaguguuaucgagaaaauggaaacccugcagcgaaagcacgggggagcccucguaagaaauccauuaucuaggaacagcacacacgagauguacugggugucaaacgcguccggcaauauugucaguagcgugaacaugaucucucggaugcugauuaaucgcuuuacuaugagacauaaaaaggcuaccuaugaacccgacguugaucuuggcuccgggacaaggaacaucggaauagagucagagacuccuaaucuggacauuaucgguaaacgaaucgaaaagauuaagcaggagcacgaaaccagcuggcauuacgaucaggaccacccauauaaaacaugggcauaccacggcucguaugagaccaagcaaacugggucugccaguuccauggugaacggagucgugcggcuacucacgaaacccugggacguaauaccgauggugacacagauggcuaugaccgauacuaccccuuucggccagcagcguguuuuuaaggaaaaagucgacacaagaacgcaagagcccaaggaggguaccaagaaacugaugaagaucacugccgaaugguuguggaaagagcuggggaagaaaaagacaccacgcauguguaccagggaagaguucacucggaaagugagaagcaaugcagcccucggagcuauuuuuacagaugagaacaaguggaagucagcgcgcgaagccguggaggacuccagguucugggaacuugucgauaaagagcgaaaucugcauuuagaaggcaagugcgagaccuguguuuacaacaugaugggcaaacgggagaagaaacugggggaauuuggaaaggcaaaggguucuagagcuaucugguauaugugguugggcgccagguuccucgaguuugaagcacugggguuccuaaaugaggaccacugguuuagccgcgaaaacagucuuuccggaguggagggcgagggucugcauaaacucggguacauucugcgugauguaagcaagaaagaaggaggcgccauguacgcugacgauacagccggcugggacacucggaucaccuuggaggaucugaagaaugaagagauggugacgaaccacauggaaggggagcauaaaaagcucgcggaggcaauauucagacuuaccuaucagaauaaggucgugaggguucagcgcccuacaccccgaggaacugugauggacaucauuucucggagagaccagagggguucaggccaagucgugaccuacgggcugaacacauucacuaacauggaagcccaguuaauccgccagauggagggagaaggcguauuuaaaaguauucaacaccugaccguuacggaggagaucgcugugaagaauugguuggucagagugggucgggaaaggcucucccguauggccauuagcggggaugacugcguggucaaaccacuggaugaccgauucgcaucugcucuaacagcccuuaacgauaugggaaagguucgcaaagacauacagcagugggagcccucgagaggcuggaaugauuggacccaggugccuuuuugcucacaccauuuccacgaacugaucaugaaggacggccggguacucguggucccauguaggaaccaagaugagcugauugggcgcgcuagaaucagccagggagccgguugguccuugcgggaaacugcaugcuuaggcaagaguuaugcgcagauguggucucugauguacuuucauaggcgagaccuccgucuugccgcuaaugccaucuguagcgcagugccgucccacuggguucccacaucaagaaccacuuggaguauucacgcuacccaugaguggaugacaacggaggauaugcugaccguguggaaccgcgucuggauacaggaaaauccuuggauggaggacaaaacuccaguggaaucuugggaggaaauccccuaucuagggaagcgggaggaucaauggugcggaagccugauuggccucacauccagggccaccugggcaaaaaacauccagacugccauuaaucagguaagaucauugaucgguaacgaggaauacacagacuauaugccuagcaugaagcgcuuccggagggaggaagaggaagcggggguucugugguga

SEQ ID NO: 14985 - RNA, 9876 nt, Artificial Sequence
  derived and/or modified CDS sequence (opt3) from DENV-2__JN851121__SS-prME
accgcaggaaucauuauaaugaugauccccaccgugauggcuuuccaccugacuacgcgaaacggggagccucauaugauugucagcaggcaggaaaagggaaaaucccuccuuuuuaagaccgagaaugguguuaacaugugcacacugauggcaauggacuugggcgaauuaugugaggauacuaucaccuacaauugcccacugcugcggcaaaacgaaccggaggacauugauuguuggugcaauucuacaucaaccugggugacuuaugggacauguaccgccacgggagagcaccgccgagaaaaacguaguguagcgcucgugccccaugucggcaugggucuggagacuagaaccgaaacauggaugagcuccgagggggcuuggaagcacgcccagaggaucgagacuuggauacuucggcauccuggauucaccaucauggcagccauucuggcuuacacaaucggcaccacguauuuucagcgcguguugauuuucauccuccugacugcaguuacaccaucuauggccaugaggugcauaggcauuucgaacagggacuuuguggaaggggucucaggagguagcuggguggauaucguacuggagcacggcaguuguguuaccacuauggcuaaaaauaagcccacacucgacuucgaauuaauuaagaccgaggccaaacacccugcgacgcugcggaaguacugcguggaagcaaaacuuaccaacacaacuaccgccucccgcuguccaacacagggggagcccucuuugaaugaggaacaagauaagcgauuugucugcaaacauagcaugguggacagaggauggggcaacgguugugggcuguucggaaagggcggcaucgugacuugcgcuauguuuaccugcaagaaaaauauggaggggaaggucguucagccugaaaaccuagaguauacaaucgugauuaccccacacuccggagaagagaaugccguagguaacgauacuggcaaacaugggaaggagauaaaagugacgccgcagucaaguaucacagaagcagagcucaccggauacggcacugucaccauggaauguagccccaggacaggucuggacuucaaugagauggugcuucugcagauggaaaacaaggcuugguugguucaccggcaaugguuucucgaucugccuuuaccauggcugcccggggccgacacccagggcucuaacuggauucagaaagagacucucgugacauucaagaauccucacgcgaagaaacaggaugucgugguacuuggaucccaagagggcgccaugcauacggcacugaccggggcuacugaaauccagaugucaagcggaaacuugcuauuuacaggucaccugaagugccgucuccgcauggacaaacugcagcuuaagggcaugaguuauucuauguguaccgggaaauucaagguugugaaggagauagccgaaacacaacauggaacuauugucaucagagugcaguacgagggcgacgguuccccaugcaaaauccccuucgagauuauggaucuggaaaagaggcacgucuuggggcggcucaucaccgugaauccgauuguuacggagaaagacagcccugugaacauagaagcugagcccccauuuggcgauucguacaucauuaucggaguagaaccuggccagcugaaguuaucuugguucaaaaagggguccucaaucggacagauguuugagaccacaaugcgaggugccaagcgcauggcaauucugggcgacacugccugggauuucgggagucuaggaggcgucuuuaccagcauagguaaagcucuccaucaaguguucggggcgaucuauggcgcagccuuuuccggaguuucuuggacaaugaagauucugaucggcguggucauuacuuggaucgggaugaauagcagaucaaccagucuuuccgugagcuugguacuggugggaguugucacgcucuaccugggcgcuauggugcaggccgacucugguuguguggucucauggaaaaacaaggagcuuaaaugcgggaguggaauauucaucacagauaauguucacaccuggacugaacaguauaaguuucagcccgagagcccauccaagcuggcaucugccauucaaaaagcucacgaagagggcaucugugguauuaggucggugacacgguuggaaaaccucauguggaagcagaucacccccgagcugaaucauauauuaacugagaacgaagugaaacugaccauuaugacaggcgacaucaaggggauuaugcaggccggaaaacgcagccuaagaccucagccaacggagcucaaguacuccuggaaagcauggggcaaggcgaagaugcugucaaccgaacuucacaaucauacuuucuugaucgaugggccggagacagcugaaugccccaacaccaauagggccuggaacagucuggagguagaggacuauggauuuggcgucuucacaacuaauauauggcucaaacugaaggaacgucaagauguguuuugugacucuaaauuaaugagcgcagccaucaaggacaaccgggcuguucacgccgauauggguuacuggauugaguccgcacugaacgacaccuggaaaaucgaaaaggcuucauucauugaggugaaaagcugccacuggccuaaaucucauacgcuuugguccaauggggucuuggagagugaaaugaucauaccaaagaacuucgccggacccgugagccagcacaauuaucgaccuggcuaccauacacagaccgcggguccauggcaccucggcagacuggagauggauuuugacuucugugaagggacuaccguugugguaacagaggauugcggaaacaggggccccucucuacgcacuaccacagccuccgggaaacugauuacggaauggugcugucggucaugcacccucccgccucugagauacaggggagaggacggcuguugguaugguauggagauccgcccacuuaaggaaaaagaggaaaauuuggucaacagucuggugacugcugggcauggacagaucgauaauuuuagcuuaggcgugcucgguauggcacuguuccuugaggaaaugcugcgaacacgggucggcaccaagcacgccauuuugcucguugcugugucguuuguaacucugaucacagggaacauguccuuccgugaccuaggaagagugauggucauggugggcgccaccaugacggaugacauugggaugggaguuacuuaccuggcacuccuggcggccuuuaaggugaggcccaccuucgcugccggccuuuugcugcgcaaauuaacaucuaaggagcucaugaugaccacuauagguaucguccugcuuagccaaucaacaauuccugagaguauccuggaacuaaccgaugcacucgcucuggggaugaugguguugaaaauuguucggaauauggagaaguaucagcuggccgugacaaucauggcaauauuaugcguccccaacgccguaauccuccagaaugcuuggaaaguguccuguacuacccuggcgguugugucugucagcccacuucuguugacguccucacaacagaaggccgacuggauuccucucgcacugacaaucaagggacuaaaccccaccgcuauuuuucugacuacccuuagcagaacaaguaaaaagaggucuuggccacucaaugaagccaucauggccgugggcaugguauccauacuggcuagcucguugcugaaaaacgauauuccgaugacuggcccuuuaguggcagggggacuccugaccgucugcuacguucuuacgggucgaucagccgaccuggaguuggaacgcgcggcugacgugcggugggaggagcaggccgaaaucucuggcaguucccccauccucagcauuacaauaucugaggaugggagcauguccaucaagaaugaagaggaggaacagacccugacuauucuaaucagaacaggacugcuugugauuucaggccucuucccagucaguauccccauaaccgcagccgcuugguaucugugggaggugaaaaagcaaagggccgguguuuugugggacguaccuagcccacccccuguggggaaagccgaauuagaggauggagcguaccguaucaagcagaagggcauucugggcuauucucagaucggggcuggagucuacaaagaagguacuuuucacacaauguggcaugugacccgcggcgccguucucaugcacaaggggaaacggauugagccguccugggcagacgugaagaaagaucugaucucauacggaggcgguuggaaacuugagggggaauggaaggagggagaagagguccaggugcuggccuuggaaccaggcaaaaaccccagagcuguacaaacgaagccuggccuauucaaaacuaacaccgggacaauaggagccgucagucuggacuuuagcccagguaccuccggcucucccauuguggauaagaaagggaagguugugggacucuauggcaauggugucgugacaaggucggggacuuacguuagcgcaaucgcucagaccgagaagucaaucgaggacaacccugaaauugaggaugacaucuucagaaagaagcggcugacgauaauggaucuucauccgggagccggcaaaacaaagcgcuauuuacccgcgauugugagagaagccaucaaaaggggccugcggacucucauuuuggcaccaacccgagucguggcugccgagauggaagaggcucugagagggcucccuauccgcuaccagacacccgcaauaagggccgagcacaccggacgugaaauuguagaccugaugugucaugccacuuucaccaugcggcuucuguccccaaucagagugccuaauuauaacuugaucauuauggaugaggcucacuuuacagaccccgcgaguaucgcagccagggguuacauuucuacgcgcguugaaaugggcgaggcugccgggauauucaugacugcaaccccaccgggaagccgagacccuuuuccccaguccaaugccccaaucauggaugaggaaagagagauucccgaacggucauggaacucuggccacgagugggucacagacuucaaggguaagaccgugugguuugugccuagcaucaaagcugggaaugauaucgcggccugccuaaggaagaacggcaagaaggucauucaacugagucgcaaaacuuucgacuccgaauauauaaagacacguaccaaugauugggacuuuguagugacgacugauaucagcgagaugggcgcaaacuucaaggcugagagaguuauugacccacggagguguaugaaacccgugauccucacagauggcgaagaacgcgucauuuuagccgggccuaugccggugacccauucuucagcagcccagcgaagaggacggguugguaggaauccaaagaacgaaaaugaccaguacaucuacaugggcgagccccuggaaaacgaugaggacugcgcucacuggaaagaggccaagaugcuucuggacaauauaaacaccccugaagggaucauucccuccauguuugagccagaacgcgagaaaguggaugcgaucgacggagaauauagacucaggggcgaggcacggaagacuuucgucgauuugaugcgucgcggugaccugccuguguggcucgccuaccgaguagcugccgaggggauuaacuaugcugauagaaggugguguuuugacggcgugaaaaauaaccaaauccuggaagagaauguugaagucgagauauggacaaaggagggagaacggaagaaacuuaagccccgcuggcuagaugcaagaauuuacagugacccacuggccuugaaagaguucaaggaguucgcugccggcaggaagucguuaacccugaaccucaucacagagauggggcggcugccuacuuuuaugacgcagaaggcaaagaaugcgcuugauaaccuggccgugcuccauaccgcugaagccggaggucgagcauauaaucacgcuuugagcgagcugccggagacacuagaaacucugcuccuucugaccuuauuggccacagugaccggcgggauuuuccuguuucucaugucuggaaaaggcaucgguaagaugacucuggggaugugcugcauaaucacggcauccauucuucugugguacgcccagauccagccccacuggauugcugcgagcaucauacucgaguucuuuuugauuguccuguuaaucccagaaccugagaaacaaagaacaccccaggacaaccagcuaacauauguugugaucgccauucugacuguaguggcagcuaccauggccaaugaaaugggcuuccucgagaagaccaagaaggauuuuggacuuggcucaaucaccaaccagcaaccagagaguaauauacuggacauugauuugcgcccugccucugcauggacucuguacgcugucgccacaacguucaucacccccaugcucaggcauuccauugaaaacagcucagugaauguuagucugacugcgaucgcuaaccaggccacagugcuuauggggcucggaaaggguuggccgcugagcaaaauggacauaggcgucccauugcuggcaaucggguguuacucccagguaaauccuauuaccuuaaccgccgcucuacugcuccuuguggcacacuaugccaucauuggacccggccugcaggcgaaggcuacacgggaggcccaaaaacgugcagccgcugguaucaugaagaacccaacuguugacgggaugacggugauugauuuggaccccaucccuuacgauccgaaauuugaaaagcagcugggccaggucaugcuccuggugcuuugcgucacccagguguuaaugaugagaacaacuugggcccugugugaggcacucaccuuggcuacaggacccauaucuacccugugggaaggcaauccagggagguucuggaacacuacgauugccguuagcauggcgaacaucuuucgcggauccuaucuagccggcgcaggucuacucuucucaaucaugaagaauacagcuaacacccggcgagggacuggaaauaccggcgagacacuuggugagaaauggaagaacagacugaaugccuugggcaaaucugaauuucaaauuuacaagaaaagugggauacaggagguggacaggacucuggcaaaggaaggaaucaaacgcggcgagaccgaucaucacgcuguaucgcgggggagcgccaagcucagaugguucguggagcguaaccuggucacaccugaaggaaagguuguggacuuaggcugcgguagagggggaugguccuauuacuguggcggucuuaaaaaugucaaggaggugaaaggccugacgaaagggggacccggccaugaagaaccuauuccaaugucuaccuauggguggaaccucguacggcuacagucaggaguggauguuuucuuuacucccccugaaaaaugcgacacacuguugugugauaucggcgagagcuccccaaaucccaccguggaggccggucgcacucugcgaguccucaaccuuguggaaaauuggcugaacaauaacacacaauucugcauuaaggucuugaauccguacaugccuagugugaucgagaagauggaagcgcugcagagaaaauacgggggagcucucguuaggaacccauuaucucggaacagcacccacgagauguauuggguaucaaaugcauccggcaacauagugaguagcgucaauaugaucucucgcaugcugauuaacagauuuacgaugaggcacaagaaagccaccuacgaacccgacguggaucuuggcuccgggacacgaaauaucggaauugagucagagacuccuaaccuggacaucauagguaagcggauugagaaaaucaagcaggagcaugaaaccagcuggcacuaugaucaggaccauccauacaagacaugggcuuaucacggcucguacgagacuaaacaaaccgggucugccaguuccaugguuaauggagugguccgucuacucacaaagcccugggacgugaucccgaugguaacccagauggcaaugacugauacgacaccuuucggccagcagagaguguuuaaagaaaagguugacacccgcacucaagagcccaaagaggguaccaagaagcugaugaaaauuacagccgaaugguuguggaaggagcuggggaaaaagaaaacgccaaggauguguacccgggaagaguucacuagaaagguccgcagcaacgcugcgcucggagccauauuuacagaugagaauaaauggaagucagcaagggaagcuguggaggacuccggcuucugggaacuuguggauaaggagcgaaaccugcacuuagaaggcaaaugcgagaccugugucuauaauaugauggggaagcgggagaaaaagcugggagaauuugguaaagccaagggcucuagagcaaucugguacaugugguugggggccagguuccucgaguuugaagcucugggauuccuaaacgaggaccauugguuuagccgcgaaaauagucuuuccggcguugagggugaggggcugcacaagcucggauacauucugcgugaugugagcaaaaaggaaggcggcgccauguaugcggacgauacugcagggugggacacacggaucaccuuggaggaucugaaaaacgaagagaugguaacaaaucauauggaaggagagcacaagaaacucgccgaggcuauuuucaaacuuacuuaccagaacaagguggucagagugcagaggccuacaccccgcgguacgguuauggacaucauaucucgacgggaccagagaggcucagggcaaguggucaccuauggacugaacacauucacuaauauggaagcccaguuaaucaggcagauggagggcgaagguguguuuaaaaguauucaacagcugaccguaaaggaggagaucgcaguuaaaaacugguugauucgcguggggagagaacggcucuccaggauggcuaucagcggagaugacugcgucgugaagccacuggaugaccguuucgccucugcucuaacagcccuuaaugauaugggcaaagugcgaaaggacauucagcagugggagcccucgcgcggcuggaacgauuggacucaagucccuuuuugcucacaucacuuccacgaacugauaaugaaggacgggagaguucucgugguaccaugucggaaucaggaugagcugaucggaagggcacgcauuagccagggugcgggcugguccuugagagaaaccgccugcuuagggaaaaguuacgcucagauguggucucugauguauuuucaucggagggaccuccgacuugccgcaaacgcuaucuguagcgccgugccgucccacuggguccccacgucacguacaaccuggaguauccaugcaacucacgaguggaugacaaccgaggauaugcugacuguguggaauagaguuuggauucaagaaaacccuuggauggaggacaagaccccaguggaaucuugggaggaaauacccuaccuaggaaaacgcgaggaucaguggugcggcagccugaucggucucacaucccgggccacgugggcgaagaauauucagaccgcuaucaaccaggucaggucauugauugggaaugaggaauauacugacuacaugccuagcaugaaaagauuccgccgggaggaagaggaagccggagugcugugguga

SEQ ID NO: 14986 - RNA, 9876 nt, Artificial Sequence
  derived and/or modified CDS sequence (opt3) from DENV-2__JN851115__SS-prME
accgccggaaucauuauaaugaugauccccacagugauggcuuuccaccugacuacgcgaaacggggaaccucauaugauugucagcaggcaggaaaagggaaaaucccuccuuuuuaagaccgaaaaugguguuaacaugugcacacugauggcaauggacuugggcgaauuaugugaggauacuaucaccuacaauugcccacuguuacggcaaaacgaaccggaggacauugauuguuggugcaauucuacaucaaccugggugacuuaugggacauguaccgccacgggagagcaccgccgagaaaaacguaguguagcgcucgugccccaugucggcaugggucuggagacucggaccgaaacauggaugagcuccgagggggcuuggaagcacgcccagaggaucgagacuuggauacuucggcauccuggauucaccaucauggcagccauucuggcuuacacaaucggcaccacguauuuucagcgcguguugauuuucauccuccugacugcaguuacaccaucuauggccaugaggugcauaggcauuucgaacagggacuuuguggaaggggucucaggagguagcuggguggauaucguacuggagcacggcaguuguguuaccacuauggcuaaaaauaagcccacacucgacuucgaauuaauuaagaccgaggccaaacacccugcgacgcugcggaaguacugcguggaagcaaaacuuaccaacacaacuaccgccucccgcuguccaacacagggggagcccucuuugaaugaggaacaagauaagcgauuugucugcaaacauagcaugguggacagaggauggggcaacgguugugggcuguucggaaagggcggcaucgugacuugcgcuauguuuaccugcaagaaaaauauggaggggaaggucguucagccugaaaaccuugaguauacaaucgugauuaccccacacuccggagaagagaaugccguagguaacgauacuggcaaacaugggaaggagauaaaagugacgccgcagucaaguaucacagaagcagagcucaccggauacggcacugucaccauggaauguagccccaggacaggucuggacuucaaugagauggugcuucugcagauggaaaacaaggcuugguugguucaccggcaauggcuccuggauuuaccucugccauggcuccccggggccgacacccagggcucuaacuggauucagaaagagacucuugugacauuuaagaauccucacgcgaagaaacaggaugucgugguacugggaucccaagagggcgccaugcauacggcauugaccggggcuacugaaauccagaugucaagcggaaaccuacuguucacaggucaccucaagugccgucugcgcauggacaaacuucagcugaagggcaugaguuauucuauguguaccgggaaauuuaagguugugaaggagauagccgaaacacaacauggaacuauugucaucagagugcaguacgagggcgacgguuccccaugcaaaauccccuucgagauuauggauuuggaaaagaggcacguccucgggcggcugaucaccgugaauccgauuguuacggagaaagacagcccugugaacauagaagcugagcccccauucggcgauucguacaucauuaucggaguagaaccuggccaguuaaagcugucuugguuuaaaaagggguccucaaucggacagauguucgagaccacaaugcgaggugccaagcgcauggcaauucuaggcgacacugccugggauuuugggagucucggaggcgucuucaccagcauagguaaagcucugcaucaaguguuuggggcgaucuauggcgcagccuucuccggaguuucuuggacaaugaagauucuuaucggcguggucauuacuuggaucgggaugaauagcagaucaaccaguuuguccgugagccugguacucgugggaguugucacgcuguaccuuggcgugauggugcaggcugacucugguugugucguuucauggaaaaacaaggagcugaaaugcgggaguggaauauuuaucacagauaaugugcacaccuggacugaacaguauaaguuccagcccgagagcccauccaaguuggccucugcaauucaaaaagcccacgaagagggcaucugugguauuaggucggugacacggcucgaaaaccugauguggaagcagaucacccccgaguuaaaucauauacugacugagaacgaaguaaaacuaaccauuaugacaggcgacaucaaggggauuaugcaggcuggaaaacgcagccucagaccucagccaacggagcugaaguacuccuggaaagccuggggcaaggcaaagaugcuuucaaccgaauugcacaaucauacuuuucugaucgaugggccggagacagcggaaugccccaacaccaauagggcuuggaacagucucgaggucgaggacuauggauucggcguguuuacaacuaauauauggcugaaauuaaaggaacgucaagauguuuucugugacucuaaacugaugagcgccgcaaucaaggacaaccgggccgugcacgcugauauggguuacuggauugaguccgcccuuaacgacaccuggaaaaucgaaaaggcaucauuuauugaggucaagagcugccacuggccuaaaucucauacguugugguccaauggggugcucgagagugaaaugaucauaccaaagaacuucgcuggacccguuagccagcacaauuaucgaccuggcuaccauacacagaccgccgguccauggcaccugggcagacuagagauggauuucgacuuuugugaagggacuaccgugguagucacagaggauugcggaaacaggggccccucucugcgcacuaccacagcguccgggaaacucauuacggaauggugcugucggucaugcacccugccgccucuuagauacaggggagaggacggcuguugguaugguauggagauccgcccauugaaggaaaaagaggaaaaucuggugaacaguuuagugacugccgggcauggacagaucgauaauuucagccucggcguccuggguauggcucuuuuucuggaggaaauguugcgaacacggguuggcaccaagcacgcaauucuccugguggccguaucguucgugacucuaaucacagggaacauguccuuucgugaccugggaagagucauggugaugguuggcgcuaccaugacggaugacauugggaugggagugacuuaccucgcccugcuugcagcguucaaggucaggcccaccuuugccgcuggcuugcuguuacgcaaacucacaucuaaggagcugaugaugaccacuauagguaucgugcuucugagccaaucaacaauuccugagaguauccuagaacucaccgaugcccuggcauuggggaugaugguucugaaaauugugcggaauauggagaaguaucaguuagcugucacaaucauggccauacucugcguacccaacgcagugauccugcaguccgccuggaaaguuucuuguacuacccuugcuguggucagcguguccccacuguugcucacgucaagccaacagaaggcggacuggauuccucuggcccuaacaaucaagggacugaaucccaccgcaauuuuccuuacuacccucaguagaacaucuaaaaagagguccuggccacugaacgaagcuaucauggccguaggcauggugagcauauuggccucgucacugcuaaagaaugauauuccgaugacuggcccucucgucgcugggggacugcuuaccguuugcuacgugcugacgggucgaucugcagacuuggagcucgaacgcgccgcggacgugcggugggaggagcaggcugaaaucaguggcuccagccccauccugucuauuacaauaagcgaggauggguccaugucaaucaagaacgaagaggaggaacagacccuaacuauucugaucagaacaggacuucucgucauuaguggccuguuuccagugagcauccccauaaccgccgcagccugguauuugugggagguuaaaaagcaaagggcugguguauuaugggacgugccuucuccacccccugucgggaaagcagaacuggaggauggagccuaccguaucaagcagaagggcauucucggcuauucccagaucggggcgggaguguacaaagaagguacuuuccacacaauguggcauguuacccgcggcgcugugcugaugcacaaggggaaacggauugagccgucaugggccgacgucaagaaagaucuuaucaguuacggaggcgguuggaagcuggagggggaauggaaggagggagaagaggugcagguauuggcacuagaaccaggcaaaaaucccagagccguccaaacgaagccuggccuguuuaaaacuaacaccgggacaauaggagcugugagccucgacuucuccccagguaccucuggcucgcccauuguugauaagaaagggaagguggucggacuguauggcaacggugugguuacaaggagcgggacuuacgugucagccaucgcacagaccgagaaguccaucgaggacaauccugaaauugaggaugacaucuuucggaaaaagagacuuacgauaauggauuuacauccgggagcuggcaaaacaaagcgcuaucugcccgccauugucagagaagcgaucaaaaggggccuccggacuuugauucuggccccaacccgagugguagcagcugagauggaagaggcccucagagggcugccuauccgcuaccagacacccgcuauaagggcagagcacaccggacgugaaauuguggaccuuaugugucaugccacuuucaccaugcggcuguugaguccaaucagaguuccuaacuauaaucuaaucauuauggaugaggcccacuucacagaccccgcuucuaucgcggcaagggguuacauuagcacgcgcgucgaaaugggcgaggccgcugggauauuuaugacugccaccccaccgggaucccgagacccuuucccccagucaaacgcaccaaucauggaugaggaaagagagauucccgaacggucuuggaauagcggccacgagugggugacagacuuuaaggguaagaccgugugguucgucccuaguaucaaagccgggaacgauaucgcugcgugccugaggaagaauggcaaaaagguaauucaacucucccgcaaaacuuuugacagcgaauauauaaagacacguaccaacgauugggacuucgugguuacgacugauaucucugagaugggcgccaauuuuaaggcagagagagugauugacccacggagguguaugaaacccgucaucuuaacagauggcgaagaacgcgugauucuggcugggccuaugccgguuacccauucauccgccgcacagcgaagaggacggguggguaggaacccaaagaaugaaaacgaccaguacaucuacaugggcgagccccuugaaaaugaugaggacugcgcccacuggaaagaggcuaagaugcugcucgacaacauaaauaccccugaagggaucauucccaguauguucgagccagaacgcgagaaagucgaugccaucgacggagaauauagauugaggggcgaggcgcggaagacuuuuguggaucugaugcgucgcggugaccucccuguauggcuggcauaccgaguggccgcugaggggauuaacuaugccgauagaaggugguguuucgacggcguuaaaaacaaucaaauccuugaagagaacgucgaaguggagauauggacaaaggagggagaacggaagaaacuaaagccccgcuggcuggaugcuagaauuuacagcgacccauuggcauuaaaagaguuuaaggaguucgccgcuggcaggaaaucgcugacccucaaucugaucacagagauggggcggcuuccuacuuucaugacgcagaaggccaagaacgcacuggauaaucucgcgguguugcauaccgccgaagcuggaggucgagccuauaaccacgcacugucugagcuaccggagacacuggaaacucuccuucuguuaaccuugcuggcuacagucaccggcgggauuuuucucuuccugauguccggaaaaggcaucgguaagaugacucuugggaugugcugcauaaucacggccagcauucugcucugguacgcacagauccagccccacuggauugccgcuucaaucauauuggaguuuuuccugauuguuuuacuaaucccagaaccugagaaacaaagaacaccccaggacaaucagcugacauaugugguaaucgcgauucucacuguggucgccgcaaccauggcuaacgaaaugggcuuucuugagaagaccaaaaaggauuucggacugggcaguaucaccacucagcaaccagagucuaauauauuggacauugaucugcgcccugccuccgccuggacacucuacgcaguggcuacgaccuuuaucacucccaugcugaggcauagcauugaaaacucaaguguuaaugugagccuuacagccaucgcgaaccaggcuaccguccucauggggcugggaaaggguuggccguuguccaaaauggacauaggcguaccacuguuagccaucggguguuacucucaggugaauccuauuacccuaacagcagcccugcuccuucugguugcucacuaugcaaucauuggacccggcuugcaggccaaggcgacucgggaggcucaaaaacgugccgcagccgguaucaugaagaacccaacgguggacgggaugaccgucauugaucuggaccccaucccuuacgauccgaaauucgaaaagcagcucggccaggugaugcugcuugucuuaugcgugacacagguucugaugaugagaacuaccugggcucucugugaggccuugacacuggcaaccggacccauaagcacucuaugggaaggcaauccagggagguuuuggaacacgacaauugcuguguccauggccaauaucuuccgcggaucauaucuggcgggcgccggucuccuauuuucuaucaugaagaacaccgcaaacacucggcgagggaccggaaauacaggcgagacucugggugagaaauggaagaacagauugaaugcucugggcaaaagugaguuccaaauuuacaagaaaucggggauacaggagguagacaggacccucgccaaggaaggaaucaaacgcggcgagacagaucaucacgcagugagccggggguccgcuaagcugagaugguuugucgagcguaacuuaguuacgccugaaggaaagguggucgaccuuggcugcgguagagggggauggucuuauuacuguggcggucugaaaaaugugaaggagguaaaaggccucaccaaagggggacccggccaugaagaaccuauuccaaugucaacuuauggguggaaccuagugcggcugcagagcggaguugauguguucuucacacccccugaaaaaugcgacaccuugcugugugauaucggcgaguccaguccaaaucccacugucgaggccggucgcacacuccgagugcuuaaccuggucgaaaauugguugaacaauaacacccaauuuugcauuaaggugcugaauccguacaugccuucuguuaucgagaagauggaagcccuccagagaaaauacgggggagcguuaguaaggaacccacugagcagaaauucaacgcacgagauguauuggguguccaacgcuaguggcaacauagucagcucugugaauaugaucucccgcaugcuuauuaacagauucaccaugaggcacaagaaagcaacauacgaacccgacguugaucugggcucagggacucgaaauaucggaauugagagcgagaccccuaaccuagacaucauagguaagcggauugagaaaaucaagcaggagcaugaaacaucguggcacuaugaucaggaccauccauacaagacuugggccuaucacggcucuuacgagaccaaacaaacagggagugcuuccagcauggugaauggagucgugcgucuccugaccaagcccugggacguaaucccgauggugacucagauggccaugacggauacaaccccuuuuggccagcagagaguuuucaaagaaaaggucgacacucgcacccaagagcccaaagaggguacaaagaaguugaugaaaauuacggcagaauggcuguggaaggagcucgggaaaaagaaaaccccaaggauguguacucgggaagaguuuacaagaaaggugcgcucaaacgccgcucuuggagcgauauucaccgaugagaauaaauggaaguccgccagggaagcaguggaggacucuggcuuuugggaacuggucgauaaggagcgaaacuuacaccuggaaggcaaaugcgagacuuguguuuauaauaugauggggaagcgggagaaaaaguugggagaguucgguaaagcuaagggcagcagagccaucugguacauguggcucggggcaagguuucuggaguucgaagcccuaggauuucuuaacgaggaccauugguucagucgcgaaaauucccugagcggcguggagggugaggggcuccacaagcugggauacauuuugcgugauguaucuaaaaaggaaggcggcgcuauguaugccgacgauacagcggggugggacacccggaucacacuggaggaucucaaaaacgaagagauggugacuaaucauauggaaggagagcacaagaaacuugcagaggccauuuuuaagcugaccuaccagaacaaggucgugagaguucagaggccuacgccccgcgguaccgugauggacaucauaucacgacgggaccagagaggcagugggcaagucgugacauauggauuaaauacuuucaccaacauggaagcucagcugaucaggcagauggagggcgaagguguauucaaauccauucaacaguugacaguuaaggaggagaucgccgugaaaaacuggcucauucgcgucgggagagaacggcugagcaggauggcaaucucuggagaugacugcguggugaagccacuagaugaccguuuugcuucggcccuuacugcucugaaugauaugggcaaaguccgaaaggacauucagcagugggagcccucacgcggcuggaacgauuggacccaaguuccuuucugcagccaucacuuucacgaacucauaaugaaggacgggagagugcugguagugccaugucggaaucaggaugaguugaucggaagggcccgcauuucccagggugcaggcuggaguuuaagagaaacggcgugccuggggaaaucuuacgcccagauguggagccucauguauuuccaucggagggaccuucgacuggcugccaacgcaaucuguuccgcugucccgucacacugggugcccacaagucguaccacuuggucuauccaugccacacacgaguggaugaccacugaggauaugcuaaccguuuggaauagaguguggauucaagaaaacccuuggauggaggacaagacaccagucgaaagcugggaggaaauacccuaccugggaaaacgcgaggaucaguggugcggcucccucaucgguuugacgucacgggcaaccugggccaagaauauucagacugcgaucaaccaggugaggagccugauuggguaugaggaauacacagacuacaugccuucuaugaaaagauuucgccgggaggaagaggaagcuggaguacuuugguga

SEQ ID NO: 14987 - RNA, 9876 nt, Artificial Sequence
  derived and/or modified CDS sequence (opt3) from DENV-2__JN851127__SS-prME
accgcaggcaucauuauaaugaugaucccaacagugauggcuuuccaccugacuacgcggaacggggaaccucauaugauugucagcaggcaggaaaagggaaaaucccuccuuuuuaagaccgagaaugguguuaacaugugcacacugauggcaauggacuugggcgaauuaugugaggauacuaucaccuacaauugcccacugcugaaacaaaacgaaccggaggacauugauuguuggugcaauucuacaucaaccugggugacuuaugggacauguaccgccacgggagagcaccggcgcgaaaagcgaaguguagcgcucgugccacaugucggcaugggucuggagacucguaccgaaacauggaugagcuccgagggggcuuggaaacacgcccagagaaucgagacuugggugcuuaggcauccuggauucaccauaauggcagccauccuggcuuacacaauuggcaccacguauuuucagcggguuuugaucuucauucuccugacugcaguggccccaucuaugacaaugcgcugcaucggcauaucgaacagagacuuugucgaaggggugucaggagguagcuggguagauauuguucuggagcacggcaguugugugaccacuauggcuaagaauaagcccacacucgacuucgaauuaaucaaaaccgaggccaagcacccugcgacgcugaggaaauacugcauugaagcaaaacuuaccaacacaacuaccgccucccgguguccaacacagggggagcccucuuugagcgaggaacaagauaaacgcuuugucugcaagcauuccaugguggaccgaggauggggcaaugguugugggcuguucggaaagggcggcaucgugacuugcgcuauguuuaccugcaaaaagaacauggaggggaaaaucguccagccugaaaaucuagaguauacaauuguuauaaccccacacucaggagaagagaacgccguggguaaugauacuggcaagcaugggaaagagaucaagguaacgccgcagaguagcauuacagaagcagagcucaccggauacggcacugugaccauggaauguucucccagaacaggucuggacuucaacgagaugguccuucugcagauggaaaauaaggcuugguuggugcacaggcaaugguuucucgaucugccuuuaccauggcugcccggggccgacacccagggcuccaacuggauccagaaggagacucucguuacauucaagaacccucacgcgaaaaagcaggauguggucgugcuuggaucacaagagggcgccaugcauacggcacugaccggggcuacugaaauacagaugagcaguggaaauuugcuauuuacaggucaccugaaaugccggcuccguauggacaagcugcagcuuaaaggcaugucuuauuccauguguaccgggaaguucaagguaguuaaagagauugccgaaacacaacauggaacuaucgugauccgcguccaguacgagggcgacgguagcccaugcaagauucccuucgagaucauggaucuggagaagagacacguguuggggaggcucauuaccgucaacccgauagugacggagaaggacucgccuguuaauaucgaagcugagcccccauuuggcgauucuuacauuaucaucggaguggaaccuggccagcugaaauuauccugguucaagaaggggucaaguauuggacagauguuugagaccacaaugcggggugccaaacgaauggcaauacugggcgacacugccugggauuucgggagccuaggaggcguauuuaccuccaucgguaaggcucuccaucaagucuucggggcgauuuauggcgcagccuuuucuggagugagcuggacaaugaaaauccugauuggcguugugaucacuuggauagggaugaacucacgcaguaccucccuuagcgucucuuuggugcugguaggagugguuacgcucuaccugggcgucauggugcaggcugacucagguuguguggucaguuggaagaauaaagagcuuaagugcgggagcggaaucuucauuacagauaacguucacaccuggacugaacaguauaaguuucagcccgaguccccaucuaaacuggccucggcaauccaaaaggcccacgaagagggcauuugugguaucagaagcgugacaagguuggaaaaucucauguggaaacagauaacccccgagcugaaccauauuuuauccgagaaugaaaucaagcugacuauuaugaccggcgacaucaaagggauaaugcaggcuggaaagcggucacuacgcccucagccaaucgagcucaaauacaguuggaaggccuggggcaaggcaaaaaugcugucuacagaacuucacaaccauacguucuugauugaugggccggagaccgcggaaugccccaauacuaacagagcuuggaauagccuggagguggaggacuauggauuuggcguauucacaaccaacaucuggcucaagcugaaagaaaggcaagaugucuuuugugacuccaaguuaaugucagccgugauuaaagacaaucgugcaguucacgccgauauggguuacuggaucgagagcgcucugaacgacacauggaagauagaaaaggccucuuucauugaggugaaauccugccacuggccuaagagucauacucuuuggagcaacggggucuuggagucugaaaugaucauccccaagaauuucgcaggacccgugucccagcacaacuaucggccuggcuaccauacccagacggcugguccauggcaccucggccgacuggagauggauuuugacuucugugaagggacaaccguugugguaacugaggauugcggaaauagaggccccucacuaaggaccacaacugccagugggaagcugauuaccgaauggugcugucgcagcugcacacucccgccucugcgguacagaggagaggacggcuguugguaugguauggagaucaggccacuuaaagaaaaggaggaaaacuuggucaauucgcuggugacggcggggcauggacagauugauaacuuuuccuuaggcgugcucgguauggcccuguuccuugaggaaaugcugcgcacccgagucggcacuaagcacgcuauauugcucguugcagugucuuuuguaacacugaucaccgggaauaugagcuuccgggaccuaggacgugugauggucauggugggcgccacuaugacagaugacauugggaugggaguuaccuaccuggcucuccuggccgcauuuaaagugagacccacguucgcggccggccuuuugcugaggaaguuaacuucaaaagagcucaugaugaccacaaucgguauuguccugcuuagucaauccaccaucccugagacuauacuggaacuaacagaugcucucgcccuggggaugaugguguugaagaucguucgcaacauggagaaauaucagcuggcagugaccauuauggcuaucuuaugcguccccaaugccguaauucuccagaacgcauggaaggugucuuguacaacucuggccguugugagcgucuccccacuucuguugaccucaagccggcaaaaggcugacuggaucccucucgcgcugacgauaaaaggacuaaaucccacagccauuuuucugaccacucuuaguagaaccucuaagaaaagguccuggccacucaacgaagcaaucauggcugugggcaugguaagcauccuggccucgucauugcugaagaaugauauuccgaugacaggcccuuuaguggccgggggacuccugacugucugcuacguucuuaccggucgaucugcugaccuggaguuggaacgcgcagccgacgugcggugggaggagcaggcggaaauaaguggcuccagccccauccucucuauuacgaucagcgaggauggguccaugucaauuaaaaacgaagaggaggaacagacacugaccauccuaauaagaacuggacugcuugugaucaguggccucuucccagucagcauucccaucacagcugccgcaugguaucugugggaggugaagaaacagagggccgguguuuugugggacguaccuucuccacccccuguggggaaggcugaauuagaggauggagcauaccguauuaagcaaaaaggcauccugggcuauucccagauaggggccggagucuacaaggaagguaccuuucacacuauguggcaugugacacgcggcgcgguucucaugcacaaagggaagcggauugagccgucaugggcugacgugaaaaaggaucugaucaguuacggaggcgguuggaaacuugagggggaauggaaagagggagaagagguccaggugcuggccuuggaaccaggcaagaaucccagagcaguacagaccaaaccuggccuauucaagacgaacacugggaccaucggagccgucagccuggacuuuuccccagguacaucuggcucgcccauuguggauaaaaaggggaagguugugggacucuauggcaacggugucgugaccaggagcgggacauacguuucagcuaucgcccaaacugagaaauccauagaggacaauccugaaauugaggaugacaucuuccgaaagaaacggcugaccauuauggaucuucauccgggagcaggcaagacgaaacgcuauuuacccgcuaucgugagagaagccauaaagaggggccugcggacacucauuuuggcgccaacucgagucguggccgcagagauggaagaggcucugagagggcucccuauccgcuaccagacccccgccaucagggcugagcacacaggacgugaaauuguagaccugaugugucaugcaaccuucacuaugcggcuucugaguccaaucagagugccuaacuauaauuugauuauaauggaugaggcccacuuuaccgaccccgccucuaucgcugcgagggguuacauuagcacacgcguugaaaugggcgaggcagccgggaucuucaugacggcuacuccaccgggaucccgagacccuuuuccccagucaaacgccccaaucauggaugaggaaagagagauucccgaacggucuuggaauagcggccacgagugggucaccgacuucaaggguaaaacagugugguuugugccuaguauaaaggcagggaacgauaucgccgcuugccuaaggaaaaauggaaagaaagucauucagcugucccgcaagaccuucgacagcgaauauaucaagacucguacaaacgauugggacuuuguagugaccacggauauuucugagaugggcgcgaauuucaaagccgagagaguuaucgacccacggagguguaugaagcccgugauacucacugauggcgaagaacgcgucaucuuagcagggccuaugccggugacacauucauccgcugcccaacgaagaggacggguugguaggaaccccaagaaugaaaacgaccaguacauuuacaugggcgagccccuggaaaaugaugaggacugcgcacacuggaaggaggccaaaaugcuucuggacaacaucaauaccccugaagggauuauccccaguauguuugagccagaacgcgagaagguggaugcuauagacggagaauauagacucaggggcgaggcccggaaaaccuucgucgauuugaugcgucgcggugaccugccuguguggcucgcguaccgaguagcagccgaggggauuaacuaugcugauagaaggugguguuuugacggcgugaagaacaaucagauccuggaagagaacguugaagucgagauuuggacuaaggagggagaacggaagaaacuuaaaccccgcuggcuagaugccagaaucuacagcgacccacuggcuuugaaagaguucaaagaguucgcagccggcaggaagucguuaacacugaaucucauaaccgagauggggcggcugccuacauuuaugacucaaaaggcucgaaacgcccuugauaaucuggcagugcuccauacggcggaagccggagguagagcuuauaaccacgccuugucugagcugccggagacccuagaaacacugcuccuucugacuuuauuggcaaccgugacaggcgggaucuuccuguuucucauguccggaaaaggcauugguaagaugacccuggggaugugcugcaucauuacugcuagcauccuucugugguacgcccagauacagccccacuggauugcagccucaaucauccucgaguucuuuuugauuguccuguuaaucccagaaccugagaaacagcgcacgccccaagacaaucagcuaaccuauguugugauagcuauucugacaguaguggcggccacuauggcaaacgaaaugggcuuccucgagaagaccaaaaaggauuuuggacuuggcaguaucacaacccagcagccagagucuaauauucuggacaucgauuugaggccugcuuccgccuggacucuguacgccgucgcaacaacguucauaacccccaugcuccggcauagcaucgaaaacucaagugugaauguuagccugacugcuauugccaaccaagcgacagugcuuauggggcucggaaaggguuggccgcuguccaaaauggacaucggcgucccauugcuggcuauuggguguuacucucagguaaauccuaucaccuuaaccgccgcacuacugcuccuuguggcccacuaugcuauuaucggacccggccugcaggcaaaggccacacgugaggcgcagaaaagagcugccgcagguauaaugaagaacccaacuguugacgggauuacggugaucgauuuggaccccaucccuuacgauccgaaauuugaaaagcaacugggccaggucaugcuccuggugcuuugcgucacccagguguuaaugaugaggacaacuugggcccugugugaggcucucaccuuggccacaggacccauuagcacccugugggaaggcaauccagggcgcuucuggaacacuacgauagcaguuuccauggcuaauaucuuucggggaucauaucuagccggcgcgggucuacucuucucuauuaugaagaacacagccaacacccgaagagggacuggaaauaccggcgagacacuuggugagaaauggaagaacaggcugaaugcauugggcaaaagugaauuucagaucuacaagaaaucggggauucaagagguggaccgcacucuggcuaaggaaggaaucaaacggggcgagaccgaucaucacgccguaagcagaggguccgcaaagcuccguugguucauagagaggaaccuggugacaccugaaggaaaggucguugacuuaggcugcgguagaggcggguggucuuauuacugugggggucuuaaaaaugugaaggaggucaaaggccugacgaaagggggacccggccaugaagaaccuaucccaaugucaaccuauggguggaaccucgugcgccuacagagcggaguagauguguucuuuacucccccugaaaaaugcgacacacuguugugugauauuggcgaguccaguccaaaucccaccguugaggcuggucgaacucugagagugcucaaccuugucgaaaauuggcugaacaauaacacacaguucugcaucaagguguugaauccguacaugccuucugucauugagaagauggaagcccugcaaaggaaauacgggggagcccucgugcggaacccauuaagccgcaauucaacccacgagauguauuggguuuccaacgcgaguggcaacaucguaagcucugugaauaugauauccagaaugcugauuaacagguuuacgaugcgacacaagaaagcuaccuacgaacccgacgucgaucuuggcucagggacacggaauaucggaaucgagagcgagacuccuaaccuggacauuauagguaagcguaucgagaaaauuaagcaggagcaugaaaccucguggcacuaugaucaggaccauccauacaagacaugggcauaucacggcucuuacgagacuaaacagaccgggagugccuccagcauggugaauggaguugugagacuacucacaaagcccugggacgucaucccgauggugacccaaauggcuaugacugauacgacaccuuucggccagcagcgcguauuuaaagaaaagguggacaccaggacucaggagcccaaagaggguaccaagaagcugaugaaaauuacagccgaaugguuguggaaggagcuggggaaacggaagacgccaagaauguguacccgcgaagaguucacuaggaaaguucgaucaaacgcagcccucggagcuaucuuuacagaugagaauaaguggaaauccgcgcgggaagccgucgaggacucuggcuucugggaacuuguggauaaggagagaaaccugcacuuagaaggcaagugcgagaccuguguguauaauaugauggggaaaagggagaagaaacugggagaauuugguaaggcaaaaggcagccgcgcuauaugguacaugugguugggggcccguuuccucgaguuugaagcacugggauuccuaaacgaggaccauugguuuagucgggaaaauucccuuagcggcgucgagggugaggggcugcacaagcucggauacauccugagagauguuucuaagaaagaaggcggcgccauguaugcugacgauacugccgggugggacacaaggauuaccuuggaggaucugaagaacgaagagauggugacaaaucauauggaaggaguacacaaaaagcucgcggaggcaaucuuccgccuuacuuaccaaaacaaagugguccgagugcagcggccuacccccagagguacgguuauggacauuaucucaaggcgcgaccagagaggcaguggacagguggucaccuauggacugaauacauucacuaacauggaggcccaauuaauucggcagauggaaggcgaggguguguuuaaguccauacagcaucugaccguaacagaagagaucgcuguuaagaacugguuggugagggucgggcgugagcgacucagccgcauggccauuucuggagaugacugcguggugaaaccacuggaugacagauucgcaucggcucuaacugcccuuaaugauaugggcaagguccggaaagacauccaacagugggaacccucaaggggcuggaacgauuggacccagguuccuuuuugcagccaccacuuccaugagcugaucaugaaggacgggcgcgugcucguagugccauguagaaaucaggaugaacugauuggacgggcuaggauaucccaaggugccggcuggaguuugcgagagacggcaugcuuagggaaaucuuacgcgcagauguggagccugauguauuuucaccguagagaccuccgccuugccgcuaacgccaucuguuccgcagucccgucacauugggugcccacaagucggaccacuuggucuauucacgcuacacacgaauggaugaccacugaggauaugcugaccguuuggaauaggguguggauccaggagaacccuuggauggaagacaagacaccaauugagagcugggaagagauccccuaccuaggaaagagagaagaucaguggugcggcucccugauaggucucacgucacgcgccaccugggccaaaaauauccaaacugccauuaaccagguccggagcuugaucgggaaugaggaguauacagacuacaugccuucuaugaagagguuccgaagagaagaggaagaggcgggagugcugugguga

SEQ ID NO: 14988 - RNA, 9876 nt, Artificial Sequence
  derived and/or modified CDS sequence (opt3) from DENV-2__JN851120__SS-prME
accgccggaaucauuauaaugaugauccccacagugauggcuuuccaccugacuacgcgaaacggggagccucauaugauuguaagcaggcaggaaaagggaaaaucccuccuuuuuaagaccgagaaugguguuaacaugugcacacugauggcaauggacuugggcgaauuaugugaggauacuaucaccuacaauugcccacugcugcggcaaaacgaaccggaggacauugauuguuggugcaauucuacaucaaccugggugacuuaugggacauguaccgccacgggagagcaccgccgagaaaaacguaguguagcgcucgugccccauguaggcaugggucuggagacuagaaccgaaacauggaugagcuccgagggggcuuggaagcacgcccagaggaucgagacuuggauacuucggcauccuggauucaccaucauggcagccauucuggcuuacacagugggcaccacguauuuucagcgcguuuugaucuucauucuccugacugcagugacaccaucuauggccaugaggugcaucggcauaucgaacagggacuuugucgaaggggugucaggagguagcuggguagauauuguucuggagcacggcaguugugugaccacuauggcuaaaaauaagcccacacucgacuucgaauuaaucaagaccgaggccaaacacccugcgacgcugcggaaguacugcgucgaagcaaaacuuaccaacacaacuaccgccucccgcuguccaacacagggggagcccucuuugaaugaggaacaagauaagcgauuugugugcaaacauagcaugguggacagaggauggggcaacgguugugggcuguucggaaagggcggcauugucacuugcgcuauguuuaccugcaagaaaaauauggaggggaagguugugcagccugaaaaccuagaguauacaaucguaaucaccccacacuccggagaagagaaugccguggguaacgauacuggcaaacaugggaaggagauuaaagucacgccgcagucaaguauaacagaagcagagcucaccggauacggcacugugaccauggaauguagccccaggacaggucuggacuucaaugagaugguucuucugcagauggaaaacaaggcuugguuggugcaccggcaaugguuucucgaucugccuuuaccauggcugcccggggccgacacccagggcucuaacuggauccagaaagagacucucgucacauucaagaauccucacgcgaagaaacaggaugugguaguucuuggaucccaagagggcgccaugcauacggcacugaccggggcuacugaaauucagaugucaagcggaaacuugcuauuuacaggucaccugaagugccgucuccgcauggacaaacugcagcuuaagggcaugaguuauucuauguguaccgggaaauucaagguggucaaggagaucgccgaaacacaacauggaacuauagugauuagaguccaguacgagggcgacgguuccccaugcaaaauccccuucgagaucauggaucuggaaaagaggcacguguuggggcggcucauuaccguuaauccgaucgugacggagaaagacagcccuguaaacauugaagcugagcccccauuuggcgauucguacauaaucauuggagucgaaccuggccagcugaaguuaucuugguucaaaaagggguccucaaucggacagauguuugagaccacaaugcgaggugccaagcgcauggcaauccugggcgacacugccugggauuucgggagucuaggaggcguguuuaccagcauugguaaagcucuccaucaaguuuucggggcgauauauggcgcagccuuuuccggagugucuuggacaaugaagauccugauuggcgucgugaucacuuggauugggaugaauagcagaucaaccagucuuuccgucagcuuggugcugguuggagucgugacgcucuaccugggcgugaugguccaggcugacucugguuguguugugucauggaaaaacaaggagcuuaaaugcgggaguggaaucuucauaacagauaaugugcacaccuggacugaacaguauaaguuucagcccgagagcccauccaagcuggccucugcaauccaaaaagcccacgaagagggcauuugugguaucaggucgguaacacgguuggaaaaccucauguggaagcagauuacccccgagcugaaucauaucuuaacugagaacgaagucaaacugaccauaaugacaggcgacauuaaggggaucaugcaggcuggaaaacgcagccuaagaccucagccaacggagcucaaguacuccuggaaagccuggggcaaggcaaagaugcugucaaccgaacuucacaaucauacuuucuugauugaugggccggagacagcggaaugccccaacaccaauagggcuuggaacagucuggagguggaggacuauggauuuggcguuuucacaacuaauaucuggcucaaacugaaggaacgucaagauguguuuugugacucuaaauuaaugagcgccgcaauaaaggacaaccgggccguccacgcugauauggguuacuggaucgaguccgcccugaacgacaccuggaaaauugaaaaggcaucauucaucgaggugaaaagcugccacuggccuaaaucucauacgcuuugguccaaugggguuuuggagagugaaaugauuaucccaaagaacuucgcuggacccgugagccagcacaauuaucgaccuggcuaccauacacagaccgccgguccauggcaccucggcagacuggagauggauuuugacuucugugaagggacuaccguagucgugacagaggauugcggaaacaggggccccucucuacgcacuaccacagcguccgggaaacugauaacggaauggugcugucggucaugcacccucccgccucugagauacaggggagaggacggcuguugguaugguauggagauucgcccacuuaaggaaaaagaggaaaauuuggugaacagucuggucacugccgggcauggacagaucgauaauuuuagcuuaggcguucucgguauggcucuguuccuugaggaaaugcugcgaacacgggugggcaccaagcacgcaaucuugcucguagccgugucguuugucacucugauuacagggaacauguccuuccgugaccuaggaagagugaugguuauggugggcgcuaccaugacggaugacaucgggaugggagucacuuaccuggcccuccuggcagcguuuaaggugaggcccaccuucgccgcuggccuuuugcugcgcaaauuaacaucuaaggagcucaugaugaccacuauugguauaguucugcuuagccaaucaacaaucccugagaguauucuggaacuaaccgaugcccucgcacuggggaugaugguguugaaaaucguccggaauauggagaaguaucagcuggcuguaacaauuauggccaucuuaugcgugcccaacgcaguuauacuccagaaugccuggaaaguguccuguacuacccuggcugucgugucuguaagcccacuucuguugacguccucacaacagaaggcggacuggaucccucucgcccugacaauuaagggacuaaaccccaccgcaaucuuucugacuacccuuagcagaacaaguaaaaagaggucuuggccacucaaugaagcuauuauggccgugggcauggucuccauccuggccagcucguugcugaaaaacgauauaccgaugacuggcccuuuaguugcugggggacuccugaccgugugcuacgugcuuacgggucgaucagcagaccuggaguuggaacgcgccgcggacguccggugggaggagcaggcugaaauuucuggcaguucccccauccucagcaucacaauuucugaggaugggagcauguccauaaagaaugaagaggaggaacagacccugacuauccuaauuagaacaggacugcuugugaucucaggccucuucccaguuaguauucccaucaccgccgcagccugguaucugugggaggucaagaagcaaagggcugguguguugugggacgucccuagcccacccccuguggggaaagcagaauuagaggauggagccuaccguauaaagcagaagggcauccugggcuauucucagauuggggcgggaguuuacaaagaagguacuuuucacacaauguggcaugugacccgcggcgcuguccucaugcacaaggggaaacggaucgagccguccugggccgacgugaagaaagaucugauuucauacggaggcgguuggaaacuugagggggaauggaaggagggagaagagguacagguccuggcauuggaaccaggcaaaaaccccagagccgugcaaacgaagccuggccuauucaaaacuaacaccgggacaaucggagcuguuagucuggacuuuagcccagguaccuccggcucucccauaguggauaagaaagggaaggucgugggacucuauggcaaugguguugugacaaggucggggacuuacgucagcgccauugcacagaccgagaagucaaucgaggacaacccugaaaucgaggaugacauuuucagaaagaagcggcugacgaucauggaucuucauccgggagcuggcaaaacaaagcgcuauuuacccgccauagugagagaagcgauuaaaaggggccugcggacucucaucuuggccccaacccgaguaguggcagcugagauggaagaggcccugagagggcucccuauucgcuaccagacacccgcuaucagggcagagcacaccggacgugaaauaguugaccugaugugucaugccacuuucaccaugcggcuucuguccccaauuagagucccuaauuauaacuugaucaucauggaugaggcccacuuuacagaccccgcuaguauugcggcaagggguuacaucucuacgcgcguggaaaugggcgaggccgcugggauuuucaugacugccaccccaccgggaagccgagacccuuuuccccaguccaaugcaccaauaauggaugaggaaagagagauccccgaacggucauggaacucuggccacgagugggugacagacuucaaggguaagaccgucugguuuguaccuagcauuaaagccgggaaugauaucgcugcgugccuaaggaagaacggcaagaaggugauccaacugagucgcaaaacuuucgacuccgaauauauuaagacacguaccaaugauugggacuuuguugugacgacugauauaagcgagaugggcgccaacuucaaggcagagagagucaucgacccacggagguguaugaaacccgugauucucacagauggcgaagaacgcguuaucuuagcugggccuaugccggugacccauucuucagccgcacagcgaagaggacgggucgguaggaauccaaagaacgaaaaugaccaguacauuuacaugggcgagccccuggaaaacgaugaggacugcgcccacuggaaagaggcuaagaugcuucuggacaauaucaacaccccugaagggauaauccccuccauguuugagccagaacgcgagaaaguggaugccauugacggagaauauagacucaggggcgaggcgcggaagacuuucguagauuugaugcgucgcggugaccugccuguguggcucgcauaccgaguugccgcugaggggaucaacuaugccgauagaaggugguguuuugacggcgucaaaaauaaccaaauucuggaagagaauguggaaguggagaucuggacaaaggagggagaacggaagaaacuuaagccccgcuggcuagaugcuagaauauacagugacccacuggcauugaaagaguucaaggaguucgccgcuggcaggaagucguuaacccugaaccucauuacagagauggggcggcugccuacuuuuaugacgcagaaggccaagaaugcacuugauaaccuggcgguccuccauaccgccgaagcuggaggucgagccuauaaucacgcauugagcgagcugccggagacacuagaaacucugcuccuucugaccuuauuggcuacaguuaccggcgggaucuuccuguuucucaugucuggaaaaggcauugguaagaugacucuggggaugugcugcaucauaacggccuccauccuucugugguacgcacagauucagccccacuggaucgccgcuagcauuauccucgaguucuuuuugauagugcuguuaauuccagaaccugagaaacaaagaacaccccaggacaaccagcuaacauauguagugaucgcgauccugacugucguggccgcaaccauggcuaaugaaaugggcuuccucgagaagaccaaaaaggauuuuggacuuggcucaauuaccacucagcaaccagagaguaacauccuggacauagauuugcgcccugccucugccuggacacuguacgcaguugcuacgaccuucauuacucccaugcucaggcauuccaucgaaaauagcucagugaacgucagucugacagccauugcgaaucaggcuaccguacuuauggggcucggaaaggguuggccgcugagcaaaauggacaucggcgugccauugcuggccauaggguguuacucccagguuaacccuaucaccuuaacagcagcccuacugcuccuuguggcucacuaugcaauuaucggacccggccugcaggccaaggcgacucgggaggcucaaaaacgugccgcagccgguauuaugaagaauccaacggucgacgggaugaccgugaucgauuuggaccccauuccuuacgauccgaaauuugaaaagcagcugggccaggucaugcuccuggugcuuugcguuacacagguguuaaugaugagaacuaccugggcucugugugaggcccucacauuggcaaccggacccaucucuacucugugggaaggcaacccagggagguucuggaauacgacaauagcuguaagcauggccaacauuuuucgcggauccuaucuagcgggcgccggucuacucuucucaaucaugaagaacaccgcaaauacucggcgagggaccggaaacacaggcgagacucuuggugagaaauggaagaauagacugaacgcuuugggcaaaucugaauuucaaaucuacaagaaaagugggauucaggagguggacaggacccuggccaaggaaggaauaaaacgcggcgagacagaucaucacgcagucucgcgggggagcgcuaagcucagaugguucguugagcguaaucuggugacgccugaaggaaaggucguggacuuaggcugcgguagagggggaugguccuauuacuguggcggucuuaaaaacguaaaggaggugaaaggccugaccaaagggggacccggccaugaagaaccuaucccaaugucuacuuauggguggaaucucguucggcuacagucaggaguggaugucuucuuuacacccccugaaaaaugcgacacccuguugugugauauuggcgagagcuccccaaaccccacuguggaggccggucgcacacugcgaguccucaaucuuguggaaaacuggcugaauaacaauacccaauucugcaucaagguuuugaacccguacaugccuaguguaauugagaagauggaagcccugcagagaaaauacgggggagcgcucgugaggaauccauuaucucggaacagcacgcacgagauguauugggucucaaacgcuuccggcaauaucgugaguagcguuaacaugauaucucgcaugcugaucaauagauuuaccaugaggcacaagaaagcaacauacgaacccgacguggaucuuggcuccgggacucgaaacauuggaaucgagucagagaccccuaaucuggacauuaucgguaagcggauagagaaaauuaagcaggagcaugaaacaagcuggcacuaugaucaggaccauccauacaagacuugggccuaucacggcucguacgagaccaaacaaacagggucugcuaguuccauggucaacggagugguacgucuacucaccaagcccugggacgugaucccgaugguuacucagauggccaugacggauacaaccccuuucggccagcagagagucuuuaaagaaaagguggacacucgcacccaagagcccaaagaggguacaaagaagcugaugaaaaucacggcagaaugguuguggaaggagcuggggaaaaagaaaaccccaaggauguguacucgggaagaguucacaagaaaggugcgcagcaaugccgcucucggagcgauuuuuaccgaugagaacaaauggaagucagccagggaagcagucgaggacuccggcuucugggaacuuguugauaaggagcgaaaucugcacuuagaaggcaaaugcgagacuuguguguauaacaugauggggaagcgggagaaaaagcugggagaauuugguaaagcuaagggcucuagagccauaugguacaugugguugggggcaagguuccucgaguuugaagcccugggauuccuaaaugaggaccauugguuuagccgcgaaaacagucuuuccggcguagagggugaggggcugcacaagcucggauacauccugcgugaugugagcaaaaaggaaggcggcgcuauguaugccgacgauacagcggggugggacacccggauuacauuggaggaucugaaaaaugaagagauggucacuaaccauauggaaggagagcacaagaaacucgcagaggccaucuucaaacuuaccuaccagaauaaggugguuagagugcagaggccuacgccccgcgguaccgucauggacauuaucucucgacgggaccagagaggcucagggcaagugguaacauauggacugaacacuuucaccaacauggaagcucaguuaauaaggcagauggagggcgaagguguuuuuaaaaguauccaacagcugacagugaaggaggagauugccgucaaaaauugguugauccgcguggggagagaacggcucuccaggauggcaauuagcggagaugacugcguggucaagccacuggaugaccguuucgcuucugcccuaacugcucuuaacgauaugggcaaaguucgaaaggacauccagcagugggagcccucgcgcggcuggaaugauuggacccaagugccuuuuugcucacaucacuuccacgaacugauuaugaaggacgggagaguacucguggucccaugucggaaccaggaugagcugauaggaagggcccgcaucagccagggugcaggcugguccuugagagaaacggcgugcuuagggaaaaguuacgcccagauguggucucugauguauuuucaucggagggaccuccgacuugcugccaaugcaauuuguagcgcugugccgucccacuggguucccacaucacguaccacuuggaguauccaugccacacacgaguggaugaccacugaggauaugcugaccguguggaacagagucuggauccaagaaaauccuuggauggaggacaagacaccaguggaaucuugggaggaaauucccuaccuaggaaaacgcgaggaucaguggugcggcagccugauaggucucacgucccgggcaaccugggccaagaacauccagacugcgauuaaucagguaaggucauugaucgggaacgaggaauauacagacuacaugccuagcaugaaaagauuccgcauugaggaagaggaagcuggaguucugugguga

SEQ ID NO: 14989 - RNA, 9876 nt, Artificial Sequence
  derived and/or modified CDS sequence (opt3) from DENV-2__JN851131__SS-prME
accgcaggagugaucauuaugaugauaccaacaguaauggcuuuccaccugacuacgagaaacggggaaccucauaugaucguuagcaggcaggaaaagggaaaaucccuccuuuuuaagaccgagaauggugugaacaugugcacacugauggcaauugacuugggcgaauuaugugaggauacuaucaccuacaauugcccacugcuacggcaaaacgaaccggaggacauugauuguuggugcaauucuacaucaaccuggguaacuuaugggacauguaccgccacgggagagcaccgccgagaaaaacguaguguggcgcucguaccccaugugggcaugggucuggagacuaggaccgaaacauggaugagcuccgagggggcuuggaagcacgcccagaggaucgagacuuggguucuucggcauccuggauucaccauaauggcagccauccuggcuuacacaauuggcaccacguauuuucagcgcguguugaucuucauucuccugacugcagucgccccaucuaugacaaugagaugcaucggcauaucgaacagggacuuuguggaagggguaucaggagguagcuggguugauauugugcuggagcacggcaguugugucaccacuauggcuaaaaauaagcccacacucgacuucgaauuaaucaagaccgaggccaaacacccugcgacgcugcggaaguacugcauugaagcaaaacuuaccaacacaacuaccgccucccgcuguccaacacagggggagcccucuuugaaggaggaacaagauaaacgauuugugugcaagcauagcaugguggacagaggauggggcaaugguugugggcuguucggaaagggcggcaucgucacuugcgcuauguuuaccugcaaaaagaacauggaggggaaaguugugcagccugaaaaucuagaguauacaaucguaauuaccccacacuccggagaagagaacgccguggguaaugauacuggcaagcaugggaaagagauaaaggucacgccgcagucaaguaucacagaagcagagcucaccggauacggcacugugaccauggaauguagccccaggacaggucuggacuucaacgagaugguucuucugcagauggaagauaaggcuugguuggugcaccggcaaugguuucucgaccugccuuuaccauggcugcccggggccgauacccagggcucuaauuggauucagaaggagacucucgucacauucaagaacccucacgcgaaaaagcaggacgugguaguucuuggaucccaagagggcgccaugcauacggcacugaccggggcuacugaaauccagaugucaagcggaaacuugcuauuuacaggucaccugaaaugccgucuccgcauggacaagcugcagcuuaaaggcaugaguuauucuauguguaccgggaaguucaagguggucaaagagauagccgaaacacaacauggaacuauugugaucagaguccaguacgagggcgaugguuccccaugcaagauccccuucgagauuauggaccuggagaaaaggcacguguuggggcggcucaucaccguuaauccgauugugacggagaaggauagcccuguaaacauagaagcugagcccccauuuggcgacucguacaucauuaucggagucgaaccuggccagcugaaauuaucuugguucaagaagggguccucaaucggacagauguuugagaccacaaugcgaggugccaaacgcauggcaauucugggcgauacugccugggacuucgggagucuaggaggcguguuuaccagcauagguaaggcucuccaucaaguuuucggggcgaucuauggcgcagccuuuuccggagugucuuggacaaugaaaauucugaucggcgucgugauuacuuggaucgggaugaauagcagaucaaccagucuuuccgucagcuuggugcugguuggagucgugacgcucuaccugggcgugaugguccaggcugauucugguuguguugugucauggaagaacaaagagcuuaagugcgggaguggaauauucaucacagacaaugugcacaccuggacugaacaguauaaguuucagcccgagagcccauccaaacuggccucugcaauucaaaaggcccacgaagagggcaucugugguauuaggucgguaacacgguuggaaaaccucauguggaaacagaucacccccgagcugaaucauauauuaagcgagaacgaagucaagcugacuauuaugaccggcgauaucaaagggauuaugcaggcuggaaagcgcucccuaagaccucagccaacagagcucaaauacucauggaagacguggggcaaggccaaaaugcugaguaccgaacuucacaaucauacuuucuugaucgacgggccggagacagcagaaugccccaacaccaauagggcguggaacucucuggagguggaggauuauggauuuggcguuuucacaacuaauauauggcucaagcugaaagaacgucaagagguguuuugugacagcaaguuaauguccgcugccaucaaagacaaccgggcaguccacgccgauauggguuacuggauugaaucagcucugaaugacaccuggaagaucgagaaggccagcuucauugaggugaaaucuugccacuggccuaagucccauacgcuuuggaguaacgggguuuuggaaagcgagaugaucauacccaaaaacuucgcaggacccgugucucagcacaauuaucgaccuggcuaccauacacagaccgcugguccauggcaccucggcaagcuggaaauggauuuugacuucugugaggggacuaccguagucgugacagaagauugcggaaacagaggccccucccuaaggacuaccacagccucagggaaacugauuacggaguggugcugucgcaguugcacccucccgccucugcgguacagaggagaggacggcuguugguaugguauggaaaucaggccaagcaaggagaaggaagagaaucuugugaacucguuggucacugcggggcauggacagaucgauaauuuuucccugggcguuuuagguauggcccucuuccuggaagagaugcuucgcacacgagugggcaccaaacacgcuauucuguugguagcagugucuuuugucacucucaucacagggaacaugagcuuccgggaccugggacgugugaugguuauggugggcgccaccaugacggaugacauugggaugggagucacuuaccuagcucugcucgccgcauuuaaggugagacccaccuucgcggccggccugcuuuugaggaaacugacaucaaaggaguuaaugaugaccacuauagguaucguucuccugagucaauccacaauuccugaaaccauccuugagcugacagaugcucuagcccucgggaugauggugcugaaaauuguccgcaauauggaaaaguaucaguuggcaguaacuaucauggcuauacugugcgugcccaacgccguuaucuuacagaaugcauggaaggugucuuguaccacgcucgccgucgugagcguauccccacugcuucugacaucaagccaacagaaagcugacuggauuccuuuggcgcucaccaucaagggacugaaccccacugccauuuuucuaaccacacugagucggacuucuaaaaagagauccuggccacuuaaugaggcaaucauggcugugggcauggucagcauacucgccucgucacuguugaaaaacgauauuccgaugaccggcccucugguugccgggggauuacucacggugugcuacgugcugacagguaggucugcugaccuugaacuggagcgagcagccgacguccgcugggaggaacaggcggagaucaguggcuccagccccaucuugucuauuaccauaagcgaagauggguccaugucaaucaagaaugaggaggaagaacagacucucacaauucugauccggaccggacuacuggugauuaguggccuuuucccaguuagcauccccauaacugcugccgcaugguaucucugggaagucaagaaacaaagagccggugugcugugggacgucccuucuccacccccuguggggaaagcugaguuggaagauggagcauacaggaucaaacagaagggcauuuuaggcuauucccagaucggggccggaguuuacaaagaggguacauuucacaccauguggcaugugacgcguggcgcgguccugaugcacaaggggaaacgcauugagccgucaugggcugacgugaagaaggaucucaucaguuacggaggcgguuggaaacuggaaggggaguggaaggaaggagaggaaguacagguccuugcccuggagccaggcaaaaacccccgggcagugcaaacuaagccuggcuuguucaaaaccaauacagggaccauaggagccguuagccuagacuuuuccccagguacaucuggcucgcccauuguggauaagaaggggaaagucgugggacuguauggcaacgguguugugacuagaagcgggaccuacgucucagcuaucgcccagacggagaaguccaucgaagacaacccugagauugaagaugacaucuucaggaaaaagcgacucacaauaauggaucugcauccgggagcaggcaaaacuaagcgguaucuucccgcuauugugcgcgaggccaucaagagaggcuuaaggacccugauucucgcgccaacacggguaguggccgcagaaauggaggaggcuuugcgagggcugccuaucagauaccagacccccgccauacgcguugaacacacuggaagggagauugucgaccucaugugucaugcuaccuucacaaugcgucugcuuaguccaauccgggugccuaauuauaaccugaucauuauggaugaagcacacuuuacggaccccgccucuaucgccgcuagagguuacauuagcacuaggguggagaugggcgaggcggcagggauauucaugaccgccacaccaccgggaucccgcgacccuuuuccccagucaaaugcuccaaucauggaugaagaacgagaaauucccgagagaucuuggaacagcggccacgaauggaucaccgacuucaaagguaagacugucugguuuguaccuaguaucaaagccgggaaugauauugcagccugcuugcggaagaacggcaaaaaggugauacaacuauccaggaagacauucgacagcgaguauaucaaaacccgcacgaaugauugggacuuuguugugacuacagauauuucugagaugggcgcuaacuucaaggcggaacgugucaucgacccaagacgguguaugaaacccgugauucugaccgauggcgaggaaaggguuauccucgccgggccuaugccggugacccauucauccgcagcucagcgccgaggaagagucggucggaauccaaagaacgagaaugaccaguacauauacaugggcgaacccuuagagaacgaugaggacugcgcccacuggaaagaagcaaagaugcugcuugacaauaucaacacuccugaggggauuauccccaguauguuugaaccagagagggaaaaaguggaugccauugacggagaguaucgccugagaggcgaggcuaggaagacauucguagaucucaugcggcguggugacuugccuguguggcuggccuaccgcguugcggcagaagggaucaauuaugccgaucgaagaugguguuuugacggcgucaagaacaaccaaauacucgaggaaaauguggagguggagauuuggaccaaagaaggagagaggaagaaacugaagccccgguggcuugaugcucgcaucuacagcgacccacuagcccugaaagaguucaaggaguucgcugcaggcagaaagucguugacauuaaaccugauuacugaaauggggaggcucccuacguuuaugacccagaaagcccggaaugcucuggauaaccuugccguccugcauacagcagaggcgggaggucgagccuauaaucacgcucucucugaguugccggaaacucuggagacccuacugcuccuuacacuguuagccaccguuacuggcgggaucuucuuguuucugauguccggaaagggcauagguaaaaugacgcucgggaugugcugcaucauuaccgcaagcgugcugcuuugguacgcucagauccagccccacuggauugccgcaucaaucauacuggaguucuuucucauuguauugcugaucccagagccugaaaagcaaagaacaccccaggacaaccaguuaacuuauguggucaucgccauucuaaccgugguugcugcgacaauggccaaugagaugggcuuccuggagaaaaccaagaaggauuuuggacucggcaguaucgcaauacagcaaccagaaucuaacauucuugacaucgaucugcgcccugcuuccgccuggacuuuguacgccguggcaacaacguucauuacccccaugcugaggcauagcaucgaaaauucaagugucaacguaagccucacugcuauagccaaucaggcgacagugcugauggggcuuggaaaagguuggccgcucuccaagauggacaucggcguuccacuguuggcuauuggguguuacucucaggugaacccuaucacccugaccgccgcauuacuacugcucgucgcccacuaugcuauuaucggacccggccuucaggcaaaagccacacgggaagcgcaaaagcgugcugccgcagguauuaugaaaaauccaacuguggacgggaucacggucauagaucuggaccccauuccuuacgauccgaaguuugagaagcaguugggccaggugaugcugcucguucugugcgugacccagguacuuaugaugagaacaacuugggccuuaugugaagcucugacccucgccacaggacccaucagcaccuugugggagggcaacccagggagguucuggaauacuacgaucgcaguguccauggcuaacauuuuucgcggaucauaucuggccggcgcgggucuacuguucucuauaaugaaaaauacagccaacacccggcgagggacuggaaacaccggcgagacacucggugaaaaguggaaaaauagacuuaacgcacugggcaagagugaguuucaaaucuacaaaaagucggggauucaggaagucgacaggacuuuggcuaaagagggaaucaagcgcggcgagaccgaucaucacgccguuagccggggguccgcaaagcugagaugguucguggaacguaaucucgucacaccugagggaaaagugguagaccugggcugcgguagagggggauggucuuauuacuguggcgguuuaaagaacgugaaagaaguuaagggccuuacgaaagggggacccggccaugaggaaccuauuccaaugucaaccuauggguggaaucuggugcggcuccagagcggagucgauguguucuuuacucccccugagaagugcgacacacuacugugugauaucggcgaguccaguccaaaccccaccgucgaagcuggucgcacuuugcgagugcugaaucucguugagaacuggcuuaauaacaauacacaauucugcauaaagguacugaacccguacaugccuucugugaucgagaaaauggaggccuugcagagaaaguacgggggagcccuggucaggaauccacucagccggaacucaacccacgaaauguauuggguguccaaugcgaguggcaacauuguuagcucugugaacaugaucucccgcauguuaauuaauagauuuacgaugaggcacaaaaaggcuaccuacgagcccgacgucgaucugggcucagggacacgaaacaucggaauagagagcgaaaaaccuaaucuugacauuaucgguaagcggaucgagaagauuaaacaggaacaugagacuucguggcacuaugaucaggaccauccauacaagaccugggcauaucacggcucuuacgaaacaaaacaaacugggagugccuccagcauggugaacggaguagugcgucugcuaaccaagcccugggacguuauaccgauggucacacagauggcuaugaccgauacuacgccuuucggccagcagagaguguuuaaagagaagguggacacacgcacccaagagcccaaggaagguacuaaaaagcucaugaaaaucaccgccgaguggcuguggaaggaauuggggaaaaagaaaacaccaaggauguguacgcgggaggaguucaccagaaagguccgcucaaaugcagcccugggagcuauuuuuacugaugaaaacaaguggaaauccgcgagggaggccguugaagacucuggcuucugggagcucgugaauaaggaacgaaaccuucaccuggagggcaaaugcgagacauguguauauaauaugauggggaagcgggagaaaaaguuaggagaguuugguaaggcaaaaggcagcagagcuaucugguacauguggcugggggccagguucuuggaauuugaggcacucggauuccugaacgaagaucauugguuuagucgcgaaaauucccuaagcggcguggagggugaagggcuucacaagcugggauacauucuccgugacgucucuaaaaaggagggcggcgccauguaugcugaugacaccgccgggugggauacucggaucacacuggaagacuugaaaaacgaggaaauggugaccaaucauauggagggagagcacaagaagcuggcggaagcaauauucaaacucacauaccagaacaagguugugagaguccagaggccuacuccccgcgguaccgugauggauaucauuucacgacgggaccagagaggcagugggcaaguaguuacguauggacuuaauaccuucacaaacauggaggcccagcugaucaggcagauggaaggcgaggguguguuuaaauccauucaacauuuaacugucaccgaggaaaucgcugugaagaacuggcuggugcgcgucgggagagagcgguugagcaggauggccauuucuggagacgauugcguugugaaaccacucgacgaucguuucgcaucggcucugacagcccuaaaugacaugggcaagguacgaaaggauauacagcagugggaacccucacgcggcuggaacgacuggacucaggugccuuuuugcagccaccacuuccaugagcuuaucaugaaagaugggagaguccuggugguuccaugucggaaucaagacgaacucauuggaagggcucgcaucucccagggugccggcuggagucugagagagaccgcaugcuuggggaagucuuacgcgcagauguggagcuuaauguauuuucaccggagggaucugcgacucgccgcuaacgccaucuguuccgcagugccgucacauuggguccccacgagucguacaaccuggucuauucacgcuacucacgaguggaugacaaccgaagacaugcuuacuguguggaauagaguauggauacaggagaacccuuggauggaagauaaaaccccaguugagagcugggaagagauccccuaccugggaaagcgcgaggaccaauggugcggcucccuaauuggucugacaucacgggccacgugggccaaaaauauccagaccgccauuaaccaggugaggagccucaucgggaaugaagaguauacugauuacaugccuucuaugaagagauuccgccgggaagaggaagaggcgggagucuugugguga

SEQ ID NO: 14990 - RNA, 9876 nt, Artificial Sequence
  derived and/or modified CDS sequence (opt3) from DENV-2__JN851122__SS-prME
accgccggaaucauuauaaugaugauccccaccgugauggcuuuccaccugacuacgcgaaacggggagccucauaugauugucagcaggcaggaaaagggaaaaucccuccuuuuuaagaccgagaaugguguuaacaugugcacccugauggcaauggacuugggcgaauuaugugaggauacuaucaccuacaauugcccacugcugcggcaaaacgaaccggaggacauugauuguuggugcaauucuacaucaaccugggugacuuaugggacauguaccgccacgggagagcaccgccgagaaaaacguaguguugcgcucgugccccaugucggcaugggucuggagacuagaaccgaaacauggaugagcuccgagggggcuuggaagcacgcccagaggaucgagacuuggauacuucggcauccuggauucaccaucauggcagccauucuggcuuacacaaucggcaccacguauuuucagcgcguguugauuuucauccuccugacugcaguuacaccaucuauggccaugaggugcauaggcauuucgaacagggacuuuguggaaggggucucaggagguagcuggguggauaucguacuggagcacggcaguuguguuaccacuauggcuaaaaauaagcccacacucgacuucgaauuaauuaagaccgaggccaaacacccugcgacgcugcggaaguacugcguggaagcaaaacuuaccaacacaacuaccgccucccgcuguccaacacagggggagcccucuuugaaugaggaacaagauaagcgauuugucugcaaacauagcaugguggacagaggauggggcaacgguugugggcuguucggaaagggcggcaucgugacuugcgcuauguuuaccugcaagaaaaauauggaggggaaggucguucagccugaaaaccuagaguauacaaucgugauuaccccacacuccggagaagagaaugccguagguaacgauacuggcaaacaugggaaggagauaaaagugacgccgcagucaaguaucacagaagcagagcucaccggauacggcacugucaccauggaauguagccccaggacaggucuggacuucaaugagauggugcuucugcagauggaaaacaaggcuugguugguucaccggcaaugguuucucgaucugccuuuaccauggcugcccggggccgacacccagggcucuaacuggauucagaaagagacucucgugacauucaagaauccucacgcgaagaaacaggaugucgugguacuuggaucccaagagggcgccaugcauacggcacugaccggggcuacugaaauccagaugucaagcggaaacuugcuauuuacaggucaccugaagugccgucuccgcauggacaaacugcagcuuaagggcaugaguuauucuauguguaccgggaaauucaagguugugaaggagauagccgaaacacaacauggaacuauugucaucagagugcaguacgagggcgacgguuccccaugcaaaauccccuucgagauuauggaucuggaaaagaggcacgucuuggggcggcucaucaccgugaauccgauuguuacggagaaagacagcccugugaacauagaagcugagcccccauuuggcgauucguacaucauuaucggaguagaaccuggccagcugaaguuaucuugguucaaaaagggguccucaaucggacagauguuugagaccacaaugcgaggugccaagcgcauggcaauucugggcgacacugccugggauuucgggagucuaggaggcgucuuuaccagcauagguaaagcucuccaucaaguguucggggcgaucuauggcgcagccuuuuccggaguuucuuggacaaugaagauucugaucggcguggucauuacuuggaucgggaugaauagcagaucaaccagucuuuccgugagcuugguacuggugggaguugucacgcucuaccugggcgugauggugcaggcugacucugguugugucguuucauggaaaaacaaggagcuuaaaugcgggaguggaauauucaucacagauaaugugcacaccuggacugaacaguauaaguuucagcccgagagcccauccaagcuggccucugcaauucaaaaagcccacgaagagggcaucugugguauuaggucggugacacgguuggaaaaccucauguggaagcagaucacccccgagcugaaucauauauuaacugagaacgaaguaaaacugaccauuaugacaggcgacaucaaggggauuaugcaggcuggaaaacgcagccuaagaccucagccaacggagcucaaguacuccuggaaagccuggggcaaggcaaagaugcugucaaccgaacuucacaaucauacuuucuugaucgaugggccggagacagcggaaugccccaacaccaauagggcuuggaacagucuggaggucgaggacuauggauuuggcguguucacaacuaauauauggcucaaacugaaggaacgucaagauguauuuugugacucuaaauuaaugagcgccgcaaucaaggacaaccgggccgugcacgcugauauggguuacuggauugaguccgcccugaacgacaccuggaaaaucgaaaaggcaucauucauugaggucaagagcugccacuggccuaaaucucauacgcuuugguccaaugggguguuggagagugaaaugaucauaccaaagaacuucgcuggacccguuagccagcacaauuaucgaccuggcuaccauacacagaccgccgguccauggcaccucggcagacuggagauggauuuugacuucugugaagggacuaccgugguagucacagaggauugcggaaacaggggccccucucuacgcacuaccacagcguccgggaaacugauuacggaauggugcugucggucaugcacccucccgccucugagauacaggggagaggacggcuguugguaugguauggagauccgcccacuuaaggaaaaagaggaaaauuuggugaacagucuggugacugccgggcauggacagaucgauaauuuuagcuuaggcguccucgguauggcucuguuccuugaggaaaugcugcgaacacggguuggcaccaagcacgcaauuuugcucguggccguaucguuugugacucugaucacagggaacauguccuuccgugaccuaggaagagucauggugaugguuggcgcuaccaugacggaugacauugggaugggagugacuuaccuggcccuccuggcagcguuuaaggucaggcccaccuucgccgcuggccuuuugcugcgcaaauuaacaucuaaggagcucaugaugaccacuauagguaucgugcugcuuagccaaucaacaauuccugagaguauccuggaacuaaccgaugcccucgcacuggggaugaugguuuugaaaauugugcggaauauggagaaguaucagcuggcugucacaaucauggccauauuaugcguacccaacgcagugauccuccagaaugccuggaaaguuuccuguacuacccuggcuguggucucugugagcccacuucuguugacguccucacaacagaaggcggacuggauuccucucgcccugacaaucaagggacuaaaccccaccgcaauuuuucugacuacccuuagcagaacaaguaaaaagaggucuuggccacucaaugaagcuaucauggccguaggcaugguguccauacuggccagcucguugcugaaaaacgauauuccgaugacuggcccuuuagucgcugggggacuccugaccguuugcuacgugcuuacgggucgaucagcagaccuggaguuggaacgcgccgcggacgugcggugggaggagcaggcugaaaucucuggcaguucccccauccucagcauuacaauaucugaggaugggagcauguccaucaagaaugaagaggaggaacagacccugacuauucuaaucagaacaggacugcuugucauuucaggccucuucccagugaguauccccauaaccgccgcagccugguaucugugggagguuaaaaagcaaagggcugguguauugugggacgugccuagcccacccccugucgggaaagcagaauuagaggauggagccuaccguaucaagcagaagggcauucugggcuauucucagaucggggcgggaguguacaaagaagguacuuuucacacaauguggcauguuacccgcggcgcugugcucaugcacaaggggaaacggauugagccguccugggccgacgucaagaaagaucugaucucauacggaggcgguuggaaacuugagggggaauggaaggagggagaagaggugcagguacuggcauuggaaccaggcaaaaaccccagagccguccaaacgaagccuggccuauucaaaacuaacaccgggacaauaggagcugugagucuggacuuuagcccagguaccuccggcucucccauuguugauaagaaagggaagguggucggacucuauggcaauggugugguuacaaggucggggacuuacgugagcgccaucgcacagaccgagaagucaaucgaggacaacccugaaauugaggaugacaucuucagaaagaaacggcugacgauaauggaucuucauccgggagcuggcaaaacaaagcgcuauuuacccgccauugucagagaagcgaucaaaaggggccugcggacucucauuuuggccccaacccgagugguagcagcugagauggaagaggcccugagagggcucccuauccgcuaccagacacccgcuauaagggcagagcacaccggacgugaaauuguggaccugaugugucaugccacuuucaccaugcggcuucuguccccaaucagaguuccuaauuauaacuugaucauuauggaugaggcccacuuuacagaccccgcuaguaucgcggcaagggguuacauuucuacgcgcgucgaaaugggcgaggccgcugggauauucaugacugccaccccaccgggaagccgagacccuuuuccccaguccaaugcaccaaucauggaugaggaaagagagauucccgaacggucauggaacucuggccacgagugggugacagacuucaaggguaagaccgugugguuugucccuagcaucaaaacugggaaugauaucgccgcuugccuaaggaagaacggcaagaagguaauucaacugagucgcaaaacauucgacuccgaauauauaaagacccguacgaaugauugggacuuugugguuacuacagauaucagcgagaugggcgcgaacuucaaggccgagagagugauugacccacggagguguaugaaacccgucauccucaccgauggcgaagaacgcgugauuuuagcagggccuaugccgguuacccauucuucagcugcccagcgaagaggacggguggguaggaauccaaagaacgaaaaugaccaguacaucuacaugggcgagccccuggaaaacgaugaggacugcgcacacuggaaagaggccaagaugcuucuggacaauauaaacacuccugaagggaucauucccuccauguuugagccagaacgcgagaaagucgaugcuaucgacggagaauauagacucaggggcgaggcccggaagacauucguggauuugaugcgucgcggugaccugccuguauggcucgcguaccgaguggcagccgaggggauuaacuaugcugauagaaggugguguuuugacggcguuaaaaauaaccaaauccuggaagagaaugucgaaguggagauauggaccaaggagggagaacggaagaaacuuaagccccgcuggcuagaugccagaauuuacagugacccacuggcuuugaaagaguucaaggaguucgcagccggcaggaagucguuaacacugaaccucaucacugagauggggcggcugccuacguuuaugacccagaaggcuaagaaugcccuugauaaccuggcagugcuccauacagcggaagccggaggucgagcuuauaaucacgccuugagcgagcugccggagacucuagaaacccugcuccuucugacauuauuggcaaccgucacuggcgggauuuuccuguuucucaugucuggaaaaggcaucgguaagaugacgcuggggaugugcugcauaaucaccgcuuccauucuucugugguacgcccagauccagccccacuggauugcagccagcaucauacucgaguucuuuuugauuguucuguuaaucccagaaccugagaaacaaagaacaccccaggacaaccagcuaacuuaugugguaaucgcuauucugaccguggucgcggccacaauggcaaaugaaaugggcuuccucgagaagaccaaaaaggauuuuggacuuggcucaaucacuacacagcaaccagagaguaacauacuggacauugauuugcgcccugcuucugccuggacgcuguacgccguggcaaccacuuucaucacacccaugcucaggcauuccauugaaaauagcucaguuaacgugagucugaccgcuaucgccaaucaggcgaccguccuuauggggcucggaaaggguuggccgcugagcaaaauggacauaggcguaccauugcuggcuaucggguguuacucccaggugaacccuauuacauuaacugccgcacuacugcuccuuguuacgcacuaugccaucauuggacccggccugcaggcuaaggcaacccgggaggcccaaaaacgugcggcugccgguaucaugaagaauccaacaguggacgggaugacugucauugauuuggaccccaucccuuacgauccgaaauuugaaaagcagcugggccaggugaugcuccugguccuuugcgugacccagguuuuaaugaugagaacaaccugggcacugugugaggcccucacuuuggcuacgggacccauaucuacacugugggaaggcaacccagggagguucuggaauaccacuauugccgugagcauggcaaacaucuuucgcggauccuaucuagcuggcgccggucuacucuucucaaucaugaagaacaccgcgaauacacggcgagggacuggaaacauuggcgagacccuuggugagaaauggaagaauagacugaacgccuugggcaaaucugaauuucaaauauacaagaaaagugggauccaggagguagacaggacacuggcaaaggaaggaauuaaacgcggcgagacggaucaucacgcugugucgcgggggagcgccaagcucagaugguucgucgagcguaaucugguuaccccugaaggaaagguggucgacuuaggcugcgguagagggggaugguccuauuacuguggcggucuuaaaaacgugaaggagguaaaaggccugacuaaagggggacccggccaugaagaaccuaucccaaugucuacauauggguggaaucucgugcggcuacagucaggaguugauguguucuuuacacccccugaaaaaugcgacacucuguugugugauauuggcgagagcuccccaaaccccacagucgaggcaggucgcacccugcgagugcucaaucuugucgaaaacuggcugaauaacaauacgcaauucugcaucaagguguugaacccguacaugccuaguguuauagagaagauggaagcucugcagagaaaauacgggggagcccucguaaggaauccauuaucucggaacagcacccacgagauguauugggugucaaacgccuccggcaauaucgucaguagcgugaacaugauuucucgcaugcugaucaauagauuuacaaugaggcacaagaaagcgacuuacgaacccgacguugaucuuggcuccgggacccgaaacauuggaaucgagucagagacaccuaaucuggacauaauugguaagcggaucgagaagaucaagcaggagcaugaaacuagcuggcacuaugaucaggaccauccauacaagaccugggcuuaucacggcucguacgagacaaaacaaaccgggucugcaaguuccauggugaacggagucgugcgucuacucacuaagcccugggacguaauuccgauggugacgcagauggccaugacagauaccacuccuuucggccagcagagaguuuuuaaagaaaaggucgacacccgcacacaagagcccaaagaggguacgaagaagcugaugaaaauaaccgcugaaugguuguggaaggagcuggggaaaaagaaaacuccaaggauguguacacgggaagaguucaccagaaaggugcgcagcaaugccgcacucggagccaucuuuacugaugagaacaaauggaagucagcuagggaagcgguggaggacuccggcuucugggaacuugucgauaaggagcgaaaucugcacuuagaaggcaaaugcgagacauguguuuauaacaugauggggaagcgggagaaaaagcugggagaauuugguaaagccaagggcucuagagcaauuugguacaugugguugggggcuagguuccucgaguuugaagcccugggauuccuaaaugaggaccauugguuuagccgcgaaaacagucuuuccggcguggagggugaggggcugcacaagcucggauacauccugcgugauguaagcaaaaaggaaggcggcgcaauguaugccgacgauaccgcugggugggacacacggauuacuuuggaggaucugaaaaaugaagagauggugaccaaccauauggaaggagagcacaagaaacucgccgaggcgaucuucaaacuuacguaccagaauaaggucgugagaguucagaggccuacaccccgcgguacagugauggacauaaucucucgacgggaccagagaggcucagggcaagucgugacuuauggacugaacaccuucacaaacauggaagcacaguuaauuaggcagauggagggcgaagguguauuuaaaaguauccaacagcugacuguuaaggaggagauugccgugaaaaauugguugauccgcgucgggagagaacggcucuccaggauggcuauuagcggagaugacugcguggugaagccacuggaugaccguuucgccucugcacuaaccgcucuuaacgauaugggcaaaguccgaaaggacauacagcagugggagcccucgcgcggcuggaaugauuggacgcaaguuccuuuuugcucacaucacuuccacgaacugaucaugaaggacgggagagugcucguagugccaugucggaaccaggaugagcugauuggaagggcccgcaucagccagggugcuggcugguccuugagagaaacagccugcuuagggaaaaguuacgcacagauguggucucugauguauuuucaucggagggaccuccgacuugcggccaaugcuaucuguagcgccgucccgucccacugggugcccaccucacguacuacauggaguauucaugcaacccacgaguggaugacuaccgaggauaugcugacaguuuggaacagaguguggauacaagaaaauccuuggauggaggacaagacgccagucgaaucuugggaggaaauccccuaccuaggaaaacgcgaggaucaguggugcggcagccugauuggucucaccucccgggcuacuugggccaagaacauccagacagcaauuaaucaggugaggucauugaucgggaacgaggaauauaccgacuacaugccuagcaugaaaagauuccgccgggaggaagaggaagccggaguacugugguga

SEQ ID NO: 14991 - RNA, 9876 nt, Artificial Sequence
  derived and/or modified CDS sequence (opt3) from DENV-2__JN851116__SS-prME
accgccggaaucauuauaaugaugauccccaccgugauggcuuuccaccugacuacgcgaaacggggagccucauaugauugucagcaggcaggaaaagggaaaaucccuccuuuuuaagaccgagaaugguguuaacaugugcacacugauggcaauggacuugggcgaauuaugugaggauacuaucaccuacaauugcccacugcugcggcaaaacgaaccggaggacauugauuguuggugcaauucuacaucaaccugggugacuuaugggacauguaccgccacgggagagcaccgccgagaaaaacguaguguugcgcucgugccccaugucggcaugggucuggagacuagaaccgaaacauggaugagcuccgagggggcuuggaagcacgcccagaggaucgagacuuggauacuucggcauccuggauucaccaucauggcagccauucuggcuuacacaaucggcaccacguauuuucagcgcguguugauuuucauccuccugacugcaguuacaccaucuauggccaugaggugcauaggcauuucgaacagggacuuuguggaaggggucucaggagguagcuggguggauaucguacuggagcacggcaguuguguuaccacuauggcuaaaaauaagcccacacucgacuucgaauuaauuaagaccgaggccaaacacccugcgacgcugcggaaguacugcguggaagcaaaacuuaccaacacaacuaccgccucccgcuguccaacacagggggagcccucuuugaaugaggaacaagauaagcgauuugucugcaaacauagcaugguggacagaggauggggcaacgguugugggcuguucggaaagggcggcaucgugacuugcgcuauguuuaccugcaagaaaaauauggaggggaaggucguucagccugaaaaccuagaguauacaaucgugauuaccccacacuccggagaagagaaugccguagguaacgauacuggcaaacaugggaaggagauaaaagugacgccgcagucaaguaucacagaagcagagcucaccggauacggcacugucaccauggaauguagccccaggacaggucuggacuucaaugagauggugcuucugcagauggaaaacaaggcuugguugguucaccggcaaugguuucucgaucugccuuuaccauggcugcccggggccgacacccagggcucuaacuggauucagaaagagacucucgugacauucaagaauccucacgcgaagaaacaggaugucgugguacuuggaucccaagagggcgccaugcauacggcacugaccggggcuacugaaauccagaugucaagcggaaacuugcuauuuacaggucaccugaagugccgucuccgcauggacaaacugcagcuuaagggcaugaguuauucuauguguaccgggaaauucaagguugugaaggagauagccgaaacacaacauggaacuauugucaucagagugcaguacgagggcgacgguuccccaugcaaaauccccuucgagauuauggaucuggaaaagaggcacgucuuggggcggcucaucaccgugaauccgauuguuacggagaaagacagcccugugaacauagaagcugagcccccauuuggcgauucguacaucauuaucggaguagaaccuggccagcugaaguuaucuugguucaaaaagggguccucaaucggacagauguuugagaccacaaugcgaggugccaagcgcauggcaauucugggcgacacugccugggauuucgggagucuaggaggcgucuuuaccagcauagguaaagcucuccaucaaguguucggggcgaucuauggcgcagccuuuuccggaguuucuuggacaaugaagauucugaucggcguggucauuacuuggaucgggaugaauagcagaucaaccagucuuuccgugagcuugguacuggugggaguugucacgcucuaccugggcgugauggugcaggcugacucugguugugucguuucauggaaaaacaaggagcuuaaaugcgggaguggaauauucaucacagauaaugugcacaccuggacugaacaguauaaguuucagcccgagagcccauccaagcuggccucugcaauucaaaaagcccacgaagagggcaucugugguauuaggucggugacacgguuggaaaaccucauguggaagcagaucacccccgagcugaaucauauauuaacugagaacgaaguaaaacugaccauuaugacaggcgacaucaaggggauuaugcaggcuggaaaacgcagccuaagaccucagccaacggagcucaaguacuccuggaaagccuggggcaaggcaaagaugcugucaaccgaacuucacaaucauacuuucuugaucgaugggccggagacagcggaaugccccaacaccaauagggcuuggaacagucuggaggucgaggacuauggauuuggcguguucacaacuaauauauggcucaaacugaaggaacgucaagauguauuuugugacucuaaauuaaugagcgccgcaaucaaggacaaccgggccgugcacgcugauauggguuacuggauugaguccgcccugaacgacaccuggaaaaucgaaaaggcaucauucauugaggucaagagcugccacuggccuaaaucucauacgcuuugguccaaugggguguuggagagugaaaugaucauaccaaagaacuucgcuggacccguuagccagcacaauuaucgaccuggcuaccauacacagaccgccgguccauggcaccucggcagacuggagauggauuuugacuucugugaagggacuaccgugguagucacagaggauugcggaaacaggggccccucucuacgcacuaccacagcguccgggaaacugauuacggaauggugcugucggucaugcacccucccgccucugagauacaggggagaggacggcuguugguaugguauggagauccgcccacuuaaggaaaaagaggaaaauuuggugaacagucuggugacugccgggcauggacagaucgauaauuuuagcuuaggcguccucgguauggcucuguuccuugaggaaaugcugcgaacacggguuggcaccaagcacgcaauuuugcucguggccguaucguuugugacucugaucacagggaacauguccuuccgugaccuaggaagagucauggugaugguuggcgcuaccaugacggaugacauugggaugggagugacuuaccuggcccuccuggcagcguuuaaggucaggcccaccuucgccgcuggccuuuugcugcgcaaauuaacaucuaaggagcucaugaugaccacuauagguaucgugcugcuuagccaaucaacaauuccugagaguauccuggaacuaaccgaugcccucgcacuggggaugaugguuuugaaaauugugcggaauauggagaaguaucagcuggcugucacaaucauggccauauuaugcguacccaacgcagugauccuccagaaugccuggaaaguuuccuguacuauucuggcuguggucucugugagcccacuucuguugaccuccucacaacagaaggcggacuggaucccucucgcccugacgauuaagggacuaaaccccacagcaaucuuucugaccacucuuagcagaaccaguaaaaagaggucuuggccacucaaugaagcuauaauggccguaggcaugguguccauucuggccagcucguugcugaaaaacgauaucccgaugacaggcccuuuagucgcugggggacuccugacuguuugcuacgugcuuaccggucgaucagcagaccuggaguuggaacgcgccgcggacgugcggugggaggagcaggcugaaaucucuggcaguucccccauucucagcauaacgaucucugaggaugggagcauguccauuaagaaugaagaggaggaacagacacugaccauccuaauuagaacuggacugcuugucaucucaggccucuucccagugaguauacccaucacagccgcagccugguaucugugggagguuaaaaagcaaagggcugguguauugugggacgugccuagcccacccccugucgggaaagcagaauuagaggauggagccuaccguauuaagcagaagggcauccugggcuauucucagauuggggcgggaguguacaaagaagguaccuuucacacuauguggcauguuacacgcggcgcugugcucaugcacaaggggaaacggaucgagccguccugggccgacgucaagaaagaucugauaucauacggaggcgguuggaaacuugagggggaauggaaggagggagaagaggugcagguacuggcauuggaaccaggcaaaaaccccagagccguccaaaccaagccuggccuauucaaaacgaacacugggaccauuggagcugugagucuggacuuuagcccagguacauccggcucucccaucguugauaagaaagggaagguggucggacucuauggcaauggugugguuaccaggucggggacauacgugagcgccaucgcacagacugagaagucaauugaggacaacccugaaaucgaggaugacauauucagaaagaaacggcugaccauuauggaucuucauccgggagcuggcaaaacgaagcgcuauuuacccgccaucgucagagaagcgauuaaaaggggccugcggacacucaucuuggccccaacucgagugguagcagcugagauggaagaggcccugagagggcucccuauacgcuaccagacccccgcuauuagggcagagcacacaggacgugaaaucguggaccugaugugucaugccaccuucacuaugcggcuucuguccccaaucagaguuccuaauuauaacuugauuaucauggaugaggcccacuuuaccgaccccgcuaguauugcggcaagggguuacauaucuacacgcgucgaaaugggcgaggccgcugggaucuucaugacggccacuccaccgggaagccgagacccuuuuccccaguccaaugcaccaauuauggaugaggaaagagagauccccgaacggucauggaacucuggccacgagugggugaccgacuucaaggguaagacagugugguuugucccuagcaucaaagccgggaaugauauugcugcgugccuaaggaagaacggcaagaagguaauacaacugagucgcaaaaccuucgacuccgaauauaucaagacucguacaaaugauugggacuuugugguuaccacggauauuagcgagaugggcgccaacuucaaggcagagagagugaucgacccacggagguguaugaaacccgucauucucacugauggcgaagaacgcgugaucuuagcugggccuaugccgguuacacauucuucagccgcacagcgaagaggacggguggguaggaauccaaagaacgaaaaugaccaguacauauacaugggcgagccccuggaaaacgaugaggacugcgcccacuggaaagaggcuaagaugcuucuggacaauaucaacaccccugaagggauuauccccuccauguuugagccagaacgcgagaaagucgaugccauugacggagaauauagacucaggggcgaggcgcggaagaccuucguggauuugaugcgucgcggugaccugccuguauggcucgcauaccgaguggccgcugaggggaucaacuaugccgauagaaggugguguuuugacggcguuaaaaauaaccaaauacuggaagagaaugucgaaguggagauuuggacuaaggagggagaacggaagaaacuuaagccccgcuggcuagaugcuagaaucuacagugacccacuggcauugaaagaguucaaggaguucgccgcuggcaggaagucguuaacacugaaccucauuaccgagauggggcggcugccuacauuuaugacucagaaggccaagaaugcacuugauaaccuggcggugcuccauacggccgaagcuggaggucgagccuauaaucacgcauugagcgagcugccggagacccuagaaacacugcuccuucugacuuuauuggcuaccgucacaggcgggaucuuccuguuucucaugucuggaaaaggcauagguaagaugacccuggggaugugcugcaucauuacugccuccauccuucugugguacgcacagauucagccccacuggaucgccgcuagcauaauucucgaguucuuuuugaucguucuguuaaucccagaaccugagaaacaaagaacgccccaggacaaccagcuaaccuaugugguaauugcgauccugacaguggucgccgcaacuauggcuaaugaaaugggcuuccucgagaagaccaaaaaggauuuuggacuuggcucaauaacaacccagcaaccagagaguaacauucuggacaucgauuugcgcccugccucugccuggacucuguacgcaguggcuacaacguucauuacccccaugcucaggcauuccaucgaaaauagcucaguuaacgugagucugacugccauagcgaaucaggcuacaguccuuauggggcucggaaaggguuggccgcugagcaaaauggacaucggcguaccauugcuggccauuggguguuacucccaggugaacccuaucaccuuaaccgcagcccuacugcuccuuguugcucacuaugcaauuaucggacccggccugcaggccaaggcgacacgggaggcucaaaaacgugccgcagccgguauuaugaagaauccaacuguggacgggaugacggucaucgauuuggaccccauaccuuacgauccgaaauuugaaaagcagcugggccaggugaugcuccugguccuuugcgugacccagguuuuaaugaugagaacaacuugggcucugugugaggcccucaccuuggcaacaggacccauuucuacccugugggaaggcaacccagggagguucuggaauacuacgaucgcugugagcauggccaacaucuuucgcggauccuaucuagcgggcgccggucuacucuucucaauuaugaagaacacagcaaauacccggcgagggacuggaaacaccggcgagacacuuggugagaaauggaagaauagacugaacgcuuugggcaaaucugaauuucaaauauacaagaaaagugggauccaggagguagacaggacucuggccaaggaaggaauuaaacgcggcgagaccgaucaucacgcagugucgcgggggagcgcuaagcucagaugguucgucgagcguaaucugguuacaccugaaggaaagguggucgacuuaggcugcgguagagggggaugguccuauuacuguggcggucuuaaaaacgugaaggagguaaaaggccugacgaaagggggacccggccaugaagaaccuaucccaaugucuaccuauggguggaaucucgugcggcuacagucaggaguugauguguucuuuacucccccugaaaaaugcgacacacuguugugugauauuggcgagagcuccccaaaccccaccgucgaggccggucgcacucugcgagugcucaaucuugucgaaaacuggcugaauaacaauacacaauucugcaucaagguguugaacccguacaugccuaguguuauagagaagauggaagcccugcagagaaaauacgggggagcgcucguaaggaauccauuaucucggaacagcacccacgagauguauugggugucaaacgcuuccggcaauaucgucaguagcgugaacaugauuucucgcaugcugaucaauagauuuacgaugaggcacaagaaagcaaccuacgaacccgacguugaucuuggcuccgggacacgaaacauuggaaucgagucagagacuccuaaucuggacauaauugguaagcggaucgagaagaucaagcaggagcaugaaaccagcuggcacuaugaucaggaccauccauacaagacaugggccuaucacggcucguacgagacuaaacaaaccgggucugcuaguuccauggugaacggagucgugcgucuacucacaaagcccugggacguaauuccgauggugacccagauggccaugacugauacgacaccuuucggccagcagagaguuuuuaaagaaaaggucgacacccgcacucaagagcccaaagaggguaccaagaagcugaugaaaauaacagcagaaugguuguggaaggagcuggggaaaaagaaaacgccaaggauguguacccgggaagaguucacuagaaaggugcgcagcaaugccgcucucggagcgaucuuuacagaugagaacaaauggaagucagccagggaagcaguggaggacuccggcuucugggaacuugucgauaaggagcgaaaucugcacuuagaaggcaaaugcgagaccuguguuuauaacaugauggggaagcgggagaaaaagcugggagaauuugguaaagcuaagggcucuagagccauuugguacaugugguugggggcaagguuccucgaguuugaagcccugggauuccuaaaugaggaccauugguuuagccgcgaaaacagucuuuccggcguggagggugaggggcugcacaagcucggauacauccugcgugauguaagcaaaaaggaaggcggcgcuauguaugccgacgauacugcggggugggacacacggauuaccuuggaggaucugaaaaaugaagagauggugacaaaccauauggaaggagagcacaagaaacucgcagaggccaucuucaaacuuacuuaccagaauaaggucgugagaguucagaggccuacaccccgcgguacggugauggacauaaucucucgacgggaccagagaggcucagggcaagucgugaccuauggacugaacacauucacuaacauggaagcucaguuaauuaggcagauggagggcgaagguguauuuaaaaguauccaacagcugaccguuaaggaggagauugccgugaaaaauugguugauccgcgucgggagagaacggcucuccaggauggcaauuagcggagaugacugcguggugaagccacuggaugaccguuucgcuucugcccuaacagcucuuaacgauaugggcaaaguccgaaaggacauacagcagugggagcccucgcgcggcuggaaugauuggacucaaguuccuuuuugcucacaucacuuccacgaacugaucaugaaggacgggagagugcucguagugccaugucggaaccaggaugagcugauuggaagggcccgcaucagccagggugcaggcugguccuugagagaaaccgcgugcuuagggaaaaguuacgcccagauguggucucugauguauuuucaucggagggaccuccgacuugcugccaaugcaaucuguagcgcugucccgucccacugggugcccacgucacguacaaccuggaguauucaugccacucacgaguggaugacaaccgaggauaugcugacuguuuggaacagaguguggauacaagaaaauccuuggauggaggacaagaccccagucgaaucuugggaggaaauccccuaccuaggaaaacgcgaggaucaguggugcggcagccugauuggucucacaucccgggcaacgugggccaagaacauccagaccgcgauuaaucaggugaggucauugaucgggaacgaggaauauacugacuacaugccuagcaugaaaagauuccgccgggaggaagaggaagcuggaguacugugguga

SEQ ID NO: 14992 - RNA, 9876 nt, Artificial Sequence
  derived and/or modified CDS sequence (opt3) from DENV-2__GU370051__SS-prME
accgccggaaucauuauaaugaugauccccaccgugauggcuuuccaccugacuacgcgaaacggggaaccucauaugauugucagcaggcaggaaaagggaaaaucccuccuuuuuaagaccgagaaugguguuaacaugugcacacugauggcaauggacuugggagaauuaugugaggauacuaucaccuacaauugcccacugcugcggcaaaacgaaccggaggacauugauuguuggugcaauucuacaucaaccugggugacuuaugggacauguaccgccacgggagagcaccgccgagaaaaacguaguguugcgcucgugccccaugucggcaugggucuggagacuagaaccgaaacauggaugagcuccgagggggcuuggaagcacgcccagaggaucgagacuuggauacuucggcauccuggauucaccaucauggcagccauucuggcuuacacaaucggcaccacguauuuucagcgcguguugauuuucauccuccugacugcaguuacaccaucuauggccaugaggugcauaggcauuucgaacagggacuuuguggaaggggucucaggagguagcuggguggauaucguacuggagcacggcaguuguguuaccacuauggcuaaaaauaagcccacacucgacuucgaauuaauuaagaccgaggccaaacacccugcgacgcugcggaaguacugcguggaagcaaaacuuaccaacacaacuaccgccucccgcuguccaacacagggggagcccucuuugaaugaggaacaagauaagcgauuugucugcaaacauagcaugguggacagaggauggggcaacgguugugggcuguucggaaagggcggcaucgugacuugcgcuauguuuaccugcaagaaaaauauggaggggaaggucguucagccugaaaaccuagaguauacaaucgugauuaccccacacuccggagaagagaaugccguagguaacgauacuggcaaacaugggaaggagauaaaagugacgccgcagucaaguaucacagaagcagagcucaccggauacggcacugucaccauggaauguagccccaggacaggucuggacuucaaugagauggugcuucugcagauggaaaacaaggcuugguugguucaccggcaaugguuucucgaucugccuuuaccauggcugcccggggccgacacccagggcucuaacuggauucagaaagagacucucgugacauucaagaauccucacgcgaagaaacaggaugucgugguacuuggaucccaagagggcgccaugcauacggcacugaccggggcuacugaaauccagaugucaagcggaaacuugcuauuuacaggucaccugaagugccgucuccgcauggacaaacugcagcuuaagggcaugaguuauucuauguguaccgggaaauucaagguugugaaggagauagccgaaacacaacauggaacuauugucaucagagugcaguacgagggcgacgguuccccaugcaaaauccccuucgagauuauggaucuggaaaagaggcacgucuuggggcggcucaucaccgugaauccgauuguuacggagaaagacagcccugugaacauagaagcugagcccccauuuggcgauucguacaucauuaucggaguagaaccuggccagcugaaguuaucuugguucaaaaagggguccucaaucggacagauguuugagaccacaaugcgaggugccaagcgcauggcaauucugggcgacacugccugggauuucgggagucuaggaggcgucuuuaccagcauagguaaagcucuccaucaaguguucggggcgaucuauggcgcagccuuuuccggaguuucuuggacaaugaagauucugaucggcguggucauuacuuggaucgggaugaauagcagaucaaccagucuuuccgugagcuugguacuggugggaguugucacgcucuaccugggcgugauggugcaggcugacucugguugugucguuucauggaaaaacaaggagcuuaaaugcgggaguggaauauucaucacagauaaugugcacaccuggacugaacaguauaaguuucagcccgagagcccauccaagcuggccucugcaauucaaaaagcccacgaagagggcaucugugguauuaggucggugacacgguuggaaaaccucauguggaagcagaucacccccgagcugaaucauauauuaacugagaacgaaguaaaacugaccauuaugacaggcgacaucaaggggauuaugcaggcuggaaaacgcagccuaagaccucagccaacggagcucaaguacuccuggaaagccuggggcaaggcaaagaugcugucaaccgaacuucacaaucauacuuucuugaucgaugggccggagacagcggaaugccccaacaccaauagggcuuggaacagucuggaggucgaggacuauggauuuggcguguucacaacuaauauauggcucaaacugaaggaacgucaagauguauuuugugacucuaaauuaaugagcgccgcaaucaaggacaaccgggccgugcacgcugauauggguuacuggauugaguccgcccugaacgacaccuggaaaaucgaaaaggcaucauucauugaggucaagagcugccacuggccuaaaucucauacgcuuugguccaaugggguguuggagagugaaaugaucauaccaaagaacuucgcuggacccguuagccagcacaauuaucgaccuggcuaccauacacagaccgccgguccauggcaccucggcagacuggagauggauuuugacuucugugaagggacuaccgugguagucacagaggauugcggaaacaggggccccucucuacgcacuaccacagcguccgggaaacugauuacggaauggugcugucggucaugcacccucccgccucugagauacaggggagaggacggcuguugguaugguauggagauccgcccacuuaaggaaaaagaggaaaauuuggugaacagucuggugacugccgggcauggacagaucgauaauuuuagcuuaggcguccucgguauggcucuguuccuugaggaaaugcugcgaacacggguuggcaccaagcacgcaauuuugcucguggccguaucguuugugacucugaucacagggaacauguccuuccgugaccuaggaagagucauggugaugguuggcgcuaccaugacggaugacauugggaugggagugacuuaccuggcccuccuggcagcguuuaaggucaggcccaccuucgccgcuggccuuuugcugcgcaaauuaacaucuaaggagcucaugaugaccacuauagguaucgugcugcuuagccaaucaacaauuccugagaguauccuggaacuaaccgaugcccucgcacuggggaugaugguuuugaaaauugugcggaauauggagaaguaucagcuggcugucacaaucauggccauauuaugcguacccaacgcagugauccucgaaaaugccuggaaaguuuccuguacuacccuggcuguggucucugugagcccacuucuguugacguccucacagcaaaaggcggacuggauuccucucgcccugacaaucaagggacuaaaccccaccgcaauuuuucugacuacccuuagcagaacaaguaaaaagaggucuuggccacucaaugaggcuaucauggccguaggcaugguguccauacuggccagcucguugcugaaaaacgauauuccgaugacuggcccuuuagucgcugggggacuccugaccguuugcuacgugcuuacgggucgaucagcagaccuggaauuggagcgcgccgcggacgugcggugggaggaacaggcugagaucucuggcaguucccccauccucagcauuacaauaucugaagaugggagcauguccaucaagaaugaggaggaagaacagacccugacuauucuaaucagaacaggacugcuugucauuucaggccucuucccagugaguauccccauaaccgccgcagccugguaucugugggaaguuaaaaagcagagggcugguguauugugggacgugccuagcccacccccugucgggaaagcagaguuagaagauggagccuaccguaucaagcaaaagggcauucugggcuauucucagaucggggcgggaguguacaaagaggguacuuuucacacaauguggcauguuacccgcggcgcugugcucaugcacaaggggaaacggauugagccguccugggccgacgucaagaaagaucugaucucauacggaggcgguuggaaacuugaaggggaguggaaggaaggagaggaagugcagguacuggcauuggagccaggcaaaaaccccagagccguccagacgaagccuggccuauucaaaacuaacaccgggacaauaggagcugugagucuggacuuuagcccagguaccuccggcucucccauuguugauaagaaagggaagguggucggacucuauggcaauggugugguuacaaggucggggacuuacgugagcgccaucgcacaaaccgagaagucaaucgaagacaacccugauauugaggacgauaucuucagaaagaaacggcugacgauaauggaccuucauccgggagcuggcaaaacaaagcgcuauuuacccgccauugucagagaagcgaucaaaaggggccugcggacucucauuuuggccccaacccgagugguagcagcugagauggaagaggcccugagagggcucccuauccgcuaccagacacccgcuauaagggcagagcacaccggacgugaaauuguggaucugaugugucaugccacuuucaccaugcggcuucuguccccaaucagaguuccuaauuauaacuugaucauuauggacgaggcccacuuuacagaccccgcuaguaucgcggcaagggguuacauuucuacgcgcgucgaaaugggcgaggccgcugggauauucaugacugccaccccaccgggaagccgagauccuuuuccccaguccaaugcaccaaucauggacgaggaaagagagauucccgaacggucauggaacucuggccacgagugggugacagauuucaaggguaagaccgugugguuugucccuagcaucaaagccgggaaugacaucgcugcgugccuaaggaagaacggcaagaagguaauucagcugagucgcaaaacuuucgauuccgaauauauaaagacacguaccaaugacugggauuuugugguuacgacugacaucagcgagaugggcgccaacuucaaggcagagagagugauugauccacggagguguaugaaacccgucauccucacagacggcgaagaacgcgugauuuuagcugggccuaugccgguuacccauucuucagccgcacaacgaagaggacggguggguaggaauccaaagaacgauaaugaccaguacaucuacaugggcgaaccccuggagaacgacgaagauugcgcccacuggaaagaggcuaagaugcuucuggacaauauaaacaccccugaggggaucauucccuccauguuugaaccagagcgcgaaaaagucgaugccaucgacggagaguauagacucaggggcgaagcgcggaagacuuucguggauuugaugcgucgcggugaccugccuguauggcucgcauaccgaguggccgcugaggggauuaacuaugccgauagaaggugguguuuugacggcguuaaaaauaaccagauccuggaggaaaaugucgagguggaaauauggacaaaggagggagagcggaagaaacuuaagccccgcuggcuagaugcuagaauuuacagugacccacuggcauugaaagaguucaaggaguucgccgcuggcaggaagucguuaacccugaaccucaucacagaaauggggcggcugccuacuuuuaugacgcaaaaggccaagaaugcacuugauaaccuggcggugcuccauaccgccgaggcuggaggucgagccuauaaucacgcauugagcgaacugccggagacacuagagacucugcuccuucugaccuuauuggcuacagucaccggcgggauuuuccuguuucucaugucuggaaaaggcaucgguaagaugacucuggggaugugcugcauaaucacggccuccauucuucugugguacgcacagauccagccccacuggauugccgcuagcaucauacucgaguucuuuuugauuguucuguuaaucccagagccugaaaaacagagaacaccccaagacaaccagcuaacauaugugguaaucgcgauucugacuguggucgccgcaaccauggcuaaugagaugggcuuccucgaaaagaccaagaaggauuuuggacuuggcucaaucaccacucagcagccagagaguaacauacuggacauugacuugcgcccugccucugccuggacacuguacgcaguggcuacgaccuucaucacucccaugcucaggcauuccauugagaauagcucaguuaacgugagucugacagccaucgcgaaucaagcuaccguccuuauggggcucggaaaggguuggccgcugagcaaaauggauauaggcguaccauugcuggccaucggguguuacucccaggugaacccuauuaccuuaacagcagcccuacugcuccuuguugcucacuaugcaaucauuggacccggccugcaggccaaggcgacucgggaagcucagaaacgugccgcagccgguaucaugaagaauccaacgguggacgggauuaccgucaucgauuuggaccccauaccuuacgauccgaaauuugagaagcaacugggccaggugaugcuccugguccuuugcgugacacagguuuuaaugaugagaacuaccugggcucugugugaagcccucacauuggcaaccggacccauuucuacucugugggagggcaacccagggagguucuggaauacgacaaucgcugugagcauggccaacaucuuucgcggauccuaucuagcgggcgccggucuacucuucucaauuaugaagaacaccgcaaauacucggcgagggaccggaaacacaggcgaaacucuuggugagaaauggaagaauagacugaacgcuuugggcaaaucugaguuucagauauacaagaaaagugggauccaagaaguagacaggacccuggccaaggagggaauuaaacgcggcgaaacagaucaucacgcagugucgcgggggagcgcuaagcucagaugguucgucgagcguaaucugguuacgccugagggaaagguggucgacuuaggcugcgguagagggggaugguccuauuacuguggcggucuuaaaaacgugaaggaaguaaaaggccugaccaaagggggacccggccaugaggaaccuaucccaaugucuacuuauggguggaaucucgugcggcuacagucaggaguugauguguucuuuacacccccugagaaaugcgacacccuguugugugauauuggcgaaagcuccccaaaccccacugucgaggccggucgcacacugcgagugcucaaucuugucgagaacuggcugaauaacaauacccaguucugcaucaagguguugacgccguacaugccuaguguuauagaaaagauggaggcccugcaaagaaaauacgggggagcgcucguaaggaacccauuaucucggaauagcacccacgaaauguauugggugucaaacgcuuccggcaacaucgucaguagcgugaauaugauuucucgcaugcugaucaacagauuuacaaugaggcacaagaaagcaacuuacgagcccgacguugaucuuggcuccgggacccgaaauauuggaaucgaaucagagacaccuaaccuggacauaauugguaagcggaucggcaaaaucaagcaggagcaugaaacuagcuggcacuaugaccaggaucauccauacaagaccugggccuaucacgggucguacgagacaaaacagaccggaucugcuaguuccauggugaauggcgucgugcgucuacucacuaagcccugggacguaauuccgauggugacgcaaauggccaugacagauaccacuccuuucggucagcagagaguuuuuaaagaaaaggucgacacccgcacacaggagcccaaagaagggacgaagaagcugaugaaaauaaccgcagagugguuguggaaggagcugggcaaaaagaaaacuccaaggauguguacacgggaagaguucaccagaaaggugcgcagcaacgccgcucucggcgcgaucuuuacugaugaaaauaaauggaagucagccagggaggcaguggaggacuccggcuucugggaacuugucgauaaggagcgaaaccugcacuuagaagggaaaugcgagacauguguuuauaauaugaugggaaagcgggagaaaaagcugggugaguuuggcaaagcuaaggggucuagagccauuugguacaugugguugggagcaagguuccucgaguuugaagcccugggcuuccuaaacgaggaccauugguuuagccgcgaaaauagucuuuccgguguggagggggaaggacugcacaagcucggcuacauccugcgugauguaagcaaaaaggagggcggggcuauguaugccgacgauaccgcgggaugggacacacggauuacuuuggaggaccugaaaaacgaagagauggugaccaaucauauggaaggugagcacaagaaacucgcagaagccaucuucaaacuuacguaccaaaacaaggucgugagaguucagaggccuacaccccgcggcacagugauggauauaaucucucgacgggaccagagagggucaggacaggucgugacuuauggccugaauaccuucacaaacauggaggcucaauuaauuaggcagauggagggugaagggguauuuaaaaguauccagcaacugacuguuaaggaggaaauugccguggagaacugguugaugcgcgucggaagagagcggcucuccaggauggcaaucagcggcgaugacugcguggugaaaccacuggaugaccguuucgcuucugcccuaaccgcucuuaaugauaugggcaagguccgaaaagacauucagcagugggaacccucgcgcggguggaacgauuggacgcagguuccuuuuugcucacaucacuuccacgagcugauaaugaaggacggaagagugcucguagugccaugucggaaucaagaugaacugaucgguagggcccgcauuagccagggcgcagggugguccuugagagagacagcgugcuuaggaaagaguuacgcccagauguggucucugauguauuuucaucggagggaccuccgacuugcugccaacgcaaucuguagcgcugucccgucccacugggugcccaccucacguacuacauggaguauccaugccacccacgaauggaugacuaccgaggauaugcugacaguuuggaauagaguguggauucaggagaacccuuggauggaagacaaaacgccagucgagucuugggaagagauacccuaccuaggcaagcgcgaagaccaauggugcgguagccugaucgggcucaccucccgggcaacuugggccaaaaauauucagacagcgaucaaccaggugaggucauugauuggaaaugaggaguauaccgauuacaugccuagcaugaagagauuccgccgggaagaggaagaggcuggcguacugugguga

SEQ ID NO: 14993 - RNA, 9876 nt, Artificial Sequence
  derived and/or modified CDS sequence (opt3) from DENV-2__EU359009__SS-prME
accgccggcaucauuauaaugaugauccccacagugauggcuuuccaccugacuacgagaaacggggagccucauaugauugucagcaggcaggaaaagggaaaaucccuccuuuuuaagaccgagaaugguguuaacaugugcacacugauggcaauggacuugggcgaauuaugugaggauacuaucaccuacaauugcccacugcuacggcaaaacgaaccggaggacauugauuguuggugcaauucuacaucaaccugggugacuuaugggacauguaccgccacgggagagcaccgccgagaaaaacguaguguagcgcucgugccccaugucggcaugggucuggagacuagaaccgaaacauggaugagcuccgagggggcuuggaagcacgcccagaggaucgagacuugggugcuucggcauccuggauucaccauaauggcagccauccuggcuuacacaauuggcaccacguauuuucagcgcguuuugaucuucauucuccugacugcaaucgccccaucuaugacaaugagaugcauaggcauuucgaacagggacuuuguggaaggggucucaggagguagcuggguggauaucguacuggagcacggcaguuguguuaccacuauggcuaaaaauaagcccacacucgacuucgaauuaauuaagaccgaggccaaacacccugcgacgcugcggaaguacugcaucgaagcaaaacuuaccaacacaacuaccgccucccgcuguccaacacagggggagcccucuuugaaugaggaacaagauaagcgauuugugugcaaacauagcauggucgacagaggauggggcaacgguugugggcuguucggaaagggcggcaucgugacuugcgcuauguuuaccugcaagaaaaauauggaggggaagauugugcagccugaaaaccuagaguauacaauagucaucaccccacacuccggagaagagaaugccguugguaacgauacuggcaaacaugggaaggagauuaaagugacgccgcagucaaguaucacagaagcagagcucaccggauacggcacuguaaccauggaauguagccccaggacaggucuggacuucaaugagauggugcuucugcagauggaaaacaaggcuugguugguccaccggcaaugguuucucgaucugccuuucccaugguuacccggggccgacacccagggcucuaacuggauacagaaagagacucuggugacauuuaagaauccucacgcgaagaaacaggauguugugguccucggaucccaagagggcgccaugcauacggcacuuaccggggcuacugaaauucagaugucaagcggaaaccuguuguucacaggucaccuaaagugccgucugcgcauggacaaacuccagcugaagggcaugaguuauucuauguguaccgggaaauucaaggugguaaaggagaucgccgaaacacaacauggaacuaucguuauuagagugcaguacgagggcgacgguuccccaugcaaaauccccuuugagauuauggaucuugaaaagaggcacguccuggggcgguugauaaccgugaauccgaucgucacggagaaagacagcccugugaacauugaagcugagcccccauucggcgauucguacaucaucauuggaguugaaccuggccagcucaagcugucuugguuuaaaaagggguccucaauaggacagauguucgagaccacaaugcgaggugccaagcgcauggcaaucuuaggcgacacugccugggauuuugggagucugggaggcguguucaccagcauugguaaagcucuacaucaaguauuuggggcgaucuauggcgcagccuucuccggagucucuuggacaaugaagauucucaucggcgugguuauaacuuggaucgggaugaauagcagaucaaccagucuguccgugagccuugucuuggugggaguagugacgcuguaccucggcguuaugguccaggcugacucugguuguguggugucauggaaaaacaaggagcugaaaugcgggaguggaauuuuuaucacagauaauguccacaccuggacugaacaguauaaguuccagcccgagagcccauccaagcuugccucugcaauucaaaaagcccacgaagagggcaucugugguauaaggucgguuacacggcuggaaaacuugauguggaagcagauuacccccgagcucaaucauauccugagcgagaacgaagugaaauuaacuauuaugaccggcgacaucaaggggauaaugcaggcuggaaaacgcucccugagaccucagccaacagagcuaaaguacucauggaaagccuggggcaaggcaaagaugcucaguacggaacugcacaaucauaccuuucuuaucgaugggccggagacugcggaaugccccaacacaaauagggcuuggaacucuuuggagguggaggacuauggauucggcguauuuaccacaaauauuuggcugaaacucaaggaacgucaagaugucuucugugacagcaaacugauguccgccgcaaucaaggacaaccgggccgugcacgcugauauggguuacuggauugagucagccuuaaacgacacuuggaaaaucgaaaaggcaagcuucauagagguuaagucuugccacuggccuaaaucccauacccuguggaguaauggggugcuugagagcgaaaugauuaucccaaagaacuuugcuggacccgucucucagcacaauuaucgaccuggcuaccauacgcagacagccgguccauggcacuugggcagacucgagauggauuucgacuuuugugaagggaccacugugguugugaccgaggauugcggaaacaggggccccucccugcgcacaacuaccgcgucagggaaacuaaucacagaauggugcugucggaguugcacgcugccgccucucagauacaggggagaggacggcuguugguaugguauggagauucgcccacugaaggaaaaagaggaaaaucuuguaaacagcuuggucaccgccgggcauggacagaucgauaauuucucgcugggcguguuagguauggcucucuuucuggaggaaaugcuucgaacucgggugggcacaaagcacgcaauucuguuggucgccguuuccuucgugacccucauaacugggaacaugucuuuucgugaccugggaagaguaauggugauggucggcgcuacaaugaccgaugacaucgggaugggagugacguaccuagcccugcucgcagcguucaagguuaggcccacuuuugccgcuggccugcuuuugcgcaaacugaccagcaaggaguuaaugaugacaaccauugguaucgugcuccugucacaaaguacuauuccugagacaauccuugaacugaccgaugcccuagcacucgggaugaugguccugaaaauagugcggaauauggagaaguaucaguuggcuguuacaaucauggccauucugugcgugcccaacgcagucaucuuacagaaugccuggaaaguauccuguacuacccucgcugugguuucugugagcccacugcuucugacguccucacaacagaaggcggacuggauuccuuuggcccucacaaucaagggacugaaccccaccgcaauauuccuaacuacccugagcagaacaaguaaaaagaggucuuggccacuuaaugaagcuauuauggccgucggcaugguguccauccucgccagcucgcuguugaaaaacgauaucccgaugacuggcccucugguagcugggggauuacucaccgugugcuacguccugacgggucgaucagcagaccuugagcuggaacgcgccgcggacguucggugggaggagcaggcugaaauuucuggcaguucccccauauugagcaucacaauuucugaggaugggagcauguccaucaagaaugaagaggaggaacagacccucacuauucugaucagaacaggacuacuggugauaucaggccuuuuuccagugaguauccccauuaccgccgcagccugguaucucugggaggucaaaaagcaaagggcuggugugcugugggacguuccuagcccacccccuguagggaaagcagaauuggaggauggagccuaccguaucaagcagaagggcauuuuaggcuauucucagaucggggcgggaguguacaaagaagguacuuuccacacaauguggcaugucacccgcggcgcugugcugaugcacaaggggaaacggauagagccguccugggccgacguuaagaaagaucucauuucauacggaggcgguuggaagcuggagggggaauggaaggagggagaagaggugcagguccuugcacuggaaccaggcaaaaaccccagagccgugcaaacgaagccuggcuuguuuaaaacuaacaccgggacaaucggagcuguaagucuagacuucagcccagguaccuccggcucucccaucgucgauaagaaagggaaggugguuggacuguauggcaaugguguggucacaaggucggggacuuacgugagcgccauugcacagaccgagaagucaaucgaggacaacccugaaauagaggaugacauuuuccgaaaaaagcggcucacgaucauggaucugcauccgggagcuggcaaaacaaagcgcuaucuucccgccauuguuagagaagcgaucaaaaggggcuuacggacucugauacucgccccaacccgaguggucgcagcugagauggaagaggccuugagagggcugccuauucgcuaccagacacccgcuaucagggcagagcacaccggacgugaaaucguggaccucaugugucaugccacuuuuaccaugcggcugcuuuccccaauuagaguaccuaauuauaaccugaucauuauggaugaggcccacuucacagaccccgcuaguauagcggcaagggguuacaucucuacgcgcguggaaaugggcgaggccgcugggauuuuuaugacugccaccccaccgggaagccgagacccuuucccccaguccaaugcaccaaucauggaugaggaaagagagauccccgaacggucauggaacucuggccacgaguggguuacagacuuuaaggguaagaccgucugguucgugccuagcauuaaagccgggaaugauauagcugcgugcuugaggaagaacggaaaaaaggugauccaacuaagucgcaaaacuuuugacacagaauauauuaagacccguacgaaugauugggacuucgucguaacuacagauaucuccgagaugggcgccaacuuuaaggcagagagagugauugacccacggagguguaugaaacccguuauccugaccgauggcgaagagcgcgugauacucgcugggccuaugccggucacccauagcucugccgcacagcgaagaggacggguggguaggaauccaaagaacgaaaaugaccaguacaucuacaugggcgagcccuuagaaaacgaugaggacugcgcccacuggaaagaggcuaagaugcugcuugacaauauuaacacuccugaagggaucauucccucaauguucgagccagaacgcgagaaaguugaugccaucgacggagaauauagacugaggggcgaggcgcggaagacauuuguggaucucaugcgucgcggugacuugccugucuggcuggcauaccgaguggccgcugaggggauaaacuaugccgauagaaggugguguuucgacggcguaaaaaauaaccaaauucucgaagagaauguggaaguugagaucuggaccaaggagggagaacggaagaaacugaagccccgcuggcuugaugcuagaauuuacuccgacccacuagcacugaaagaguucaaggaauuugccgcuggcaggaaaaguuugacauuaaaccugaucacugagauggggcggcucccuacguucaugacccagaaggcccgaaaugcacuggauaaccuugcgguccugcauacagccgaagcuggagguagagccuauaaucacgcacucagcgaguugccggagacucuggaaacccuacugcuccuuacacuguuagcuaccgugacuggcgggauauuuuuguuccugaugucgggaaagggcaucgguaaaaugacgcucgggaugugcugcauuaucaccgccucuauucugcuuugguacgcacagauccagccccacuggauagccgcuuccauuauccuggaguuuuuccucaucguguugcugauuccagaaccugagaagcaacgcacaccccaggacaaccaguuaacuuaugucguuaucgcgauacuaaccgugguagccgcaacaauggcuaaugaaaugggcuuucuggagaaaaccaagaaagauuucggacucggcagcauuacuacacagcaaccagagucaaacauccuugacauugaucugaggccugccagugccuggacguuguacgcaguggcuaccacuuuuaucacacccaugcugcggcauucuauagaaaauuccagcgucaacgugucacucaccgccaucgcgaaucaggcuaccguucugauggggcuuggaaaggguuggccgcucaguaagauggacauuggcgugccacuguuggccaucggguguuacagccaggucaacccuauuacacugacugcagccuuacuacugcucguagcucacuaugcaaucauuggacccggccuucaggccaaagcgacgcgugaggcucaaaagagagccgcagccgguaucaugaaaaauccaaccguggacgggauaacaguuauugaucuggaccccaucccuuacgauccgaaguucgaaaaacaguugggccaggugaugcugcucguccugugcgugacucagguccuuaugaugaggaccacaugggcuuuaugugaggcccugacccucgcaacuggacccaucuccacguugugggaaggcaacccagggcgcuuuuggaauacaaccauugcugugucuauggccaacauauuccggggaagcuaucuggcgggcgccggucuacuguuuuccaucaugaagaacacugcaaauacccgaagagggacaggaaacacuggcgagacccucggugagaaguggaaaaauaggcuuaacgcucugggcaagucagaauuccaaauuuacaaaaagucugggauccaggagguugaccgcacauuggccaaagaaggaauuaagcggggcgagacggaucaucacgcagugaguagagggucggcuaaacugcguugguucguagagaggaaucucgugaccccugaaggaaaggucguugaccugggcugcggucgggggggauggagcuauuacuguggcgguuuaaagaacgugaaagaggucaagggccuuacuaaagggggacccggccaugaagagccuaucccaauguccacauauggguggaaucuggugcgccuccagucuggaguagauguguuuuucacccccccugaaaagugcgacacucuacugugugauauaggcgagucaagcccaaaccccacaguugaggccggucgaaccuugagagugcugaaucucgucgaaaacuggcuuaauaacaauacgcaauuuugcaucaaagugcugaacccguacaugccuuccgucauugagaagauggaagccuugcagaggaaguacgggggagcgcuggugcggaauccacucagucgcaacucuacccacgagauguauuggguuagcaacgcuucaggcaauaucguauccagugugaacaugauuagcagaauguuaaucaauagguucacaaugcgacacaaaaaggcaacuuacgaacccgacgucgaucugggcucugggacccggaacauaggaauugaguccgagacaccuaaucuugacaucaucgguaaacguauugaaaagauaaaacaggagcaugaaacuucauggcacuaugaucaggaccauccauacaagaccugggccuaucacggcagcuacgagacaaagcaaaccgggucggcuucuaguauggugaacggaguugugagacugcuaacuaaacccugggacgucaucccgauggugacgcagauggccaugacagauaccacuccuuuuggccagcagcgcguauucaaggaaaaaguggacaccaggacacaagagcccaaggaggguacgaaaaagcucaugaagauuaccgcagaauggcuguggaaagaguuggggaagaaaaagacuccacggauguguacaagagaagaguuuacccgcaaaguuagguccaaugccgcucugggagcgaucuucacugaugagaacaaguggaaaagcgcccgagaagcagucgaggacucaggcuuuugggaacucguggauaaggagcggaaucuucaccuggaaggcaagugcgagacauguguguauaacaugauggggaaaagagagaagaaauuaggagaauucgguaaggcuaaaggcuccagggccauuugguacauguggcugggggcacgcuuuuuggaguucgaagcccucggauuucugaaugaggaccauugguucucucgugaaaacagccuaaguggcgucgagggugaggggcuucacaagcugggauacauccuccgggauguuuccaagaaagaaggcggcgcuauguaugccgacgauaccgcggggugggacacaagaauaacucuggaggauuugaagaaugaagagauggugaccaaccauauggaaggagagcacaaaaagcuggcagaggccaucuucaggcucacguaccagaauaaaguagugcgcguccagcgaccuaccccccgggguacagugauggacauuaucagcagaagggaccagcgcggcucugggcaaguugugacuuauggacuuaacaccuuuacaaacauggaagcucagcugauuagacagauggagggcgaaggugucuucaagucaauccaacauuuaacugugaccgaggagauugccguaaagaauuggcugguucggguggggagggaacguuugagucgaauggcaauauccggagaugacugcgucgugaaaccacucgaugaccgcuuugcuagcgcccugacggcucuaaacgauaugggcaaggugagaaaagacauccagcagugggagcccucucggggcuggaaugauuggacacaggucccuuucugcucgcaccacuuucaugaacuuauuaugaaggacgggaggguucuggugguaccaugucgcaaccaagaugagcucaucggaagagcccggaucucacagggugcaggcuggagccugagggaaaccgcgugcuuggggaaauccuacgcccagauguggaguuuaauguauuuccaccgacgugaccugagacucgcugccaaugcaauuuguucugcugugccgagccauuggguccccacuucccgcacaaccuggucaauacacgccacucacgaguggaugaccacagaggauaugcuuacgguguggaaccggguuuggauccaggaaaauccuuggauggaggacaagaccccaguggaaaguugggaggaaauucccuaccugggaaagagggaggaucaauggugcggcucucuaaucggucugacuagcagagcaacaugggccaaaaacauucagaccgcgaucaaucagguccgcucccucauagggaacgaggaauauacugacuacaugccuucaaugaagcgguuuaggcgagaggaagaggaagcuggaguguugugguga

SEQ ID NO: 14994 - RNA, 9876 nt, Artificial Sequence
  derived and/or modified CDS sequence (opt3) from DENV-2__KC131142__SS-prME
accgcaggaaucauuauaauggugauccccaccgucauggcuuuccaccugacuacgcgaaacggggagccucauaugauuguuagcaggcaggaaaagggaaaaucccuccuuuuuaagaccgagaauggucugaacaugugcacauugauggcaauggacuuaggcgaacugugugaggauacuaucaccuacaauugcccauuacuccggcaaaacgaaccggaggacauugauuguuggugcaauucuacaucaaccugggugacuuaugggacauguaccgccacgggagagcaccgccgagaaaaacguaguguagcgcuggugccccaugucggcaugggucuugagacuagaaccgaaacauggaugagcuccgagggggcuuggaagcacgcccagaggaucgagacuugggugcugcggcauccuggauucaccauaauggcagccaucuuggcuuacacaauuggcaccacguauuuucagcgcguucucaucuucauucugcugacugcaaucgccccaucuaugacaaugcggugcauaggcauuucgaacagggacuuuguggaaggggucucaggagguagcuggguggauaucguacucgagcacggcaguuguguuaccacuauggcuaaaaauaagcccacauuagacuucgaacugauuaagaccgaggccaaacacccugcgacgcuucggaaguacugcaucgaagcaaaauugaccaacacaacuaccgccucccgcuguccaacacagggggagcccucucugaaugaggaacaagauaagcgauuugugugcaaacauagcauggucgacagaggauggggcaacgguugugggcuauucggaaagggcggcaucgugacuugcgcuauguuuaccugcaagaaaaauauggaggggaagauugugcagccugaaaaccucgaguauacaauagucaucaccccacacuccggagaagagaaugccguugguaacgauacuggcaaacaugggaaggagauuaaagugacgccgcagucaaguaucacagaagcagagcugaccggauacggcacuguaaccauggaauguagccccaggacaggucuugacuucaaugagauggugcuguugcagauggaaaacaaggcuuggcucguccaccggcaaugguuucuggauuuaccucugccauggcuccccggggccgacacccagggcucuaacuggauacagaaagagacucuugugacauucaagaauccucacgcgaagaaacaggauguugugguccugggaucccaagagggcgccaugcauacggcauugaccggggcuacugaaauucagaugucaagcggaaaccuacuguuuacaggucaccucaagugccgucugcgcauggacaaacuucagcugaagggcaugaguuauucuauguguaccgggaaauucaaggugguaaaggagaucgccgaaacacaacauggaacuaucguuauuagagugcaguacgagggcgacgguuccccaugcaaaauccccuucgagauuauggauuuggaaaagaggcacguccucgggcggcugauaaccgugaauccgaucgucacggagaaagacagcccugugaacauugaagcugagcccccauuuggcgauucguacaucaucauuggaguugaaccuggccaguuaaagcugucuugguucaaaaagggguccucaauaggacagauguuugagaccacaaugcgaggugccaagcgcauggcaauccuaggcgacacugccugggauuucgggagucucggaggcguguuuaccagcauugguaaagcucugcaucaaguauucggggcgaucuauggcgcagccuuuuccggagucucuuggacaaugaagauucuuaucggcgugguuauaacuuggaucgggaugaauagcagaucaaccaguuuguccgugagccugguccucgugggaguagugacgcuguaccuuggcguuaugguccaggcugacucugguuguguggugucauggaaaaacaaggagcugaaaugcgggaguggaauuuucaucacagauaauguccacaccuggacugaacaguauaaguuucagcccgagagcccauccaaguuggccucugcaauucaaaaagcccacgaagagggcaucugugguauaaggucgguuacacggcucgaaaaccugauguggaagcagauuacccccgaguuaaaucauauccugagcgagaacgaagugaaacuaacuauuaugaccggcgacaucaaggggauaaugcaggcuggaaaacgcucccucagaccucagccaacagagcugaaguacucauggaaagccuggggcaaggcaaagaugcuuaguacggaauugcacaaucauaccuuccugaucgaugggccggagacugcggaaugccccaacacaaauagggcuuggaacucucucgagguggaggacuauggauuuggcguauucaccacaaauauuuggcugaaauuaaaggaacgucaagaugucuuuugugacagcaaacugauguccgccgcaaucaaggacaaccgggccgugcacgcugauauggguuacuggauugagucagcccuuaacgacacuuggaaaaucgaaaaggccagcuucauagagguuaagucuugccacuggccuaaaucccauaccuuguggaguaauggggugcucgagagcgaaaugauuaucccaaagaacuucgcuggacccgucucucagcacaauuaucgaccuggcuaccauacgcagacagccgguccauggcaccugggcagacuagagauggauuuugacuucugugaagggaccacugugguugugaccgaggauugcggaaacaggggccccucccugcgcacaacuaccgcgucagggaaacucaucacagaauggugcugucggaguugcacgcugccgccucuuagauacaggggagaggacggcuguugguaugguauggagauucgcccauugaaggaaaaagaggaaaaucugguaaacagcuuagucaccgccgggcauggacagaucgauaauuuuucgcucggcgugcuggguauggcucuuuuccuggaggaaauguugcgaacucgggugggcacaaagcacgcaauucuccuggucgccguuuccuuugugacccuaauaacugggaacaugucuuuccgugaccugggaagaguaauggugauggucggcgcuacaaugaccgaugacaucgggaugggagugacguaccucgcccugcuugcagcguuuaagguuaggcccacuuucgccgcuggcuugcuguuacgcaaacucaccagcaaggagcugaugaugacaaccauugguaucgugcuucugucacaaaguacuauuccugagacaauccuagaacucaccgaugcccuggcauuggggaugaugguccugaaaauagugcggaauauggagaaguaucaguuagcuguuacaaucauggccauucucugcgugcccaacgcagucauccugcagaaugccuggaaaguauccuguacuacccuugcugugguuucugugagcccacuguugcucacguccucacaacagaaggcggacuggauuccucuggcccuaacaaucaagggacugaaccccaccgcaauauuucuuacuacccucagcagaacaaguaaaaagaggucuuggccacugaaugaagcuauuauggccgucggcaugguguccaucuuggccagcucgcugcuaaagaacgauaucccgaugacuggcccucucguagcugggggacugcuuaccgugugcuacguccugacgggucgaucagcagacuuggagcucgaacgcgccgcggacguucggugggaggagcaggcugaaauuucuggcaguucccccauacugagcaucacaauuucugaggaugggagcauguccaucaagaaugaagaggaggaacagacccuaacuauucugaucagaacaggacuucucgugauaucaggccuguucccagugaguauccccauuaccgccgcagccugguauuugugggaggucaaaaagcaaagggcugguguguuaugggacguuccuagcccacccccuguagggaaagcagaacuggaggauggagccuaccguaucaagcagaagggcauucucggcuauucucagaucggggcgggaguguacaaagaagguacuuuucacacaauguggcaugucacccgcggcgcugugcugaugcacaaggggaaacggauagagccguccugggccgacguuaagaaagaucuuauuucauacggaggcgguuggaagcuggagggggaauggaaggagggagaagaggugcaggucuuggcacuagaaccaggcaaaaaccccagagccgugcaaacgaagccuggccuguucaaaacuaacaccgggacaaucggagcuguaagucucgacuuuagcccagguaccuccggcucucccaucgucgauaagaaagggaaggugguuggacuguauggcaaugguguggucacaaggucggggacuuacgugagcgccauugcacagaccgagaagucaaucgaggacaaccuugaaauagaggaugacauuuuccggaaaaagagauuaacgguuauggaucugcauccuggagcuggcaaaacaaagcgcuaucucccggccaucgugagagaagcgauuaaaaggggcuugcggacucugauccucgcccccacccgagucguggcagcugagauggaagaggcccugagagggcuuccaauacgcuaccagaccccugcuauuagggcagagcacacaggacgugaaaucguagaccugaugugucaugccacuuucaccaugcgguugcuaucccccaucagagugccaaauuauaaccugauuaucauggaugaggcccacuuuacagacccugcuaguauugcggcaagggguuacauaucuacgcgcguugaaaugggcgaggccgcugggaucuucaugacugccacacccccaggaagccgagacccguuuccucaguccaaugcacccauuauggaugaggaaagagagaucccagaacggucauggaacucuggccacgagugggucacagacuucaaggguaagaccgugugguuugugcccagcaucaaagccgggaaugauauugcugcgugccucaggaagaacggcaaaaaggucauacaauuaagucgcaaaacuuucgacacagaauauaucaagacccguacgaaugauugggacuuuguagugacuacagauauuuccgagaugggcgccaacuucaaggcagagagaguuaucgacccucggagguguaugaaaccagugauucugaccgauggcgaagaacgcgucauccuugcugggcccaugccugugacccauagcucugccgcacagcgaagaggacggguugguaggaauccgaagaacgaaaaugaccaguacauauacaugggcgagccacuggaaaacgaugaggacugcgcccacuggaaagaggcuaagaugcucuuggacaauaucaacacucccgaagggauuaucccuucaauguuugagcccgaacgcgagaaaguggaugccauugacggagaauauagacugaggggcgaggcgcggaagacauucgucgaucucaugcgucgcggugaccugccaguguggcuugcauaccgaguagccgcugaggggaucaacuaugccgauagaaggugguguuuugacggcgugaaaaauaaccaaauacuagaagagaauguugaagucgagauuuggaccaaggagggagaacggaagaaacugaagccucgcugguuggaugcuagaaucuacuccgaccccuuagcacugaaagaguucaaggaguucgccgcuggcaggaaaagucucacacugaaccuuauuacugagauggggcggcugccaacguuuaugacccagaaggcccgaaaugcacucgauaacuuggcggugcugcauacagccgaagcuggagguagagccuauaaucacgcacuaagcgagcugccugagacucucgaaacccuucuguuauugacacugcucgcuaccgugacuggcgggaucuuccuguuucuuaugucgggaaagggcauagguaaaaugacgcuggggaugugcugcaucauuaccgccucuauccucuugugguacgcacagauucagccgcacuggaucgccgcuuccauaauucuggaguucuuuuuaaucguccuacugauccccgaaccagagaagcaacgcacaccucaggacaaccagcucacuuauguugugauugcgauccuuaccguaguggccgcaacaauggcuaaugaaaugggcuuccuggagaaaaccaagaaagauuuuggauugggcagcauaacuacacagcaacccgagucaaacauucuggacaucgaucucaggccagccagugccuggacgcuguacgcagucgcuaccacuuucauuacaccuaugcuucggcauucuaucgaaaauuccagcgugaacguuucacucaccgccauagcgaaucaggcuaccgugcugaugggguugggaaaggguuggccccugaguaagauggacaucggcgucccguuacuagccauuggguguuacagccagguaaacccaaucacacugacugcagcccuccuucuguugguggcucacuaugcaauuaucggaccuggccugcaggccaaagcgacgcgugaggcucaaaagagagccgcagccgguauuaugaaaaaucccaccguugacgggaucacagugauagaucucgacccaauucccuacgauccuaaguuugaaaaacagcugggccaggucaugcuuuuagugcugugcgucacucaggugcucaugaugaggaccacaugggcuuugugugaggcccugacccuagcaacuggaccgaucuccacgcugugggaaggcaaccccgggcgcuucuggaauacaaccaucgcuguuucuauggccaacauuuuucggggaagcuaucucgcgggcgccggucuucuguucuccauaaugaagaacacugcaaauacccgaagagggacaggaaacacuggcgagaccuugggugagaaguggaaaaauaggcugaacgcucucggcaagucagaauuucaaaucuacaaaaagucugggauucaggagguggaccgcacacuggccaaagaaggaaucaagcggggcgagacggaucaucacgcaguaaguagagggucggcuaaauuacguugguucguggagaggaaucuugucaccccagaaggaaagguuguggaccugggcugcgguagagggggauggagcuauuacuguggcggucucaagaacgucaaagaggugaagggccuaacuaaagggggaccuggccaugaggaacccauuccuauguccacauauggguggaaucugguacgcuugcagucuggaguggauguuuucuuuaccccacccgaaaagugcgacacucugcucugugauaucggcgagucaagcccuaacccaacaguggaggccggucgaacccuuagaguccugaauuugguggaaaacuggcugaauaacaauacgcaauucugcauaaaaguccucaaccccuacaugccguccgugaucgagaagauggaagccuuacagaggaaguacgggggagcgcugguucggaauccucuuagucgcaacucuacccacgagauguauuggguaagcaacgcuucaggcaauauuguguccagugucaacaugaucagcagaaugcugauuaauagguuuacaaugcgacacaaaaaggcaacuuacgaaccagacguggaucuaggcucugggacccggaacaucggaauagaguccgagacacccaaucucgacauuaucgguaaacguaucgaaaagauuaaacaggagcaugaaacuucauggcacuaugaucaggaccauccuuacaagaccugggccuaucacggcagcuacgagacaaagcaaaccgggucggcuucuaguaugguuaacggaguggucaaacuguugacuaagccaugggacgugauacccaugguaacgcagauggccaugacagauaccacuccguucggccagcagagaguguuuaaagaaaagguugacacccgcacacaagagccuaaagaggguacgaagaagcugaugaaaaucaccgcagaauggcucuggaaggagcuugggaaaaagaaaacucccaggauguguacacgggaagaguucaccagaaagguccgcuccaaugccgcucugggagcgauuuuuacugaugagaacaaauggaaaagcgccaggggcgcaguggaagacucaggcuucugggaguuaguggauaaggaacgaaaucugcacuuggaggggaaaugcgaaacaugugucuauaacaugaugggaaagcgggagaaaaagcucggugaguuuggcaaagcuaagggguccagagccaucugguacauguggcugggagcaagguuccuagaauuugaggcccuuggcuuccugaaugaagaccauugguuuucucgcgagaacagccucagugguguugaaggggagggacugcacaaguugggcuacauucugcgugauguguccaaaaaggagggcggggcuauguaugccgacgauaccgcgggaugggacacacggaucacucucgaagaucuuaaaaaugaggaaaugguaaccaaccauauggagggugugcacaagaaacuggcagaagccauauucagauuaacguaccagaauaaggucgugaggguucagcgcccaaccccucgaggcacagugauggacaucauuagccggagagaccagagggggucuggacaagucgugacuuauggccugaacaccuucacaaacauggaggcucaguugauccgccagauggagggugaagggguauuuaagucaauucaacaucucacuguuaccgaggaaaucgccgugaaaaauuggcuggucagagugggacgggagaggcuaagucguauggcaauuuccggcgaugacugcguggucaagccccuugaugaccgauucgcuagcgcccugacggcucucaacgauaugggcaaaguucgcaaggacauacagcagugggagccaucuagaggguggaaugauuggacacaggugcccuuuugcucgcaccacuuccaugaacugaucaugaaagacggacggguauugguggucccuuguaggaaccaagaugaguuaauuggucgcgccagaaucucacagggcgcaggguggagccugcgggaaaccgcgugccucggaaaguccuacgcccagauguggagucuuauguauuuucacaggcgagaccugcgucuagcugccaaugcaaucuguucugcugugccaagccauuggguuccgacuuccagaacaaccuggucaauucacgccacucacgaguggaugaccacagaagauaugcugacgguguggaaccgcgucuggauacaggagaaucccuggauggaggacaagaccccuguggaaaguugggaggaaaucccauaccucggcaaacgggaggaucaauggugcgguucuuugauugggcugacuagcagggcaacaugggccaagaacauccagaccgcgauuaaucagguaagaucccuuaucggaaacgaagaguauacugacuacaugcccucaaugaaacgcuuccggagggaggaagaggaagcuggcguucugugguga

SEQ ID NO: 14995 - RNA, 9876 nt, Artificial Sequence
  derived and/or modified CDS sequence (opt3) from DENV-2__AY858035__SS-prME
accgccggaaucauuauaaugaugauccccacugugauggcuuuccaccugacuacgcgaaacggggagccucauaugauugucagcaggcaggaaaagggaaagucccuccuuuuuaagaccgagaaugguguuaacaugugcacacugauggcaauggacuugggcgaauuaugugaggauacuaucaccuacaauugcccacugcugcggcaaaacgaaccggaggacauugauuguuggugcaauucuacaucaaccugggugacuuaugggacauguaccgccacgggagagcaccgccgagaaaaacguaguguagcgcucgugccccaugucggcaugggucuggagacuagaaccgaaacauggaugagcuccgagggggcuuggaagcacgcccagaggaucgagacuugggugcuucggcauccuggauucaccauaauggcagccauccuggcuuacacaauuggcaccacguauuuucagcgcguuuugaucuucauucuccugacugcaguggccccaucuaugacaaugaggugcaucggcauaucgaacagggacuuugucgaaggggugucaggagguagcuggguagauauuguucuggagcacggcaguugugugaccacuauggcuaaaaauaagcccacacucgacuucgaauuaaucaagaccgaggccaaacacccugcgacgcugcggaaguacugcauugaagcaaaacuuaccaacacaacuaccgccucccgcuguccaacacagggggagcccucuuugaaugaggaacaagauaagcgauuugucugcaaacauagcaugguggacagaggauggggcaacgguugugggcuguucggaaagggcggcaucgugacuugcgcuauguuuaccugcaagaaaaauauggaggggaagaucguccagccugaaaaccuagaguauacaauuguuauaaccccacacuccggagaagagaaugccguggguaacgauacuggcaaacaugggaaggagaucaaaguaacgccgcagucaaguauuacagaagcagagcucaccggauacggcacugugaccauggaauguagccccaggacaggucuggacuucaaugagaugguccuucugcagauggaaaacaaggcuugguuggugcaccggcaaugguuucucgaucugccuuuaccauggcugcccggggccgacacccagggcucuaacuggauccagaaagagacucucguuacauucaagaauccucacgcgaagaaacaggauguggucgugcuuggaucccaagagggcgccaugcauacggcacugaccggggcuacugaaauacagaugucaagcggaaacuugcuauuuacaggucaccugaagugccgucuccgcauggacaaacugcagcuuaagggcaugaguuauucuauguguaccgggaaauucaagguaguuaaggagauugccgaaacacaacauggaacuaucgugaucagaguccaguacgagggcgacgguuccccaugcaaaauucccuucgagaucauggaucuggaaaagaggcacguguuggggcggcucauuaccgucaauccgauagugacggagaaagacagcccuguuaacaucgaagcugagcccccauuuggcgauucguacauuaucaucggaguggaaccuggccagcugaaguuaucuugguucaaaaagggguccucaauuggacagauguuugagaccacaaugcgaggugccaagcgcauggcaauacugggcgacacugccugggauuucgggagucuaggaggcguauuuaccagcaucgguaaagcucuccaucaagucuucggggcgauuuauggcgcagccuuuuccggagugucuuggacaaugaagauccugauuggcguugugaucacuuggauagggaugaauagcagaucaaccagucuuuccgucagcuuggugcugguaggagugguuacgcucuaccugggcgucauggugcaggcugacucugguuguguggucucauggaaaaacaaggagcuuaaaugcgggaguggaaucuucauuacagauaauguucacaccuggacugaacaguauaaguuucagcccgagagcccauccaagcuggccucugcaauccaaaaagcccacgaagagggcauuugugguaucaggucggugacacgguuggaaaaccucauguggaagcagauaacccccgagcugaaucauauuuuaagcgagaacgaagugaaacugacuaucaugaccggcgacauuaaggggaucaugcaggcuggaaaacgcucccuaagaccucagccaacagagcucaaguacucauggaaaacguggggcaaggccaagaugcugaguaccgaacuucacaaucauacuuucuugauagaugggccggagacagcagaaugccccaacaccaauagggcguggaacucucuggagguagaggacuauggauuuggcgucuucacaacuaauaucuggcucaaacugaaggaacgucaagauguguuuugugacagcaaauuaauguccgcugccauuaaggacaaccgggcaguucacgccgauauggguuacuggaucgagucagcucugaacgacaccuggaaaauugaaaaggccagcuucaucgaggugaagucuugccacuggccuaaaucccauacgcuuuggaguaauggggucuuggagagcgaaaugauaauuccaaagaacuucgcaggacccgugucucagcacaauuaucgaccuggcuaccauacacagaccgcugguccauggcaccucggcagacuggagauggauuuugacuucugugaagggacuaccguugugguaacagaggauugcggaaacaggggccccucccuacgcacuaccacagccucagggaaacugaucacggaauggugcugucggaguugcacccucccgccucugagauacaggggagaggacggcuguugguaugguauggagauccgcccacuuaaggaaaaagaggaaaauuuggucaacagccuggugacugcggggcauggacagauugauaauuuuucguuaggcgugcucgguauggcccuguuccuugaggaaaugcugcgaacacgggucggcaccaagcacgcuaucuugcucguugcaguguccuuuguaacucugauuacagggaacaugucuuuccgugaccuaggaagagugauggucauggugggcgccaccaugacggaugacauagggaugggaguuacuuaccuggcucuccuggccgcauuuaaggugaggcccaccuucgcggccggccuuuugcugcgcaaauuaacaagcaaggagcucaugaugaccacuaucgguauuguccugcuuucacaaaguacaaucccugagaccauucuggaacuaacagaugcucucgcccuggggaugaugguguugaaaaucguucggaauauggagaaguaucagcuggcagugacuauaauggcuaucuuaugcguccccaacgccguaauucuccagaaugcauggaaaguguccuguaccacgcuggccguugugucugucagcccacuucuguugacauccucacaacagaaggcugacuggaucccucucgcgcugaccauuaagggacuaaaccccacugccaucuuucugaccacacuuagcagaacaaguaaaaagaggucuuggccacucaaugaagcaauaauggcugugggcaugguauccauucuggccagcucguugcugaaaaacgauaucccgaugaccggcccuuuaguggccgggggacuccugacggucugcuacguucuuacaggucgaucagcugaccuggaguuggaacgcgcagccgacgugcggugggaggagcaggcggaaaucucuggcaguucccccauucucagcauaaccaucucugaggaugggagcauguccauuaagaaugaagaggaggaacagacucugacaauccuaauuagaaccggacugcuuguggucucaggccucuucccagugaguauccccauaacugcugccgcaugguaucugugggagguuaaaaagcaaagggccgguguauugugggacgugccuagcccacccccugucgggaaagcugaauuagaggauggagcauaccguaucaagcagaagggcauucugggcuauucucagaucggggccggaguguacaaagaagguacauuucacaccauguggcauguuacgcgcggcgcggugcucaugcacaaggggaaacggauugagccguccugggcugacgucaagaaagaucugaucucauacggaggcgguuggaaacuugagggggaauggaaggagggagaagaggugcagguacuggccuuggaaccaggcaaaaaccccagagcaguccaaacuaagccuggccuauucaaaaccaacacagggaccauaggagccgugagucuggacuuuagcccagguacauccggcucucccauuguugauaagaaagggaagguggucggacucuauggcaauggugugguuacuaggucggggaccuacgugagcgcuaucgcccagacggagaagucaaucgaggacaacccugaaauugaggaugacaucuucagaaagaagcggcugacaauaauggaucuucauccgggagcaggcaaaacuaagcgcuauuuacccgcuauugucagagaagccaucaaaaggggccugcggacccucauuuuggcgccaacacgagugguagccgcagagauggaagaggcucugagagggcucccuauccgcuaccagacccccgccauaagggcugagcacacuggacgugaaauuguggaccugaugugucaugcaaccuucacaaugcggcuucuguccccaaucagaguuccuaauuauaacuugaucauuauggaugaggcccacuuuacggaccccgccaguaucgcugcgagggguuacauuucuacucgcgucgaaaugggcgaggcagccgggauauucaugaccgcuacaccaccgggaagccgagacccuuuuccccaguccaaugccccaaucauggaugaggaaagagagauucccgaacggucauggaacucuggccacgagugggugaccgacuucaaggguaagacugugugguuugucccuagcaucaaagcagggaaugauaucgccgcuugccuaaggaagaacggcaagaagguaauucaacugagucgcaaaacauucgacuccgaauauauaaagacccguacgaaugauugggacuuugugguuacuacagauaucagcgagaugggcgcgaacuucaaggccgagagagugauugacccacggagguguaugaaacccgucauccucaccgauggcgaagaacgcgugauuuuagcagggccuaugccgguuacccauucuucagcugcccagcgaagaggacggguggguaggaauccaaagaacgaaaaugaccaguacaucuacaugggcgagccccuggaaaacgaugaggacugcgcacacuggaaagaggccaagaugcuucuggacaauauaaacacuccugaagggaucauucccuccauguuugagccagaacgcgagaaagucgaugcuaucgacggagaauauagacucaggggcgaggcccggaagacauucguggauuugaugcgucgcggugaccugccuguauggcucgcguacaaaguggcagccgaggggauuaacuaugcugaucgaagaugguguuuugacggcguuaagaauaaccaaauccuggaagagaaugucgaaguggagauauggaccaaggagggagaaaggaagaaacuuaaaccccgguggcuagaugcccgcauuuacagugacccacuggcuuugaaagaguucaaagaguucgcagccggcagaaagagcuuaacacugaaccucaucacugagauggggaggcugccuacguuuaugacccagaaggcucggaaugcccuugauaaccuggcagugcuccauacagcggaagccggaggucgagcuuauaaucacgccuugucggagcugccggagacucuagaaacccugcuccuucugacauuauuggcaaccgucacuggcgggauuuuccuguuucucaugucuggaaaaggcaucgguaagaugacgcuggggaugugcugcauaaucaccgcuuccauucuucugugguacgcccagauccagccccacuggauugcagccagcaucauacucgaguucuuuuugauuguucuguuaaucccagaaccugagaaacaaagaacaccccaggacaaccagcuaacuuaugugguaaucgcuauucugaccguggucgcggccacaauggcaaaugaaaugggcuuccucgagaagaccaaaaaggauuuuggacuuggcucaaucacuacacagcaaccagagaguaacauacuggacauugauuugcgcccugcuucugccuggacgcuguacgccguggcaaccacuuucaucacacccaugcucaggcauuccauugaaaauagcucaguuaacgugagucugaccgcuaucgccaaucaggcgaccguccuuauggggcucggaaaggguuggccgcugagcaaaauggacauaggcguaccauugcuggcuaucggguguuacucccaggugaacccuauuacauuaacugccgcacuacugcuccuuguugcccacuaugcuaucauuggacccggccugcaggcaaaggccacgcgggaggcgcaaaaacgugcugccgcagguaucaugaagaauccaaccguggacgggauuacagucaucgauuuggaccccauaccuuacgauccgaaauuugaaaagcagcugggccaggugaugcuccugguccuuugcgugacucagguuuuaaugaugagaaccacaugggcccugugugaggcucucaccuuggccacuggacccauuucuacgcugugggaaggcaacccagggagguucuggaauacaaccaucgcagugagcauggcuaacaucuuucgcggauccuaucuagccggcgcgggucuacucuucucaauuaugaagaacacugccaauacccggcgagggacaggaaacacuggcgagacccuuggugagaaauggaagaauagacugaacacauugggcaaaucugaauuucaaauauacaagaaaagugggauccaggagguagacaggacgcuggcaaaggaaggaauuaaacgcggcgagaccgaucaucacgcugugucgcgggggagcgccaagcucagaugguucgucgagcguaaucugguuacuccugaaggaaagguggucgacuuaggcugcgguagagggggaugguccuauuacuguggcggucuuaaaaacgugaaggagguaaaaggccugacaaaagggggacccggccaugaagaaccuaucccaaugucuaccuauggguggaaucucgugcggcuacagucaggaguugauguguucuuuacucccccugaaaaaugcgacacacuguugugugauauuggcgagagcuccccaaaccccaccgucgaggcaggucgcacgcugcgagugcucaaucuugucgaaaacuggcugaauaacaauacccaauucugcaucaagguguugaacccguacaugccuaguguuauagagaagauggaagcucugcagagaaaauacgggggagcccucguaaggaauccauuaucucggaacagcacacacgagauguauugggugucaaacgccuccggcaauaucgucaguagcgugaacaugauuucucgcaugcugaucaauagauuuacuaugaggcacaagaaagcgaccuacgaacccgacguugaucuuggcuccgggacacgaaacauuggaaucgagucagagauaccuaaucuggacauuaucgguaagcggaucgagaagauuaagcaggagcaugaaacuagcuggcacuaugaucaggaccauccauacaagaccugggcuuaucacggcucguacgagacaaaacaaaccgggucugcaaguuccauggugaacggagucgugcgucuacucacuaagcccugggacguaauaccgauggugacgcagauggccaugacagauaccacuccuuucggccagcagagaguuuuuaaagaaaaggucgacacccgcacacaagagcccaaagaggguacgaagaagcugaugaaaaucaccgcugaaugguuguggaaggagcuggggaaaaagaaaacuaggcggauguguacaagagaagaguucacccgcaaggugaggagcaaugccgcacucggagccauuuuuacugaugagaacaaauggaagucagcucgagaagcgguggaggacuccggcuucugggaacuugucgauaaggagcggaaucugcacuuagaaggcaaaugcgagacauguguuuauaacaugauggggaagagagagaaaaagcugggagaauuugguaaagccaagggcucuagggcaaucugguacaugugguugggggcucgcuuccucgaguuugaagcccugggauuccuaaaugaggaccauugguuuagccgugaaaacagucuuuccggcguggagggugaggggcugcacaagcucggauacauucugcgggauguaagcaaaaaggaaggcggcgcaauguaugccgacgauaccgcugggugggacacaagaaucacuuuggaggaucugaaaaaugaagagauggugaccaaccauauggaaggagagcacaagaaacucgccgaggcgauauucaaacuuacguaccagaauaaggucgugaggguucagcgcccaaccccucgagguacagugauggacaucauuucucggagagaccagaggggcucagggcaagucgugacuuauggacugaacaccuucacaaacauggaagcacaguuaauccgccagauggagggcgaagguguauuuaaaaguauucaacagcugacuguuaccgaggagaucgccgugaagaauugguuggaaagagucgggcgggagaggcucucccguauggcuauuagcggagaugacugcguggugaaaccccuggaugaccgauucgccucugcacuaacggcucuuaacgauaugggcaagguccgcaaagacauacagcagugggaaccaucgagaggcuggaaugauuggacacaaguucccuuuugcucacaucacuuccacgagcugaucaugaaggacgggcgggugcucguagugccuuguaggaaccaggaugaacugauuggacgcgccagaaucagccagggugcuggcugguccuugcgggagaccgccugcuuagggaagaguuacgcacagauguggucucugauguauuuucauaggcgagaccuccgucuugcggccaaugcuaucuguagcgccgucccaucccacugggugccgacuucaagaacaaccuggaguauucaugcaacucacgaguggaugaccacagaagauaugcugacgguuuggaaccgcguguggauacaagagaaucccuggauggaagacaaaaccccugucgagucuugggaagagaucccauaccuaggaaagcgggaggaucaguggugcggcagccugauuggucucacuuccagggcuacaugggccaaaaacauccagaccgcaauuaaucaggugagaucauugaucgggaacgaagaguauacugacuacaugcccagcaugaagcgcuuccggagggaagaggaagaggccggaguacugugguga

SEQ ID NO: 14996 - RNA, 9873 nt, Artificial Sequence
  derived and/or modified CDS sequence (opt3) from DENV-2__JX567951__SS-prME
accgcaggcgugaucguaaugcugauucccacagcuauggcauuccaccucacuacgaggaacggggagccucauaugauaguuggaaggcaggaaaaggguaaaagccuucuguuuaagaccgaggacggcgugaauaugugcacauugauggcaaucgauuuaggggaacugugugaggacacuauuaccuacaaaugcccacuacuccggcaaaacgaaccggaggauaucgacuguuggugcaauuccacaucuaccuggguuacuuauggaacauguaccacgacuggcgagcaccgccgagaaaagcguucaguggcgcuggucccccauguggguauggggcuugagacccggacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaggaacaggacaaacgauuuaucugcaagcauucuauggucgauagaggcugggguaacggguguggacuauucggcaagggcgggaucgugaccugcgccauguuuacaugcaaaaagaauauggaaggaaaaauugugcagccugagaaccucgaauacaccauagucaucacuccacacagcggugaggagcaugcuguuggcaaugacacggggaagcacggaaaagaaauuaagaucacaccgcaguccucaaccacugaggccgaacugaccggcuaugguacagugaccauggaguguagucccaggacugggcuugauuucaacgaaaugguacuguugcaaauggaggacaaagcauggcucgugcaccggcagugguuucuggauuuaccucugccauggcuccccggcgcugacacacagggaagcaauuggauacagaaggagacgcuugucaccuucaagaacccucaugccaaaaagcaagacgugguugugcugggcucucaggaaggggcgaugcacacugccuugacaggagcaaccgagauucagauguccucagguaaucuacuguuuacaggccaucucaaaugccgucugcgcauggauaaacuucaacugaaagggaugagcuacaguauguguacuggaaaguucaagaucgucaaagaaaucgcugagacccagcacggcacgauugugaucagaguacaguaugagggugacgggucuccaugcaagauucccuucgaaauaaccgauuuggagaaaaggcauguucucggccggcugaucacagugaacccgauugucacugaaaaggacuccccugugaacaucgaggccgaacccccauuuggagauagcuacaucauugucggcguggagccugggcaguuaaaacugaauugguucaagaagggaucgucuauaggucaaauguuugagaccacaaugcgaggcgcuaaacgcauggccauccuaggggacacugcaugggauuucggaucccucggcgguguuuuuaccucaauugggaaggcccugcaccagguguucggcgcuaucuacggagcggcauuuaguggcguaagcuggacgaugaaaauucuuaucggggucauaaucacauggauuggaaugaacuccagaucuaccagcuugucagugagucugguucucgugggcgucgugacucuguaucuuggugccaugguacaggcugacuccggguguaucgugagcuggaagaauaaagaacugaagugcggaucuggcauuuucaucacagauaacguucacaccuggacugagcaguacaaguuucaacccgaaucaccaaguaaauuggccagcgcaauacagaaggcccaugaggaagguauuuguggcaucagguccgucacccggcucgagaaucugauguggaaacagauuacacccgaguuaaaccacauccugucugaaaaugaggugaagcuaacgauaaugaccggggacaucaaaggaauuaugcaggcuggcaagcgcucgcucagaccucaaccaacugaacugaaauauagcuggaagacaugggggaaggccaaaaugcuuuccaccgagucacauaaccagacauucuugaucgauggaccggaaacugcagagugccccaauaccaacagggcguggaauagucuggagguggaagacuacggcuuuggugucuucacgacaaacauuuggcucaagcugcgugagaaacaggacguauuuugugauucuaaguuaaugagcgcugccaucaaagacaaucgggcagugcacgccgauaugggguauuggauagaauccgcucugaacgacaccuggaagauggagaaggccucauucauugaggugaaaagcugccacuggccuaagucucauacucuuugguccaauggaguauuggaaagugagaugaucauccccaagaauuucgcaggccccgucagccagcacaacuaccgaccugguuaucauacccaaacagcuggcccauggcaccucgggaagcuggaaauggauuuugacuucugugagggaacuaccgugguugugacagaagauugcggcaauagagggcccucucuaaggacgaccacugccuccggaaaacugauuacagaguggugcugucgcucaugcacccucccgccucugcgguacagaggcgaggacgguuguugguacgggauggaaaucaggccacuuaaggagaaggaagagaacuuggucaauagucuggugacugcgggacauggccagauugauaacuuuagcuuagguguucucggcauggcccuguuccuugaagagaugcugcgcacacgaguggggaccaaacacgcuauauugcucguagcacugucguuugucacgcuaaucacuggaaauauguccuuccgggaccugggccgugugauggugauggucggggccaccaugacagaugacauuggaaugggcguuaccuaucucgcucugcuugccgcauuuaaggugagacccacuuucgcggccgguuugcuguuaaggaaacucacaucuaaggagcugaugauggcuaccaucgggauugcccuucugagccagucaacacuaccugaaacuauccucgagcugaccgaugcauuggcucugggaaugauggccuuaaaaauaguacgcaacauggaaaaguaccaacucgcagugacgaucauggccauuaguugcguccccaaugcugugauccugcagaacgcguggaagguuuccuguacaauucuugccgcagugucugucagcccacuguugcucaccuccucacagcagaaagcugacuggaucccucuggcccuaacuauaaagggccugaaucccaccgccauuuuucuuacaacucucagccggaccaguaaaaagagaucuuggccacugaacgaggcuaucauggcagugggcaugguuuccaucuuggccagcucgcugcuaaagaaugacauuccgaugacggggccucucguggcgggaggucugcuuacagucugcuauguacugaccggcaggucagcugauuuggaacucgagcgagccgcagacgugaagugggaggaucaagccgaaauaucugggaguucccccauccugagcauuacuaucucugaggacggaagcauguccauuaaaaacgaagaggaggaacagacacuaaccauccugauacgcacuggccuucucguuaucucagguguguucccagucaguauucccaucacagcugcagccugguaccugugggaggugaagaagcagcgggcggggguauugugggaugugccuagcccacccccugucggaaaagcugaauuagaggacggcgccuauagaauuaagcagaggggcauccugggguacucucaaauaggagccgguguuuauaaagaaggcaccuuucacacgauguggcaugugacucguggggcagugcucaugcaccgcggaaagcggauugagccguccugggcugaugucaaaaaggaccugaucucauacggcgguggguggaaacuugagggagaauggaaagagggcgaagaggugcagguucuggccuuggaaccaggcaagaaucccagagcaguacagaccaaaccugggaucuucaagacaaacaccggaacaauuggugcugugagucuagauuuuagcccaggcacuuccgggucucccaucgucgacaggaaaggaaaggugguuggccuguacgguaaugggguggucacccgaucgggagccuaugugagcgcgauagcccagacggagaagucaauugaggauaacccugaaaucgaggacgauauuuuccggaaaaagcgccucacaaucauggaccugcauccgggcgcaggcaaaacuaagagauaccuucccgcuauaguaagggaagccauuaaacggggguuacgaacccugauccucgcuccaacaagagucguggcagccgagauggaagaggccuugcgcggacugccuaucagguaucaaacccccgcuauucgugcggagcacacuggucgggaaaucguugaccucaugugucaugcaaccuucacaaugagacugcuuuccccagugagggucccuaacuacaaucugauuauaauggaugaggcccacuuuacggaccccgcuaguaucgccgcacgcggcuauauuucuacucgaguggaaaugggggaggccgcuggaaucuucaugaccgcgacaccaccgggcagcagagauccuuuuccccaguccaacgccccaaucauggacgaggaacgggagauucccgaaaggucauggaacucuggucacgaguggguuaccgauuucaaggggaagacugugugguuugucccuagcauaaaagcaggaaacgacaucgcugccugcuugcgcaagaauggcaaaaaggugauucagcuaagucguaaaacauucgauuccgaauacguaaagaccagagcaaacgacugggauuuugugguuacgacugacaucagcgagaugggcgccaauuucaaggcugagcgggucauugauccaaggcgcuguaugaaacccgugauccugacagacggggaagaacgagugauacucgccggaccuaugccggucacccauucuucagcggcacaaagacgggguaggaucggccgcaacccaaagaaugaaaacgaccaguauauuuacaugggggagcccuuagaaaaugaugaggacugcgcccacuggaaagaggcuaagaugcugcuugauaacaucaauaccccugaaggaauuauccccuccauguuugagccagaaagagagaaaguagacgccauagauggcgaauacaggcugcggggugaggcucguaagacuuucguggaccucaugcgccgaggggauuugccuguuuggcuggcauauaaaguggccgcugagggcauuaacuacgccgacagaaagugguguuuugauggaaucaagaauaaccagauucucgaagagaacgucgaaguggagaucuggacaaaagagggcgaaaggaagaaacugaagccccgguggcuugacgcacgcauauauagugauccacuagcgcugaaagaguucaaggaguucgccgcugggagaaagagcuugaccuuaaaucugaucacagagaugggaaggcucccuacuuuuaugacgcagaaagcccggaacgcacuggacaaucuugcuguucugcauaccgccgaaguggguggcaaggcauacacacacgcccucucggaguugccggagacucuggaaacccuacugcuccuuacacuguuagcugcggucaccgggggaauuuucuuguuucugaugucuggcaaagguaucgggaagaugacucucggcaugugcugcauuaucacggccuccauacugcuuugguaugcacaaauucagccccacuggaucgcugccagcaucauucuggaguucuuucucaucguguugcugauaccagaaccugagaaacagcgaaccccacaggauaaccaauuaacauacguagugauugccauccuaacuguugucgcagcuaccauggccaaugaaaugggauuccuggagaagacaaagaaagaccucggcuuugggucaauuaccacucaggagagugaaucuaacauccuugacauagaucugagaccagcguccgcuuggacauuguaugccguggcaacgaccuucgugacuccuaugcugcgccauagcaucgaaaauucaagugucaacguuagccucacagccauugcuaaucaggcaaccgugcugaugggacuugguaagggcuggccccucuccaaaauggacaucgggguaccgcuguuggccauuggauguuacucucaggugaacccaaucacccugacagcggcuuuacuacugcucgucgcccacuacgcaauuaucggcccuggucuucaagccaaggcuacuagggaagcccagaaacgggcagcugccgggauaaugaagaaucccacgguggauggcauuaccguuaucgaccuggagccaauccccuaugauccuaaguuugaaaaacaguugggacaggugaugcugcucauucugugcgucacacaaguacuuaugaugcguacuaccugggcguuaugugaggcccugacacucgcaaccggcccgauaagcacuuugugggaggggaaccccggaagauucuggaauacgacaaucgcuguguccauggccaacauuuuuaggggcucauaccuggccggugcugggcuacuguucucuaucaugaagaauaccacuaacacccgccggggaacaggcaauguuggugaaacucucggcgagaaauggaagagucgacuuaacgcccuggggaaaucggaauuucagauuuauaagaaaagcggaauccaggagguggacagaaccuuggccaaggagggcauaaagagaggggaaacagaucaucacgcggucucccgcggaucugcuaaacugcggugguucguggagagaaacauggucacgccagaaggcaaggugguugaccucgguugcgggcguggaggcuggucauacuauugugguggccugaaaaaugugagggagguaaagggguuaaccaaaggaggcccugggcaugaggaacccaucccuaugagcacuuacggauggaaccuugugcggcugcaauccggcgucgauguuuucuuuacaccacccgagaagugcgacacccuccuaugugauauuggugaaaguucuccuaauccaacuaucgaggcagggcgcacacugcgaguguugaaccuggucgaaaauuggcucaacaauaacacccaguucugcauuaaggugcuuaaucccuauaugccgagcguaaucgagaaaauggaaacgcugcagagaaaguacggaggcgccuuggugaggaacccucugucaagaaauuccacccacgagauguacuggguuaguaacgcuacaggcaauauagugagcucugucaacaugauuucccgcaugcucaucaauagauuuacuaugaaacacaagaaagccaccuaugagccagacguggauuuagggucaggaacaaggaacaucgguauugaaagcgagauacccaaccuggacaucauuggcaagcgaaucgaaaagauuaaacaggagcaugaaacuucguggcacuacgaccaagaucauccuuauaagaccugggcauaccacgggucuuaugagacaaaacagaccggaagugccuccagcauggucaauggcgugguucggcuucugacuaagccaugggacguagugcccauggucacgcagauggcuaugacagauaccacuccguucggucagcaacguguguuuaaagagaagguugacaccagaacacaggaaccuaaggaggggacgaaaaagcuaaugaaaaucaccgcggaauggcucuggaaggagcugggaaaagagaagacuccccgcauguguacaagggaagaguucacccggaaagugagaucaaacgccgcauugggcgcugucuuuacugaugaaaauaaguggaaguccgcccgcgaggcaguggaagacggcagguucugggagcugguagaucgagagcggaaccuccaccuugaagggaaaugcgagacauguguguacaauaugaugggaaagagagagaaaaagcugggugaguuuggcaaagccaaggggucuagggcuauaugguauaugugguuaggagcccgcuuccuggaauuugaggcguugggcuuccucaacgaggaccauugguuuagccgugguaauagucuguccgggguugaaggagagggccuacaccggcuuggcuacauccugagagaagucgggaagaaagagggaggugcaauguacgccgaugacaccgcuggcugggauacaaggauuacucucgaagaccugaagaacgaggagauggugaccaaucauaugaaaggggaacacaagaaauuggccgaggcaaucuucaagcugacguaucagaacaaggugguccgcguucagcgaccaaccccucggggaacagugauggacauuaucagcagaaaagaucaaaggggcucuggucagguagggacuuacggacucaauaccuucacaaacauggaagcucagcuuauucgccaaauggagggcgagggcauauuuaagucaauccagcaucugacugccaccgaagagauugcugugcagaauugguuagccagagucgggcgggaaaggcugagucguauggcaaucuccggagacgauugcgugguuaaacccaucgacgaucgauucgcgagcgccuugacggcucucaacgacauggguaaggugcgcaaagauauucagcaaugggagccaucuagaggcuggaaugacuggacacagguccccuuuugcucgcaccacuuccaugaacuggugaugaaggaugggcgggucuuaguugugccuuguaggaaccaggacgagcuuauaggacgcgccagaaucucacagggcgcagguuggagccugaaggagaccgcuugccucgggaaauccuaugcccaaauguggacucugauguacuuucaccggagggauuugcgauuagcagccaacgcgauuuguagugcugucccaucucauugggugccgacaagccguaccacuugguccauccacgccaagcacgaauggaugaccacagaggacaugcuggcaguguggaauagagucuggauucaggaaaaccccuggauggaggauaaaacgccuguugaaucaugggaggaggugccauaucucggaaagcgcgaagaccaguggugcggcagucuuaucggccugaccucucgggccacuugggcuaaaaauauacagacagccaucaaccaaguaaggagccuaauugggaaugagggauacaccgacuauaugcccuccaugaagagauuccgccgggaagaggaagaggccggugugcugugg

SEQ ID NO: 14997 - RNA, 9873 nt, Artificial Sequence
  derived and/or modified CDS sequence (opt3) from DENV-2__JX567950__SS-prME
accgcaggagugaucgucaugcugauucccacugcuauggcauuccaccucacuacgaggaacggggagccucauaugauaguuggaaggcaggaaaaggguaagagccuucuguuuaagaccgaggacggcgugaauaugugcaccuugauggcaaucgauuuaggggaacugugugaggacacuauuaccuacaaaugcccacuucuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaagaacaggacaaacgauuuaucugcaagcauucuauggucgauagaggcugggguaacggguguggacuauucggcaagggcgggaucgugaccugcgccauguuuacaugcaaaaagaauauggaaggaaaagugguccucccugagaaccuggaauacaccauuguuauaacuccacacagcggugaggagcaugcugugggcaaugacacggggaagcacggagaagagaucaaaauuacaccgcaguccucaaucaccgaagccgagcuuacuggcuaugguaccguaacaauggaauguagucccaggaccgggcuggauuucaacgagaugguguugcuccagauggaggacaaggcauggcugguccaccggcaaugguuuuuagaucugccucucccauggcuucccggcgcugacacucagggaagcaauuggauacagaaagaaacacuggugacguucaagaacccucaugccaagaaacaggacguuguggucuugggcucucaagagggggcgaugcacaccgcccuaacuggagcaacagaaauucagauguccucagguaaucugcucuuuaccggccaucugaagugccgucuucgcauggauaaacugcaguugaaggggaugagcuacaguauguguacaggaaaauucaagaucgugaaggagaucgcugagacucaacacggcaccauuguaaucagaguucaguaugaaggugacgggucuccaugcaaaauucccuucgagauaacggaucucgaaaagaggcaugugcugggccgguuaaucaccgucaacccgauugugacagagaaagacuccccugucaacaucgaagccgagcccccauuuggagauagcuacaucauugugggcguugagccugggcagcugaagcuaaauugguucaaaaagggaucgucuauaggucagauguuugaaacuaccaugcgaggcgcuaagcgcauggccauccucggggacacagcaugggauuucggaucccugggcgguguguuuacuucaauugggaaagcccuucaccaaguauucggcgcuaucuacggagcggcauuuaguggcgucagcuggaccaugaagauuuugaucggggugauaaucacguggauuggaaugaacuccagaucuacaagccugucaguuagucucgugcuggucggcgugguaacccuuuaucugggugccauggugcaggcugacuccggguguaucguuagcuggaaaaauaaggaguugaaaugcggaucuggcauuuucaucacugauaacguccacacauggaccgaacaguacaaguuucagcccgagucaccaaguaagcucgccagcgcaauacaaaaagcccaugaagaggguauuuguggcaucagguccgugacucggcuggagaauuuaauguggaagcagauuacccccgaacugaaccacauccuaucugagaaugaagugaaacucacaauaaugacgggggacaucaagggaauuaugcaggcuggcaaacgcucgcugagaccucagccaaccgagcuuaaguauagcuggaaaacuugggggaaggccaagauguuguccacagaaucacauaaccaaaccuuccugaucgauggaccggagacagcagagugccccaauacuaacagggcguggaauagucucgaagucgaggacuacggcuuugguguuuucaccacgaacauuuggcugaaauuacgugaaaagcaggacguguuuugugauucuaaacugaugagcgcugccaucaaggacaaucgggcagugcacgccgauaugggguauuggauagaguccgcucuuaacgacacauggaaaauggagaaggccucauucauugaaguaaagagcugccacuggccuaaaucucauaccuugugguccaauggaguccucgagagugaaaugaucaucccaaagaacuucgcaggccccgugagccagcacaacuaccgaccugguuaucauacucagaccgcuggcccauggcaccuggggaaacuagagauggauuuugacuucugugaaggaacaacuguuguggucaccgaggauugcggcaauagagggcccucucugaggacaacgaccgccuccggaaagcucauuacugaguggugcugucgcucaugcacacugccgccucuucgguacagaggcgaagacgguuguugguacgggauggagaucaggccauugaaagaaaaggaggaaaaccuggugaauaguuuaguuaccgcgggacauggccaaauugauaacuuuagccucggugugcugggcauggcccuuuuccuggaggagauguugcgcacucgaguagggacaaagcacgcuauacuccuggucgcacuaucguuugugacccugaucacgggaaauauguccuuccgggaccucggccgugugauggucaugguuggggccacuaugaccgaugacauuggaaugggcgugacauaucuggcucuuuuggccgcauuuaaaguaagacccaccuucgcggccggucuguuacucaggaagcugacuucuaaagaacuuaugauggcuacaaucgggauugcccugcuaagccagucaacccucccugagacaauccuggaauugacugaugcacuggcuuuaggaaugauggcccucaagauagugcgcaacauggagaaauaccagcuggcagucaccaucauggccauuaguugcgugcccaaugcuguuauccuucaaaacgcguggaagguguccuguacgauucuggccgcagucucugugagcccauugcuccugacauccucacagcagaaggcugacuggaucccucuagcccugaccauaaaaggccuuaaucccacugccauuuuucucaccacacugagccggacaaguaagaaaagaucuuggccauugaacgaagcuaucauggcaguuggcaugguguccauccuggccagcucguuacucaagaaugacauuccgaugaccgggccucuggucgcgggaggucuucugacgguaugcuauguguugacaggcaggucagcugaucucgagcuggagcgagccgcagacguuaaaugggaagaucaggccgagauaucugggaguucccccauccuaagcgugaccauuucugaagacggaagcauguccaucaagaacgaggaggaagaacaaacucugacaauucuuauccgcaccggccuccuggucauaucagguguguucccaguaaguauccccauuacugcugcagccugguacuugugggaagugaaaaagcagcgggcgggggucuuaugggauguuccuagcccacccccugugggaaaggcugagcuggaagacggcgccuauagaaucaaacagaggggcauucucggguacucucagaucggagccgguguguauaaggagggcacauuucacaccauguggcaugucacgcguggggccgugcugaugcaccgcggaaaacggauagagccguccugggcugauguuaagaaagaccuuauuucauacggcgguggguggaagcuggaaggagaguggaaggaaggcgaggaaguacaaguguuggcccuagagccaggcaaaaaucccagagcaguccagacuaagccugggaucuucaaaaccaacacaggaaccaucggugcugugagucuggauuuuagcccaggcacauccgggucucccauuguugacaggaagggaaaaguggucggccucuacgguaauggggugguaacucgaucgggagccuaugucagcgcgaucgcccagaccgagaagucaauagaagauaacccugagauugaagacgauaucuuccggaagaaacgccugacgauuauggaccuucauccgggcgcaggcaagacaaaaagauacuuacccgcuaucgugagggaggccauaaagcgggggcugcgaacucucauuuuggcuccaaccagaguuguggcagccgaaauggaggaggcccugcgcggacucccuaucagguaucagacacccgcuauccgugcggaacacaccggucgggagauugucgaccugaugugucaugcaacuuucaccaugagacuucuguccccagugaggguuccuaacuacaauuugaucauuauggaugaagcccacuuuagugaccccgcuucuauagccgcacgcggcuauaucagcacacgaguggagaugggggaggccgcuggaauuuucaugacggcgacuccaccgggcuccagagauccuuuuccccaaucaaacgccccaaucauggacgaagaacgggaaauccccgagaggucuuggaauagcggucacgaaugggucaccgauuucaaagggaagacagugugguuuguaccuaguauuaaggcaggaaacgacauagcugccugccuacgcaaaaauggcaagaaagugauccagcugucccguaagaccuucgauagcgaguacguuaaaacuagagcaaacgacugggauuuugucgugacaaccgacauuucugagaugggcgccaauuucaaggcugaacgggugaucgauccaaggcgcuguaugaagcccgucauucucacggacggggaggaacgaguaaucuuagccggaccuaugccggugacucauucauccgcggcacagagacgggguaggauaggccgcaaccccaagaaugagaacgaccaauauaucuacaugggggaaccccuggagaaugaugaggacugcgcccacuggaaggaagcuaaaaugcuucuggauaacauuaauacaccugagggaaucauucccaguauguuugaaccagagagagaaaagguugacgccaucgauggcgaguacaggcuccggggugaggcucguaaaaccuucguggacuugaugcgccgaggggaucugccugucuggcucgcauauaagguggccgcugaaggcauaaacuacgccgacagaaaaugguguuuugauggaauuaagaauaaccagauccuggaggaaaacguugagguggagauuuggaccaaggaaggcgagaggaagaaacuuaaaccccgguggcuagacgcacgcaucuauagcgauccacuggcguugaaagaguucaaagaguucgccgcugggagaaagucguuaacucugaaucucauaacagaaaugggaaggcugccuaccuuuaugacacagaaggcccggaacgcacuugacaaucuggcuguccuccauacugccgagguggguggcaaagcauacacgcacgccuugaacgagcugccggaaacccuagagacacugcuccuucugacuuuauuggcugcgguaaccgggggaaucuuccuguuucucaugucuggcaaggguauugggaaaaugacacugggcaugugcugcaucauuaccgccuccauccuucugugguaugcacagauacaaccccacuggauugcugccagcaucauccucgaguucuuuuugauugugcuguuaaucccagagccugaaaagcagcgaacuccccaggauaaucagcuaacguacguugucauagccauucugaccgugguggcagcuacaauggccaacgagaugggauuccucgagaaaacuaagaaguaucuuggccuggggucaaucaccacacaagaaagugagucuaauauuuuggacaucgaccugagaccagcguccgcuuggacccucuacgccgucgcaacuacauuuguuacgccuaugcugcgccauagcauagugaacucaaguguaaaugugacccuuacugccaucgcuaaccaggcaacaguccucaugggacuggguaaaggcuggcccuugagcaagauggauauuggggugccgcuguuagccaucggauguuacucccagguuaauccaauuacccuaaccgcggcucugcuccuucugguggcccacuaugcaaucauuggcccugguuugcaggccaaagcuacaagggaagcccaaaagcgggcagcugccgggaucaugaaaaaccccacugucgacggcauaacgguaauugaucuggagccaauccccuacgacccuaaguucgaaaagcagcucggacaggugaugcugcuuaucuuaugcguuacccaggugcugaugaugcguacaacuugggcgcucugugaggccuugacccuggcaacaggcccgauuucuacccuaugggaggggaaucccggaagauuuuggaacacuacgauagcugucagcauggccaauaucuucaggggcuccuaucuggccggugcugggcuccuauuuucaauuaugaaaaacacaaccaauacucgccggggaaccggcaacgugggugaaacacugggcgagaaguggaaaucucgauugaacgcccuggggaagaaugaguuccaaaucuacaaaaagaguggcauucaggaggucgauagaacucucgccaaagagggcaucaagagaggggaaaccgaccaucacgcggugucgcgcggaagcgcuaagcugcggugguuuguugagagaaacauggugacaccagaaggcaaaguaguggauuuagguugcgggcguggaggcugguccuauuacugugguggccuuaagaaugucagggagguuaaagggcugacgaagggaggcccugggcaugaagaaccaauaccuaugucuaccuauggauggaaccucgugcggcuacagucaggcgucgacguguucuucacuccacccgagaaaugcgauacacuguugugugacaucggugaaagcuccccuaauccaaccauugaggcagggcgcacucugcgaguacucaaccuugccgaaaauuggcugaacaauaacacacaauuuugcaucaagguguugaaucccuacaugccgaguguuauugagaagauggaaacccugcagagaaaauacggaggcgcucucgugaggaacccuuuaucucggaauagcacgcacgagauguauugggucucaaacgccaccggcaauaucguguccagugucaacaugauaagccgcaugcugauuaacagauucacaaugaagcacaaaaaggcaacuuacgagccagauguggaccuugggucuggaaccaggaauaucgguaucgaauccgagauucccaaccuggauauaaucggcaaacgaauugaaaagaucaagcaggagcaugaaacaucauggcacuaugaccaggaccauccuuacaaaacuugggccuaucacgggagcuacgagaccaagcaaacaggaucggcuucuaguaugguuaauggcguagugcggcuacucaccaaaccaugggaugucgugcccaugguuacucagauggcgaugacggacacaaccccguuuggucagcagcguguguucaaggagaaagucgauacuagaacccaagaaccuaaggaggggacaaagaaacugaugaagauuacggccgaaugguuguggaaagagcugggaaaggagaaaacaccccgcauguguacuagggaagaguuuacacggaaggugagauccaacgcagcucucggcgccguauucaccgacgaaaauaaauggaaaagcgcacgcgaggccguggaagauggcagguuuugggagcuuguugaccgagagcggaaccugcacuuagaagggaagugcgagacuugugucuauaauaugaugggaaaaagagaaaagaaacugggugaguucggcaaggcuaaagggucaagggccaucugguacaugugguugggagcgcgcuuucucgaguucgaggcacugggcuuucuaaacgaggaucauugguucucccgugaaaauucucuuagcgguguggagggggaaggacugcaccggcucggcuacauacugagagacgugaguaagaaggagggcggggccauguaugcugaugacacagccggaugggauaccaggaucacauuggaagaccugaaaaacgaggagauggucacuaaucauaugaagggugaacacaaaaagcucgcagaggcuauuuuuaaacuuaccuaccagaacaagguugugcgcguacagcgaccaacgccucggggcaccgugauggacaucauuuccagaagggaucagcgcgggagcggacaagucggcacauauggucugaauacuuucaccaacauggaagcccaguuaaucagacagauggagggggagggaauuuucaagucuauacaacaucugacagcuacugaagagaucgccgugcagaauugguuggcacggguuggcagggaacgucucucacgaauggcgauuaguggcgacgauugcguggucaaacccaucgacgaucgcuuugccuccgcucugaccgcccuaaacgacauggggaaggugagaaaagauauccagcagugggagccaagccggggauggaacgacuggacgcaaguacccuucugcucucaccacuuucaugaacuuguuaugaaggaugguagggugcuggucgugccuugucgcaaucaggacgagcucauuggcagagcacggauaucgcagggggcuggauggucacugaaagagacagccugcuugggcaagagcuacgcacagauguggaccuuaauguauuuccacaggcgagaucugcgucucgccgcgaacgcuaucuguuccgccgugccaagucauugggucccgacuucuagaacaaccuggagcauucacgcaaagcacgaauggaugacuaccgaggacaugcuugccguuuggaaucgcguguggauccaagaaaaccccuggauggaggauaaaacaccuguagaauccugggaggagauuccauaccuggguaagcgggaagaccaguggugcgggucacuaaucggacugacgaguagggcuaccugggccaaaaauauacagacugcaaucaaccaggugagaucucucauuggcaaugagggcuauacagacuacaugcccagcaugaagcgcuuucggagggaagaggaagaggcuggggucuugugg

SEQ ID NO: 14998 - RNA, 9873 nt, Artificial Sequence
  derived and/or modified CDS sequence (opt3) from DENV-2__HQ012538__SS-prME
accgccggcgugaucauuaugcugauacccacggcuauggcuuuccaccucacuacgagaaauggggaaccucauaugaucgucggaagacaggaaaaggguaaaagccuucuguuuaagaccgaggacggcguuaauaugugcacauugauggccauugauuuaggggaacugugugaggacacuaucaccuacaaaugcccacuucuccggcaaaacgaaccggaggauauugacuguuggugcaauuccacaucuaccugggugacuuauggaacauguaccacgacuggcgagcaccgccgagaaaagcguucaguugcgcuggugccccaugucgguauggggcuugagaccagaacagaaacuuggaugaguagcgagggagcuuggaaacacgugcagaggaucgagaccuggauacugcggcauccuggcuucgccaucauggcagccauuuuggcuuacacaaucggcaccacgcacuuucagcgcgcacucauuuucauccugcugacugccguugcuccauccaugacaaugagaugcauagggauuucuaacagggauuuuguggaaggagucucggguggcucauggguggacaucgugcucgagcacgggagcuguguuaccacuauggccaagaauaagcccacauuagauuucgaacugauuaaaaccgaggcgaagcagccugcaacgcuucggaaauauugcaucgaagccaaguugaccaacacaacuaccgagagucgcuguccaacacaaggagagcccucccugaaugaagaacaggacaaacgauuuaucugcaagcauucuaugguggauagaggcugggguaacggguguggacuauucggcaagggcgggauugucacuugcgcuauguuuaccugcaaaaagaauauggaaggaaaaguggugcucccugagaaccuggaauacacaauagucaucaccccacacagcggugaggagcaugccguuggcaaugacacugggaagcacggagaagagauuaaaaucacgccgcaguccucaauaacagaagcagagcuuaccggcuaugguacugugaccauggaauguagucccaggacagggcuggauuucaacgagaugguauugcuccagauggaggaaaaggcuuggcuggugcaccggcaaugguuuuuagaccugccucucccauggcuucccggcgccgauacccagggaagcaauuggauucagaaagagacucuggucacauucaagaacccucaugcgaagaaacaggacgugguuguguugggcucucaagaaggggccaugcacacggcacuaaccggagcuacugagauccagauguccucagguaaucugcucuuuacaggccaucugaagugccgucuucgcauggacaaacugcaguugaaggggaugagcuacaguauguguaccggaaaauucaagaucgucaaggagauugccgaaacacaacacggcacuaucgugauuagaguacaguaugagggugaugggucuccaugcaaaauacccuucgaaaucauggaccucgagaagaggcauguucugggccgguuaauuaccgugaacccgaucgucacggaaaaagauuccccugugaacaucgaggcugagcccccauuuggagacagcuacauuauaaucggcgucgaaccugggcagcugaagcuaaauugguucaaaaagggaucgucuauuggucagauguuugagaccacaaugcgaggcgccaagcgcauggcaauccucggggauacugccugggacuucggaucccugggcgguguguuuaccucaauugggaaagcacuucaccaaguuuucggcgcgaucuacggagcagccuuuaguggcgugagcuggacaaugaagauauugaucgggguaauuaucacuuggauuggaaugaacuccagaucuaccagccugucagucagucucgugcugguuggcguggucacgcuuuaucugggugcuauggugcaggccgauuccggguguguagugagcuggaaaaauaaggaauugaaaugcggaucuggcaucuucauaacagacaacguucacaccuggacugagcaguacaaguuucagcccgaaucaccaaguaagcucgcaagcgccauucaaaaagcucaugaggaggguaucuguggcauuagguccgucacacggcuggaaaauuuaauguggaagcagaucacccccgagcugaaccacauacuaucugaaaaugaggugaaacucacuaucaugaccggggauauuaagggaaucaugcaggccggcaaacgcucgcugagaccucagccaacagaacuuaaguauagcuggaaaacgugggggaaggcaaagauguuguccaccgagucacauaaccaaacuuuccugauugacggaccggagacagcggaaugccccaauaccaacagggcuuggaauagucucgagguggaagauuacggcuuuggugucuucacaacuaacaucuggcugaaauuacgugagaagcaggacguauuuugugacucuaaacugaugagcgccgcaauaaaggauaaucgggccgugcacgcugacaugggguauuggauugaguccgcccuuaacgauaccuggaaaauggaaaaggcaucauucaucgagguaaagagcugccacuggccuaaaucucauacguugugguccaauggaguacucgaaagugagaugaucauuccaaagaacuucgcuggccccgucagccagcacaacuaccgaccugguuaucauacacagaccgccggcccauggcaccuggggaaacuagaaauggacuuugauuucugugagggaacuaccgugguugugacagaggacugcggcaauagagggcccucucugaggacuaccacagcguccggaaagcucaucacggaauggugcugucgcucaugcacccugccgccucuucgguacagaggcgaggaugguuguugguacgggauggaaauuaggccauugaaagagaaggaagagaaccuggucaauaguuuagugacugccggacauggccaaauagacaacuuuagccucgguguucugggcauggcucuuuuccuggaggaaauguugcgcacacgaguggggaccaagcacgcaauccuccugguagccgucucguuugugacucuaauuacaggaaauauguccuuccgggaucugggccgugugauggucaugguuggggugaccaugacggacgauaucggaaugggcguaacuuaucucgcucugcuugccgcauuuaaagugagacccaccuucgcggccgguuugcuguuaaggaagcucacaucuaaagagcugaugauggcuaccauugggaucgcccuucugagccagucaacuauaccugaaacaauccuagagcucaccgacgcacuggcuuugggaaugaugguccugaagauugugcgcaacauggaaaaauaccaguuagccguuacaaucauggcaauuaguugcgugcccaaugccgucauccuccugaacgcuuggaagguguccuguacuauacuugcggccguuucugugagcccacuguugcucaccuccucacaacagaagacggauuggauuccucuggcacuaacaaucaaaggccugaaucccaccgcuaucuuucuuacuacccucagccggacaaguaagaaaagaucuuggccacugaacgaggccgucauggccguaggcaugguguccauuuuggcuagcucgcuguuaaagaaugacauaccgaugacugggccucucguugcaggaggucugcuuaccgugugcuauguccugacgggcaggucagccgacuuggagcucgaacgagcggcugaugugaaaugggaggaccaggccgaaaucucugggaguucccccauucugagcaucacaauuucugaggauggaagcauguccaucaagaacgaggaagaggaacagacccuaacuauacugauccgcacaggccuucucguaauuucagguguguucccagucaguauccccauuaccgcagccgcuugguaccugugggagguuaaaaagcaacgggcagggguguugugggacgugccuagcccacccccugucgaaaaggccgaguuagaggauggagcguauagaaucaaacagaggggcauacugggcuacucucagauuggggcuggaguguauaaggaagguacuuuucacacaauguggcauguuacccguggcgccguacucaugcaccgcgggaaacggaucgagccguccugggcagacgugaagaaagaucugaucucauacggaggcgguuggaaacuugaaggggaguggaaggaaggagaggagguccaggugcuggccuuggaaccaggcaaaaaucccagagcuguucaaacgaagccuggccuauucaaaacuaacaccgggacaauuggagccgugagucuggacuuuagcccagguaccuccggcucucccaucgucgauaggaaggggaaagugguaggacucuacggcaauggugucgugacacgaucgggggcauauguuagcgcuauagcccagacugagaagucaauugaagacaacccugagaucgaagaugacauuuuccggaagaaacgccugaccaucauggaucuucauccgggagcgggcaagacgaaaagauacuuacccgccauagugagggaggcaauuaagcggggccugcgaacacucaucuuggcuccaacuagagucguggccgcugagauggaagaggcacugcgcgggcucccuaucagguaucagacccccgccauucgugccgaacacacaggacgggagaucguugaccugaugugucaugcuaccuucacuaugagacuucuguccccagugagggucccuaacuacaauuugauuauaauggacgaggcgcacuuuaccgaucccgcaaguaucgccgcucgcgguuauauuucuacacgaguggaaaugggcgaggccgcagggaucuucaugacggccacuccaccgggaagcagagacccuuuuccccaguccaacgcuccaaucauggaugaagaacgggaaauucccgagaggucauggaacucuggccacgaguggguaaccgacuucaaagguaagacagugugguuuguuccuagcauaaaggcggggaacgauaucgccgcaugccuacgcaaaaauggaaagaaagucauucaacugagucguaagaccuucgacuccgaauacgugaaaacuagagcuaacgauugggacuuuguggucacaaccgauaucagcgagaugggcgccaauuuccgggcagaaaggguaauugacccacgccgauguaugaagcccgugauccucacggauggcgaggaaagaguuauauuagccgggccuaugccggugacucauucuucagcugcccagcggaggggacgcaucgguagaaacccaaagaaugagaacgaccaguauauuuacaugggcgagccccuggaaaaugacgaggauugcgcgcacuggaaagaagcaaagaugcuucuggacaacaucaauacaccugaggggauuauccccuccauguuugaaccagagagggagaaagucgaugccauagacggagaauaccggcuccguggcgaggcucgcaagaccuucguggauuugaugcgaagaggugaccugccuguuuggcucgccuauaggguggcugcagaagggauuaacuacgccgaucggcgcugguguuuugacggcaucaaaaauaaccaaauucuggaggagaacgucgaaguggagaucuggaccaaggaaggagagaggaagaaacuuaagcccagguggcuagaugcucggauauauagugacccacuggccuugaaagaguucaaggaguucgcagcgggccgaaagagcuuaacucugaaucucaucacagagauggggagacugccuaccuuuaugacacagaaggcccgcgaugcucuugacaaccuggccguacuccauacugcagaagcuggagguagggccuacaaucacgcauugucggagcugccggaaacgcuagagacccugcuccuucugacauuauuggccacugugaccggcgggauuuuccuguuucucaugucuggaaaaggcaucgguaagaugacacuggggaugugcugcauuaucaccgcuuccauacuucugugguaugcgcagauucagccccacuggaucgccgcaagcaucauucucgaguucuuuuugaucguucuguuaauaccagagccugagaagcaacggacuccccaggauaaccagcuaacguacgucgugauugcuauccugaccguggucgccgccacaauggcaaaugaaaugggcuuccucgagaaaacuaagaaagaccuuggacugggcucaauuaccacacaggaaagugagucuaacaucuuggacauagaucugcguccagcuuccgccuggacccucuaugcgguugcuacuacauuugugacgccuaugcugagacauagcaucgaaaauucaaguguaaacgugagccuuaccgccauugcaaaucaagccacuguccucauggggcugggaaaggguuggcccuuguccaaaauggacaucggcgugccgcuguuagcuauuggguguuacucucagguuaacccaaucacacuaaccgcagcccugcuccuucugguggcgcacuacgcuauuaucggaccuggcuugcaggccaaggcaaccagggaggcccagaagcgcgcugccgcagguauaaugaaaaaucccacagucgaugggauuacuguaaucgaccuggagccaauccccuaugauccuaaguucgaaaaacaacucggccaggugaugcugcuuauuuuaugcguuacacaggugcugaugaugcggaccacaugggcucucugugaggccuugacucuggcgaccggaccgauaagcacacuaugggaaggcaaccccgggcgauuuuggaauaccacuaucgccgucuccauggcaaacauuuucagaggaucauaccuggcuggcgccggucuccuauuuucuaucaugaagaauacgacaaacaccaggcgcgggacuggaaauauuggcgagacccugggugagaaauggaagagucgguugaacgcacugggcaagucggaguuccagaucuauaaaaagagcgggauacaagagguggacagaacacucgcuaaagaaggaaucaagcguggcgagacugaucaucacgccgucuccagggggucugccaaacugcggugguuuguggaacgcaacaugguuaccccagagggaaaggugguagacuuaggcugcggucgagggggauggucauacuauuguggcggucuuaaaaaugugagagaggucaagggccugacaaaaggcgggccugggcaugaagaacccauuccuaugagcacguacggguggaaccucguuaggcuacaguccggaguggaugucuucuucaccccacccgaaaaaugcgacacucuguugugugauaucggcgagaguucuccuaauccaacaauugaagcgggucggacccugcgcgugcucaaccuuguagagaauuggcugaacaauaacacucaguuuugcaucaagguguugaaucccuauaugccgagcguuauagagaaaauggaaacacugcaaagaaaguacgggggagcucucgugaggaacccuuuaucacgaaauuccacccacgagauguacugggucaguaacgcaacgggcaauauugugagcucugucaacaugaucucccggaugcugaucaaucguuucaccaugaaacacaagaaggccacauaugaaccagacguggaucuuggcucagggacuagaaacauuggaauagagagcgaaauccccaaccuggacauuaucgguaaacgcauugagaagaucaaacaggagcaugaaaccucguggcacuacgaccaggaucauccuuauaagacaugggcuuaccacggcucuuaugagacuaaacagaccgggagugccuccagcaugguuaauggaguagugaggcuacucacaaagccaugggacgucgugcccaugguuacccaaauggcaaugacugauacgacaccguuuggccagcagcggguguucaaggaaaaagucgacaccagaacucaggagccuaaggaggguaccaaaaagcugaugcgcauaacagccgaaugguuguggaaagagcuggggaagaagaaaacgcccaggauguguacccgagaagaguuuacucggaaggugagaucaaacgcugcgcucggagccaucuucacagaugaaaauaaauggaaguccgcaagggaggcuguagaggacucucgcuuuugggaacuuguggaucgugagcggaaccugcacuuagaaggcaaaugcgagaccuguguuuacaauaugaugggcaagagagagaagaagcugggggaguucggaaaggccaaagguagcagggcaauuugguauaugugguugggcgcccgcuuucucgaguucgaagcucugggguuucuaaacgaggaccauugguucagucgaggaaauucccuuagcggcgucgaaggugaggggcugcaccggcucggauacauccugagagaugugucuaagaaagaaggcggcgccauguacgcggacgauacugcagggugggacacaaggauuaccuuggaggaccugaagaacgaggaaauggugacaaaucauaugaaaggagagcacaagaagcucgccgaagcuaucuuuaaacuuacuuaucaaaacaaggucguucgcgugcagagaccaaccccucgggguacgguaauggauauuauaucaaggcgugaccagcgaggcaguggacaggugggaaccuacggccugaauacauucacuaacauggaggcccaauuaauccgccagauggagggugaagggauuuucaaauccauccagcaucugaccgucacagaggaaaucgcagugcaaaauugguuggcuagaguuggacgggagaggcucagccgcauggccauuucuggcgaugacugcguggucaagccccuggaugacagauuugcuucggcccuaacugcacuuaacgauaugggcaaagugcggaaggacauacagcagugggaaccaucaaggggguggaaugauuggacccagguacccuucugcagccaccacuuucaugagcugguuaugaaggacggacgagugcucgucgugccuugucguaaccaagaugagcugaucgguagagcgcgcauuucccagggcgccggguggaguuugaaagaaacggcuugcuuaggaaagucuuaugcccagauguggacacugauguacuuccaccggagggaccucagacuugcagcuaacgccaucuguagcgcagugccaucccauugggucccgaccucacgcacuacauggaguauucacgccaaacacgaguggaugaccacugaagauaugcuggcgguuuggaaucggguguggauccaggagaaccccuggauggaagacaagaccccuguagagucuugggaggaagugccauaucuaggcaaaagggaggaccaauggugcgguagccugauagggcucacaucccgagcuacgugggccaagaauauccagaccgcaauuaaccaggucagaucauugaucggaaaugaagaguacacugauuauaugcccagcaugaagcgguuuaggcgcgaagaggaggaagccggcgugcugugg

SEQ ID NO: 14999 - RNA, 9873 nt, Artificial Sequence
  derived and/or modified CDS sequence (opt3) from DENV-2__HQ012533__SS-prME
accgccggcgugaucauuaugcugauacccacagcuauggcauuccaccucacuacgagaaacggggagccucauaugaucgucggaaggcaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgugcagaggaucgagaccuggauacugcggcauccuggcuucgccaucauggcagccauuuuggcuuacacaaucggcaccacgcacuuucagcgcgcacucauuuucauccugcugacugccguugcuccauccaugacaaugagaugcauagggauuucuaacagggauuuuguggaaggagucucggguggcucauggguggacaucguacucgagcacgggagcuguguuaccacuauggccaagaauaagcccacauuagauuucgaacugauuaaaaccgaggcgaagcagccugcaacgcuucggaaauauugcaucgaagccaaguugaccaacacaacuaccgagagucgcuguccaacacaaggagagcccucccugaaugaagagcaggacaaacgauuuaucugcaagcauucuaugguggauagaggcugggguaacggguguggacuauucggcaagggcgggauugucacuugcgcuauguuuaccugcaaaaagaauauggaaggaaaaguggugcucccugagaaccuggaauacacaauagucaucaccccacacagcggugaggagcaugccguuggcaaugacacugggaagcacggagaagagauuaaaaucacgccgcaguccucaauaacagaagcagagcuuaccggcuaugguacugugaccauggaauguagucccaggacagggcuggauuucaacgagaugguauugcuccagauggaggaaaaggcuuggcuggugcaccggcaaugguuuuuagaccugccucucccauggcuucccggcgccgauacccagggaagcaauuggauucagaaagagacucuggucacauucaagaacccucaugcgaagaaacaggacgugguuguguugggcucucaagaaggggccaugcacacggcacuaaccggagcuacugagauccagauguccucagguaaucugcucuuuacaggccaucugaagugccgucuucgcauggacaaacugcaguugaaggggaugagcuacaguauguguaccggaaaauucaagaucgucaaggagauugccgaaacacaacacggcacuaucgugauuagaguacaguaugagggugaugggucuccaugcaaaauacccuucgaaaucauggaccucgagaagaggcauguucugggccgguuaauuaccgugaacccgaucgucacggaaaaagauuccccugugaacaucgaggcugagcccccauuuggagacagcuacauuauaaucggcgucgaaccugggcagcugaagcuaaauugguucaaaaagggaucgucuauuggucagauguuugagaccacaaugcgaggcgccaagcgcauggcaauccucggggauacugccugggacuucggaucccugggcgguguguuuaccucaauugggaaagcucuucaccaaguuuucggcgcgaucuacggagcagccuuuaguggcgugagcuggacaaugaagauauugaucgggguaauuaucacuuggauuggaaugaacuccagaucuaccagccugucagucagucucgugcugguuggcguggucacgcuuuaucugggugcuauggugcaggccgauuccggguguguagugagcuggaaaaauaaggaauugaaaugcggaucuggcaucuucauaacagacaacguucacaccuggacugagcaguacaaguuucagcccgaaucaccaaguaagcucgcaagcgccauucaaaaagcucaugaggaggguaucuguggcauuagguccgucacacggcuggaaaauuuaauguggaagcagaucacccccgagcugaaccacauacuaucugaaaaugaggugaaacucacuaucaugaccggggauauuaagggaaucaugcaggccggcaaacgcucgcugagaccucagccaacagaacuuaaguauagcuggaaaacgugggggaaggcaaagauguuguccaccgagucacauaaccaaacuuuccugauugacggaccggagacagcggaaugccccaauaccaacagggcuuggaauagucucgagguggaagauuacggcuuuggugucuucacaacuaacaucuggcugaaauuacgugagaagcaggacguuuuuugugacucuaaacugaugagcgccgcaauaaaggauaaucgggccgugcacgcugacaugggguauuggauugaguccgcccuuaacgauaccuggaaaauggaaaaggcaucauucaucgaggugaagagcugccacuggccuaaaucucauacguugugguccaauggaguacucgaaagugagaugaucauuccaaagaacuucgcuggccccgucagccagcacaacuaccgaccugguuaucauacacagaccgccggcccauggcaccuggggaaacuagaaauggacuuugauuucugugagggaacuaccgugguugugacagaggacugcggcaauagagggcccucucugaggacuaccacagcguccggaaagcucaucacggaauggugcugucgcucaugcacccugccgccucuucgguacagaggcgaggaugguuguugguacgggauggaaauuaggccauugaaagagaaggaagagaaccuggucaauaguuuagugacugccggacauggccaaauagacaacuuuagccucgguguucugggcauggcucuuuuccuggaggaaauguugcgcacacgaguggggaccaagcacgcaauccuccugguagccgucucguuugugacucuaauuacaggaaauauguccuuccgggaucugggccgugugauggucaugguuggggugaccaugacggacgauaucggaaugggcguaacuuaucucgcucugcuugccgcauuuaaagugagacccaccuucgcggccgguuugcuguuaaggaagcucacaucuaaagagcugaugauggcuaccauugggaucgcccuucugagccagucaacuauaccugaaacaauccuagagcucaccgacgcacuggcuuugggaaugaugguccugaagauugugcgcaacauggaaaaauaccaguuagccguuacaaucauggcaauuaguugcgugcccaaugccgucauccuccugaacgcuuggaagguguccuguacuauacuugcggccguuucugugagcccacuguugcucaccuccucacaacagaagacggauuggauuccucuggcacuaacaaucaaaggccugaaucccaccgcuaucuuucuuacuacccucagccggacaaguaagaaaagaucuuggccacugaacgaggccgucauggccguaggcaugguguccauuuuggcuagcucgcuguuaaagaaugacauaccgaugacugggccucucguugcaggaggucugcuuaccgugugcuauguccugacgggcaggucagccgacuuggagcucgaacgagcggcugaugugaaaugggaggaccaggccgaaaucucugggaguucccccauucugagcaucacaauuucugaggauggaagcauguccaucaagaacgaggaagaggaacagacccuaacuauacugauccgcacaggccuucucguaauuucagguguguucccagucaguauccccauuaccgcagccgcuugguaccugugggagguuaaaaagcaacgggcagggguguugugggacgugccuagcccacccccugucggaaaggccgaauuagaggauggcgcguauagaaucaaacagaggggcauacugggguacucucagauuggagcugguguguauaaggagggcacuuuucacacaauguggcauguuacccguggggccguacucaugcaccgcggaaaacggaucgaaccguccugggcagacgugaagaaagaucugaucucauacggcgguggguggaagcuugagggagaauggaaggagggcgaagagguccaggugcuggccuuggagccaggcaaaaaucccagagcuguucaaacgaagccugggcuauucaaaacuaacaccggaacaauuggugccgugagucuggacuuuagcccaggcaccuccgggucucccaucgucgauaggaagggaaaagugguaggccucuacgguaauggggucgugacacgaucgggagcauauguuagcgcuauagcccagacugaaaagucaauugaggacaacccugaaaucgaggaugacauuuuccggaagaaacgccugaccaucauggaucuucauccgggcgcgggcaagacgaaaagauacuuacccgccauagugagggaagcaauuaagcgggggcugcgaacacucaucuuggcuccaacuagagucguggccgcugagauggaggaagcacugcgcggacucccuaucagguaucagacccccgccauucgugccgagcacacaggucgggaaaucguugaccugaugugucaugcuaccuucacuaugagacuucuguccccagugagggucccuaacuacaauuugauuauaauggacgaggcgcacuuuaccgaucccgcaaguaucgccgcucgcggcuauauuucuacacgaguggagaugggggaagccgcaggaaucuucaugacggccacuccaccgggcagcagagacccuuuuccccaguccaacgcuccaaucauggaugaggaacgggagauucccgaaaggucauggaauucuggucacgaguggguaaccgacuucaaagggaagacagugugguuuguuccuagcauaaaggcgggaaacgauaucgccgcaugccuacgcaaaaauggcaagaaagucauucaacugagucguaagaccuucgacuccgaguacgugaaaacuagagcuaacgauugggacuuuguggucacaaccgauaucagcgaaaugggcgccaauuuccgggcagagaggguaauugacccacgccgauguaugaagcccgugauccucacggauggggaagagagaguuauauuagccggaccuaugccggugacucauucuucagcugcccagcggaggggucgcaucggcagaaacccaaagaaugaaaacgaccaguauauuuacaugggggagccccuggagaaugacgaagauugcgcgcacuggaaagaggcaaagaugcuucuggacaacaucaauacaccugaaggaauuauccccuccauguuugagccagaaagggagaaagucgaugccauagacggcgaguaccggcuccguggugaagcucgcaagaccuucguggauuugaugcgaagaggggaccugccuguuuggcucgccuauaggguggcugcagagggcauuaacuacgccgaucggcgcugguguuuugacggaaucaaaaauaaccaaauucuggaagagaacgucgagguggaaaucuggaccaaggagggcgaaagaaaaaagcuuaagcccagguggcuagaugcucggauauauagugacccacuggccuugaaagaguucaaggaauucgcagcggggcgaaaaagcuuaacucugaaucucaucacagagaugggaagacugccuaccuuuaugacacagaaggcccgcgaugcucuugacaaccuggccguacuccauacugcagaggcugguggcagggccuacaaucacgcauugucggaacugccggagacgcuagaaacccugcuccuucugacauuauuggccacugugaccgggggaauuuuccuguuucucaugucuggcaaagguaucgggaagaugacacugggcaugugcugcauuaucaccgcuuccauacuucugugguaugcgcagauucagccccacuggaucgccgcaagcaucauucucgaguucuuuuugaucguucuguuaauaccagaaccugagaagcaacggacuccccaggauaaccagcuaacguacgucgugauugcuauccugaccguggucgccgccacaauggcaaaugagaugggauuccucgaaaaaacuaagaaagaccuuggccuggggucaauuaccacacaggagagugaaucuaacaucuuggacauagaucugcguccagcuuccgccuggacccucuaugcgguugcuacuacauuugugacgccuaugcugagacauagcaucgagaauucaaguguaaacgugagccuuaccgccauugcaaaucaagccacuguccucaugggacuggguaagggcuggcccuuguccaaaauggacaucggggugccgcuguuagcuauuggauguuacucucagguuaacccaaucacacuaaccgcagcccugcuccuucugguggcgcacuacgcuauuaucggcccugguuugcaggccaaggcaaccagggaagcccagaagcgcgcugccgcagggauaaugaaaaaucccacagucgauggcauuacuguaaucgaccuggagccaauccccuaugauccuaaguucgagaaacaacucggacaggugaugcugcuuauuuuaugcguuacgcaggugcugaugaugcggaccacaugggcucucugugaagccuugacucuggcgaccggcccgauaagcacacuaugggaggggaaccccggacgauuuuggaauaccacuaucgccgucuccauggcaaacauuuucagaggcucauaccuggcuggugccgggcuccuuuuuucuaucaugaagaauacgacaaacaccaggcgcggaacuggcaauauuggugaaacccugggcgagaaauggaagagucgguugaacgcacuggggaagucggaguuccagaucuauaaaaagagcggaauacaagaaguggacagaacacucgcuaaagagggcaucaagcguggggaaacugaucaucacgccgucuccaggggaucugccaaacugcggugguuuguggagcgcaacaugguuaccccagaaggcaaggugguagacuuagguugcgggcgaggaggcuggucauacuauugugguggccuuaaaaaugugagagaggucaaggggcugacaaagggaggcccugggcaugaggaacccauuccuaugagcacguacggauggaaccucguuaggcuacaguccggcguggaugucuucuucaccccacccgagaaaugcgacacucuguugugugauaucggugaaaguucuccuaauccaacaauugaggcggggcggacccugcgcgugcucaaccuuguagaaaauuggcugaacaauaacacucaguuuugcaucaagguguugaaucccuauaugccgagcguuauagagaaaauggagacacugcaaagaaaguacggaggcgcucucgugaggaacccuuuaucacgaaauuccacccacgaaauguacugggucaguaacgcaacgggcaauauugugagcucugucaacaugaucucccggaugcugaucaaucguuucaccaugaaacacaagaaggccacauaugagccagacguggaucuugggucaggaacuagaaacauugguauagaaagcgagauccccaaccuggacauuaucggcaaacgcauugaaaagaucaaacaggagcaugagaccucguggcacuacgaccaggaucauccuuauaagacaugggcuuaccacgggucuuaugaaacuaaacagaccggaagugccuccagcaugguuaauggcguagugaggcuacucacaaagccaugggacgucgugcccaugguuacccaaauggcaaugacugauacgacaccguuuggucagcagcggguguucaaggagaaagucgacaccagaacucaggaaccuaaggaggggaccaaaaagcugaugcgcauaacagccgagugguuguggaaagaacugggaaagaagaaaacgcccaggauguguacccgagaggaauuuacucggaaggugagaucaaacgcugcgcucggcgccaucuucacagaugagaauaaauggaaguccgcaagggaagcuguagaggacucucgcuuuugggagcuuguggaucgugaacggaaccugcacuuagagggcaaaugcgaaaccuguguuuacaauaugauggggaagagagagaaaaagcugggagaauucgguaaggccaaaggcagcagggcaauuugguauaugugguugggggcccgcuuucucgaguucgaggcucugggauuucuaaacgaagaccauugguucagucgaggcaauucccuuagcggugucgagggggaaggacugcaccggcucggcuacauccugagagaugugucuaagaaagagggcggggccauguacgcggacgauacugcaggaugggacacaaggauuaccuuggaagaccugaagaacgaggagauggugacaaaucauaugaaaggugaacacaagaagcucgccgaggcuaucuuuaaacuuacuuaucaaaacaaggucguucgcgugcagagaccaaccccucggggcacgguaauggauauuauaucaaggcgugaccagcgagggaguggacaggugggcaccuacggucugaauacauucacuaacauggaagcccaauuaauccgccagauggagggggagggaauuuucaaauccauccagcaucugaccgucacagaagagaucgcagugcaaaauugguuggcuagaguuggccgggaaaggcucagccgcauggccauuucuggcgaugacugcguggucaagccccuggaugacagauuugcuucggcccuaacugcacuuaacgauauggggaaagugcggaaggacauacagcagugggagccaucaaggggauggaaugauuggacccagguacccuucugcagccaccacuuucaugaacugguuaugaaggacggucgagugcucgucgugccuugucguaaccaagaugagcugaucggcagagcgcgcauuucccagggggccggauggaguuugaaagagacggcuugcuuaggcaagucuuaugcccagauguggacacugauguacuuccaccggagggaccucagacuugcagcuaacgccaucuguagcgcagugccaucccauugggucccgaccucacgcacuacauggaguauucacgccaaacacgaauggaugaccacugaggauaugcuggcgguuuggaaucggguguggauccaggaaaaccccuggauggaggacaagaccccuguagaaucuugggaggaggugccauaucuagguaaaagggaagaccaauggugcgggagccugauaggacucacaucccgagcuacgugggccaagaauauccagaccgcaauuaaccaggucagaucauugaucggcaaugaggaauacacugauuauaugcccagcaugaagcgguuuaggcgcgaggaagaggaggccggcgugcugugg

SEQ ID NO: 15000 - RNA, 9873 nt, Artificial Sequence
  derived and/or modified CDS sequence (opt3) from DENV-2__HQ012534__SS-prME
accgccggcgugaucauuaugcugauacccacagcuauggcauuccaccucacuacgagaaacggggagccucauaugaucgucggaaggcaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgugcagaggaucgagaccuggauacugcggcauccuggcuucgccaucauggcagccauuuuggcuuacacaaucggcaccacgcacuuucagcgcgcacucauuuucauccugcugacugccguugcuccauccaugacaaugagaugcauagggauuucuaacagggauuuuguggaaggagucucggguggcucauggguggacaucguacucgagcacgggagcuguguuaccacuauggccaagaauaagcccacauuagauuucgaacugauuaaaaccgaggcgaagcagccugcaacgcuucggaaauauugcaucgaagccaaguugaccaacacaacuaccgagagucgcuguccaacacaaggagagcccucccugaaugaagagcaggacaaacgauuuaucugcaagcauucuaugguggauagaggcugggguaacggguguggacuauucggcaagggcgggauugucacuugcgcuauguuuaccugcaaaaagaauauggaaggaaaaguggugcucccugagaaccuggaauacacaauagucaucaccccacacagcggugaggagcaugccguuggcaaugacacugggaagcacggagaagagauuaaaaucacgccgcaguccucaauaacagaagcagagcuuaccggcuaugguacugugaccauggaauguagucccaggacagggcuggauuucaacgagaugguauugcuccagauggaggaaaaggcuuggcuggugcaccggcaaugguuuuuagaccugccucucccauggcuucccggcgccgauacccagggaagcaauuggauucagaaagagacucuggucacauucaagaacccucaugcgaagaaacaggacgugguuguguugggcucucaagaaggggccaugcacacggcacuaaccggagcuacugagauccagauguccucagguaaucugcucuuuacaggccaucugaagugccgucuucgcauggacaaacugcaguugaaggggaugagcuacaguauguguaccggaaaauucaagaucgucaaggagauugccgaaacacaacacggcacuaucgugauuagaguacaguaugagggugaugggucuccaugcaaaauacccuucgaaaucauggaccucgagaagaggcauguucugggccgguuaauuaccgugaacccgaucgucacggaaaaagauuccccugugaacaucgaggcugagcccccauuuggagacagcuacauuauaaucggcgucgaaccugggcagcugaagcuaaauugguucaaaaagggaucgucuauuggucagauguuugagaccacaaugcgaggcgccaagcgcauggcaauccucggggauacugccugggacuucggaucccugggcgguguguuuaccucaauugggaaagcucuucaccaaguuuucggcgcgaucuacggagcagccuuuaguggcgugagcuggacaaugaagauauugaucgggguaauuaucacuuggauuggaaugaacuccagaucuaccagccugucagucagucucgugcugguuggcguggucacgcuuuaucugggugcuauggugcaggccgauuccggguguguagugagcuggaaaaauaaggaauugaaaugcggaucuggcaucuucauaacagacaacguucacaccuggacugagcaguacaaguuucagcccgaaucaccaaguaagcucgcaagcgccauucaaaaagcucaugaggaggguaucuguggcauuagguccgucacacggcuggaaaauuuaauguggaagcagaucacccccgagcugaaccacauacuaucugaaaaugaggugaaacucacuaucaugaccggggauauuaagggaaucaugcaggccggcaaacgcucgcugagaccucagccaacagaacuuaaguauagcuggaaaacgugggggaaggcaaagauguuguccaccgagucacauaaccaaacuuuccugauugacggaccggagacagcggaaugccccaauaccaacagggcuuggaauagucucgagguggaagauuacggcuuuggugucuucacaacuaacaucuggcugaaauuacgugagaagcaggacguuuuuugugacucuaaacugaugagcgccgcaauaaaggauaaucgggccgugcacgcugacaugggguauuggauugaguccgcccuuaacgauaccuggaaaauggaaaaggcaucauucaucgaggugaagagcugccacuggccuaaaucucauacguugugguccaauggaguacucgaaagugagaugaucauuccaaagaacuucgcuggccccgucagccagcacaacuaccgaccugguuaucauacacagaccgccggcccauggcaccuggggaaacuagaaauggacuuugauuucugugagggaacuaccgugguugugacagaggacugcggcaauagagggcccucucugaggacuaccacagcguccggaaagcucaucacggaauggugcugucgcucaugcacccugccgccucuucgguacagaggcgaggaugguuguugguacgggauggaaauuaggccauugaaagagaaggaagagaaccuggucaauaguuuagugacugccggacauggccaaauagacaacuuuagccucgguguucugggcauggcucuuuuccuggaggaaauguugcgcacacgaguggggaccaagcacgcaauccuccugguagccgucucguuugugacucuaauuacaggaaauauguccuuccgggaucugggccgugugauggucaugcucgggguucccaugaccgacgauaucggaaugggcgugacguaucuggcucuuuuggccgcauuuaaaguaagaccuacuuucgcggccggucuguuacucaggaagcugaccucuaaagagcuuaugauggcuacaauugggaucgcccugcuaagccagucaaccauacccgaaacuauccucgagcugacagacgcauuggcucugggaaugaugguguuaaagauuguccgcaacauggaaaaauaccagcucgccgugaccaucauggcaauuaguugcguuccaaaugccgugauccugcuuaacgcuuggaaggucuccuguacaauacuggcggccgugucuguuagcccuuugcuccugacuuccucacaacagaagaccgauuggauuccccuagcacugacgaucaaaggccuuaauccaacagcuaucuuucucaccacucugagccggaccaguaagaaaagaucuuggccguugaacgaggccgugauggccgucggcaugguauccauucuggcuagcucguuacucaagaaugacauaccuaugacagggccccugguggcaggaggucuucugacuguuugcuauguguugaccggcaggucagccgaccucgagcuggaacgagcggcugaugucaaaugggaggaccaggccgaaaucucugggaguuccccaauucuaagcaucacgauuucugaggauggaagcauguccaucaagaacgaggaagaggaacagacacugaccauacuuauccgcacuggccuccuggugauuucagguguauuccccgugaguaucccuauuacagcagccgcuugguacuugugggaggucaaaaagcaacgggcagggguuuuaugggacgugccaagccccccuccggugggaaaggccgaacuggaggauggcgcguauagaaucaaacagaggggcauacucggguacucucagauuggagcuggugucuauaaggagggcaccuuucacacuauguggcaugugacacguggggccguucugaugcaccgcggaaaacggaucgaaccauccugggcagacguaaagaaagaucuuaucucauacggcgguggguggaagcuggagggagaauggaaggagggcgaagaggugcaggucuuggcccuagagcccggcaaaaauccuagagcugugcaaaccaagccagggcuguucaaaacgaacacuggaaccauuggugccguuagucucgacuuuagccccggcacauccgggucuccuaucguggauaggaagggaaaagucgugggccuguacgguaaugggguagucacccgaucgggagcauaugugagcgcuauagcccagacagaaaagucaauugaggacaacccggaaaucgaggaugacauuuuccggaagaaacgccuuacuaucauggauuuacaucccggcgcgggcaagaccaaaagauaccugccagccauaguuagggaagcaauuaagcgggggcuccgaacguugauccuggcuccuacaagaguggucgccgcugagauggaggaagcacuccgcggacugcccaucagguaucagacuccagccauucgugccgagcacaccggucgggaaaucguggaccuuaugugucaugcuacauucaccaugagacuguuguccccuguuagggugcccaacuacaaucuaauuauaauggacgaggcgcacuuuacugauccagcaaguaucgccgcucgcggcuauauuucuacccgagucgagaugggggaagccgcaggaaucuucaugacagccacgccgccuggcagcagagaccccuuuccacaguccaacgcucccaucauggaugaggaacgggagauuccugaaaggucauggaauucuggucacgagugggugacugacuucaaagggaagaccguaugguuugugccaagcauaaaggcgggaaacgauaucgccgcaugccugcgcaaaaauggcaagaaaguuauucaacucagucguaagacauucgacuccgaguacgucaaaaccagagcuaacgauugggacuuuguggugacuacagauaucagcgaaaugggcgccaauuuccgggcagagagggucauugacccccgccgauguaugaagccuguaaucuuaaccgauggggaagagagagugauacuggccggaccgaugccaguuacgcauucuucagcugcccagcggaggggucgcaucggcagaaaccccaagaaugaaaacgaccaguauauuuacaugggggagccucuugagaaugacgaagauugcgcgcacuggaaagaggcaaagaugcugcucgacaacaucaauacucccgaaggaauuaucccauccauguuugagccugaaagggagaaaguggaugccauagacggcgaguaccgguugcguggugaagcucgcaagacauucgucgaucugaugcgaagaggggaccuccccguguggcuggccuauaggguugcugcagagggcauuaacuacgccgaucggcgcugguguuuugacggaaucaaaaauaaccaaauucuugaagagaacguggaggucgaaaucuggaccaaggagggcgaaagaaaaaagcuaaagccaagguggcuggaugcucggauauauagugacccuuuggccuuaaaagaguucaaggaauucgcagcggggcgaaaaagccugacccucaaucugaucacugagaugggaagacuuccgacauuuaugacccagaaggcccgcgaugcucuggacaaccucgccguguugcauacagcagaggcugguggcagggccuacaaucacgcacugucggaacuacccgagacucuggaaacgcuccuucuguuaaccuugcuggccacaguaacugggggaauuuuccucuuucugaugucuggcaaagguaucgggaagaugacccuuggcaugugcugcauuaucacagcuuccauacugcucugguaugcgcagauucagccacacuggaucgccgcaagcaucauuuuggaguucuuucugaucguguuacuaauaccugaacccgagaagcaacggaccccacaggauaaccagcugacuuacguugucauugcuauccucacggugguggccgccaccauggcaaaugagaugggauuccuugaaaaaacaaagaaagaccugggcuuggggucaauuacuacccaggagagugaaucuaacauccuggacauagaucuccguccugcuuccgccuggacacuguaugcggucgcuaccacuuuuguuacacccaugcuuagacauagcaucgagaauucaagugugaacguaagccucacggccauugcaaaucaagccaccgugcugaugggauuggguaagggcuggccgcuguccaaaauggacaucggggucccauuacuagcuauuggauguuacucucaggugaacccuaucacucugacagcagcccuccuucuguugguugcgcacuacgcuauuaucggccccggucugcaggccaaggcaaccagggaagcccagaagcgcgcugccgcagggauaaugaaaaauccaaccguggauggcauuacagucaucgaccucgagcccaucccuuaugauccgaaguucgagaaacaacugggacagguaaugcuuuuaauucugugcgugacucagguucucaugaugcggacgaccugggcuuugugugaagcccugacacuagcgacuggccccauaagcacccugugggaggggaacccaggacgauuuuggaauacaaccaucgccguguccauggcaaacauuuucagaggcucauaccucgcuggugccgggcuucuguuuucuaucaugaagaauacuacgaacacaaggcgcggaaccggcaauauuggugaaacuuugggcgagaaauggaagagucggcugaacgcacucgggaagucggaguuccagaucuauaaaaagagcggaauacaagaagucgacagaacccuggcuaaagagggcaucaagcguggggaaacagaucaucacgccguguccaggggaucugccaaauuacggugguuugucgagcgcaacauggugacuccugaaggcaagguuguggaccuugguugcgggcgaggaggcuggucauacuauugugguggccugaaaaauguaagagaggugaaggggcucaccaagggaggccccgggcaugaggaaccuauuccaaugagcacauacggauggaaccuagucaggcugcaguccggcguugauguguucuucacgcccccugagaaaugcgacaccuugcugugugauaucggugaaaguucuccaaaucccacuauugaggcggggcggacacuccgcguccuuaaccugguggaaaauugguugaacaauaacacccaguuuugcaucaagguacugaauccguauaugccuagcgugauagagaaaauggagacucuccaaagaaaguacggaggcgcuuuaguuaggaacccacugucacgaaauuccacacacgaaauguacugggugaguaacgcaaccggcaauauugucagcucugugaacaugaucucccggaugcuuaucaaucguuucacgaugaaacacaagaaggccaccuaugagcccgacgucgaucuggggucaggaacaagaaacauugguauagaaagcgagaucccuaaccuagacauuaucggcaaacgcauugaaaagaucaaacaggagcaugagacuucguggcacuacgaccaggaucauccauauaagaccugggcuuaccacgggucuuaugaaacaaaacagacuggaagugccuccagcauggugaauggcguuguaaggcuccugaccaagcccugggacguggucccgauggugacacaaauggcaaugaccgauacuacgccuuuuggucagcagcggguuuucaaggagaaaguggacacaagaacccaggaacccaaggaggggacuaaaaaguugaugcgcauaaccgccgaguggcuguggaaagaacucggaaagaagaaaacaccaaggauguguacgcgagaggaauuuacccggaaggucagaucaaacgcugcgcuuggcgccaucuucacugaugagaauaaauggaaguccgcaagggaagcuguggaggacucucgcuuuugggagcugguagaucgugaacggaacuuacaccuggagggcaaaugcgaaacauguguguacaauaugauggggaagagagagaaaaaguugggagaauucgguaaggccaaaggcagcagggcaauuugguauauguggcucggggcccgcuuucuggaguucgaggcucuaggauuucuuaacgaagaccauugguucagucgaggcaauucccugagcgguguugagggggaaggacuccaccggcugggcuacaucuugagagaugucucuaagaaagagggcggggccauguacgcggacgauaccgcaggaugggacacuaggauuacacuggaagaccucaagaacgaggagauggugaccaaucauaugaaaggugaacacaagaagcuugccgaggcuaucuuuaaacugacauaucaaaacaaggugguccgcguucagagaccuacuccccggggcaccgugauggauauuauaucaaggcgugaccagcgagggaguggacagguaggcacguacgguuuaaauaccuucacaaacauggaagcccaacugauccgccagauggagggggagggaauuuucaaauccauccagcauuugacugugaccgaagagaucgcaguccaaaauuggcucgcuagagugggccgggaaaggcugagccgcauggccauuucuggcgaugacugcguugugaagccacuagaugacagauuugcuucggcccuuacagcacugaacgauauggggaaaguccggaaggacauacagcagugggagcccucaaggggauggaaugauuggacucaggugccuuucugcagccaccacuuucaugaacucguaaugaaggacggucgaguucugguggucccaugucguaaccaagaugaguugaucggcagagcgcgcauuucccagggggccggauggaguuuaaaagagaccgcuugccugggcaagucuuaugcccagauguggacgcucauguacuuccaccggagggaccuuagacuggcagcuaacgccaucuguagcgcagugccgucccauugggugcccacaucacgcaccacuuggaguauucacgccaaacacgaauggaugacaaccgaggauaugcuagcggucuggaaucggguuuggauccaggaaaacccuuggauggaggacaagacuccaguggaaucuugggaggagguacccuaucuggguaaaagggaagaccaauggugcgggagccucauaggauugaccucccgagcuacaugggccaagaauauccagacggcaauuaaccaggugagaucacugaucggcaaugaggaauacaccgauuauaugccuagcaugaagcgguuuaggcgcgaggaagaggaggccggcguccuuugg

SEQ ID NO: 15001 - RNA, 9873 nt, Artificial Sequence
  derived and/or modified CDS sequence (opt3) from DENV-2__HQ012535__SS-prME
accgccggcgugaucauuaugcugauacccacagcuauggcauuccaccucacuacgagaaacggggagccucauaugaucgucggaaggcaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgugcagaggaucgagaccuggauacugcggcauccuggcuucgccaucauggcagccauuuuggcuuacacaaucggcaccacgcacuuucagcgcgcacucauuuucauccugcugacugccguugcuccauccaugacaaugagaugcauagggauuucuaacagggauuuuguggaaggagucucggguggcucauggguggacaucguacucgagcacgggagcuguguuaccacuauggccaagaauaagcccacauuagauuucgaacugauuaaaaccgaggcgaagcagccugcaacgcuucggaaauauugcaucgaagccaaguugaccaacacaacuaccgagagucgcuguccaacacaaggagagcccucccugaaugaagagcaggacaaacgauuuaucugcaagcauucuaugguggauagaggcugggguaacggguguggacuauucggcaagggcgggauugucacuugcgcuauguuuaccugcaaaaagaauauggaaggaaaaguggugcucccugagaaccuggaauacacaauagucaucaccccacacagcggugaggagcaugccguuggcaaugacacugggaagcacggagaagagauuaaaaucacgccgcaguccucaauaacagaagcagagcuuaccggcuaugguacugugaccauggaauguagucccaggacagggcuggauuucaacgagaugguauugcuccagauggaggaaaaggcuuggcuggugcaccggcaaugguuuuuagaccugccucucccauggcuucccggcgccgauacccagggaagcaauuggauucagaaagagacucuggucacauucaagaacccucaugcgaagaaacaggacgugguuguguugggcucucaagaaggggccaugcacacggcacuaaccggagcuacugagauccagauguccucagguaaucugcucuuuacaggccaucugaagugccgucuucgcauggacaaacugcaguugaaggggaugagcuacaguauguguaccggaaaauucaagaucgucaaggagauugccgaaacacaacacggcacuaucgugauuagaguacaguaugagggugaugggucuccaugcaaaauacccuucgaaaucauggaccucgagaagaggcauguucugggccgguuaauuaccgugaacccgaucgucacggaaaaagauuccccugugaacaucgaggcugagcccccauuuggagacagcuacauuauaaucggcgucgaaccugggcagcugaagcuaaauugguucaaaaagggaucgucuauuggucagauguuugagaccacaaugcgaggcgccaagcgcauggcaauccucggggauacugccugggacuucggaucccugggcgguguguuuaccucaauugggaaagcucuucaccaaguuuucggcgcgaucuacggagcagccuuuaguggcgugagcuggacaaugaagauauugaucgggguaauuaucacuuggauuggaaugaacuccagaucuaccagccugucagucagucucgugcugguuggcguggucacgcuuuaucugggugcuauggugcaggccgauuccggguguguagugagcuggaaaaauaaggaauugaaaugcggaucuggcaucuucauaacagacaacguucacaccuggacugagcaguacaaguuucagcccgaaucaccaaguaagcucgcaagcgccauucaaaaagcucaugaggaggguaucuguggcauuagguccgucacacggcuggaaaauuuaauguggaagcagaucacccccgagcugaaccacauacuaucugaaaaugaggugaaacucacuaucaugaccggggauauuaagggaaucaugcaggccggcaaacgcucgcugagaccucagccaacagaacuuaaguauagcuggaaaacgugggggaaggcaaagauguuguccaccgagucacauaaccaaacuuuccugauugacggaccggagacagcggaaugccccaauaccaacagggcuuggaauagucucgagguggaagauuacggcuuuggugucuucacaacuaacaucuggcugaaauuacgugagaagcaggacguuuuuugugacucuaaacugaugagcgccgcaauaaaggauaaucgggccgugcacgcugacaugggguauuggauugaguccgcccuuaacgauaccuggaaaauggaaaaggcaucauucaucgaggugaagagcugccacuggccuaaaucucauacguugugguccaauggaguacucgaaagugagaugaucauuccaaagaacuucgcuggccccgucagccagcacaacuaccgaccugguuaucauacacagaccgccggcccauggcaccuggggaaacuagaaauggacuuugauuucugugagggaacuaccgugguugugacagaggacugcggcaauagagggcccucucugaggacuaccacagcguccggaaagcucaucacggaauggugcugucgcucaugcacccugccgccucuucgguacagaggcgaggaugguuguugguacgggauggaaauuaggccauugaaagagaaggaagagaaccuggucaauaguuuagugacugccggacauggccaaauagacaacuuuagccucgguguucugggcauggcucuuuuccuggaggaaauguugcgcacacgaguggggaccaagcacgcaauccuccugguagccgucucguuugugacucuaauuacaggaaauauguccuuccgggaucugggccgugugauggucaugguuggggugaccaugacggacgauaucggaaugggcguaacuuaucucgcucugcuugccgcauuuaaagugagacccaccuucgcggccgguuugcuguuaaggaagcucacaucuaaagagcugaugauggcuaccauugggaucgcccuucugagccagucaacuauaccugaaacaauccuagagcucaccgacgcacuggcuuugggaaugaugguccugaagauugugcgcaacauggaaaaauaccaguuagccguuacaaucauggcaauuaguugcgugcccaaugccgucauccuccugaacgcuuggaagguguccuguacuauacuugcggccguuucugugagcccacuguugcucaccuccucacaacagaagacggauuggauuccucuggcacuaacaaucaaaggccugaaucccaccgcuaucuuucuuacuacccucagccggacaaguaagaaaagaucuuggccacugaacgaggccgucauggccguaggcaugguguccauuuuggcuagcucgcuguuaaagaaugacauaccgaugacugggccucucguugcaggaggucugcuuaccgugugcuauguccugacgggcaggucagccgacuuggagcucgaacgagcggcugaugugaaaugggaggaccaggccgaaaucucugggaguucccccauucugagcaucacaauuucugaggauggaagcauguccaucaagaacgaggaagaggaacagacccuaacuauacugauccgcacaggccuucucguaauuucagguguguucccagucaguauccccauuaccgcagccgcuugguaccugugggagguuaaaaagcaacgggcagggguguugugggacgugccuagcccacccccugucgaaaaggccgaguuagaggauggagcguauagaaucaaacagaggggcauacugggcuacucucagauuggggcuggaguguauaaggaagguacuuuucacacaauguggcauguuacccguggcgccguacucaugcaccgcgggaaacggaucgagccguccugggcagacgugaagaaagaucugaucucauacggaggcgguuggaagcuugaaggggaguggaaggaaggagaggagguccaggugcuggccuuggaaccaggcaaaaaucccagagcuguucaaacgaagccuggccuauucaaaacuaacaccgggacaauuggagccgugagucuggacuuuagcccagguaccuccggcucucccaucgucgauaggaaggggaaagugguaggacucuacggcaauggugucgugacacgaucgggggcauauguuagcgcuauagcccagacugagaagucaauugaagacaacccugagaucgaagaugacauuuuccggaagaaacgccugaccaucauggaucuucauccgggagcgggcaagacgaaaagauacuuacccgccauagugagggaggcaauuaagcggggccugcgaacacucaucuuggcuccaacuagagucguggccgcugagauggaagaggcacugcgcgggcucccuaucagguaucagacccccgccauucgugccgaacacacaggacgggagaucguugaccugaugugucaugcuaccuucacuaugagacuucuguccccagugagggucccuaacuacaauuugauuauaauggacgaggcgcacuuuaccgaucccgcaaguaucgccgcucgcgguuauauuucuacacgaguggaaaugggcgaggccgcagggaucuucaugacggccacuccaccgggaagcagagacccuuuuccccaguccaacgcuccaaucauggaugaagagcgggaaauucccgagaggucauggaauucuggccacgaguggguaaccgacuucaaagguaagacagugugguuuguuccuagcauaaaggcggggaacgauaucgccgcaugccuacgcaaaaauggaaagaaagucauucaacugagucguaagaccuucgacuccgaauacgugaaaacuagagcuaacgauugggacuuuguggucacaaccgauaucagcgagaugggcgccaauuuccgggcagaaaggguaauugacccacgccgauguaugaagcccgugauccucacggauggcgaggaaagaguuauauuagccgggccuaugccggugacucauucuucagcugcccagcggaggggacgcaucgguagaaacccaaagaaugagaacgaccaguauauuuacaugggcgagccccuggaaaaugacgaggauugcgcgcacuggaaagaagcaaagaugcuucuggacaacaucaauacaccugaggggauuauccccuccauguuugaaccagagagggagaaagucgaugccauagacggagaauaccggcuccguggcgaggcucgcaagaccuucguggauuugaugcgaagaggugaccugccuguuuggcucgccuauaggguggcugcagaagggauuaacuacgccgaucggcgcugguguuuugacggcaucaaaaauaaccaaauucuggaggagaacgucgaaguggagaucuggaccaaggaaggagagagaaaaaagcuuaagcccagguggcuagaugcucggauauauagugacccacuggccuugaaagaauucaaggaguucgcagcgggccgaaaaagcuuaacucugaaucucaucacagagauggggagacugccuaccuuuaugacacagaaggcccgcgaugcucuugacaaccuggccguacuccauacugcagaagcuggagguagggccuacaaucacgcauugucggagcugccggaaacgcuagagacccugcuccuucugacauuauuggccacugugaccggcgggauuuuccuguuucucaugucuggaaaaggcaucgguaagaugacacuggggaugugcugcauuaucaccgcuuccauacuucugugguaugcgcagauucagccccacuggaucgccgcaagcaucauucucgaauucuuuuugaucguucuguuaauaccagagccugagaagcaacggacuccccaggauaaccagcuaacguacgucgugauugcuauccugaccguggucgccgccacaauggcaaaugaaaugggcuuccucgagaaaacuaagaaagaccuuggacugggcucaauuaccacacaggaaagugagucuaacaucuuggacauagaucugcguccagcuuccgccuggacccucuaugcgguugcuacuacauuugugacgccuaugcugagacauagcaucgaaaauucaaguguaaacgugagccuuaccgccauugcaaaucaagccacuguccucauggggcugggaaaggguuggcccuuguccaaaauggacaucggcgugccgcuguuagcuauuggguguuacucucagguuaacccaaucacacuaaccgcagcccugcuccuucugguggcgcacuacgcuauuaucggaccuggcuugcaggccaaggcaaccagggaggcccagaagcgcgcugccgcagguauaaugaaaaaucccacagucgaugggauuacuguaaucgaccuggagccaauccccuaugauccuaaguucgaaaaacaacucggccaggugaugcugcuuauuuuaugcguuacgcaggugcugaugaugcggaccacaugggcucucugugaggccuugacucuggcgaccggaccgauaagcacacuaugggaaggcaaccccgggcgauuuuggaauaccacuaucgccgucuccauggcaaacauuuucagaggaucauaccuggcuggcgccggucuccuuuuuucuaucaugaagaauacgacaaacaccaggcgcgggacuggaaauauuggcgagacccugggugagaaauggaagagucgguugaacgcacugggcaagucggaauuccagaucuauaaaaagagcgggauacaagagguggacagaacacucgcuaaagaaggaaucaagcguggcgagacugaucaucacgccgucuccagggggucugccaaacugcggugguuuguggaacgcaacaugguuaccccagagggaaaggugguagacuuaggcugcggucgagggggauggucauacuauuguggcggucuuaaaaaugugagagaggucaagggccugacaaaggggggaccuggccaugaagagcccauuccuaugagcacguacggguggaaccucguuaggcuacaguccggaguggaugucuucuucaccccacccgaaaaaugcgacacucuguugugugauaucggcgagaguucuccuaauccaacaauugaagcgggucggacccugcgcgugcucaaccuugcugagaauuggcugaacaauaacacucaguuuugcaucaagguauugaaucccuauaugccgagcgugauagagaaaauggaaacacugcaaagaaaguacgggggagcacucguuaggaacccuuuaucacgaaauuccacccacgagauguacugggugaguaacgccacgggcaauauugucagcucugugaacaugaucucccggaugcugaucaaucguuucaccaugaaacacaagaaggcuacauaugaaccagacgucgaucuuggcucagggacuagaaacauuggaauagagagcgaaauccccaaccuggacauuaucgguaaacgcauugagaagaucaaacaggagcaugaaaccucguggcacuacgaccaggaucauccuuauaagacaugggccuaccacggcucuuaugagacuaaacagaccgggagugcauccagcauggugaauggaguuguaaggcuacucacaaagccaugggacgugguccccauggugacccaaauggccaugacugauacgacaccguuuggccagcagcggguuuucaaggaaaaaguggacaccagaacucaggagccuaaggaggguaccaaaaagcugaugcgcauaacagcugaaugguuguggaaagagcuggggaagaagaaaacgcccaggauguguacccgagaagaguuuacucggaaggucagaucaaacgcggcccucggagcaaucuucacagaugaaaauaaauggaaguccgcuagggaggccguggaggacucucgcuuuugggaacuuguagaucgugagcggaaccugcacuuagaaggcaaaugcgagaccuguguguacaauaugaugggcaagagagaaaaaaagcugggggaguucggaaaggcaaaagguagcagggccauuugguauaugugguugggcgcucgcuuucucgaguucgaagcccugggguuucuaaacgaggaccauugguucagucgaggaaauucccuuagcggcguugaaggugaggggcugcaccggcucggauacauccugagagaugucucuaagaaagaaggcggcgcgauguacgcagacgauacugccgggugggacacaaggauuaccuuggaggaccugaagaacgaggaaauggugacaaaucauaugaaaggagagcacaagaagcucgcugaagccaucuuuaaacuuacuuaucaaaacaaggugguccgcguucagagaccaaccccucgggguacggugauggauauuauaucaaggcgugaccagcgaggcagugggcagguaggaaccuacggccugaauacauucacuaacauggaggcacaauuaauccgccagauggagggugaagggauuuucaaauccauccagcaucugaccgugacagaggaaaucgcuguccaaaauugguuggccagagugggacgggagaggcucagccgcauggcuauuucuggcgaugacugcguugugaagccccuggaugacagauuugccucggcacuaacugcgcuuaacgauaugggcaaaguccggaaggacauacagcagugggaaccaucaaggggguggaaugauuggacccaggugcccuucugcagccaccacuuucaugagcugguaaugaaggacggacgaguucucguggucccuugucguaaccaagaugagcugaucgguagagcccgcauuucccagggcgcuggguggaguuugaaagaaacggccugcuuaggaaagucuuaugcacagauguggacacugauguacuuccaccggagggaccucagacuugcugccaacgcaaucuguagcgccgugccaucccauugggugccgaccucacgcacuacauggaguauucacgcgaaacacgaguggaugaccacugaagauaugcuggcugucuggaaucggguuuggauccaggagaaccccuggauggaagacaagaccccuguggagucuugggaggaaguaccauaucuaggcaaaagggaggaccaauggugcgguagccugauagggcucacaucccgagccacgugggcaaagaauauccagaccgccauuaaccaggugagaucauugaucggaaaugaagaguacacugauuauaugcccagcaugaagcgguuuaggcgcgaagaggaggaagcuggcguccugugg

SEQ ID NO: 15002 - RNA, 9873 nt, Artificial Sequence
  derived and/or modified CDS sequence (opt3) from DENV-2__HQ012536__SS-prME
accgccggagugaucauuaugcugauacccacagcuauggcauuccaccucacuacgaggaacggggaaccucauaugaucgucggaaggcaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguugcgcuggugccccaugucgguauggggcuugagaccagaacagaaacuuggaugaguagcgagggagcuuggaaacacgugcagaggaucgagaccuggauacugcggcauccuggcuucgccaucauggcagccauuuuggcuuacacaaucggcaccacgcacuuucagcgcgcacucauuuucauccugcugacugccguugcuccauccaugacaaugagaugcauagggauuucuaacagggauuuuguggaaggagucucggguggcucauggguggacaucguacucgagcacgggagcuguguuaccacuauggccaagaauaagcccacauuagauuucgaacugauuaaaaccgaggcgaagcagccugcaacgcuucggaaauauugcaucgaagccaaguugaccaacacaacuaccgagagucgcuguccaacacaaggagagcccucccugaaugaggaacaggacaaacgauuuaucugcaagcauucuaugguggauagaggcugggguaacggguguggacuauucggcaagggcgggauugucacuugcgcuauguuuaccugcaaaaagaauauggaaggaaaaguggugcucccugagaaccuggaauacacaauagucaucaccccacacagcggugaggagcaugccguuggcaaugacacugggaagcacggaaaagaaauuaagaucacgccgcaguccucaauaacagaggcagaacuuaccggcuaugguacugugaccauggaguguagucccaggacagggcuggauuucaacgaaaugguauugcuccagauggaggagaaggcuuggcuggugcaccggcaaugguuuuuagaccugccucucccauggcuucccggcgccgauacccagggaagcaauuggauucagaaggaaacucuggucacauucaagaacccucaugcgaaaaagcaggacgugguuguguugggcucucaagagggggccaugcacacggcacuaaccggagcuacugaaauccagauguccucagguaaucugcucuuuacaggccaucugaaaugccgucuucgccuggacaaguugcagcucaaagggaugagcuacaguauguguaccggaaaguucaagaucgucaaagagauugccgagacacaacacggcacuaucgugauuagaguacaguaugaaggugaugggucuccaugcaagauacccuucgagaucauggaccuggagaagaggcauguuuuaggccggcugauuaccgugaacccgaucgucacgggaaaggauuccccugugaacaucgaggcugaacccccauuuggcgacagcuacauuauaaucggggucgagccuggacagcuaaaacucaauugguucaagaaggguucgucuauuggccagauguuugagaccacaaugcgaggggccaaacgcauggcaauccugggagauacugccugggacuucggcucccuuggugggguguuuaccucaauuggcaaggcuuugcaccaaguuuucggagcgaucuacggcgcagccuuuaguggggugagcuggacaaugaaaauacugaucggaguaauuaucacuuggauuggcaugaacuccagaucuaccagccucucagucagucuggugcuuguugguguggucacgcuguauuugggggcuauggugcaggccgauuccggauguguagugagcuggaagaauaaagaacucaagugcggcucugguaucuucauaacagacaacguucacaccuggacugagcaguacaaguuucagcccgaaucaccaaguaaacuggcaagcgccauucaaaaggcucaugaggaaggcaucugugggauuagguccgucacacgguuagagaaucugauguggaaacagaucacccccgagcuaaaccacauacucucugaaaaugaggugaagcugacuaucaugaccggagauauuaaaggcaucaugcaggccgggaagcgcucgcuuagaccucagccaacagaauugaaauauagcuggaagacguggggaaaggcaaaaaugcuguccaccgagucacauaaccaaacuuuccucauugacggcccggaaacagcggagugccccaauaccaacagggcuuggaauagucuggagguggaagauuacgguuuuggggucuucacaacuaacaucugguuaaagcugcgugagaaacaggacguauuuugugacucuaaacuuaugagcgccgcaauaaaagauaaucgggccgugcacgcugacaugggauauuggauugaauccgccuugaacggcaccuggaagauggagaaggcaucauucaucgaggugaaaagcugccacuggccuaagucucauacgcucugguccaaugguguacuggaaagugagaugaucauucccaagaauuucgcuggccccgucagccagcacaacuaccgaccuggguaucauacacagaccgccggaccauggcaccuaggcaagcuggaaauggauuuugacuucugugaggggacuaccgugguugugacagaagauugcggaaauagaggccccucucucaggacuaccacagcguccgguaaacugaucacggaguggugcugucgcucaugcacccuuccgccuuugcgguacagaggggaggacggauguugguacggcauggaaauuaggccacugaaggagaaggaagagaacuuagucaauagucucgugacugccggucauggccaaauagauaacuuuagccuggggguucuuggaauggcucuguucuuggaagagaugcuccgcacacgagugggcaccaaacacgcaauccugcuaguagccgucucguuugugacucugauuacagggaauauguccuucaaggaccucggacgggugauggucaugguuggcguggcuaugaccgaugacaucgguauggggguaacguaucuggcccuuuuggcagcguuuaaagugcgucccacuuucgccgcuggacuguuacucagaaagcugaccucuaaagagcuuaugauggccacaauuggcaucacccugcuaagccagucaacuauaccugaaacaauccucgagcugaccgaugcauuggcucugggcaugauggucuuaaagauugugaggaacauggaaaaguaccagcucgccguuacaaucauggcaauuaguugcgugcccaaugccgucauccugcuuaacgcuuggaaaguguccuguacuauacuggcggccguuucugugagcccauugcuccugaccuccucacaacagaagacggacuggauuccucuagcacugacaaucaaagggcuuaaucccaccgcuaucuuucucacuacccugagccgcacaaguaagaaacggucuuggccauugaacgaggccgucauggccguaggaaugguguccauucuggcuagcucguuacucaagaaugauauaccgaugacugguccucugguugcaggcgggcuucugaccgugugcuaugucuugacgggaagaucagccgaccucgaacuggagagggcggcugacgugaaaugggaggaucaggccgaaaucucuggcaguucccccauucuaagcaucacaauuucugaggacgguagcauguccaucaagaacgaagaggaggaacagacccugacuauacuuauccgaacagggcuccugguaauuucaggaguguucccagucaguauccccauuaccgcagccgcuugguacuugugggagguuaagaaacaacgcgcaggcguguuaugggaugugccuagcccacccccugucggcaaggccgaacuggaggacggggcguaucggaucaaacagagaggaauacucgguuacucucagauuggcgcugggguguauaaggaaggaacuuuucacacaauguggcauguuaccaggggcgccguacugaugcaccgugguaaacgcaucgagccguccugggcagaugugaagaaggaccuuaucucauacgggggaggcuggaaacuggagggcgaauggaaggagggggaagagguccagguguuggcccuagaaccaggcaaaaauccccgggcuguucaaacgaagccuggucuguucaaaacuaacaccggcacaauuggggccgugagucucgauuuuagcccaggaaccuccggcucucccaucgucgacagaaaggguaaggugguagggcuguacggaaauggcgucgugacaaggucgggcgcauauguuagcgcuauagcccagacugagaaaucaauugaggauaacccugaaaucgaggacgauauuuuccgaaagaaacggcuuaccaucauggacuuacauccgggggcgggaaagacgaaacgcuaccugcccgccauagugagagaagcaauuaagaggggucuccggacauugauccuggcuccaacucgagucguggccgcugagauggaagaggcacucagaggccugccuauccgcuaucagacccccgccauuagggccgagcacacagggcgugaaaucguugaucuuaugugucaugcuaccuucacuaugcggcuguuguccccagugagagucccuaacuacaaucuaauuauaauggacgaggcgcacuuuaccgaccccgcaaguaucgccgcuaggggauauauuucuacacgcguggaaaugggcgaggccgcagguaucuucaugacggccacuccaccggggagccgagauccuuuuccccaguccaacgcuccaaucauggacgaggaaagagagauucccgaacggucauggaacucuggacacgaguggguaaccgauuucaagggcaaaacagugugguuuguuccuagcauaaaggcgggcaacgacaucgccgcaugccugaggaaaaaugggaagaaagucauucaacucagucgcaagaccuucgauuccgaauacgugaagacucgugcuaacgacugggauuuuguggucacaaccgacaucagcgagaugggagccaauuucagagcagagcggguaauugauccaaggcgcuguaugaaacccgugaucuuaacggacggugaagaacgaguuauacuggccggcccuaugccggugacucauucuucagcugcccagagacgggggagggucggacgcaacccaaagaaugaaaacgaucaguauaucuacaugggcgagccccuugaaaaugacgaggacugcgcgcacuggaaagaggcaaagaugcugcucgauaacauuaauacaccugaagguaucauucccuccauguuugagccagaaagagagaaaguggacgccaucgauggggaauacagguugcggggcgaggcucguaagaccuucguugaccugaugcgccgaggagaucucccuguguggcuggccuauagagucgcugcagagggcauaaacuacgccgacaggcggugguguuuugaugggauuaaaaauaaccaaauccuugaagagaacguggaaguagagauuuggaccaaggagggagaacgcaagaaacuaaagcccagauggcuggacgcuaggaucuauagugauccauuggccuuaaaagaguucaaggaguucgcagcgggucggaaaagccugacucucaaucugauaacagagaugggccgacuuccuaccuuuaugacacagaaggccagagacgcucuggauaaccucgccguguugcauacugcagaagcugggggacgcgccuacaaucacgcacugucggagcuaccggagacgcuggaaacccuccuucuguuaacauugcuggccacuguuaccggcgguaucuuccucuuucugaugucugggaagggcauuggaaaaaugacacuuggcaugugcugcaucauuaccgcuuccauccugcucugguaugcgcagauacagccccacuggauugccgcaagcaucaucuuggaguucuuucugauugucuuacuaaucccagaaccugagaagcaaaggacuccccaggacaaccagcugacguacguggugauagcuauucucaccgucguugccgccacaauggcaaaugaaaugggguuccuugagaaaacuaagaaagaucugggauuggguucaaucaccacacaggagagugaaucuaacauucuggacaucgaccuccggccagcuuccgccuggacccuguaugcgguggcuacuacauuuguaacgccuaugcuucgucauagcauagaaaauucaagugugaacgucagccucaccgccaucgcaaaucaagccacugugcugaugggcuuggggaagggauggccccuguccaagauggauauuggcguuccguuacuagcuaucgguuguuacucucaggugaacccaauuacacugaccgcagcccuccuucuguuggucgcgcacuacgcuaucauugggccuggccugcaggccaaagcaaccagagaagcccagaagagggcugccgcaggaaucaugaaaaaucccacaguagacggcauaacugugauugaucucgagccaauccccuaugacccuaaguucgaaaaacaacuggggcagguuaugcuuuuaauccugugcgugacgcagguccucaugaugcgcaccacaugggcuuugugugaggcccugacucuagcgaccggaccgauuagcacacugugggagggcaaccccggucgguuuuggaauaccacuauagccguguccauggcaaacaucuuccgagggucauaccucgcuggagccggccuucuguuuucuauuaugaagaauacgacaaacaccagaagggguacuggcaauaucggggaaaccuugggagagaaguggaaaagucgccugaacgcacucggcaagucggaguuccagauuuauaaaaagagcgggauccaagaggucgaucggacacuggcuaaagagggaauaaagagaggcgaaacugaccaucacgccgugucccgugguucugccaaauuaaggugguuuguugagcggaacauggugaccccagaagggaagguaguggaucuuggaugcggccgcgguggcuggucauacuauugugggggacugaagaauguccgagagguuaaaggccucacaaaaggcgggccugggcaugaagaaccaaucccuaugagcacguacgguuggaaccuagugagacugcaguccggggucgacguguucuucaccccacccgagaaaugcgauacuuugcugugugacauuggagaaaguucuccuaauccaacaaucgaggcgggcaggacccuccggguacuuaaccugguggaaaauugguugaacaauaacacucaguuuugcauuaagguucugaaucccuauaugccgagcgugaucgagaaaauggaaacacuccaacgcaaguacggcggggcuuuagucagaaacccucugucaagaaauuccacccacgagauguacugggugaguaacgcaacgggaaauauagucagcucugugaacaugauuucccgaaugcuuaucaaucgguucaccaugaagcacaaaaaggccacauaugagccagauguugaccuggguucaggcacucguaacaucgggauugaaagcgagauacccaaccuagauaucauuggaaaaagaaucgaaaagauuaaacaggagcaugaaaccucguggcacuacgaccaggaccauccuuauaagacaugggcuuaccacggcucuuaugagacuaagcagaccgguagugccuccagcaugguaaauggggugguccgccuccugacaaaaccaugggaugugguucccauggugacccaaauggcaaugacugacacgacaccguuuggacagcagagggucuucaaggagaaaguggauacccggacucaggaaccuaaggagggcaccaaaaaguugaugagaaucacagccgaauggcuguggaaggagcucggcaaaaagaaaacgccccgcauguguaccagggaggaauuuacucgaaagguacggucaaacgcugcgcuuggggccauauucacagacgagaauaaauggaaguccgcaagagaagcuguggaggauucuagguuuugggaacugguugaccgcgagcguaacuuacaccuggagggaaaaugcgaaaccugugucuacaauaugauggguaagcgggagaagaaauugggcgaguucgggaaggccaaaggaagcagagcaaucugguauauguggcucggcgccagguuucuggaguucgaagcucuagguuuucuuaacgaggaucauugguucagucgcggaaauucccugagcggaguggagggcgaaggccuccaccgacugggguacauuuugcgggacgugucuaagaaagagggaggugccauguacgcggaugacacugcaggcugggauacaagaaucacccuggaagaccucaagaacgaggaaauggucacaaaucauaugaagggggagcacaagaaacuugccgaggcuauuuuuaaacugacuuaucaaaacaaaguugugaggguacagcgcccaaccccuagaggaacggugauggacaucauuucacggagggaucagcguggcaguggucaggucgggaccuacggauuaaauacauucacuaacauggaagcccaacugauacgacagauggagggcgaaggcaucuucaaauccauucagcauuugaccgugacagaggagaucgcaguucaaaauuggcucgcucgcguggggagagaacggcugagcaggauggccaucucuggagacgauugcgucgugaagccccuagacgaucgcuuugcuucggcccuuacugcacugaacgacauggguaagguaagaaaagauauucagcagugggagccaucacggggcuggaaugacuggacccagguucccuucugcagccaccacuuucaugaacucgugaugaaggaugggaggguccugguggugccuugucgaaaccaagacgaguugauaggacgugcgagaaucucccagggcgccgguuggaguuuaaaagaaacggcuugccuggggaagucuuaugcccagauguggacacucauguacuuccaccgccgggaucuuaggcuggcagcuaacgccauuuguagcgcagucccaucccauuggguuccgaccucaagaacuacauggaguauccacgccaaacacgaguggaugaccacugaggacaugcuagcgguguggaaucgcguauggauucaggaaaaccccuggaugggagauaagaccccuguggagucuugggaagaggucccauaucugggcaagcgggaagaccaauggugcggcagccucaucggguugacauccagggcuacgugggccaaaaauauacagaccgcaaucaaccaggugcgaucacugauuggaaaugaggaguacacugacuauaugcccagcaugaagagauuucggagggaagaggaagaggccgguguucuuugg

SEQ ID NO: 15003 - RNA, 9873 nt, Artificial Sequence
  derived and/or modified CDS sequence (opt3) from DENV-2__HQ012537__SS-prME
accgcaggcgugaucauuaugcugauaccaacggcuauggcuuuccaccucacuacgagaaacggggaaccucauaugaucgucggaaggcaggaaaaggguaaaagccuucuguuuaagaccgaggacggcguuaauaugugcacauugauggccauugauuuaggggaacugugugaggacacuaucaccuacaaaugcccacuucuccggcaaaacgaaccggaggauauugacuguuggugcaauuccacaucuaccugggugacuuauggaacauguaccacgacuggcgagcaccgccgagaaaagcguucaguugcgcuggugccccaugucgguauggggcuugagaccagaacagaaacuuggaugaguagcgagggagcuuggaaacacgugcagaggaucgagaccuggauacugcggcauccuggcuucgccaucauggcagccauuuuggcuuacacaaucggcaccacgcacuuucagcgcgcacucauuuucauccugcugacugccguugcuccauccaugacaaugagaugcauagggauuucuaacagggauuuuguggaaggagucucggguggcucauggguggacaucguacucgagcacgggagcuguguuaccacuauggccaagaauaagcccacauuagauuucgaacugauuaaaaccgaggcgaagcagccugcaacgcuucggaaauauugcaucgaagccaaguugaccaacacaacuaccgagagucgcuguccaacacaaggagagcccucccugaaugaagaacaggacaaacgauuuaucugcaagcauucuaugguggauagaggcugggguaacggguguggacuauucggcaagggcgggauugucacuugcgcuauguuuaccugcaaaaagaauauggaaggaaaaguggugcucccugagaaccuggaauacacaauagucaucaccccacacagcggugaggagcaugccguuggcaaugacacugggaagcacggaaaagaaauuaagaucacgccgcaguccucaauaacagaggcagaacuuaccggcuaugguacugugaccauggaguguagucccaggacagggcuggauuucaacgaaaugguauugcuccagauggaggagaaggcuuggcuggugcaccggcaaugguuuuuagaccugccucucccauggcuucccggcgccgauacccagggaagcaauuggauucagaaggaaacucuggucacauucaagaacccucaugcgaaaaagcaggacgugguuguguugggcucucaagagggggccaugcacacggcacuaaccggagcuacugaaauccagauguccucagguaaucugcucuuuacaggccaucugaaaugccgucuucgcauggacaagcugcaguugaaagggaugagcuacaguauguguaccggaaaguucaagaucgucaaagagauugccgagacacaacacggcacuaucgugauuagaguacaguaugaaggugaugggucuccaugcaagauacccuucgagaucauggaccucgagaagaggcauguucugggccgguuaauuaccgugaacccgaucgucacggagaaggauuccccugugaacaucgaagcugagcccccauuuggagacagcuacauuauaaucggcgucgagccugggcagcugaaacuaaauugguucaagaagggaucgucuauuggucagauguuugaaaccacaaugcgaggcgccaaacgcauggcaauccucggggauacugccugggacuucggaucccugggcgguguguuuaccucaauugggaaggcacuucaccaaguuuucggcgcgaucuacggagcagccuuuaguggcgugagcuggacaaugaaaauauugaucgggguaauuaucacuuggauuggaaugaacuccagaucuaccagccugucagucagucucgugcugguuggcguggucacgcuuuaucugggugcuauggugcaggccgauuccggguguguagugagcuggaagaauaaagaguugaagugcggaucuggcaucuucauaacagacaacguucacaccuggacugaacaguacaaguuucagcccgagucaccaaguaaacucgcaagcgccauucaaaaggcucaugaagaggguaucuguggcauuagguccgucacacggcuggagaauuuaauguggaaacagaucacccccgaacugaaccacauacuaucugagaaugaagugaagcucacuaucaugaccggggauauuaaaggaaucaugcaggccggcaagcgcucgcugagaccucagccaacagagcuuaaauauagcuggaagacgugggggaaggcaaaaauguuguccaccgaaucacauaaccaaacuuuccugauugacggaccggagacagcggagugccccaauaccaacagggcuuggaauagucucgaaguggaggauuacggcuuuggugucuucacaacuaacaucuggcugaaguuacgugaaaaacaggacguauuuugugacucuaagcugaugagcgccgcaauaaaagauaaucgggccgugcacgcugacaugggguauuggauugaguccgcccuuaacgauaccuggaagauggagaaggcaucauucaucgaagugaaaagcugccacuggccuaagucucauacguugugguccaauggaguacucgagagugaaaugaucauucccaaaaauuucgcuggccccgucagccagcacaacuaccgaccugguuaucauacacagaccgccggcccauggcaccuggggaagcuagagauggacuuugauuucugugaaggaacuaccgugguugugacagaggacugcggcaauagagggcccucucugaggacuaccacagcguccggaaaacucaucacggaguggugcugucgcucaugcacccugccgccucuucgguacagaggcgaagaugguuguugguacgggauggagauuaggccauugaaggaaaaggaggaaaaccuggucaauaguuuagugacugccggacauggccaaauagacaacuuuagccucgguguucugggcauggcucuuuuccuggaggagauguugcgcacacgaguggggaccaaacacgcaauccuccugguagccgucucguuugugacucuaauuacaggaaauauguccuuccgggaucugggccgugugauggucaugguuggggugaccaugacggacgauaucggaaugggcguaacuuaucucgcucugcuugccgcauuuaaggugagacccaccuucgcggccgguuugcuguuaaggaaacucacaucuaaggaacugaugauggcuaccauugggaucgcccuucugagccagucaacuauaccugagacaauccuagaacucaccgacgcacuggcuuugggaaugaugguccugcgcauugugcggaacauggagaaauaccaguuagccguuacaaucauggcaauuaguugcgugcccaaugccgucauccuccugaacgcuuggaagguguccuguacuauacuugcggccguuucugugagcccacuguugcucaccuccucacaacagaagacggauuggauuccucuggcacuaacaaucaaaggccugaaucccaccgcuaucuuucuuacuacccucagcagaacaaguaagaaaaggucuuggccacugaacgaagccgucauggccguaggcaugguguccauuuuggcuagcucgcuguuaaagaaugacauaccgaugacugggccucucguugcaggaggucugcuuaccgugugcuauguccugacgggccgaucagccgacuuggagcucgagcgcgcggcugaugugaaaugggaagaccaggccgagaucucugggaguucccccauucugagcaucacaauuucugaagauggaagcauguccaucaagaacgaggaggaagaacagacccuaacuauacugauccggacaggccuucucguaauuucagguguguucccagucaguauccccauuaccgcagccgcuugguaccugugggaaguuaaaaagcaaagagcagggguguugugggacgugccuagcccacccccugucgagaaggccgaauuagaggauggagcguauaggaucaaacagcguggcauacugggcuacucucagauuggggcuggaguguauaaggaggguacuuuucacacaauguggcauguuacccgcggcgccguacucaugcaccgggggaaaagaaucgaaccguccugggcagacgugaagaaagaucugaucucauacggaggcgguuggaaacuugagggggaauggaaggagggagaagagguccaggugcuggccuuggagccaggcaaaaaucccagggcuguucaaacgaagccuggccuauucaaaacuaacaccgggacaauuggagccgugagucuggacuuuagcccagguaccuccggcucucccaucgucgaucgaaaggggaaagugguaggacucuacggcaauggugucgugacacggucgggggcauauguuagcgcuauagcccagacugaaaagucaauugaggacaacccugaaaucgaggaugacauuuuccgcaagaaaagacugaccaucauggaucuucauccgggagcgggcaagacgaaaagguacuuacccgccauagugcgggaagcaauuaagcgaggccugagaacacucaucuuggcuccaacucgcgucguggccgcugagauggaggaagcacugagggggcucccuauccguuaucagacccccgccauucgggccgagcacacaggaagagaaaucguugaccugaugugucaugcuaccuucacuaugaggcuucuguccccagugcgcgucccuaacuacaauuugauuauaauggacgaggcgcacuuuaccgaucccgcaaguaucgccgcucgagguuauauuucuacaagaguggagaugggcgaagccgcagggaucuucaugacggccacuccaccgggaagccgggacccuuuuccccaguccaacgcuccaaucauggaugaggaaagggagauucccgaacgcucauggaacucuggccacgaguggguaaccgacuucaaagguaagacagugugguuuguuccuagcauaaaggcggggaacgauaucgccgcaugccuacguaaaaauggaaagaaagucauucaacugaguagaaagaccuucgacuccgaguacgugaaaacucgggcuaacgauugggacuuuguggucacaaccgauaucagcgaaaugggcgccaauuucagggcagagcgcguaauugacccacgaagauguaugaagcccgugauccucacggauggcgaagaacggguuauauuagccgggccuaugccggugacucauucuucagcugcccagaggcgcggaagaaucgguaggaacccaaagaaugaaaacgaccaguauauuuacaugggcgagccccuggagaaugacgaagauugcgcgcacuggaaagaggcaaagaugcuucuggacaacaucaauacaccugaagggauuauccccuccauguuugagccagaacgggagaaagucgaugccauagacggagaguaccgucuccgcggcgaagcucgaaagaccuucguggauuugaugagaaggggugaccugccuguuuggcucgccuaucggguggcugcagaggggauuaacuacgccgaucgcagaugguguuuugacggcaucaaaaauaaccaaauucuggaagagaacgucgagguggaaaucuggaccaaggagggagaaaggaagaaacuuaaaccccgguggcuagaugcucgaauauauagugacccacuggccuugaaagaguucaaggaguucgcagcgggcagaaagagcuuaacucugaaucucaucacagagauggggcgccugccuaccuuuaugacacagaaggccagggaugcucuugacaaccuggccguacuccauacugcagaggcuggaggucgggccuacaaacacgcauugucggaacugccggagacgcuagaaacccugcuccuucugacauuauuggccacugugaccggcgggauuuuccuguuucucaugucuggaaagggcaucgguaagaugacacuggggaugugcugcauuaucaccgcuuccauacuucugugguaugcgcagauucagccccacuggaucgccgcaagcaucauucucgaguucuuuuugaucguucuguuaauaccagaaccugagaaacaacguacuccccaggauaaucagcuaacguacgucgugauugcuauccugaccguggucgccgccacaauggcaaacgagaugggcuuccucgaaaagacuaaaaaggaccuuggacugggcucaauuaccacacaggagagugaaucuaauaucuuggacauagaucugagaccagcuuccgccuggacccucuaugcgguugcuacuacauuugugacgccuaugcugaggcauagcaucgagaacucaaguguaaaugugagccuuaccgccauugcaaaccaagccacuguccucauggggcugggaaaagguuggcccuuguccaagauggacaucggcgugccgcuguuagcuauuggguguuacucucagguuaauccaaucacacuaaccgcagcccugcuccuucugguggcgcacuacgcuauuaucggaccuggcuugcaggccaaggcaacccgcgaagcccagaaacgggcugccgcagguauaaugaagaaccccacagucgaugggauuacuguaaucgaccuggagccaauccccuaugauccuaaauucgagaagcaacucggccaggugaugcugcuuauuuuaugcguuacacaggugcugaugaugcgaaccacaugggcucucugugaagccuugacucuggcgaccggaccgauaagcacacuaugggagggcaaucccgggagauuuuggaacaccacuaucgccgucuccauggcaaauauuuucaggggaucauaccuggcuggcgccggucuccuauuuucuaucaugaaaaacacgacaaauacccgccgggggacuggaaacauuggcgaaacccugggugagaaguggaagaguagauugaaugcacugggcaaaucggaguuccagaucuauaagaaaagcgggauacaagaaguggaccguacacucgcuaaggagggaaucaaaaggggcgaaacugaucaucacgccgucucccgggggucugccaagcugcgcugguuuguggagcgaaacaugguuaccccagaaggaaaagugguagacuuaggcugcgguagagggggauggucauacuauuguggcggucuuaagaacgugagggaggucaagggccugacaaaagggggaccuggccaugaggaacccauuccuaugagcacguacggguggaaucucguucggcuacaguccggaguggaugucuucuucaccccacccgagaagugcgacacucuguugugugauaucggcgaaaguucuccuaacccaacaauugaggcgggucgcacccugagagugcucaaucuugcugaaaacuggcugaauaacaauacucaguuuugcaucaaaguauugaaccccuauaugccgagcgugauagagaagauggagacacugcaaaggaaauacgggggagcacucguucgaaauccuuuaucacggaacuccacccacgaaauguacugggugaguaaugccacgggcaacauugucagcucugugaauaugaucucccguaugcugaucaacagauucaccaugaagcacaagaaagcuacauaugagccagacgucgaucuuggcucagggacucgcaauauuggaauagaaagcgagauccccaaccuggacauuaucgguaagaggauugagaaaaucaagcaggagcaugagaccucguggcacuacgaccaggaucauccuuauaaaacaugggccuaccacggcucuuaugaaacuaagcagaccgggagugcauccagcauggugaacggaguuguacggcuacucacaaagccaugggacgugguccccauggugacccaaauggccaugacugauacgacaccguuuggccagcagagaguuuucaaagagaagguggacacccgcacucaggaaccuaaagaggguaccaagaaacugaugaggauaacagcugagugguuguggaaggaacuggggaagaaaaagacgccccgaauguguacccgggaggaauuuacuagaaaagucaggucaaaugcggcccucggagcaaucuucacagaugagaacaaguggaaauccgcucgcgaagccguggaggacucucguuuuugggagcuuguagaucgggaaagaaaucugcacuuagagggcaagugcgaaaccuguguguacaacaugaugggcaaaagggagaagaagcugggggaguucggaaaagcaaaggguagccgcgccauuugguauaugugguugggcgcucgauuucucgaguucgaggcccugggguuucuaaaugaagaccauugguucagucggggaaacucccuuagcggcguugagggugaagggcugcacagacucggauacauccugagggaugucucuaaaaaggagggcggcgcgauguacgcagacgauacugccgggugggacacacgcauuaccuuggaagaccugaaaaaugaggagauggugacaaaccauaugaagggagaacacaagaaacucgcugaggccaucuuuaaacuuacuuaucaaaauaaaguggucagaguucagcggccaaccccuagggguacggugauggauauuauaucacguaaggaccagcgaggcagugggcagguaggaaccuacggccugaacacauucacuaauauggaagcacaauuaauccgccagauggagggugaggggauuuucaaauccauccagcaucugaccgugacagaagagaucgcuguccaaaacugguuggccagagugggacgggaaaggcucagccgcauggcuauuucuggcgaugacugcguugugaagccccuggaugacagauuugccucggcacuaacugcgcuuaaugauaugggcaagguccggaaagacauacagcagugggagccaucaaggggguggaacgauuggacccaggugcccuucugcagccaccacuuucaugaacugguaaugaaggacggacgaguucucguggucccuugucguaaucaagaugagcugaucgguagagcccgcauuucccagggcgcuggguggaguuugaaagagacggccugcuuaggaaagucuuaugcacagauguggacacugauguacuuccaccggagggaccucagacuugcugccaacgcaaucuguagcgccgugccaucccauugggugccgaccucacgcacuacauggaguauucacgcgaaacacgaauggaugaccacugaggauaugcuggcugucuggaaccggguuuggauccaggaaaaucccuggauggaggacaagaccccuguggaaucuugggaggagguaccauaucuaggcaagagggaagaccaauggugcgguagccugauagggcucacaucccgagccacgugggccaaaaacauccagaccgccauuaaucaggugagaucauugaucggaaacgaggaauacacugauuauaugcccagcaugaagcgguuuaggcgcgaggaagaggaggcuggcguccugugg

SEQ ID NO: 15004 - RNA, 9876 nt, Artificial Sequence
  derived and/or modified CDS sequence (opt3) from DENV-2__KU365901__SS-prME
accgccggaaucauuauaaugaugauccccacagugauggcuuuccaccugacuacgagaaauggggaaccucauaugauugucagcaggcaggaaaagggaaagucccuccuuuuuaagaccgagaaugguguuaacaugugcacacugauggcaauggacuugggcgaauuaugugaggauacuaucaccuacaauugcccacugcuccggcaaaacgaaccggaggacauugauuguuggugcaauucuacaucaaccugggugacuuaugggacauguaccgccacgggagagcaccgccgagaaaaacguaguguagcgcucgugccccaugucggcaugggucuggagacucggaccgaaacauggaugagcuccgagggggcuuggaagcacgcccagaggaucgagacuugggugcuucggcauccuggauucaccauaauggcagccauccuggcuuacacaauuggcaccacguauuuucagcgcguuuugaucuucauucuccugacugcaguggccccaucuaugacaaugagaugcaucggcauaucgaacagggacuuugucgaaggggugucaggagguagcuggguagauauuguucuggagcacggcaguugugugaccacuauggcuaaaaauaagcccacacucgacuucgaauuaaucaagaccgaggccaaacacccugcgacgcugcggaaguacugcauugaagcaaaacuuaccaacacaacuaccgccucccgcuguccaacacagggggagcccucuuugaaugaggaacaagauaagcgauuugucugcaaacauagcaugguggacagaggauggggcaacgguugugggcuguucggaaagggcggcaucgugacuugcgcuauguuuaccugcaagaaaaauauggaggggaagaucguccagccugaaaaccuggaguauacaauuguuauaaccccacacuccggagaagagaaugccguggguaacgauacuggcaaacaugggaaggagaucaaaguaacgccgcagucaaguauuacagaagcagagcucaccggauacggcacugugaccauggaauguagccccaggacaggucuggacuucaaugagaugguccuucugcagauggaaaacaaggcuugguuggugcaccggcaaugguuucucgaucugccuuuaccauggcugcccggggccgacacccagggcucuaacuggauccagaaagagacucucguuacauucaagaauccucacgcgaagaaacaggauguggucgugcuuggaucccaagagggcgccaugcauacggcacugaccggggcuacugaaauacagaugucaagcggaaacuugcuauuuacaggucaccugaagugccgucuccgcauggacaaacugcagcuuaagggcaugaguuauucuauguguaccgggaaauucaagguaguuaaggagauugccgaaacacaacauggaacuaucgugaucagaguccaguacgagggcgacgguuccccaugcaaaauucccuucgagaucauggaucuggaaaagaggcacguguuggggcggcucauuaccgucaauccgauagugacggagaaagacagcccuguuaacaucgaagcugagcccccauuuggcgauucguacauuaucaucggaguggaaccuggccagcugaaguuaucuugguucaaaaagggguccucaauuggacagauguuugagaccacaaugcgaggugccaagcgcauggcaauacugggcgacacugccugggauuucgggagucuaggaggcguauuuaccagcaucgguaaagcucuccaucaagucuucggggcgauuuauggcgcagccuuuuccggagugucuuggacaaugaagauccugauuggcguugugaucacuuggauagggaugaauagcagaucaaccagucuuuccgucagcuuggugcugguaggagugguuacgcucuaccugggcgucauggugcaggcugacucugguuguguggucucauggaaaaacaaggagcuuaaaugcgggaguggaaucuucauuacagauaauguucacaccuggacugaacaguauaaguuucagcccgagagcccauccaagcuggccucugcaauccaaaaagcccacgaagagggcauuugugguaucaggucggugacacgguuggaaaaccucauguggaagcagauaacccaggagcugaaucauauuuuaagcgagaacgaagugaaacugacuaucaugaccggcgacauuaaggggaucaugcaggcuggaaaacgcucccuaagaccccaaccuacagagcucaaguacucauggaaaacguggggcaaggccaagaugcugaguaccgaacuucacaaucauacuuucuugauagaugggccagagacagcagaaugcccgaacaccaauagggcguggaacucucuggagguagaggacuauggauuuggcgucuucacaacuaauaucuggcucaaacugaaggaaaaacaggauguguuuugugacagcaaguuaauguccgcugccauuaaagacaaccgugcaguucacgccgauauggguuacuggaucgagucagcucugaacgacaccuggaagauugaaaaggccagcuucaucgaggugaaaucuugcaauuggcccaagucccacacgcuuuggaguaacggggucuuggagagcgaaaugauaauuccuaaaaauuucgcaggaccagugucucagcauaacuaucggcccggcuaccacacacagaccgcugguccuuggcaucucggccgacuggagauggauuuugaguucugugaggggacuaccguugugguaacagaagacugcggaaauagaggcccaucccuaaggacuaccacagccucagggaagcugaucacggaguggugcugucgcaguugcacccuacccccgcugcgguacagaggagaggauggcuguugguaugguauggaaaucaggccucuuaaagagaaggaagagaacuuggucaauagccuggugacugcggggcacggacaaauugacaacuuuucguuaggcgugcucgguauggcccuguuccuugaagagaugcugcgcacacgagucggcaccaagcaugcuaucuugcucguugcagugacuuuuguaacacugauuaccgggaauauguccuuccgggaucuaggacgugugauggucauggugggcgccacgaugacugacgauauagggaugggaguuaccuaccuggcucuccuggccgcauuuaaagugagaccaacauucgcggccggccuuuugcugaggaaguuaaccucuaaagagcucaugauggcuacuaucgguauuguccugcuuagccagucaacaauccccgaaaccauucuggagcuaacagacgcccucgcacuggggaugaugguguugaagaucguucgcaacauggaaaaauaucagcuggcugugacuauaauggccaucuuaugcgucccuaaugcaguaauucuccaaaacgccuggcgggugaguuguaccacgcuggcuguuguguccgucucuccccuucuguugacaagcucccagcagaaggcggauuggaucccacucgcccugaccauuaagggacuaaauccuacugcaaucuuucugaccacacuuucaagaacuagcaaaaagaggaguuggccccucaacgaggcuauaauggccgugggcaugguaucuauucuggccuccagcuugcugaaaaaugacaucccaaugaccggcccguuaguggcugggggacuccugacggucugcuacguucuuacaggucgaucggcagaucuggaauuggagcgcgccgcggacgugcggugggaggaacaggcugagaucucaggcucuaguccuauucucuccauaaccaucagcgaagacgggucuaugagcauuaagaacgaggaggaagaacaaacucugacaauccuaauuagaaccggacugcuugugaucuccggccucuuccccgucucaauaccaaucacugccgcagccugguaucugugggaagugaaaaagcagagggcugguguuuugugggauguacccaguccuccacccguggggaaagcagaguuagaagacggagccuaccguauuaagcagaagggcauccugggcuauagccagauuggggcgggagucuacaaagaggguacauuucacaccauguggcacgugacgcgcggcgcuguucucaugcauaaggggaaacggaucgagccuucuugggccgaugugaagaaagaccugauauccuacggaggcgguuggaaacuugaaggggaguggaaggaaggagaggaaguccaagugcuggcauuggagccgggcaaaaacccaagagccguacagacuaagcccggccuauucaaaaccaauacagggaccauuggagcugucucacuggauuuuaguccugguacaagcggcuccccaaucguggacaagaaagggaagguugugggacucuauggcaacggugucgugacuaggucugggaccuacguuucggccaucgcacagacggaaaagagcauugaagauaaucccgagaucgaagacgauauauucagaaagaagcggcugacaauuauggaccuucacccuggagcuggcaaaacuaagcgcuauuuaccggccaucgugagagaggcgauuaaaaggggccugcggacccucaucuuggcccccacacgagucguggcagcugaaauggaggaggcccugagagggcucccaauacgcuaccagaccccugcuauuagggcagaacauacuggacgugagaucguagaucugaugugucacgccaccuucacaaugcggcuucugucacccaucagagugccaaacuauaauuugauuaucauggacgaagcccauuuuacggauccugcuuccauugcggcaagggguuacauaaguacucgcguugagaugggcgaggccgcugggaucuucaugaccgccacacccccaggaucucgagacccguuuccucaaagcaacgcacccauuauggacgaagagagagaaaucccagagcgguccuggaacucaggccacgaaugggucaccgauuucaaggguaagacugugugguuugugcccucuaucaaagccgggaacgacauugcugcgugccuaaggaagaauggcaagaaggucauacagcugagccgcaaaacauucgauagugaguauaucaagacccguacgaacgacugggauuuuguagugacuacagacauuuccgagaugggcgccaauuucaaggcagaaagaguuaucgauccucggagguguaugaaaccagugauucucaccgacggcgaggaacgcgucaucuuagcugggcccaugccugugacccacagcucugccgcacagcgaagaggacggguugguaggaacccgaagaaugagaacgaucaauacauauacaugggcgaaccacuggagaaugacgaggauugcgcccauuggaaagaagcuaagaugcuucuggacaacaucaacacucccgaggggauuaucccuucaauguuugaacccgagcgcgaaaaaguggacgccauugauggagaguauagacucaggggcgaggcgcggaagacauucgucgacuugaugcgucgcggugaucugccaguguggcucgcauaccgaguagccgcugaagggaucaauuaugccgacagaaggugguguuuugauggcgugaaaaacaaucagauacuggaggaaaacguugaggucgagauuuggaccaaggaaggagagcggaagaaacuuaagccucgcuggcuagacgcuagaaucuacuccgauccccuggcauugaaagaguucaaggaguucgccgcuggcaggaaaaguuuaacacugaaucucauuacugaaauggggcggcugccaacguuuaugacccagaaggcccgaaacgcacuugacaaucuggcggugcuccacacagccgaggcuggagguagagccuauaaccaugcauugagcgagcugccugaaacucuagagacccugcuccuucugacauuauuggcuaccgugacuggcgggaucuuccuguuucucaugucgggaaagggcauagguaaaaugacgcuggggaugugcugcaucauuaccgccucuauccuucugugguacgcacagauucaaccgcacuggaucgccgcuuccauaauucucgaguucuuuuugaucguccuguuaauccccgagccagaaaagcagcgcacaccucaggauaaucagcuaacuuauguugugauugcgauccugaccguaguggccgcaacaauggcuaacgagaugggcuuccucgagaaaaccaagaaagacuuuggacuuggcagcauaacuacacaacagcccgaaucaaauauucuggauaucgacuugaggccagccagugccuggacgcuguacgcagucgcuaccacuuucauuacaccuaugcuccggcacucuaucgagaacuccagcgugaauguuucacugaccgccauagcgaaccaggcuaccgugcuuauggggcucggaaaggguuggccccugaguaagauggauaucggcgucccguugcuggccauuggguguuacagccagguaaauccaaucacauuaacugcagcccuacugcuccuuguggcucauuaugcaauuaucggaccuggccugcaagccaaagcgacgcgugaagcucagaagagagccgcagccgguauuaugaaaaaccccaccguugacgggaucacagugauagacuuggauccaauucccuacgacccuaaguuugagaaacagcugggccaggucaugcuccuggugcuuugcgucacucaaguguuaaugaugaggaccacaugggcucugugugaagcccucaccuuggcaacuggaccgaucuccacgcugugggagggcaaucccgggcgcuucuggaacacaaccaucgcuguuucuauggccaacauuuuucggggaagcuaucuagcgggcgccggucuacucuucuccauaaugaagaauacugcaaacacccgaagagggacaggaaauacuggcgagacccuuggugaaaaguggaaaaacaggcugaaugcuuugggcaagucagaguuucagaucuacaaaaagucugggauucaggaaguggaucgcacacuggccaaagagggaaucaagcggggcgagacggaccaccaugcaguaaguagagggucggcuaaacuccguugguucguggaaaggaaccuggucaccccagagggaaagguuguggauuuaggcugcgguagaggcggguggagcuauuacugugggggucuuaagaaugucaaagaagugaagggccugacuaaagggggaccuggccacgaggaacccauuccuauguccacauauggguggaaccucguacgccuacaaucuggaguggacguuuucuuuaccccacccgagaagugcgauacucuguugugugacaucggcgagucaagcccuaauccaacaguggaagccggucgaacccugagaguccucaaccuuguggagaauuggcugaacaauaacacgcaguucugcauaaaagucuugaaucccuacaugccguccgugaucgaaaagauggaggcccugcagaggaaguacgggggagcgcucguucggaacccuuuaagucgcaacucuacccaugaaauguauuggguaagcaaugcuucaggcaacauuguguccagugucaauaugaucagcagaaugcugauuaacagguuuacaaugcgacacaaaaaggcaacuuacgagccagauguggaccuuggcucugggacccggaauaucggaauagaguccgaaacacccaaccuggauauuaucgguaaacguaucgagaagauuaaacaggaacacgagacuucauggcauuaugaccaagaucacccuuacaagaccugggccuaucauggcagcuacgaaacaaagcagaccgggucggcuucuaguaugguuaauggaguggucagacuacucacuaaaccaugggacgugauacccaugguaacgcagauggccaugacagacaccacuccguucggccagcaacgcguguuuaaggagaaaguugauaccaggacacaggagccuaaggaagguacgaaaaagcugaugaagaucaccgcagagugguuguggaaagaacuggggcggaagaaaacucccagaauguguacacgcgaggaguucaccaggaagguccgauccaacgccgcucucggagcgauuuuuacugacgaaaauaaauggaaaagcgcccgggaggcaguggaagauucaggcuucugggagcuuguggacaaagaaagaaaccugcacuuagagggcaagugcgagacaugugucuauaauaugauggggaagagggagaaaaagcugggagaauuugguaaagcuaagggcucccgcgccaucugguacaugugguugggggcacguuuccucgaauuugaggcccugggauuccuaaacgaagaucacugguuuucucgggagaauagccuuaguggcguugagggugaagggcugcauaaacucggauacauucugagagacguguccaagaaggagggcggcgcuauguaugccgaugacaccgcggggugggauacaaggaucacuuuggaagaccugaaaaacgaggaaaugguaaccaaucacauggagggagagcauaagaaacucgcagaagccauauucaaacuuacguaccagaacaaagugguccgcgugcagcgaccaaccccucgggguacaguuauggauaucauuagcagaagggaccaacgcggcucuggacagguggucacuuauggacugaacaccuucacaaauauggaggcucaguuaaucagacaaauggaaggcgaggguguguuuaagucaauucagcagcugacuguaaccgaggaaaucgccguuaagaacugguuggcacggguggggagggagcgucucagucgaauggcuauuuccggagacgauugcgucgugaaaccccuggacgaucgcuucgccagcgcucuaacggcccuuaaugacaugggcaaggugagaaaagauauacagcaaugggaaccaucucggggcuggaacgacuggacacagguccccuuuugcucgcaccauuuccacgagcugaucaugaaggaugggaggguucucgugguaccuugucgcaaucaggacgaacugauuggacgagcacggaucucacagggugcgggcuggagcuugagggagaccgccugcuuagggaaauccuacgcucaaauguggagucugauguauuuucaccgacgugaucucagacuugccgcaaacgcuaucuguucugccgugccaagccauugggucccgacuucccgcacaaccuggucaauucacgcaacucaugaguggaugaccacagaagacaugcugacgguguggaaucggguuuggauacaggagaaccccuggauggaagauaagaccccuguggagaguugggaagagaucccauaccuaggaaagagggaggaccaguggugcggcucucugauuggucucacuagcagagccacaugggcgaaaaauauccagaccgcuauuaaccaaguccgcuccuugaucgggaaugaagaguauacugauuacaugcccucaaugaagcgguucaggcgagaagaggaagaggccggagugcugugguga

SEQ ID NO: 15005 - RNA, 9876 nt, Artificial Sequence
  derived and/or modified CDS sequence (opt3) from DENV-2__GQ398258__SS-prME
accgccggcaugaucauuaugcugauacccacagugauggcuuuccaccucacuacgcgaaacggggaaccucauaugaucgucagcaggcaggaaaaggggaaaucccuucuguuuaagaccgaagacgguguuaauaugugcacauugauggcaauggauuuaggcgaacugugugaagacacuauuaccuacaacugcccacuacuccggcaaaaugaaccggaggauaucgacuguuggugcaacucuacaucaaccugggugacuuaugggacauguaccgccacgggagagcaccgccgagaaaaacguaguguagcgcuggugccccaugucggcaugggucuugagacucgaaccgaaacauggaugagcuccgagggggcuuggaagcacgcccagaggauugagacuuggauccugcggcauccuggauucaccauaauggcagccaucuuggcuuacacaauuggcaccacguauuuucagcgcgugcucaucuucauucugcugacugcaguugccccaucuaugacaaugagaugcaucggcauaucgaauagggauuuuguggaaggggucucaggagguagcuggguggacauuguacucgagcacggcaguuguguuaccacuauggcuaaaaacaagcccacauuagauuucgaacugaucaagaccgaggccaaacagccugcgacgcuucggaaguacugcauugaagcaaaauugaccaauacaacuaccgccucccgcuguccaacacaaggggagcccucucugaacgaggaacaggacaagcgauuugugugcaaacacagcauggucgauagaggauggggcaaugguugugggcuauucggaaagggcggcaucgugacuugcgcuauguuuaccugcaagaaaaacauggaggggaaggugguccagccugaaaaucucgaguauacaaucguuauuaccccacauuccggagaagagaacgccguggguaaugacacuggcaaacacgggaaggagauaaaaaucacgccgcagucaaguauuacagaagcagagcugaccggauacggcacuguaaccauggaauguagccccaggacaggucuugauuucaacgagauggugcuguugcaaauggaaaauaaggcuuggcucguccaucggcagugguuucuggacuuaccucugccauggcuccccggggccgauacccagggcucuaacuggauccagaaagagacucuugugacauucaagaacccucacgcgaagaaacaagacguugugguccugggaucccaggagggcgccaugcacacggcauugaccggggcuacugaaauacagaugucaagcggaaaucuacuguuuacaggucaucucaagugccgucugcgcauggacaaacuucaacugaagggcaugaguuauucuauguguaccgggaaauucaaggugguaaaggagauugccgaaacacagcacggaacuaucguuaucagagugcaguacgagggcgaugguuccccaugcaaaauucccuucgagaucauggacuuggaaaagaggcauguccucgggcggcugauuaccgugaacccgauagucacggagaaagauagcccugugaauaucgaagcugagcccccauuuggcgacucguacauuaucaucggaguugaaccuggccaguuaaagcugaacugguucaaaaaggggucuuccauuggacaaauguuugagaccacaaugcgaggugccaagcgcauggcaauacuaggcgauacugccugggacuucgggucacucggaggcguguuuaccaguaucgguaaagcucugcaccagguauucggggcgauuuauggcgcagccuuuagcggagucuccuggacaaugaagauccuuauuggcgugguuaucacuuggauagggaugaacucuagaagcaccucauugagugugucccugguccucgugggaguagugacgcuguaccuuggcguuaugguccaggcugauagcgguuguguggugucuuggaaaaacaaggagcugaaaugcgggucaggaaucuucauuacagacaauguccauaccuggacugaacaguauaaguuucaacccgagaguccaagcaaguuggccuccgcaauccagaaagcccacgaagagggcauuugugguaucaggucuguuacacggcucgaaaaccugauguggaagcagauaacccccgaguuaaaucacauucugucggagaacgaagugaaacuaacuaucaugaccggcgauauuaaggggaucaugcaggcuggaaaacgcagccucagaccucaaccaacagagcugaaguacuccuggaaaacguggggcaaggccaagaugcuuucaaccgaauugcauaaucagacuuuccugauagacgggccggagacagcagaaugccccaacaccaauagggcguggaacagucucgagguggaggauuauggauuuggcguauucacaacuaauaucuggcugaaauuaaaggaacgucaggacgucuuuugugacccuaaacugaugucugcugccauuaaggauaaccgggcagugcacgccgacauggguuacuggaucgagagcgcucuuaacgauaccuggaaaauugaaaaggccuccuucaucgagguuaagucaugccauuggccaaaaagccacacguuguggucuaauggggugcucgaguccgaaaugauaauucccaagaacuucgcaggaccugucagucagcacaauuaucgaccaggcuaccauacacaaaccgcuggucccuggcaccugggcaaacuagagauggacuuugauuucugugaagggacuaccgugguugugacagaggacugcggaaacagaggcccgagccugaggacuaccacagccucugggaagcucaucacggaauggugcugucgcuccugcacccugccuccacuucgguacaaaggagaggauggcuguugguaugguauggagaucagacccuugaaggaaaaggaggaaaaucugguaaacucauuagucacugcggggcauggacagauugacaauuuuagucucggcgugcuggguauggcccuuuuccuggaggaaauguugaggacacgcgugggcaccaaacacgcuauccuccuggucgcaguuagcuuugugacucuaauuacagggaacaugucguuccgagaucugggacggguaauggugauggucggcgccaccaugacggacgauauagggaugggagugacuuaccucgcucugcuugccgcauuuaagguucguccuaccuucgcggccggcuugcuguuaagaaaacucacauccaaggagcugaugaugaccacuaucgguauugugcuucugucucagagcacaauccccgagaccauucuagaacucacagacgcucuggccuuggggaugaugguccugaaaaucgugaagaauauggagaaguaucaauuagcaguuacuauaauggcuauccucugcgugccaaacgccgucauucugcagaaugcauggaaaguaucauguaccauccuugccgugguuaguguguccccucuguugcucacgucuagccagcagaaggcugauuggauuccccuggcgcuaacaaucaaaggacugaacccaaccgccauauuucuuacuacccucuccaggacaucaaagaaacgcagcuggccgcugaaugaagcaauuauggcugucggcauggugaguaucuuggccucuucccuguuaaagaacgacaucccuaugacuggcccccucguagccgggggacugcuuaccgugugcuacguccugacgggucggagcgcugacuuggagcucgaaagagcagccgauguuaggugggaggaccaagcggagauuucgggcucaucuccaauacugaguaucacaauuuccgaagaugggagcaugucuaucaaaaaugaggaagaggagcagacccuaacuauucugauccgaacaggacuucucgugauaagcggccuguuccccguguccaucccuauuaccgcugccgcaugguauuugugggaagucaagaagcagcgcgccgguguguuaugggacguuccaucacccccuccgguagggaaagcugagcuggaagauggagcauaccggaucaagcagaaaggcauucucggcuauagucaaaucggggccggaguguacaaggaggguacuuuucauacaauguggcacgucaccagaggcgcggugcugaugcacaaagggaagaggauagaaccaagcugggcugacguuaagaaagaucuuauuucuuacggaggcgguuggaagcuggagggggaguggaaagaaggagaggaagugcaggucuuggcccuagagcccggcaagaacccucgugcagugcagacgaaaccaggccuguucaagacuaacaccgggacaaucggagccguaucccucgacuuuucacccgguaccaguggcagcccuaucgucgauaagaaagggaaggugguuggacuguauggcaaugguguggucacacgcuccgggacuuacgugucugcuauugcccagaccgaaaaaucgaucgaggacaacccggagauagaagaugacauuuuccggaagaaaagacuuacgaucauggauuuacaucccggagcaggcaagacaaagagguaucugccagcuauuguucgagaggccaucaaacggggccuccgcacuuugauacuggcgccuaccagaguggucgccgcagaaauggaggaagcucucagggggcugcccauucgguaccaaacaccagccauccgagcugagcacaccggaagagagaucguggaccuuaugugucaugcaacuuucaccaugcgccuguugagcccuguaagggugcccaauuauaaccuaauuaucauggacgaagcccacuuuacagauccagccucaauugcugcgcgugguuacauauccacgcggguugagaugggcgaagcagccgggaucuucaugacugcuaccccgccuggaaguagagaccccuuuccacagucuaaugcccccauuauggaugaggagagggaaaucccugagcgcagcuggaacuccggccaugaaugggucacagacuucaaggguaaaaccgugugguuugugccaucaaucaaggcagggaaugauauugccgcuugccugagaaagaauggaaagaaggucauacagcucucuagaaaaacuuucgacagcgaguauaucaagacacggaccaaugauugggacuuuguagugacgacugauauuagugaaaugggcgcgaacuucaaagccgagaggguuaucgacccccgccguuguaugaagccugugauuuuaacagauggcgaggaaagagucauccuggcagggccgaugccagugacccacuccagcgcugcccaacggaggggacgcauaggucgaaaucccaaaaacgagaaugaccaguacaucuacaugggcgaaccucuugagaacgacgaagauugcgcacacuggaaggaggccaaaaugcugcucgacaauauuaacacccccgaggggaucauuccaucuauguuugaaccugagagagaaaagguugaugcuaucgacggagaguaucgguugaggggcgaagcccgcaagacuuucguggaucugaugagaaggggugaccuccccgucuggcuggcguaccggguggcagccgaggggauaaacuaugcugaucgucgcugguguuuugacggcauuaaaaauaaccagauccuugaggaaaauguagagguggaaauuuggacaaaggagggagagaggaaaaagcuaaaaccaagauggcuggaugccagaaucuacucagacccuuuggcuuuaaaggaguucaaggaguucgcagccggccggaaaucccugacccucaaccugauaacagaaauggggcgccuuccgacuuuuaugacgcagaaggcuagaaaugcccuggauaaccucgcaguuuugcauaccgcggaggccggagguagggcuuauaaucacgcccugagugaacuacccgagacacuggagacucuccuucuguuaaccuugcuggcaacagucaccggcgggaucuuccucuuucugaugagcggaaaaggcauugguaagaugacucuugggaugugcugcaucauuacggcuucgauccugcucugguacgcccaaauacagccacauuggauugcagccucuaucaucuuggaguucuuucugauuguguuacuaaucccugagcccgaaaaacagcggaccccacaggacaaccaacugacauauguggucauagcuauucucacuguuguggcggccaccauggcaaaugagaugggcuuccuugaaaagacaaagaaagauuuuggacugggcuccaucgcuacccaccagccugagagcaacauuuuggacaucgaccugcgacccgccucagccuggacucucuacgcaguagcuacaacguucauaaccccgaugcugagacacaguaucgaaaauucuuccgugaacgucagccuuacugccauugcgaaucaggcuacagugcucauggggcugggaaaggguuggccauugucaaaaauggauaucggcguuccucuguuagccauuggguguuacagucaggugaaccccaucacccuaaccgcagcccugcuccuucuggucgcucauuaugcaauuaucggaccaggcuugcaagccaaggcgacacgcgaagcucagaaaagggccgcagccgguauaaugaagaaucccacuguagacgggauuacggugaucgaucuggacccuaucccguacgaucccaaguuugagaaacagcucggccagguuaugcugcuuguguuaugcgucacccaagugcugaugaugcggacaacuugggcucucugugaagccuugacccuggcaacaggaccaauuagcacccuaugggagggcaacccugggcguuucuggaauacuacgauagcugucuccauggccaacaucuuuagaggaucuuaucuggcgggcgccggucuccuuuucagcauuaugaagaacacagcaaauaccaggcgcgggacuggaaacaccggcgaaacacugggugagaaauggaagaaucgguugaacgcucugggcaaauccgaguuucagaucuacaagaaaucagggauucaggaaguggaccgaacucucgccaaggagggaaucaagagaggcgaaaccgaucaccaugcaguuucuagggggagugcuaaacugcgcugguucguggagcggaauuuaguaacacccgagggaaagguggucgaccuuggcugcgguagagggggauggucguauuacuguggcggucugaaaaacguucgugaagugaagggccucacgaaagggggaccuggccacgaggaaccaauacccaugagcaccuauggguggaaucuagucaggcugcaauccggaguggauguauucuuuacuccuccagagaagugcgacacauugcugugugauaucggcgaaucuucacccaacccgaccguggaggccggucggacucuccgcguucuuaaucugguggagaacugguugaauaacaauacacaguucugcauuaagguccugaacccuuacaugccaagcgugaucgagaaaauggaggcccuccagcgaaaguacgggggagcguuagucagaaauccccuguccaggaacaguacccaugaaauguauugggugucuaacgcuagcggcaauauuguuucauccguaaacaugaucagucggaugcuuauaaaucgcuuuacgaugagacacaaaaaggcaaccuacgagccugacguggaucugggcagcgggacaaggaacauuggaaucgaaucugagacuccaaaucuagacaucauugguaaacgaauagagaagaucaagcaggaacacgagaccuccuggcauuaugaccaagaucaccccuacaaaacaugggccuaucauggcucauacgaaacuaagcagaccgggagcgcuucgucuauggucaacggagugguucggcuccugacaaaaccgugggacgugauuccuauggucacccagauggccaugacugauacgacacccuucggccagcaacguguguuuaaggagaaaguagacaccagaacucaggaaccaaaggaggguaccaagaaauugaugaagaucacagcagaguggcuguggaaagaacucgggaagaaaaagacgccucgcauguguaccagggaggaguucacucggaaagugagaaguaaugccgcucuuggagcgauuuuuacagaugagaacaaguggaaguccgcccgcgaggcaguugaagacagcagguucugggagcuggucgauaaagaacgaaauuuacaccuggagggcaagugcgaaaccuguguguauaacaugaugggcaaacgggagaagaaauugggggaguuuggaaaggcuaaggguucaagagccaucugguacauguggcucggcgcaagguuccuggaauuugaggcccuaggguuccuuaaugaagaccacugguuuucccgcgagaacucucugagcggaguggaaggcgagggucuccauaaacugggguacauauugcgugaugucaguaagaaagagggaggcgcuauguaugccgacgauacugcgggcugggacacacggaucacccuggaagaccucaagaaugaggaaaugguuacaaaccacauggagggggaacauaagaaacuugcagaggccauuuucaaacugacuuaccagaauaaagugguaagagugcagaggcccaccccacgcggaacggucauggauaucauuucccgacgggaccaaagagguagcggccagguggggaccuauggauuaaacacauucacuaacauggaggcucagcugaucaggcaaauggaaggcgaggguguuuuuaagucuauucagcacuugaccgugacagaagagauagccguccagaauuggcucgcacgcguggggagagagcggcugucaaggauggcuaucaguggagaugacugcguaguuaaaccccuagaugaccguuucgccuccgcucuuacugcccugaacgauaugggcaaggugcgaaaagacauucagcaaugggaaccuagccgcggcuggaaugauuggacccaggucccauuuugcucucaucacuuccacgagcucaucaugaaggacgggagagugcugguggucccgugucggaaccaggaugaauugaucggaagggcacgcauuucgcagggugcgggcuggucauuaagagagacggccugccugggaaagagcuacgcucaaauguggucccucauguauuuucaucggagggaccuucgacuggccgcaaaugcuauauguagugccguucccucucacugggugccuacaagccguaccacuugguccauccaugcaagacacgaauggaugacaaccgaggauaugcuaacuguauggaaccgcguguggguccaggagaauccauggauggaagacaaaacccccguggagucaugggaagagauuccuuaccugggaaagcgggaagaccaguggugcggcagucucaucgguuugacaucuagggccacgugggcgaaaaacauucagaccgcuaucaaucaaguuagaagccugauagggaacgaggaguauacugauuacaugccauccaugaagcgcuuccggagggaagaggaagaggccggagugcuuugguga

SEQ ID NO: 15006 - RNA, 9876 nt, Artificial Sequence
  derived and/or modified CDS sequence (opt3) from DENV-2__GQ398259__SS-prME
accgccggcaugaucauuaugcugauacccaccgugauggcuuuccaccucacuacgcgaaacggggaaccucauaugaucgucagcaggcaggaaaagggaaaaucccuucuguuuaagaccgaagacgguguuaauaugugcacauugauggcaauggauuuaggcgaacugugugaagacacuauuaccuacaacugcccacuacuccggcaaaaugaaccggaagauaucgacuguuggugcaacucuacaucaaccugggugacuuaugggacauguaccgccacgggagagcaccgccgagaaaaacguaguguagcgcuggugccccaugucggcaugggucuugagacucgaaccgaaacauggaugagcuccgagggggcuuggaagcacgcccagaggauugagacuuggauccugcggcauccuggauucaccauaauggcagccaucuuggcuuacacaauuggcaccacguauuuucagcgcgugcucaucuucauucugcugacugcaguugccccaucuaugacaaugagaugcaucggcauaucgaauagggauuuuguggaaggggucucaggagguagcuggguggacauuguacucgagcacggcaguuguguuaccacuauggcuaaaaacaagcccacauuagauuucgaacugaucaagaccgaggccaaacagccugcgacgcuucggaaguacugcauugaagcaaaauugaccaauacaacuaccgccucccgcuguccaacacaaggggagcccucucugaacgaggaacaggacaagcgauuugugugcaaacacagcauggucgauagaggauggggcaaugguugugggcuauucggaaagggcggcaucgugacuugcgcuauguuuaccugcaagaaaaacauggaggggaaggugguccagccugaaaaucucgaguauacaaucguuauuaccccacauuccggagaagagaacgccguggguaaugacacuggcaaacacgggaaggagauaaaaaucacgccgcagucaaguauuacagaagcagagcugaccggauacggcacuguaaccauggaauguagccccaggacaggucuugauuucaacgagauggugcuguugcaaauggaaaauaaggcuuggcucguccaucggcagugguuucuggacuuaccucugccauggcuccccggggccgauacccagggcucuaacuggauccagaaagagacucuugugacauucaagaacccucacgcgaagaaacaagacguugugguccugggaucccaggagggcgccaugcacacggcauugaccggggcuacugaaauacagaugucaagcggaaaucuacuguuuacaggucaucucaagugccgucugcgcauggacaaacuucaacugaagggcaugaguuauucuauguguaccgggaaauucaaggugguaaaggagauugccgaaacacagcacggaacuaucguuaucagagugcaguacgagggcgaugguuccccaugcaaaauucccuucgagaucauggacuuggaaaagaggcauguccucgggcggcugauuaccgugaacccgauagucacggagaaagauagcccugugaauaucgaagcugagcccccauuuggcgacucguacauuaucaucggaguugaaccuggccaguuaaagcugaacugguucaaaaaggggucuuccauuggacaaauguuugagaccacaaugcgaggugccaagcgcauggcaauacuaggcgauacugccugggacuucgggucacucggaggcguguuuaccaguaucgguaaagcucugcaccagguauucggggcgauuuauggcgcagccuuuagcggagucuccuggacaaugaagauccuuauuggcgugguuaucacuuggauagggaugaacucuagaagcaccucauugagugugucccugguccucgugggaguagugacgcuguaccuuggcguuaugguccaggcugauagcgguuguguggugucuuggaaaaacaaggagcugaaaugcgggucaggaaucuucauuacagacaauguccauaccuggacugaacaguauaaguuucaacccgagaguccaagcaaguuggccuccgcaauccagaaagcccacgaagagggcauuugugguaucaggucuguuacacggcucgaaaaccugauguggaagcagauaacccccgaguuaaaucacauucugucggagaacgaagugaaacuaacuaucaugaccggcgauauuaaggggaucaugcaggcuggaaaacgcagccucagaccucaaccaacagagcugaaguacuccuggaaaacguggggcaaggccaagaugcuuucaaccgaauugcauaaucagacuuuccugauagacgggccggagacagcagaaugccccaacaccaauagggcguggaacagucucgagguggaggauuauggauuuggcguauucacaacuaauaucuggcugaaauuaaaggaacgucaggacgucuuuugugacucuaaacugaugagcgcugccauuaaggauaaccgggcagugcacgccgacauggguuacuggaucgaguccgcucuuaacgauaccuggaaaauugaaaaggccucauucaucgagguuaagagcugccauuggccuaaaucucacacguugugguccaauggggugcucgagagugaaaugauaauuccaaagaacuucgcaggacccgucagccagcacaauuaucgaccuggcuaccauacacaaaccgcugguccauggcaccugggcaaacuagagauggacuuugauuucugugaagggacuaccgugguugugacagaggacugcggaaacagaggccccucucugaggacuaccacagccuccgggaagcucaucacggaauggugcugucgcucaugcacccugccgccucuucgguacaaaggagaggauggcuguugguaugguauggagaucagaccauugaaggaaaaggaggaaaaucugguaaacaguuuagucacugcggggcauggacagauugacaauuuuagccucggcgugcuggguauggcccuuuuccuggaggaaauguugaggacacgcgugggcaccaaacacgcuauccuccuggucgcaguuucguuugugacucuaauuacagggaacauguccuuccgagaucugggacggguaauggugauggucggcgccaccaugacggacgauauagggaugggagugacuuaccucgcucugcuugccgcauuuaagguucgucccaccuucgcggccggcuugcuguuaagaaaacucacaucuaaggagcugaugaugaccacuaucgguauugugcuucugagccagucaacaaucccugagaccauucuagaacucacagacgcucuggccuuggggaugaugguccugaaaaucgugaagaauauggagaaguaucaauuagcaguuacuauaauggcuauccucugcgugcccaacgccgucauucugcagaaugcauggaaaguaaguuguaccauccuugccgugguuuccgugucuccacuguugcucacgagcucccagcagaaggcugauuggauuccucuggcgcuaacaaucaaaggacugaaccccaccgccauauuucuuacuacccucucaaggacaagcaagaaacgcaguuggccacugaaugaagcaauuauggcugucggcauggugucuaucuuggccuccagccuguuaaagaacgacaucccgaugacuggcccucucguagccgggggacugcuuaccgugugcuacguccugacgggucggucggcugacuuggagcucgaaagagcagccgauguuaggugggaggaccaagcggagauuucaggcucuagucccauacuguccaucacaauuagcgaagaugggucuaugagcaucaaaaaugaggaagaggagcagacccuaacuauucugauccgaacaggacuucucgugauauccggccuguucccagugucaauccccauuaccgcugccgcaugguauuugugggaagucaagaagcagcgcgccgguguguuaugggacguuccuaguccacccccuguagggaaagcugagcuggaagauggagcauaccggaucaagcagaaaggcauucucggcuauagccaaaucggggccggaguguacaaggaggguacuuuucauacaauguggcacgucaccagaggcgcggugcugaugcacaaagggaagaggauagaaccgucuugggcugacguuaagaaagaucuuauuuccuacggaggcgguuggaagcuggagggggaguggaaagaaggagaggaagugcaggucuuggcccuagagccaggcaagaacccccgugcagugcagacgaaaccuggccuguucaagacuaacaccgggacaaucggagccguaucacucgacuuuaguccagguaccagcggcucccccaucgucgauaagaaagggaaggugguuggacuguauggcaaugguguggucacacgcucugggacuuacgugucggcuauugcccagaccgagaaaagcaucgaggacaacccugagauagaagaugacauuuuccggaagaaaagacuuacgaucauggauuuacauccgggagcaggcaagacaaagagguaucugcccgcuauuguucgagaggccaucaaacggggccuccgcacuuugauacuggcgccaaccagaguggucgccgcagaaauggaggaagcucucagggggcugccuauucgguaccaaacacccgccauccgagcugagcacaccggaagagagaucguggaccuuaugugucaugcaacuuucaccaugcgccuguugucaccaguaagggugccuaauuauaaccuaauuaucauggacgaagcccacuuuacagaucccgccuccauugcugcgcgugguuacauaaguacgcggguugagaugggcgaagcagccgggaucuucaugacugcuaccccaccgggaucuagagacccuuuuccccagagcaaugccccaauuauggaugaggagagggaaauccccgagcgcuccuggaacucaggccaugaaugggucacagacuucaaggguaaaaccgugugguuugugccuucuaucaaggcagggaaugauauugccgcuugccugagaaagaauggaaagaaggucauacagcucagcagaaaaacuuucgacagugaguauaucaagacacggaccaaugauugggacuuuguagugacgacugauauuuccgaaaugggcgcgaacuucaaagccgagaggguuaucgacccacgccguuguaugaagcccgugauuuuaacagauggcgaggaaagagucauccuggcagggccuaugccggugacccacagcucugcugcccaacggaggggacgcauaggucgaaaucccaaaaacgagaaugaccaguacaucuacaugggcgaaccccuugagaacgacgaagauugcgcacacuggaaggaggccaaaaugcugcucgacaauauuaacaccccugaggggaucauucccucaauguuugaaccagagagagaaaagguugaugcuaucgacggagaguaucgguugaggggcgaagcccgcaagacuuucguggaucugaugagaaggggugaccucccugucuggcuggcguaccggguggcagccgaggggauaaacuaugcugaucgucgcugguguuuugacggcauuaaaaauaaccagauccuugaggaaaauguagagguggaaauuuggacaaaggagggagagaggaaaaagcuaaaacccagauggcuggaugccagaaucuacuccgacccauuggcuuuaaaggaguucaaggaguucgcagccggccggaaaagucugacccucaaccugauaacagaaauggggcgccuuccuacuuuuaugacgcagaaggcuagaaaugcccuggauaaccucgcaguuuugcauaccgcggaggccggagguagggcuuauaaucacgcccugagcgaacuaccggagacacuggagacucuccuucuguuaaccuugcuggcaacagucaccggcgggaucuuccucuuucugaugucgggaaaaggcauugguaagaugacucuugggaugugcugcaucauuacggcuucuauccugcucugguacgcccaaauacagccccauuggauugcagccuccaucaucuuggaguucuuucugauuguguuacuaaucccagagccugaaaaacagcggaccccacaggacaaccaacugacauauguggucauagcuauucucacuguuguggcggccaccauggcaaaugagaugggcuuccuugaaaagacaaagaaagauuuuggacugggcagcaucgcuacccaccagccagagucaaacauuuuggacaucgaccugcgaccugccagugccuggacucucuacgcaguagcuacaacguucauaacccccaugcugagacacucuaucgaaaauuccagcgugaacgucucacuuacugccauugcgaaucaggcuacagugcucauggggcugggaaaggguuggccguugaguaaaauggauaucggcguuccacuguuagccauuggguguuacagccaggugaacccuaucacccuaaccgcagcccugcuccuucuggucgcucauuaugcaauuaucggacccggcuugcaagccaaggcgacacgcgaagcucagaaaagggccgcagccgguauaaugaagaauccaacuguagacgggauuacggugaucgaucuggaccccaucccuuacgauccgaaguuugagaaacagcucggccagguuaugcugcuuguguuaugcgucacccaagugcugaugaugcggacaacuugggcucucugugaagccuugacccuggcaacaggacccauuuccacccuaugggagggcaacccagggcguuucuggaauacuacgauagcugucucuauggccaacaucuuuagaggaagcuaucuggcgggcgccggucuccuuuucuccauuaugaagaacacagcaaauaccaggcgcgggacuggaaacaccggcgaaacacugggugagaaauggaagaaucgguugaacgcucugggcaaaucagaguuucagaucuacaagaaaucugggauucaggaaguggaccgaacucucgccaaggagggaaucaagagaggcgaaaccgaucaccaugcaguuaguagggggucggcuaaacugcgcugguucguggagcggaauuuaguaacaccugagggaaagguggucgaccuuggcugcgguagagggggauggagcuauuacuguggcggucugaaaaacguucgugaagugaagggccucacgaaagggggacccggccacgaggaaccuauaccaauguccaccuauggguggaaucuagucaggcugcaaucuggaguggauguauucuuuacucccccugagaagugcgacacauugcugugugauaucggcgaaucaagcccaaaccccaccguggaggccggucggacucuccgcguucuuaaucugguggagaacugguugaauaacaauacacaguucugcauuaagguccugaacccguacaugccuuccgugaucgagaaaauggaggcccuccagcgaaaguacgggggagcguuagucagaaauccacugaguaggaacucuacccaugaaauguauugggugagcaacgcuucaggcaauauuguuuccaguguaaacaugaucagccggaugcuuauaaaucgcuuuacgaugagacacaaaaaggcaaccuacgagcccgacguggaucugggcucugggacaaggaacauuggaaucgaauccgagacuccuaaucuagacaucauugguaaacgaauagagaagaucaagcaggaacacgagaccucauggcauuaugaccaagaucacccauacaaaacaugggccuaucauggcagcuacgaaacuaagcagaccgggucggcuucuaguauggucaacggagugguucggcuccugacaaaacccugggacgugauuccgauggucacccagauggccaugacugauacgacaccuuucggccagcaacguguguuuaaggagaaaguagacaccagaacucaggaacccaaggaggguaccaagaaauugaugaagaucacagcagaguggcuguggaaagaacucgggaagaaaaagacgccacgcauguguaccagggaggaguucacucggaaagugagauccaaugccgcucuuggagcgauuuuuacagaugagaacaaguggaaaagcgcccgcgaggcaguugaagacucaagguucugggagcuggucgauaaagaacgaaauuuacaccuggagggcaagugcgaaaccuguguguauaacaugaugggcaaacgggagaagaaauugggggaguuuggaaaggcuaaggguuccagagccaucugguacauguggcucggcgcaagguuccuggaauuugaggcccuaggguuccuuaaugaagaccacugguuuucucgcgagaacagccugaguggaguggaaggcgagggucuccauaaacugggguacauauugcgugaugucuccaagaaagagggaggcgcuauguaugccgacgauacugcgggcugggacacacggaucacccuggaagaccucaagaaugaggaaaugguuacaaaccacauggagggggaacauaagaaacuugcagaggccauuuucaagcugacuuaccagaauaaagugguaagagugcagaggccuacaccccgcggaacggucauggauaucauuagccgacgggaccaaagagguucuggccagguggggaccuauggauuaaacacauucacuaacauggaggcucagcugaucaggcaaauggaaggcgaggguguuuuuaagucaauucagcacuugaccgugacagaagagauagccguccagaauuggcucgcacgcguggggagagagcggcugaguaggauggcuaucuccggagaugacugcguaguuaaaccacuagaugaccguuucgccagcgcucuuacugcccugaacgauaugggcaaggugcgaaaagacauucagcaaugggaacccucucgcggcuggaaugauuggacccaggucccuuuuugcucgcaucacuuccacgagcucaucaugaaggacgggagagugcugguggucccaugucggaaccaggaugaauugaucggaagggcacgcauuucacagggugcgggcuggagcuuaagagagacggccugccuggggaaguccuacgcucaaauguggagucucauguauuuucaucggagggaccuucgacuggccgcaaaugcuauauguucugccguuccgagccacugggugcccacaucccguaccacuuggucaauccaugcaagacacgaauggaugacaaccgaggauaugcuaacuguauggaaccgcguguggguccaggagaauccuuggauggaagacaaaaccccaguggagaguugggaagagauucccuaccugggaaagcgggaagaccaguggugcggcucucucaucgguuugacaagcagggccacgugggcgaaaaacauucagaccgcuaucaaucaaguuagaucccugauagggaacgaggaguauacugauuacaugccuucaaugaagcgcuuccggagggaagaggaagaggccggagugcuuugguga

SEQ ID NO: 15007 - RNA, 9876 nt, Artificial Sequence
  derived and/or modified CDS sequence (opt3) from DENV-2__GQ398268__SS-prME
accgccggcaugaucauuaugcugauaccaacagugauggcuuuccaccucacuacgaggaacggggagccucauaugaucgucagcaggcaggaaaagggaaagucccuucuguuuaagaccgaggacgguguuaauaugugcacauugauggcaauggauuuaggcgaacugugugaggacacuauuaccuacaaaugcccacuucuccggcaaaacgaaccggaggauaucgacuguuggugcaauucuacaucaaccugggugacuuaugggacauguaccacgacuggagagcaccgccgagaaaagcguagugucgcccuggugccccaugucggcaugggucuugagaccagaacagaaacuuggaugagcuccgagggggcguggaaacacgcucagaggauugagaccuggauccugcggcauccuggauucacaauaauggccgcaaucuuggccuacaccauuggcacgacucacuuucagcgcgcucucaucuucauucugcugacagcaguggccccaucuaugaccaugagaugcaucggcauaucgaacagggauuuuguugaaggggugucaggagguagcugggucgacauugugcucgagcacggcaguuguguaacuacaauggcuaagaauaagcccaccuuagauuucgaacugaucaaaacggaggccaagcagccugcgacccuucggaaauauugcauugaagcaaaguugacaaacacuaccacagagucccgcuguccaacucaaggggagcccucucugaaugaagaacaggacaaacgauuuguuugcaagcauagcaugguggauagaggauggggcaacgguugugggcuauucggaaagggcggcaucguaaccugcgccauguuuacaugcaaaaagaauauggaagggaaaguggugcagccugagaaccucgaauacaccaucgucauuacuccacacuccggagaggagcaugcuguugguaaugacacgggcaagcacgggaaagaaauaaagaucacaccgcagucaaguauuaccgaggccgaacugacuggauauggcaccgugacaauggaguguagccccaggaccggucuugauuucaacgaaaugguacuguugcaaauggagaauaaagcauggcucgugcaccggcagugguuucuggacuuaccucugccauggcuccccggggcugauacucagggcucuaacuggauccagaaggagacacuugucacguucaagaauccucaugccaaaaagcaagacgugguugugcugggaucccaggaaggcgcgaugcacaccgccuugacuggggcaacagagauacagaugucaagcggaaaccuacuguuuaccggucaucucaaaugccgucugcgcauggacaaacuucaacugaaaggcaugaguuacucuauguguacagggaaguucaaggucgugaaagaaauugcugagacucagcacggaaccaucguaaucagaguucaguaugagggcgaugguuccccaugcaagauucccuucgaaaucauggacuuggagaaaaggcaugugcucgggcggcugauuacggucaacccgauagugaccgaaaaggauagcccugucaauaucgaggccgaacccccauuuggcgacucguacauuaucaucggaguggagccuggccaguuaaaacugaacugguucaagaaggggucuuccauuggacaaauguuugagacaacuaugcgaggugcuaaacgcauggccauacuaggcgauaccgcaugggacuucgggucacucggaggcguuuuuacaaguaucgguaaggcccugcaccagguguucggggcuauuuacggcgcggcauuuagcggaguauccuggacuaugaaaauccuuauuggcgucaucauaaccuggaucgggaugaacucuagaagcacgucauugagugugucccugguucucgugggagucgugacacuguaucuuggcguaauggugcaggccgauagcgguuguguugucucuuggaagaacaaagaacugaagugcgggucaggaauuuucaucaccgacaaugugcacacuuggacagagcaguacaaguuucaacccgaaaguccaagcaaauuggcuuccgccauucagaaggcacaugaggaaggcaucugugguauaaggucugugacccggcucgagaaccugauguggaaacagauuacucccgaguuaaaucacauccugucggaaaacgaggucaagcuaaccauuaugacaggcgauaucaaagggauaaugcaggccggaaagcgcagccucagaccucaaccaacggaacugaaauauuccuggaagaccuggggcaaggcuaaaaugcuuucaacugagagucauaaucagacauucuugaucgacgggccggaaaccgccgagugccccaacacaaauagggcauggaacucucuggagguugaagauuacggauuuggcguguucacuaccaauauuuggcucaagcugcgugagaaacaggacguguuuugugacagcaaguuaauguccgcggcuaucaaagauaaccgggccguacacgcagacauggguuauuggauugaaucagcccugaaugauacguggaagaucgagaaggcuagcuucauagaggucaaaucuugccacuggccuaagucccauacacuuuggaguaacgggguguuggaaagcgagaugauuauccccaagaauuucgccggacccguuucucagcacaauuaccgaccuggcuaucauacccaaacugcagguccauggcaccucggcaagcuggaaauggacuuugauuucugugaggggaccacaguggucgugacugaagacugcggaaacagaggccccucccuaaggaccacaacggcuucagggaaacugaucaccgaguggugcugucgcaguugcacucucccgccucugcgguacagaggagaggauggcuguugguacgguauggaaauuaggccacuuaaggagaaggaagagaauuugguuaacagccuggugacagccgggcauggacagaucgacaauuuuucguuaggcguacucgguauggcgcuguuccuugaagagaugcugcgcacccgagucggcacuaaacacgccauuuugcucguggcuguguccuuugucacacugauaaccgggaacaugucuuuccgggaucuaggacguguuauggugaugguaggcgcaacgaugacugacgauaucgggaugggagugaccuaucuggcccuccuggcugccuuuaaggucagacccacauucgcagcgggccuuuugcugaggaaauuaaccagcaaggagcucaugaugacuacaauugguaucgugcugcuuucacagaguaccauuccugaaacaauccuggagcuaacugacgcccucgcucuggggaugaugguuuugaaaauggugcgcaagauggaaaaguaccaacuggccgucaccauaauggcaaucuuaugcgugcccaaugcuguuauucuccagaacgccuggaaaguguccuguacgauccuggcagucguaucugugagcccacuucuguugacauccucacagcagaaggccgauuggauuccucucgcucugaccaucaaaggacuaaaucccacugcgauauuucugaccacacuuagccggacuaacaagaaaagaaguuggccacucaaugaggccauuauggcaguuggcauggugucuauccuggcuuccagcuugcugaagaacgacaucccgaugaccggcccuuuagucgccgggggacuccugacggugugcuauguacuuacagguaggucggccgaccuggaauuggagcgagcugcagaugugaaaugggaggaccaagccgaaauuucaggcucuagucccauacucuccaucaccauuagcgaggaugggucuaugagcaucaagaaugaagaggaggaacagacucugacaauucuaauccgcaccggacugcuugucauauccggccucuucccaguuucaauccccauuacugcggcugccugguaccugugggaggugaagaaacagcgggccgguguguugugggacgucccuaguccacccccuguggggaaggccgaauuagaggauggagcuuauagaaucaaacagaagggcauucugggcuacagccaaaucggggcaggaguuuauaaagaagguacauuucacaccauguggcauguaacgaggggcgccgugcucaugcacaaggggaagcguauagagccgucuugggcggacgucaaaaaggaucugauuuccuacggaggcgguuggaaacuugagggggaauggaaggagggagaagaggugcagguucuggcuuuggaaccaggcaaaaacccccgcgccgugcagacuaagccuggccuauucaagaccaaugcagggacaaucggagccgucucacuggacuuuaguccagguaccagcggcucccccaucauugauaaaaaggggaaagugguaggacucuacggcaacggugucgugacacggucuggggcuuauguuucggccaucgcacagacugaaaagagcauagaggacaacccugaaauugaggaugacaucuucagaaaaaggaagcugaccauuauggaucuucauccgggagcuggcaagacgaaacgauacuuacccgccaucgugcgggaagcgauaaagcgcggccugagaacacucauuuuggccccaacuagggucguggcagcugagauggaagaggcccugcgggggcucccuauccgauaucaaacccccgcuaucagagcagagcacacaggacgcgaaauuguugaccugaugugucaugccaccuucacuaugaggcuucugucaccagugcgugucccuaauuacaacuugaucauuauggacgaggcccacuuuaccgaucccgcuuccauagcggcacgggguuauaucaguacaagaguggaaaugggcgaggccgcugggauuuucaugacggccacuccaccgggaucuagggacccuuuuccccagagcaaugcaccaaucauggaugaggaacgcgagauccccgaacgauccuggucaucuggccacgaguggguaaccgacuucaaagguaagacagugugguuuguuccuagcauuaaagccgggaacgauauagcugcgugccuaagaaagaauggaaagaaagucauccagcugagucggaagaccuucgacuccgaauacgugaaaacuaggacaaacgauugggacuuuguggucaccacggauauuagcgagaugggcgccaauuucaaggcagagcgcguaaucgacccacguagauguaugaaacccgugauucucacugauggcgaagaacggguuaucuuagcugggccuaugccggugacacauucuucagccgcacaaaggcgcggacgaauagguagaaacccaaagaaugaaaacgaccaguauaucuacaugggcgagccccuggaaaaugacgaggauugcgcccacuggaaagaggcuaagaugcuucuggacaacauuaauaccccugaagggaucauucccuccauguuugagccagaacgggagaaggucgaugccaucgacggagaauacaggcuccgcggcgaggcgagaaaaaccuucguggauuugaugaggcggggugaccugccuguuuggcucgcauaucguguggccgcugaggggauaaacuacgccgaucgccgaugguguuuugacggcauuaagaauaaccagauccuggaagagaacgucgaaguggagauuuggacuaaagagggagaaagaaagaaacuuaagcccagguggcuagaugcucggaucuauagugacccacuggcauugaaggaguucaaagaguucgccgcuggccgcaagagcuuaacacugaaucucauaaccgagauggggagacugccuacauuuaugacucagaaagccagggaugcacuugacaaccuggcgguacuccauacggccgaagcuggaggucgggccuacaaucacgcauugucggagcugccggagacccuagaaacacugcuccuucugacuuuauuggcuaccgugacaggcgggaucuuccuguuucucaugucuggacgaggcauugguaagaugacccuggggaugugcugcaucauuacugccuccauccuucugugguaugcacaaauacagccccacuggauugccgcuagcaucauccucgaguucuuuuugauuguucuguuaaucccagaaccugagaaacagagaacgccccaggauaaccaacuaaccuacgucgugauagcgauucugacaguggucgccgcaacuauggcuaaugaaaugggcuuccucgagaagaccaagaaagaccuuggacugggcucaaucacaacccagcagccagagaguaacauuuuggacaucgaucugcgcccugccucugccuggacucucuaugcaguugcuacaacguuugugacccccaugcugaggcauuccauagaaaauagcucaguaaacgugagucuuacugccaucgcgaaucaggcuacaguccucauggggcugggaaaggguuggccguugagcaaaauggacauuggcgugccacuguuagccaucggguguuacucccaaguuaacccuauuacccuaaccgcagcccugcuccuucugguggcucacuacgcaaucauuggacccggcuugcaggccaaggcgacacgggaggcucagaaacgugccgcagccgguaucaugaagaauccaacugucgaugggauaacgguaauugaccuggaucccaucccuuaugacccgaaguucgaaaaacagcucggccaagugaugcugcuuguuuuaugcgugacccagguccugaugaugagaacaacuugggcucucugugaggccuugacccuggcaacaggacccaucucuacccuaugggaaggcaacccagggagguuuuggaauacuacgauugcugugagcauggccaacauauuccgcggauccuaccuggcgggcgccggucuccuauuuucaaucaugaagaauacaaccaacacucggcgagggaccggaaauauuggcgagacacugggugagaaauggaagucuagauugaacgcacugggcaaaagugaguuccagaucuauaagaaaucggggauucaagaggucgauaggacucucgcuaaggaaggaaucaagcgcggcgagaccgaccaucacgccgugagccggggguccgcaaaacugagaugguuuguugagcguaacauggugacaccugaaggaaagguaguggauuuaggcugcgguagagggggauggucuuacuauuguggcggucuuaaaaauguccgggagguuaagggccugacgaaagggggacccggccaugaggaaccuauaccaaugucaaccuacggguggaaccucgugcgccuacagagcggagucgacguguucuucacucccccugaaaagugcgauacacuguugugugacaucggcgaguccaguccaaaucccaccguagaggcuggucgaacucugagagugcucaaccuuguugaaaauuggcugaacaauaacacacaguuuugcauuaagguguugaauccguauaugccuucugucaucgagaaaauggaagcccugcagaggaaguacgggggagcccucgugcggaacccauuaagccgcaauucaacccacgagauguacugggucuccaacgcgaguggcaauauugugagcucuguuaacaugaucuccagaaugcugauaaauagguucacgaugcgacacaaaaaggcuaccuaugaacccgauguagaccuuggcucagggacacggaacauuggaaucgagagcgagaucccuaaccuggacauuauagguaaacguaucgaaaagauuaagcaagagcaugaaacuucguggcacuacgaucaggaccauccauauaaaaccugggcauaccacggcucuuaugagacaaagcagacugggagugccuccagcauggugaauggagucgugagacuacucaccaaacccugggauguugugccgauggucacacagauggcuaugaccgacacuacgccuuuuggccaacagcgcguguucaaggaaaaaguagauacaaggacccaggagcccaaggaggguacuaagaaacugaugaagaucaccgccgaaugguuguggaaagagcuggggaagaaaaagacaccacggauguguacgagagaagaguuuacccgcaaagugaggucaaacgcagcccucggagcuauuuucacugacgagaauaaguggaaguccgcgcgagaagccguugaggauucucgguuuugggaacuugucgacaaagagagaaaccugcacuuagaaggcaagugcgagacauguguguacaauaugaugggcaaaagggagaagaaacugggggaguucggaaaggcaaaggguagccgcgcuaucugguauaugugguugggcgcccguuuucucgaguucgaagcacugggguuucuaaacgaggaucauugguucagucgggaaaauucccuuagcggaguggagggcgagggucugcacaaacucggguacauacugagagacgucucuaagaaagaaggaggcgccauguacgcugaugacaccgccggcugggacacuaggaucacauuggaggaucugaagaacgaagagaugguuaccaaucauauggaaggggagcacaaaaagcucgcggaggcaauuuuuaaacuuacauaucagaacaaagugguacgcgugcaacgaccuacuccccggggaaccgucauggacaucauuucaagaagggaucagcgcgguaguggccagguggggacguacggacugaauaccuucacaaacauggaagcccaauuaaucagacagauggagggcgaagguguuuucaaguccauucagcaucugacugugaccgaggagauagcuguccagaauugguuggcccggguggggagggaacgucucagccgaauggcaaucucuggagacgauugcguaguuaaaccacuggacgaucgcuuugcuucggcccuaacagcucuuaacgacaugggcaaggugagaaaagauauucaacagugggagcccucacggggcuggaaugacuggacucaggucccuuucugcagccaccacuuucaugaacugaucaugaaggaugggagggugcucguggucccaugucgcaaccaggacgagcugaucgguagagcacggauuucccaaggagcaggcuggaguuugagggaaaccgcgugcuuagggaagucuuaugcccagauguggagccugauguacuuccaccgacgugaucucagacuugcugccaacgcaauauguuccgcuguuccgucacauugggugcccacgagucgcacaaccuggucuauccacgccaaacacgaguggaugacuacagaggacaugcugaccguauggaaucggguguggauucaggaaaacccuuggauggaggacaagacuccagucgaaagcugggaggaaauccccuaucuaggaaaaagggaggaucaguggugcggcucccugauuggucucaccucaagagcaacaugggccaagaauauccaaacggcgauaaaccaggugcgcagcuugaucgggaaugaggaauacaccgacuauaugccuucuaugaaacgguuuaggcgagaggaagaggaagcuggaguucugugguga

SEQ ID NO: 15008 - RNA, 9876 nt, Artificial Sequence
  derived and/or modified CDS sequence (opt3) from DENV-2__GQ398263__SS-prME
accgccggaaugaucauuaugaugauacccacugugauggcuuuccaccugacuacgcgaaacggggagccucauaugaucgucagcaggcaggaaaagggaaaaucccuccuuuuuaagaccgaggacgguguuaauaugugcacccugauggcaauggauuugggcgaauuaugugaggacacuauuaccuacaacugcccacugcuucggcaaaaugaaccggaggauaucgacuguuggugcaacucuacaucaaccugggugacuuaugggacauguaccgccacgggagagcaccgccgagaaaaacguaguguagcgcucgugccccaugucggcaugggucuggagacuagaaccgaaacauggaugagcuccgagggggcuuggaagcacgcccagaggauugagacuugggugcuucggcauccuggauucaccaucauggcagccauacuggcuuacacaaucggcaccacguauuuucagcgcguuuugauuuucauccuccugacugcaguggccccaucuaugacaaugcggugcauuggcaucucgaauagggauuuugucgaaggggugucaggagguagcuggguagacauaguucuggagcacggcaguugugugaccacuauggcuaaaaacaagcccacacucgauuucgaauuaauuaagaccgaggccaaacacccugcgacgcugcggaaguacugcaucgaagcaaaacuuaccaauacaacuaccgccucccgcuguccaacacagggggagcccucuuugaacgaggaacaagacaagcgauuugucugcaaacauagcaugguggauagaggauggggcaaugguugugggcuguucggaaagggcggcauugugacuugcgcuauguuuaccugcaagaaaaacauggaggggaaggucguucagccugaaaaucuagaguauacaaucgugaucaccccacacuccggagaagagaacgccguagguaaugacacuggcaaacaugggaaggagauuaaaauaacgccgcagucaaguaucacagaagcagagcucaccggauacggcacugugaccauggaauguagccccaggacaggucuggauuucaacgagaugguccuucugcagauggaaaauaaggcuugguuggugcaccggcaaugguuucucgaccugccuuuaccauggcugcccggggccgauacccagggcucuaacuggauucagaaagagacucucguuacauucaagaacccucacgcgaagaaacaggacguggucgugcuuggaucccaagagggcgccaugcauacggcacugaccggggcuacugaaauccagaugucaagcggaaauuugcuauuuacaggucaccugaagugccgucuccgcauggacaaacugcagcuuaagggcaugaguuauucuauguguaccgggaaauucaagguaguuaaggagauagccgaaacacaacauggaacuauuguggucagagugcaguacgagggcgaugguuccccaugcaaaauccccuucgagaucauggaccuggaaaagaggcacgucuuggggcggcucauuaccgugaacccgaucguuacggagaaagauagcccugugaauauugaagcugagcccccauuuggcgacucguacauaaucauuggaguagaaccuggccagcugaaguuaucuugguucaaaaagggguccucaaucggacagauguuugagaccacaaugcgaggugccaagcgcauggcaauccugggcgauacugccugggacuucgggagucuaggaggcgucuuuaccagcauugguaaagcucuccaucaaguguucggggcgauauauggcgcagccuuuuccggaguuucuuggacaaugaagauccugauuggcguggucaucacuuggauugggaugaacagcagaucaaccagucuuuccgugagcuugguacuggugggaguugucacgcucuaccugggcgugauggugcaggcugauucugguugugucguuucauggaaaaauaaggagcuuaaaugcgggaguggaaucuucauaacagacaacgugcacaccuggacugaacaguauaaguuucagcccgagagcccauccaagcuggccucugcaauccaaaaagcccacgaagagggcauuugugguaucaggucggugacacgguuggaaaaucucauguggaagcagauuacccccgagcugaaccauaucuuaagcgagaaugaaguaaaacugacuauaaugaccggcgauauuaaggggaucaugcaggcuggaaaacgcucccuaagaccucagccaacagagcucaaguacucauggaaaacguggggcaaggccaagaugcugaguaccgaacuucacaaccauacuuucuugauugacgggccggagacagcagaaugccccaccacaaauagggcguggaacucucuggaggucgaggauuauggauuuggcguguucacuaccaauaucuggcucaaacugaaggaacgucaagacguuuuaugugacagcaaacugauguccgcugccauaaaggauaaccgggcagugcacgccgacauggguuacuggaucgagucagcucuuaaugauacguggaaaauugaaaaggccagcuuuaucgaggucaagucuugccacuggccuaaaucccauacauuguggaguaacggggugcucgagagcgaaaugauuaucccaaagaacuucgcaggacccguuucucagcacaauuaucgaccuggcuaccauacccagacugcugguccauggcaccugggcaaacuagagauggacuucgauuuuugugaagggaccacagugguagucacugaggacugcggaaacagaggccccucccugaggaccacaacggccucagggaagcucauaaccgaauggugcugucgcaguugcacucugccgccucuucgguacagaggagaggauggcuguugguaugguauggagauuaggccauugaaagacaaggaagagaaucuggugaacagcuuagugacagcggggcauggacagaucgauaauuucucgcucggcguccuggguauggcccuuuuucuggaagagauguugcgcacccgaguuggcacuaagcacgcuauccuccugguggcaguauccuucgugacacuaauuaccgggaacaugucuuuucgggaccugggacgugucauggugaugguuggcgccacgaugacugaugacaucgggaugggagugaccuaccucgcucugcuugccgcauucaaagucagacccacauuugcggccggcuugcuguuaaggaagcucaccagcaaagaacugaugaugacuacaauugguauagugcuucugucacaaaguaccaucccugagacaauucuagagcucacugaugcucuggccuuggggaugaugguucugaagaucgugcgcaauauggaaaaauaucaguuagcagucaccauuauggcuauccucugcguacccaacgccgugauacugcagaaugcauggaagguuuccuguacgauccuugccguggucucugugagcccacuguugcucacauccucacaacagaaggcugacuggauuccucuggcgcuaaccaucaaaggacugaaccccacugccauuuuccuuaccacacucagccggacaaguaagaaaagaucuuggccacugaaugaggcaaucauggcuguaggcaugguguccauauuggccagcucgcuguuaaagaacgacauuccgaugaccggcccucucgucgccgggggacugcuuacgguuugcuacgugcugacagguaggucagcugauuuggaacucgagcgagcagccgacgugcgcugggaagaucaggcggagaucucuggcaguucccccauccugagcauuaccauaucugaggacgggagcauguccaucaaaaaugaagaggaagaacagacucuaacaauucugauccggaccggacuucucgucauuucaggccuguuuccagugaguauccccauaacugcugccgcaugguauuugugggagguuaagaaacaaagagccgguguauuaugggaugugccuagcccacccccugucgggaaggcugaacuggaggacggagcauacaggaucaagcagaaaggcauucucggcuauucucagaucggggccggaguguacaaggaagguacauuccacaccauguggcauguuacgcguggcgcggugcugaugcacaaagggaagcgcauugagccguccugggcugauguccggaaagaccuuaucucauacggaggcgguuggaagcuggaaggggaguggaaggagggagaagaggugcagguauuggcccuagaaccaggcaaaaaccccagagcaguccaaacuaagccuggccuguuuaaaaccaauacagggaccauaggagccgugagucucgauuucagcccagguacauccggcucucccauuguugacaagaaagggaagguggucggacuguauggcaacggugugguuacuaggucggggaccuacgugagcgcuaucgcccagacggagaagucaaucgaagauaacccugagauugaggacgauaucuuuagaaagaagcggcuuacaauaauggacuuacauccgggagcaggcaaaacuaagcgcuaucugcccgcuauugucagagaagccaucaaaaggggccuccggaccuugauucuggcgccaacacgagugguagccgcagagauggaagaggcucucagagggcugccuauccgcuaccagacccccgccauaagggcugaacacacuggacgugagauuguggaccuuaugugucaugcaaccuucacaaugcggcuguuguccccaguuagagucccuaauuauaaccuaaucaucauggaugaggcccacuucacggaccccgccaguauugcugcgagggguuacaucucuacucgcguggaaaugggcgaggcagccgggauuuuuaugaccgcuacaccaccgggaagccgagauccuuucccccaguccaaugccccaauaauggacgaagagagagagauccccgaacggucauggaacucuggccacgagugggugaccgauuuuaaggguaagacugucugguucguaccuagcauuaaagcagggaaugacaucgccgcuugccugaggaagaacggcaaaaaggugauccaacucagucgcaaaacauuugauuccgaauauauuaagacccguacgaaugacugggauuucguugugacuacagacauaagcgagaugggcgcgaacuuuaaggccgaaagagucaucgauccacggagguguaugaaacccgugauuuuaaccgacggcgaggagcgcguuauccuggcagggccuaugccggugacccauucuucagcugcccagcgaagaggacggauugguaggaauccaaagaacgaaaaugaccaguacaucuacaugggcgagccccuugaaaacgaugaggacugcgcacacuggaaagaagccaagaugcugcucgauaauauaaacacuccugaggggaucauucccuccauguucgagccagaacgcgagaaagucgacgcuaucgauggagaauauagauugaggggcgaggcccggaagacauuuguggaccugaugcgucgcggugaucucccuguauggcuggcguaccgaguggcagccgaagggauuaauuaugcugacagaaggugguguuucgauggcaucaaaaacaaccaaauacuugaggagaauguugaagucgagauuuggaccaaggaaggagagcggaagaaacuaaagccccgcuggcuggacgccagaaucuacagugauccauuggcuuuaaaagaguuuaaggaguucgcagccggcaggaaaagccugacacucaaccugauuacugagauggggcggcuuccuacguucaugacccagaaggcucgaaaugcccuggacaaccucgcaguguugcauacagcggaagccggagguagagcuuauaaucacgcccugucggagcuaccggaaacucuggagacccuccuucuguuaacauugcuggcaaccgugacuggcgggaucuuucucuuccugaugucuggaaagggcauagguaaaaugacgcuugggaugugcugcaucauuaccgcuuccauccugcucugguacgcccagauucagccccacuggaucgcagccagcauaauuuuggaguuuuuccugaucgucuuacuaaucccagaaccugagaagcaacgcacaccccaggauaaccagcugacuuauguugugauugcuauccucaccguaguggcggccacaauggcaaaugaaaugggcuuucuugagaaaaccaagaaagacuucggacugggcucaauagcuacucagcaaccagaaaguaacauuuuggacaucgaucugaggccugccucugccuggacacucuacgcagucgcuacgaccuuuauuacucccaugcugcggcauuccaucgagaauagcucagugaacguuagucuuacagccauagcgaaucaggcuaccgugcucauggggcugggaaaggguuggccguugagcaagauggacaucggcgucccacuguuagccauuggguguuacucccagguaaacccuaucacccuaacagcagcccugcuccuucugguggcucacuaugcaauuaucggacccggcuugcaggccaaagcgacucgugaggcucaaaagagagccgcagccgguauuaugaaaaauccaacgguugaugggaucaccgugauagaccuggaucccauuccuuacgacccgaaguucgaaaaacagcucggccaggucaugcugcuuguguuaugcgucacacaggugcugaugaugaggacuaccugggcucucugugaggccuugacacuggcaaccggacccaucucuacucuaugggaaggcaacccagggcgcuuuuggaauacgacaaucgcuguuagcauggccaacauuuuccggggauccuaucuggcgggcgccggucuccuauuuucaauaaugaagaauaccgcaaacacucgaagagggaccggaaacacaggcgagacucugggugaaaaguggaaaaauagguugaacgcucugggcaagucugaguuccaaaucuacaaaaagagugggauucaggagguggaucgcacccucgccaaagaaggaaucaagcggggcgagacagaccaucacgcaguaucgagagggagcgcuaaacugcguugguuuguggaaaggaauuuagucacgccugagggaaagguuguggaucuuggcugcgguagagggggaugguccuauuacuguggcggucugaagaacgucaaagaggugaagggccucaccaaagggggacccggccaugaggaaccuauuccaaugucuacuuauggguggaaucuaguacgccugcagucaggaguggacguuuucuucacacccccugaaaagugcgauaccuugcugugugacaucggcgagagcuccccaaaccccacuguggaagccggucgaacacucagaguccuuaaucugguggagaacugguugaauaacaauacccaauuuugcauaaaaguccugaacccguacaugccuagugugaucgagaagauggaagcccuccagaggaaguacgggggagcguuaguucggaauccacugucucgcaacagcacgcacgagauguauuggguaucaaaugcuuccggcaacauugugaguagcgucaacaugaucucuagaaugcuuauuaauagguucaccaugcgacacaaaaaggcaacauacgaacccgauguggaccugggcuccgggacucggaacaucggaauagagucagaaauuccuaaucuagacguuaucgguaaacguaucgagaagauuaaacaggagcaugaaaccagcuggcacuaugaucaggaccauccauacaagacaugggccuaucacggcucguacgagacuaagcaaaccgggucugcuaguuccauggugaacggagucgugagacuccugacaaaacccugggauguaauaccgauggugacccagauggccaugacugacacgacaccuuuuggccagcagcgcguuuucaaggaaaaagucgauaccaggacucaagagcccaaggaagguaccaaaaaguugaugaagaucacagcagaguggcuguggaaagagcucgggaagaaaaagacgccacggauguguaccagagaagaguuuacucgcaaagugaggagcaaugccgcucuuggagcgauuuauacagacgaaaacaaguggaaaucagcccgagaggcaguggaggauucccgguucugggaacuggucgacaaggagagaaauuuacaccuggaaggcaagugcgagaccuguguuuacaacaugaugggcaaaagggaaaagaaauugggggaguuuggaaaggcuaaagguucucgcgccaucugguacauguggcucggcgcacguuuccuggaguuugaagcccuaggguuccuuaaugaggaucauugguuuagccgggaaaacagucuguccggaguggagggcgaaggucuccacaagcugggguauauuuugagagacguaagcaagaaagagggaggcgcuauguacgccgaugacacugcgggcugggacacaaggaucacccuggaggaucucaagaaugaagagauggugacaaaccauauggaaggggagcacaagaaacuugcagaagccauauucaaacugacuuaucagaauaaagucgugcgcguucagcgaccuacaccccggggaacggugauggacaucauuucuagaagggaucagcgcgguucaggccaagucgugaccuacggguuaaacacauuuacuaauauggaggcucagcugaucagacagauggagggagaaggcguauucaagaguauucaacauuugaccguuacagaggaaaucgccgugaaaaacuggcucgcacgggucgguagggagcgucugucccgaauggcuauuagcggggacgauugcguggugaagccacuagacgaucgcuucgccucugcucuuacugcccugaacgacaugggaaaagucagaaaggauauacagcagugggagcccucgcggggcuggaaugacuggacccagguuccuuuuugcucacaccacuuccaugaacucaucaugaaagauggcagggugcugguagugccaugucgcaaccaagacgaguugauugggagagcacggaucagccagggagcggguugguccuuaagggaaacggccugccugggcaagaguuaugcucagauguggucucucauguacuuucaccgacgugaucuuagacuggccgcaaaugcuaucuguagcgccgucccgucccauugggugcccacaucacgcaccacuuggaguauucacgcaacacacgaguggaugaccacugaagacaugcuaaccguuuggaaccggguguggauacaggagaauccuuggauggaggacaagacaccagucgaaucuugggaggaaauccccuaucuggggaaaagggaggaucaauggugcggaagccucauuggcuugacguccagagccaccugggcgaagaacauccagacugcuauuaaucaggugcgcucacugaucgguaacgaagaguacacagacuacaugccuagcaugaaacgguucaggcgagaggaagaggaagccgggguacuuugguga

SEQ ID NO: 15009 - RNA, 9876 nt, Artificial Sequence
  derived and/or modified CDS sequence (opt3) from DENV-2__GQ398264__SS-prME
accgccggcaugaucauuaugaugauacccacagugauggcuuuccaccugacuacgagaaacggggagccucauaugaucgucagcaggcaggaaaagggaaaaucccuccuuuuuaagaccgagaaugguguuaacaugugcacacugauggcaauggacuugggcgaauuaugugaggauacuauuaccuacaauugcccacugcuacggcaaaacgaaccggaggacaucgauuguuggugcaauucuacaucaaccugggugacuuaugggacauguaccgccacgggagagcaccgccgagaaaaacguaguguagcgcucgugccccaugucggcaugggucuggagacuagaaccgaaacauggaugagcuccgagggggcuuggaagcacgcccagaggauugagacuugggugcuucggcauccuggauucaccaucauggcagccauacuggcuuacacaaucggcaccacguauuuucagcgcguuuugauuuucauccuccugacugcaguggccccaucuaugacaaugagaugcauuggcaucucgaacagggacuuugucgaaggggugucaggagguagcuggguagauauaguucuggagcacggcaguugugugaccacuauggcuaaaaauaagcccacacucgacuucgaauuaauuaagaccgaggccaaacacccugcgacgcugcggaaguacugcaucgaagcaaaacuuaccaacacaacuaccgccucccgcuguccaacacagggggagcccucuuugaaugaggaacaagauaagcgauuugucugcaaacauagcaugguggacagaggauggggcaacgguugugggcuguucggaaagggcggcauugugacuugcgcuauguuuaccugcaagaaaaauauggaggggaaggucguucagccugaaaaccuagaguauacaaucgugaucaccccacacuccggagaagagaaugccguagguaacgauacuggcaaacaugggaaggagauuaaaauaacgccgcagucaaguaucacagaagcagagcucaccggauacggcacugugaccauggaauguagccccaggacaggucuggacuucaaugagaugguccuucugcagauggaaaacaaggcuugguuggugcaccggcaaugguuucucgaucugccuuuaccauggcugcccggggccgacacccagggcucuaacuggauucagaaagagacucucguuacauucaagaauccucacgcgaagaaacaggauguggucgugcuuggaucccaagagggcgccaugcauacggcacugaccggggcuacugaaauccagaugucaagcggaaacuugcuauuuacaggucaccugaagugccgucuccgcauggacaaacugcagcuuaagggcaugaguuauucuauguguaccgggaaauucaagguaguuaaggagauagccgaaacacaacauggaacuauugugaucagaguccaguacgagggcgacgguuccccaugcaaaauccccuucgagauuauggaucuggaaaagaggcacguguuggggcggcucaucaccgucaauccgauugugacggagaaagacagcccuguuaacauagaagcugagcccccauuuggcgauucguacaucauuaucggaguggaaccuggccagcugaaguuaucuugguucaaaaagggguccucaaucggacagauguuugagaccacaaugcgaggugccaagcgcauggcaauucugggcgacacugccugggauuucgggagucuaggaggcguauuuaccagcauagguaaagcucuccaucaagucuucggggcgaucuauggcgcagccuuuuccggagugucuuggacaaugaagauucugaucggcguugugauuacuuggaucgggaugaauagcagaucaaccagucuuuccgucagcuuggugcugguaggagugguuacgcucuaccugggcgucauggugcaggcugacucugguuguguggucucauggaaaaacaaggagcuuaaaugcgggaguggaauauucaucacagauaauguucacaccuggacugaacaguauaaguuucagcccgagagcccauccaagcuggccucugcaauucaaaaagcccacgaagagggcaucugugguauuaggucggugacacgguuggaaaaccucauguggaagcagaucacccccgagcugaaucauauauuaagcgagaacgaagugaaacugacuauuaugaccggcgacaucaaggggauuaugcaggcuggaaaacgcucccuaagaccucagccaacagagcucaaguacucauggaaaacguggggcaaggccaagaugcugaguaccgaacuucacaaucauacuuucuugaucgaugggccggagacagcagaaugccccaacaccaauagggcguggaacucucuggagguagaggacuauggauuuggcgucuucacaacuaauauauggcucaaacugaaggaacgucaagauguguuuugugacagcaaauuaauguccgcugccaucaaggacaaccgggcaguucacgccgauauggguuacuggauugagucagcucugaacgacaccuggaugaucgaaaaagccagcuucauugaggugaagucuugccacuggccuaagucccauacgcuuuggaguaauggggucuuggagagcgaaaugaucauaccaaaaaacuucgcaggacccgugucucagcacaauuaucgaccuggcuaccauacacagaccgcugguccauggcagcucggcaagcuggagauggauuuugacuucugugaagggacuaccguugugguaacagaggauugcggaaacagaggccccucccuaaggacuaccacagccucagggaaacugauuacggaauggugcugucgcaguugcacccucccgccucugcgguacagaggagaggacggcuguugguaugguauggagaucaggccacuuaaggaaaaagaggaaaauuuggucaacagccuggugacugcggggcacggacaaaucgauaauuuuucguuaggcgugcucgguauggcccuguuccuugaggaaaugcugcgcacacgagucggcaccaagcaugcuauuuugcucguugcaguguccuuuguaacucugaucacagggaacaugucuuuccgggaccuaggacgugugauggucauggugggcgccaccaugacggaugacauugggaugggaguuacuuaccuggcucuccuggccgcauuuaaggugagacccaccuucgcggccggccuuuugcugaggaaauuaacaagcaaggagcucaugaugaccacuauagguaucguccugcuuucacagaguacaauuccugagaccauccuggaacuaacagaugcucucgcccuggggaugaugguguugaaaauuguucgcaauauggagaaguaucagcuggcagugacuaucauggcuauauuaugcguccccaacgccguaauccuccaaaaugcauggaaaguguccuguaccacgcuggccguugugucugucagcccacuucuguugacauccucacagcagaaggcugacuggauuccucucgcgcugaccaucaagggacuaaaccccacugccauuuuucugaccacacuuagccggacuaguaaaaagagaucuuggccacucaaugaagcaaucauggcugugggcaugguauccauacuggccagcucguugcugaaaaacgauauuccgaugaccggcccuuuaguggccgggggacuccugacggucugcuacguucuuacagguaggucagcugaccuggaguuggaacgagcagccgacgugcgcugggaggaucaggcggagaucucuggcaguucccccauccucagcauuaccauaucugaagacgggagcauguccaucaagaaugaggaagaggagcaaacucugacaauucuaauccggaccggacugcuugugauuucaggccucuucccagucaguauccccauaacugcugccgcaugguaucugugggaagugaaaaagcagagagccgguguuuugugggauguaccuagcccacccccuguggggaaagcugaguuagaagacggagcauacaggaucaagcagaagggcauucugggcuauucucagaucggggccggagucuacaaagaggguacauuucacaccauguggcacgugacgcguggcgcgguucucaugcauaaggggaaacgcauugaaccguccugggcugaugugcggaaggaccugaucucauacggaggcgguuggaaacuugagggggaguggaaggaaggagaggaaguccaagugcuggccuuggagccaggcaagaaccccagagcaguacagacuaaaccuggccuauucaagaccaacacagggaccauaggagccgucagucuggauuuuagcccagguacauccggcucucccauuguggacaaaaaggggaaaguugugggacucuauggcaauggugucgugacuaggucggggaccuacguuagcgcuaucgcccagacggaaaagucaaucgaggauaacccugagauugaagacgauaucuuccgaaagaaacggcugacaauaauggaccuucacccgggagcaggcaagacuaaacgcuauuuacccgcuauugugagagaggccaucaagaggggccugcggacccucauuuuggcgccaacacgagucguggccgcagaaauggaggaagcucugagagggcucccuauccgcuaccagacccccgccauaagggcugagcauacuggacgugagauuguagaucugaugugucacgcaaccuucacaaugcggcuucuguccccagugagaguuccuaauuauaacuugaucaucauggacgaagcccauuuuacggaccccgccaguauugcugcgagggguuacaucucuacucgcgucgagaugggcgaagcagccgggauuuucaugaccgcuacaccaccgggaagccgagauccuuuuccccaauccaaugccccaauaauggacgaggagagagaaauccccgagcggucauggaacucuggccacgaaugggugaccgauuucaaagguaagacugugugguuugucccuagcauuaaggcagggaaugacaucgccgcuugccuaaggaaaaacggaaagaaaguaauccagcugagucgcaagacauucgauuccgaguauauuaaaacccguacgaaugacugggauuuugugguuacuacagacauaagcgaaaugggcgcgaacuucaaggccgagagagugaucgauccacggagguguaugaagcccgucauucucaccgacggcgaggaacgcgugaucuuagcagggccuaugccgguuacccacucuucagcugcccagcgaagaggacggguggguaggaauccaaaaaacgagaaugaucaauacauuuacaugggcgaaccccuggagaacgacgaagacugcgcacauuggaaggaggccaaaaugcuucuggauaauaucaacacuccugaggggauaauccccuccauguuugaaccagagcgcgaaaaggucgacgcuauugauggagaguauagacucaggggcgaagcccggaaaacauucguggacuugaugcgucgcggugaucugccuguauggcucgcguaccgaguggcagccgaggggaucaacuaugcugacagaaggugguguuuugauggcguuaagaauaaccagauucuggaggaaaaugucgagguggaaaucuggaccaaagagggagagcggaagaagcuuaaaccccgcuggcuagacgccagaauauacagugauccacuggcuuugaaggaauucaaagaguucgcagccggcaggaagagcuuaacacugaaccucauuacugaaauggggcggcugccuacguuuaugacccagaaagcucgaaaugcccuugacaaccuggcagugcuccacacagcggaggccggagguagagcuuauaaucaugccuugucggaacugccggagacucuagagacccugcuccuucugacauuauuggcaaccgucacuggcgggaucuuccuguuucucaugucuggaaagggcauugguaagaugacgcuggggaugugcugcaucauaaccgcuuccauccuucugugguacgcccagauucaaccccacuggaucgcagccagcauuauccucgaauucuuuuugauaguucuguuaauuccagagccugaaaaacagcgcacaccccaggauaaccagcuaacuuaugugguaaucgcuauccugaccguggucgcggccacaauggcaaaugagaugggcuuccucgaaaagaccaaaaaggacuuuggacuuggcucaacugcuacacaacagccagagaguaacauucuggauaucgacuugaggccugccucugccuggacgcuguacgcaguggcuaccacuuucauaacacccaugcuccggcacuccauugagaauagcucaguuaacgugagucugaccgccaucgcgaaucaggcuaccguccuuauggggcucggaaaagguuggccgcugagcaagauggacauuggcguaccauugcuggccaucggguguuacucccaggugaacccuauaacauuaacugcagcccuacugcuccuuguugcucauuaugcaaucauuggacccggccugcaagccaaggcgacgcgugaagcucagaaaagagccgcagccgguaucaugaagaauccaaccguggaugggauuacagucaucgacuuggaucccauuccuuacgacccgaaauuugagaagcagcugggccaggugaugcuccugguccuuugcgugacucaaguuuuaaugaugaggaccacaugggcucugugugaagcccucaccuuggcaacuggacccaucucuacgcugugggagggcaacccagggcgcuucuggaauacaaccauagcugugagcauggccaacauuuuucggggauccuaucuagcgggcgccggucugcucuucucaaucaugaaaaacacugcaaauacccgaagagggacaggaaacacuggcgaaacccuuggugagaaguggaagaauaggcugaacgcuuugggcaaaucugaguuucagaucuacaagaaaagugggauucaggaaguagaucgcacacuggccaaggagggaauaaaacggggcgaaacggaccaccaugcagugucgagagggagcgcuaagcuccguugguucgucgagaggaaucugguuaccccugagggaaaaguggucgauuuaggcugcggucgggggggaugguccuauuacuguggcggucuuaagaacgugaaggaaguaaaaggccugacuaaggggggacccggccacgaggaaccuaucccaaugucuacauauggguggaaucucgugcgccuacaaucaggaguugacguguucuuuacccccccugagaaaugcgauacucuguugugugacauuggcgaaagcuccccaaaccccacagucgaggccggucgaacccugagagugcucaaucuugucgagaacuggcugaauaacaauacgcaguucugcaucaagguguugaacccguacaugccuaguguuauugaaaaaauggaggcccugcagaggaaguacgggggagcgcucguacggaauccauuaucucgcaacagcacccaugaaauguauugggugucaaacgcuuccggcaauaucgucaguagcgugaacaugauaucuagaaugcugaucaauagguuuacaaugcgacacaagaaagcaacuuacgagcccgauguugaccuuggcuccgggacccggaacauuggaaucgaaucagagacaccuaaucuggauauuaucgguaagcguauagagaaaauuaagcaggaacacgagacuagcuggcauuaugaccaagaccacccauacaaaaccugggccuaucauggcucguacgaaacaaagcagaccgggucugcuaguuccauggugaacggagucgugagacuacucacuaagcccugggauguaaucccgauggugacgcagauggccaugacagacaccacuccuuucggccagcaacgcguuuuuaaagagaaggucgauaccaggacacaggaacccaaagaggguacgaagaaacugaugaagaucaccgcagagugguuguggaaggaacuggggaaaaagaaaacuccacggauguguacaagagaggaauucacccgcaaggugaggagcaaugccgcucucggagcgauuuuuacugacgagaacaaauggaagucagcccgagaggcaguggaagauuccggcuucugggagcuugucgacaaagaacggaaucugcacuuagagggcaagugcgaaacauguguuuauaacaugauggggaagagagagaaaaagcugggagaguuugguaaagcuaagggcucuagggccauaugguacaugugguugggggcacgcuuccucgaauuugaggcccugggauuccuaaaugaagaucacugguuuagccgugagaacagucuuuccggcguggaaggugaggggcugcauaaacucggauacauccugcgggacguaagcaagaaggagggcggcgcuauguaugccgaugacaccgcggggugggauacaagaauuacuuuggaagaccugaaaaaugaggaaauggugaccaaccacauggagggagaacauaagaaacucgcagaggccaucuucaagcuuacguaccagaauaaagucgugaggguucagcgcccuaccccccgagguacagugauggacauuaucucucggagagaucaaaggggcucagggcaggucgugacuuauggacugaacaccuucacaaacauggaggcucaguuaauacgccaaauggaaggcgaggguguauuuaagaguauccagcaccugacuguuaccgaagagauugccgugaagaauugguuggcaagagucgggcgggagaggcucucccguauggcuaucagcggagacgauugcguggugaaaccacuggacgaucgauucgccucugcucuaacggcccuuaacgacaugggcaagguccgcaaagauauucagcagugggaacccucgagaggcuggaaugacuggacacaaguuccuuuuugcucacaucacuuccacgagcugaucaugaaggaugggcgggugcucguagugccauguaggaaccaggacgaacugauuggacgcgcaagaauaagccagggugcgggcugguccuugcgggagaccgccugcuuagggaaaaguuacgcucagauguggucucugauguauuuucauaggcgagaucuccgucuugccgcaaaugcuaucuguagcgccgucccgucccacugggugcccacuucaagaacaaccuggaguauucaugcaacucacgaauggaugaccacagaggacaugcugacgguuuggaaccgcguguggauccaagagaauccuuggauggaagauaagaccccagucgagucuugggaagagauccccuaccuaggaaagcgggaagaccaguggugcggcagccugauuggucucacuuccagggccacaugggcgaaaaacauacagaccgcuaucaaucaggugagaucauugauugggaacgaggaguauacugacuacaugccuagcaugaagcgcuuccggagggaagaggaagaggccggaguacugugguga

SEQ ID NO: 15010 - RNA, 9876 nt, Artificial Sequence
  derived and/or modified CDS sequence (opt3) from DENV-2__GQ398260__SS-prME
accgccggcaugaucauuaugcugauacccacugugauggcuuuccaccucacuacgaggaauggggaaccucauaugaucgucagcaggcaggaaaagggaaaaucccuucuguuuaagaccgaagacgguguuaauaugugcaccuugauggcaauggauuuaggcgaacugugugaagacacuauuaccuacaauugcccacuacuccggcaaaaugaaccggaagauaucgacuguuggugcaacucuaccucaaccugggugacuuaugggacauguaccgccacgggagagcaccgccgagaaaaacguaguguggcgcuggugccccaugucggcaugggucuugagacuagaaccgaaacauggaugagcuccgagggggcuuggaagcacgcccagaggauugagacuuggauccugcggcauccuggauucaccauaauggcagccaucuuggcuuacacaauuggcaccacguauuuucagcgcgugcucaucuucauucugcugacugcaguugccccaucuaugacaaugagaugcaucggcauaucgaauagggauuuuguggaaggggucucaggagguagcuggguggacauuguacucgagcacggcaguuguguuaccacuauggcuaaaaacaagcccacauuagauuucgaacugaucaagaccgaggccaaacagccugcgacgcuucggaaguacugcauugaagcaaaauugaccaauacaacuaccgccucccgcuguccaacacaaggggagcccucucugaacgaggaacaggacaagcgauuugugugcaaacacagcauggucgauagaggauggggcaaugguugugggcuauucggaaagggcggcaucgugacuugcgcuauguuuaccugcaagaaaaacauggaggggaaggugguccagccugaaaaucucgaguauacaaucguuauuaccccacauuccggagaagagaacgccguggguaaugacacuggcaaacacgggaaggagauaaaaaucacgccgcagucaaguauuacagaagcagagcugaucggauacggcaccguaacuauggaauguagccccaggaccggucuugauuucaacgagauggugcuguugcaaauggaaaauaaggcuuggcucguccaucggcagugguuucuggacuuaccucugccauggcuccccggggccgauacacagggcucuaacuggauacagaaagagacccuugugacuuucaagaacccucacgcgaagaaacaagacguugugguccugggaucccaggagggcgccaugcacacagcauugacgggggcuaccgaaauucagaugucaagcggaaaucuacuguuuacuggucaucucaagugccgucugcgcauggacaaacuucaacugaagggcaugaguuauucuauguguacagggaaauucaaggugguaaaggagaucgccgaaacccagcacggaacaaucguuauuagagugcaguacgagggcgaugguuccccaugcaaaauccccuucgagauuauggacuuggaaaagaggcauguccucgggcggcugauaacugugaacccgaucgucaccgagaaagauagcccugugaauauugaagcugagcccccauuuggcgacucguacaucaucauuggaguugaaccuggccaguuaaagcugaacugguucaaaaaggggucuuccauaggacaaauguuugagacgaccaugcgaggugccaagcgcauggcaauccuaggcgauacagccugggacuucgggucacucggaggcguguuuacaaguauugguaaagcucugcaccagguauucggggcgaucuauggcgcagccuuuagcggagucuccuggaccaugaagauucuuaucggcgugguuauaacauggaucgggaugaacucuagaagcacuucauugagugugucccugguccucgugggaguagugacccuguaccuuggcguuaugguccaggcugauagcgguuguguggugucuuggaaaaacaaggagcugaaaugcgggucaggaauuuucgucacggacaauguucauacauggaccgaacaguauaaguuucaacccgagaguccaagcaaguuggccuccgcaauccagaaagcccacgaagagggcauuugugguaucaggucugugacucggcucgaaaaccugauguggaagcagauaacacccgaguuaaaucacauucugucggagaacgaagugaaacuaaccaucaugacuggcgauauuaaggggaucaugcaggcuggaaaacgcagccucagaccucaaccaaccgagcugaaguacuccuggaaaacauggggcaaggccaagaugcuuucaacggaauugcauaaucagaccuuccugauagacgggccggagacugcagaaugccccaacacaaauagggcguggaacagucucgagguagaggauuauggauuuggcgucuucaccacaaauaucuggcugaaauuaaaggaacgucaggacguguuuugugacucuaaacugaugagcgcugccauuaaggauaaccgggcaguucacgccgacauggguuacuggaucgaguccgcucuuaacgauacuuggaaaauugaaaaggccucauucaucgagguaaagagcugccauuggccuaaaucucacaccuugugguccaaugggguccucgagagugaaaugauaauuccaaagaacuucgcaggacccgugagccagcacaauuaucgaccuggcuaccauacgcaaacagcugguccauggcaccugggcaaacuagagauggacuuuaacuucugugaagggaccacuguugugguaaccgaggauugcggaaauagaggccccucucugaggacaacuaccgccuccgggaagcucaucacagaauggugcugucgcucaugcacgcugccgccucuucgguacagaggagaggacggcuguugguaugguauggagaucaggccauugaaagaaaaggaggaaaaccuggucaauaguuuagugaccgcggggcauggacagauugauaacuuuagccucggcgugcuggguauggcccuuuuccuggaggaaauguugcgcacucgagucggcacaaagcacgcuauccuccugguugcagugucguuuguaacccuaauuacugggaauauguccuuccgggaccugggacgugugauggucauggugggcgccacaaugaccgaugacauagggaugggaguuacguaccucgcucugcuugccgcauuuaaagugagacccacuuucgcggccggcuugcuguuaaggaagcucaccucuaaagagcugaugaugacaaccaucgguauuguccuucugagccagucaacuaucccugagacaauucuagaacucaccgaugcucuggccuuggggaugauggugcugaagaucguucgcaacauggagaaauaucaauuagcagugacaauaauggcuauccucugcguccccaaugccguaauucugcagaacgcauggaaggugaguuguacuauccuugccguuguguccgucucuccacuguugcucaccagcucccagcagaaggcugacuggauuccucuggcgcuaacgaucaaaggacugaaucccacagccauauuucuuaccacucucucacggaccagcaagaaaagaaguuggccacugaacgaagcaauuauggcugugggcaugguaucuaucuuggccuccagccuguuaaagaaugauaucccgaugacaggcccucucguggccgggggacugcuuacugucugcuacguucugaccgguaggucggcugacuuggagcucgaacgagcagccgacgugcgcugggaggaucaagcggagauuucaggcucuagucccauacuguccaucacgauuagcgaagacgggucuaugagcaucaaaaacgaggaagaggagcagacacuaaccauucugauccggacuggacuucucgugauauccggccuguucccagucucaauccccauuacagcugccgcaugguauuugugggaagugaagaaacagagagccgguguuuuaugggauguaccuaguccacccccuguggggaaggcugagcuggaagacggagcauacaggaucaagcagaaaggcauucucggcuauagccaaaucggggccggagucuacaaggaggguaccuuucauacuauguggcacgugacacguggcgcgguucugaugcacaaagggaagcgcauagaaccgucuugggcugaugugaaaaaggaccuuauuuccuacggaggcgguuggaagcuggagggggaguggaaagaaggagaggaaguccagguguuggcccuagagccaggcaagaacccccgggcaguacagaccaaaccuggccuguucaagacgaauacugggaccaucggagccgucucacucgauuuuaguccagguacaagcggcucccccaucguggacaaaaaggggaagguugugggacuguauggcaacggugucgugaccagaucugggacauacguuucggcuauugcccagacugagaaaagcaucgaggauaauccugagauagaagacgauauuuucaggaagaaacgacuuaccaucauggacuuacauccgggagcaggcaagacgaaacgguaucugcccgcuauugugcgcgaggccaucaagagaggccucaggacauugauacuggcgccaacucgggucguggccgcagaaauggaggaagcucuccgagggcugccuauuagauaccaaacccccgccauccgcgcugagcacacaggaagggagaucguagaucuuaugugucaugcaaccuucacuaugcgucuguugucaccagugcggguuccuaacuauaaucuaauuaucauggacgaagcccacuuuaccgaccccgccuccauugcugcgagagguuacauaaguacaagggucgagaugggcgaagcagccgggaucuucaugacggcuacuccaccgggaucucgcgauccuuuuccccagagcaacgccccaauuauggacgaggagcgagaaauccccgagagauccuggaacucaggccaugaaugggugaccgauuucaaggguaaaacagugugguuugucccuucuaucaaggcagggaacgacauugccgcuugccugcggaaaaauggaaagaaaguaauacagcucagcaggaagaccuucgauagugaguauaucaagacucgcacaaacgacugggauuuugugguuaccacggacauuuccgaaaugggcgcgaauuucaaagccgagcgugugaucgauccaagacgguguaugaagcccgucauuuuaacugacggcgaggaaagggugauccuggcagggccuaugccgguuacacacagcucugcugcccaacgccgaggaagaauaggucggaaccccaaaaaugagaacgaucaguacaucuacaugggcgaaccccuugagaaugacgaagacugcgcacacuggaaggaggccaaaaugcugcucgauaacauuaacaccccugaggggaucauucccucaauguuugaaccagagagggaaaagguggacgcuaucgauggagaguaucgcuugagaggcgaagccaggaaaaccuucgucgaccugaugcggcguggugaucucccuguguggcuggcguaccgcguagcagccgaggggauaaauuaugcugaccgaagaugguguuuugauggcauuaagaacaaucagauccuugaggaaaacguggagguugaaauuuggacuaaggagggagagaggaaaaagcuaaaaccccgguggcuggacgcccgcaucuacuccgauccauuggcuuuaaaggaguucaaagaguucgcagccggcagaaagagucugacacucaaucugauaaccgaaaucgggaggcuuccuacauuuaugacucagaaggcucggaacgcccuggacaaucucgcagucuugcauacggcggaggccggaggucgagcuuauaaccacgcccugagcgaacuaccggagacccuggagacacuccuucuguuaacuuugcuggcaaccgugacaggcgggauuuuccucuuucugaugucgggaaaaggcaucgguaagaugacccuugggaugugcugcauuaucacugcuucuauacugcucugguacgcccaaauucagccccauuggaucgcagccuccaucauuuuggaguucuuucugaucguguuacuaauaccagagccugaaaaacagagaacgccccaggauaaucaacugaccuaugucguuauugcuauccucacagugguagcggccacuauggcaaacgagaugggcuuccuugaaaagaccaaaaaggacuuuggacugggcagcauugcuacacagcagccagagucaaauaucuuggauauagaccugcgcccugccagugccuggacccucuacgcaguggcuacuacauucaucacgcccaugcugaggcacucuauugagaacuccagcgucaaugugucacuuaccgccaucgcgaaccaggcuacuguucucauggggcugggaaaggguuggccguugaguaaaauggacauuggcgugccacuguuagccaucggguguuacagccaagucaauccuauuacacuaaccgcagcccugcuccuucugguagcucacuaugcaaucauaggacccggcuugcaggccaaggcgacccgggaagcucagaaacgugccgcagccgguauuaugaagaacccaacaguggaugggaucacuguuaucgaccuggaucccauuccuuacgacccgaaauuugagaagcagcucggccaagugaugcugcuugucuuaugcgugacgcagguccugaugaugagaaccacaugggcucucugugaagccuugacucuggcaaccggacccauauccacacuaugggagggcaauccagggagguucuggaacaccacuaucgcugugucuauggccaacauuuuucgcggaagcuaucuggcgggcgccggucuccuuuucuccaucaugaagaauacggcaaacacacggcgagggaccggaaauacuggcgaaacccugggugagaaauggaagaacagauugaaugcucugggcaaaucagaguuucagauuuacaagaaaucugggauccaagaaguugauaggacacucgccaaggagggaauaaaacgcggcgaaacugaccaucacgcagugagucgggggucggcuaagcugagaugguucguagagcguaacuuagugaccccugagggaaaggucguugaucuuggcugcgguagagggggauggagcuauuacuguggcggucugaaaaaugugcgggaagucaagggccucacaaaagggggacccggccaugaggaaccuaucccaauguccacguauggguggaaccuagugcgccugcagucuggaguagacguguucuuuacaccaccugagaagugcgauacuuugcugugugacauuggcgaaucaagcccaaaucccacaaucgaggccggucgaacccucagaguucuuaaccugguggagaauugguugaacaauaacacucaguucugcauuaaaguccugaauccguacaugccuuccgugaucgaaaagauggaggcccuccagaggaaguacgggggagcguuaguccggaacccacugagucgcaacucuacacacgaaauguauugggugagcaaugcuucaggcaacauaguuuccaguguaaauaugauuagcagaaugcuuaucaacagguuuaccaugcgacauaaaaaggcaacguacgagcccgauguggaccugggcucugggacccggaauaucggaauugaauccgagacaccuaaccuagauauaaucgguaaacguauugagaagaucaaacaagaacacgagacuucauggcacuaugaccaggaccauccauacaagaccugggccuaucacggcagcuacgaaacaaagcagacugggucggcuucuaguauggucaauggagugguuagacuccugaccaaacccugggaugugauuccgacagucacccagauggccaugacugacacgacaccuuucggccaacagcgcguguuuaaggagaaaguagauaccaggacucaggaacccaaggaggguaccaaaaaguugaugaagaucacagcagaguggcuguggaaagaacucgggaagaaaaagacgccacggauguguaccagagaggaguucacucgcaaagugagguccaacgccgcucuuggagcgauauuuacagacgagaauaaguggaaaagcgcccgagaggcaguugaagauucacgguucugggagcuggucgacaaggaaagaaacuuacaucuggagggcaagugcgaaaccuguguguauaauaugaugggcaaaagggagaagaaauugggggaguuuggaaaggcuaaagguucccgcgccaucugguacauguggcucggcgcacguuuccuggaauuugaggcccuaggguuccuuaacgaagaucacugguuuucucgggagaauagccugaguggaguggaaggcgagggucuccacaagcugggguacauuuugagagacgucuccaagaaagagggaggcgcuauguaugccgaugacacugcgggcugggauacaaggaucacccuggaagaccucaagaacgaggaaaugguuacaaaucauauggagggggaacacaagaaacuugcagaggccauuuucaaacugacuuaccagaacaaggugguacgcgugcaacgaccuacaccccggggaacggucauggacaucauuagcagaagggaucagcgcgguucuggccagguggggaccuauggauuaaacacauucacuaauauggaggcucaacugauaagacagauggaaggcgaggguguuuuuaagucaauccagcauuugaccgugacagaagagauugccguccagaacuggcucgcacggguggggagggagcgucugagucgaauggcuaucuccggagacgauugcguaguuaaaccacuagacgaucgcuucgccagcgcucuuacugcccugaaugacaugggcaaggugagaaaagauauccaacagugggaacccucucggggcuggaacgacuggacccaggucccuuuuugcucgcaccauuuccacgagcucauuaugaaggaugggagggugcugguggucccaugucgcaaucaggacgaauugauagguagagcacggaucucacaaggagcgggcuggagcuuaagggagacggccugccuggggaaauccuacgcucagauguggagucucauguauuuucaccgacgugaucuuagacuggccgcaaacgcuauuuguucugccguuccgagccauugggugcccacaucccgcaccacuuggucaauccacgcacggcaugaauggaugacaaccgaggacaugcuaacuguauggaauaggguguggauucaggagaacccuuggauggaagauaagaccccagucgagaguugggaagagauccccuaccugggaaagagagaagaccaguggugcggcucucucauagguuugacaagccgcgccacgugggcgaaaaauauccaaaccgcuauuaaccaggugcggucccugaucgggaaugaggaguauacugacuacaugccuucaaugaagagguuccgaagagaagaggaagaggccggaguucuuugguga

SEQ ID NO: 15011 - RNA, 9876 nt, Artificial Sequence
  derived and/or modified CDS sequence (opt3) from DENV-2__GQ398262__SS-prME
accgccggaaugaucauuaugcugauacccacagugauggcuuuccaccucacuacgcgaaauggggaaccucauaugaucgucagcaggcaggaaaagggaaaaucccuucuguuuaagaccgaagacgguguuaauaugugcacauugauggcaauggauuuaggcgaacugugugaagacacuauuaccuacaacugcccauuacuccggcaaaaugaaccggaagauaucgacuguuggugcaacucuacaucaaccugggugacuuaugggacauguaccgccacgggagaacaccgccgagaaaaacguaguguagcgcuggugccccaugucggcaugggucuugagacuagaaccgaaacauggaugagcuccgagggggcuuggaagcacgcccagaggauugagacuuggauccugcggcauccuggauucaccauaauggcagccaucuuggcuuacacaauuggcaccacguauuuucagcgcgugcucaucuucauucugcugacugcaguugccccaucuaugacaaugcggugcaucggcauaucgaauagggauuuuguggaaggggucucaggagguagcuggguggacauuguacucgagcacggcaguuguguuaccacuauggcuaaaaacaagcccacauuagauuucgaacugaucaagaccgaggccaaacagccugcgacgcuucggaaguacugcauugaagcaaaauugaccaauacaacuaccgccucccgcuguccaacacaaggggagcccucucugaacgaggaacaggacaagcgauuugugugcaaacacagcauggucgauagaggauggggcaaugguugugggcuauucggaaagggcggcaucgugacuugcgcuauguuuaccugcaagaaaaacauggaggggaaggugguccagccugaaaaucucgaguauacaaucguuauuaccccacauuccggagaagagaacgccguggguaaugacacuggcaaacacgggaaggagauaaaaaucacgccgcagucaaguauuacagaagcagagcugaccggauacggcacuguaaccauggaauguagccccaggacaggucuugauuucaacgagauggugcuguugcaaauggaaaauaaggcuuggcucguccaucggcagugguuucuggacuuaccucugccauggcuccccggggccgauacccagggcucuaacuggauccagaaagagacucuugugacauucaagaacccucacgcgaagaaacaagacguugugguccugggaucccaggagggcgccaugcacacggcauugaccggggcuacugaaauacagaugucaagcggaaaucuacuguuuacaggucaucucaagugccgucugcgcauggacaaacuucaacugaagggcaugaguuauucuauguguaccgggaaauucaaggugguaaaggagauugccgaaacacagcacggaacuaucguuaucagagugcaguacgagggcgaugguuccccaugcaaaauucccuucgagaucauggacuuggaaaagaggcauguccucgggcggcugauuaccgugaacccgauagucacggagaaagauagcccugugaauaucgaagcugagcccccauuuggcgacucguacauuaucaucggaguugaaccuggccaguuaaagcugaacugguucaaaaaggggucuuccauuggacaaauguuugagaccacaaugcgaggugccaagcgcauggcaauacuaggcgauacugccugggacuucgggucacucggaggcguguuuaccaguaucgguaaagcucugcaccagguauucggggcgauuuauggcgcagccuuuagcggagucuccuggacaaugaagauccuuauuggcgugguuaucacuuggauagggaugaacucuagaagcaccucauugagugugucccugguccucgugggaguagugacgcuguaccuuggcguuaugguccaggcugauagcgguuguguggugucuuggaaaaacaaggagcugaaaugcgggucaggaaucuucauuacagacaauguccauaccuggacugaacaguauaaguuucaacccgagaguccaagcaaguuggccuccgcaauccagaaagcccacgaagagggcauuugugguaucaggucuguuacacggcucgaaaaccugauguggaagcagauaacccccgaguuaaaucacauucugucggagaacgaagugcgccuaacuaucaugaccggcgauauuaaagggaucaugcaggcuggaaagagaagccucaggccucaaccaacagagcugaaauacuccuggaagacguggggcaaagccaagaugcuuucaaccgaauugcauaaucagacuuuccugauagacgggccggagacagcagaaugccccaacaccaaucgugcguggaacagucucgagguggaggauuauggauuuggcguauucacaacuaauaucuggcugaaguuaaaagaacggcaggacgucuuuugugacucuaagcugaugagcgcugccauuaaagauaaccgagcagugcacgccgacauggguuacuggaucgaguccgcucuuaacgauaccuggaagauugaaaaagccucauucaucgagguuaagagcugccauuggccuaagucucacacguugugguccaauggggugcucgagagugaaaugauaauucccaagaauuucgcaggacccgucagccagcacaauuauagaccuggcuaccauacacaaaccgcugguccauggcaccugggcaagcuagagauggacuuuaacuucugugaagggacuaccgugguugugacagaggauugcggaaauaggggccccucucugcgcacuaccacagccuccgggaaacucaucacggaauggugcugucggucaugcacccugccgccucuuagauacaggggagaggacggcuguugguaugguauggagauccgcccauugaaggaaaaagaggaaaaccugguaaauaguuuagucacugcggggcauggacagauugauaacuuuagccucggcgugcuggguauggcccuuuuccuggaggaaauguugcgaacacgggugggcaccaagcacgcuauccuccuggucgcaguuucguuugugacucuaauuacagggaauauguccuuccgugaccugggaagaguaauggugauggucggcgccaccaugacggaugacauagggaugggagugacuuaccucgcucugcuugccgcauuuaagguuaggcccaccuucgcggccggcuugcuguuacgcaaacucacaucuaaggagcugaugaugaccacuaucgguauugugcuucugagccagucaacaaucccugagaccauucuagaacucacagaugcucuggccuuggggaugaugguccugaaaaucgugcggaacauggagaaguaucaauuagcaguuacuauaauggcuauccucugcgugcccaaugccgucauucugcagaacgcauggaaaguaaguuguaccauccuugccgugguuuccgugucuccacuguugcucacgagcucccagcagaaggcugacuggauuccucuggcgcuaacaaucaagggacugaaucccaccgccauauuucuuacuacccucucaagaacaagcaaaaagaggaguuggccacugaacgaagcaauuauggcugucggcauggugucuaucuuggccuccagccugcuaaagaaugauaucccgaugacuggcccucucguagccgggggacugcuuaccgugugcuacguccugacgggucgaucggcugacuuggagcucgaacgcgcagccgacguucggugggaggaucaagcggagauuucaggcucuagucccauacuguccaucacaauuagcgaagacgggucuaugagcaucaagaacgaggaagaggagcagacccuaacuauucugaucagaacaggacuucucgugauauccggccuguucccagugucaauccccauuaccgcugccgcaugguauuugugggaagucaaaaagcagagggccgguguguuaugggauguuccuaguccacccccuguagggaaagcugagcuggaagacggagcauaccguaucaagcagaagggcauucucggcuauagccaaaucggggccggaguguacaaagaggguacuuuucauacaauguggcacgucacccgcggcgcggugcugaugcacaaggggaaacggauagaaccgucuugggcugauguuaagaaagaccuuauuuccuacggaggcgguuggaagcuggagggggaguggaaggaaggagaggaagugcaggucuuggcccuagagccaggcaaaaaccccagagcagugcagacgaagccuggccuguucaaaacuaauaccgggacaaucggagccguaucacucgauuuuaguccagguaccagcggcucccccaucgucgacaagaaagggaaggugguuggacuguauggcaacgguguggucacaaggucugggacuuacgugucggcuauugcccagaccgaaaagagcaucgaggauaauccugagauagaagacgauauuuuccggaaaaagagacuuacgaucauggacuuacauccgggagcaggcaaaacaaagcgcuaucugcccgcuauuguuagagaggccaucaaaaggggccuccggacuuugauacuggcgccaacccgaguggucgccgcagaaauggaggaagcucucagagggcugccuauucgcuaccaaacacccgccaucagggcugagcacaccggacgugagaucguggaucuuaugugucaugcaacuuucaccaugcggcuguugucaccaguaagagugccuaacuauaaucuaauuaucauggacgaagcccacuuuacagaccccgccuccauugcugcgagggguuacauaaguacgcgcguugagaugggcgaagcagccgggaucuucaugacugcuaccccaccgggaucucgagauccuuuuccccagagcaacgccccaauuauggacgaggagagagaaauccccgagcgguccuggaacucaggccaugaaugggucacagauuucaaggguaagaccgugugguuugugccuucuaucaaagcagggaacgacauugccgcuugccugaggaagaauggcaaaaaggucauacagcucagccgcaaaacuuucgauagugaguauaucaagacacguaccaacgacugggauuuuguagugacgacugacauuuccgaaaugggcgcgaauuucaaggccgagagaguuaucgauccacggagguguaugaaacccgugauuuuaacagacggcgaggaacgcgucauccuggcagggccuaugccggugacccacagcucugcugcccaacgaagaggacggauagguaggaacccaaagaaugagaacgaucaguacaucuacaugggcgaaccccuugagaaugacgaagacugcgcacacuggaaagaggccaagaugcugcucgauaacauuaacaccccugaggggaucauucccucaauguuugaaccagagcgcgaaaaaguugacgcuaucgauggagaguauagauugaggggcgaagcccggaagacuuucguggaccugaugcgucgcggugaucucccugucuggcuggcguaccgaguggcagccgaggggauaaauuaugcugacagaaggugguguuuugauggcauuaaaaacaaucagauccuugaggaaaacguagagguggaaauuuggacaaaggagggagagcggaagaaacuaaagccccgcuggcuggacgccagaaucuacuccgauccauuggcuuuaaaagaguucaaggaguucgcagccggcaggaaaagucugacccucaaucugauaacagaaauggggcggcuuccuacuuuuaugacgcagaaggcucgaaacgcccuggacaaucucgcaguuuugcauaccgcggaggccggagguagagcuuauaaccacgcccugagcgaacuaccggagacacuggagacucuccuucuguuaaccuugcuggcaacagucaccggcgggaucuuccucuuucugaugucgggaaagggcauugguaaaaugacucuugggaugugcugcaucauuacggcuucuauccugcucugguacgcccaaauacagccccauuggauugcagccuccaucaucuuggaguucuuucugauuguguuacuaaucccagagccugaaaagcagcgcaccccacaggauaaucaacugacauauguggucauagcuauucucacuguuguggcggccaccauggcaaacgagaugggcuuccuugagaaaacaaagaaagacuuuggacugggcagcaucgcuacccagcagccagagucaaauauuuuggauaucgaccugaggccugccagugccuggacucucuacgcaguagcuacaacguucauaacccccaugcugcggcacucuaucgagaacuccagcgugaaugucucacuuacugccauugcgaaccaggcuacagugcucauggggcugggaaaggguuggccguugaguaagauggacaucggcguuccacuguuagccauuggguguuacagccaagugaauccuaucacccuaaccgcagcccugcuccuucuggucgcucacuaugcaauuaucggacccggcuugcaggccaaagcgacacgugaagcucagaagagagccgcagccgguauaaugaaaaacccaacuguagaugggauuacggugaucgaccuggaucccaucccuuacgacccgaaguuugagaaacagcucggccaaguuaugcugcuuguguuaugcgucacccaggugcugaugaugaggacaacuugggcucucugugaagccuugacccuggcaacaggacccauuuccacccuaugggagggcaauccagggcgcuucuggaacacuacgauagcugucucuauggccaacaucuuucggggaagcuaucuggcgggcgccggucuccuuuucuccauuaugaagaauacagcaaacacccgaagagggacuggaaauaccggcgaaacacugggugagaaguggaaaaacagguugaaugcucugggcaagucagaguuucagaucuacaaaaagucugggauucaagaaguggaucgcacucucgccaaagagggaaucaagcggggcgaaaccgaccaucacgcaguuaguagagggucggcuaaacugcguugguucguggagaggaacuuaguaacaccugagggaaagguggucgaucuuggcugcgguagagggggauggagcuauuacuguggcggucugaagaauguucgcgaagugaaaggccucacgaaagggggacccggccaugaggaaccuauaccaauguccaccuauggguggaaccuaguccgacugcagucuggaguggacguauucuuuacucccccugagaaaugcgauacauugcugugugacaucggcgaaucaagcccaaaucccaccguggaggccgguagaacucucaggguucuuaaccugguggagaauugguugaacaauaacacacaguucugcauuaagguccugaauccguacaugccuuccgugaucgagaaaauggaggcccuccagcggaaguacgggggagcguuaguccgcaacccacugaguagaaacucuacccacgaaauguauugggugagcaaugcuucaggcaacauuguuuccaguguaaauaugaucagcaggaugcuuauaaaccgauuuacgaugcggcauaagaaagcaaccuacgagcccgauguggaccugggcucugggacacguaauauuggaaucgaauccgagacuccuaaccuagauaucauugguaagagaauagagaaaaucaagcaagaacacgagaccucauggcacuaugaccaggaccauccauacaaaacaugggccuaucacggcagcuacgaaacuaagcagaccgggucggcuucuaguauggucaauggagugguucgccuccugacaaagcccugggaugugauuccgauggucacccagauggccaugacugacacgacaccuuucggccaacagaggguguuuaaagagaagguagauacccggacucaggaacccaaagaggguaccaagaaauugaugaagaucacagcagaguggcuguggaaggaacucgggaaaaagaaaacgccaagaauguguacccgcgaggaguucacuaggaaggugcgauccaacgccgcucuuggagcgauuuuuacagacgagaauaaauggaaaagcgcccgggaggcaguugaagauucaagauucugggagcuggucgacaaagaaaggaacuuacaucuggagggcaagugcgaaaccuguguguauaauaugaugggcaagcgcgagaaaaaguugggggaguuuggaaaagcuaaggguucccgugccaucugguacauguggcucggcgcacgguuccuggaauuugaggcccuaggguuccuuaacgaagaucacugguuuucuagagagaauagccugaguggaguggaaggcgagggucuccacaaacugggguacauauugagggacgucuccaagaaggagggaggcgcuauguaugccgaugacacugcgggcugggauacacgcaucacccuggaagaccucaaaaacgaggaaaugguuacaaaucauauggagggggaacacaagaaacuugcagaggccauuuucaagcugacuuaccagaacaaagugguacgagugcaacggccuacccccagaggaacggucauggacaucauuagcaggcgcgaucagagagguucuggccagguggggaccuauggauuaaacacauucacuaauauggaggcucaacugauccggcagauggaaggcgaggguguuuuuaagucaauucagcauuugaccgugacagaagagauagccguccagaacuggcucgcaaggguggggcgugagcgacugagucgcauggcuaucuccggagacgauugcguaguuaagccacuagacgauagauucgccagcgcucuuacugcccugaaugacaugggcaaagugcggaaggauauucaacagugggaacccucuaggggcuggaacgacuggacccaggucccuuuuugcucgcaccauuuccacgagcucaucaugaaagaugggcgcgugcugguggucccauguagaaaucaggacgaauugaucggacgggcaaggauuucacaaggugcgggcuggagcuuacgagagacggccugccuggggaaguccuacgcucagauguggagucucauguauuuucaccguagagaucuucgccuggccgcaaacgcuauauguucugccguuccgagccauugggugcccacaucccggaccacuuggucaauccacgcaaggcaugaauggaugacaaccgaggacaugcuaacuguauggaauagaguguggauucaggagaacccuuggauggaagauaaaaccccagucgagaguugggaagagauccccuaccugggaaagcgcgaagaccaguggugcggcucucucauugguuugacaagccgggccacgugggcgaagaauauccaaaccgcuauaaaccaggugaggucccugaucgggaaugaggaguauacugacuacaugccuucaaugaaacgauucagacgggaagaggaagaggccggaguucuuugguga

SEQ ID NO: 15012 - RNA, 9876 nt, Artificial Sequence
  derived and/or modified CDS sequence (opt3) from DENV-2__GQ398261__SS-prME
acagccggaaugaucauuaugcugauacccacagugauggcuuuccaccucacuacgagaaauggggagccucauaugaucgucagcaggcaggaaaaggggaaaucccuucuguuuaagaccgaggacgguguuaauaugugcacauugauggcaauggauuuaggcgaacugugugaggacacuauuaccuacaauugcccacuacuccggcaaaaugaaccggaggauaucgacuguuggugcaacucuacaucaaccuggauuacuuaugggacauguaccgccacgggagagcaccgccgagaaaaacguaguguggcgcuggugccccaugugggcaugggucuugagacuagaaccgaaacauggaugagcuccgagggggcuuggaagcacgcccagaggaucgagacuuggauacugcggcauccuggauucaccaucauggcagccauuuuggcuuacacaaucggcaccacguauuuucagcgcguccucauuuucauccugcugacugcaguggccccaucuaugacaaugagaugcauaggcauuucgaauagggauuuuguugaaggggugucaggagguagcugggucgacaucgugcucgagcacggcaguuguguaaccacuauggcuaaaaacaagcccacauuagauuucgaacugauuaagaccgaggccaaacagccugcgacgcuucggaaguacugcaucgaagcaaaauugaccaauacaacuaccgccucccgcuguccaacacaaggggagcccucucugaacgaggaacaggacaagcgauuuguuugcaaacacagcaugguggauagaggauggggcaaugguugugggcuauucggaaagggcggcaucgucacuugcgcuauguuuaccugcaagaaaaacauggaggggaagguggugcagccugaaaaucucgaguauacaauugucauaaccccacauuccggagaagagaacgccguugguaaugacacuggcaaacacgggaaggagaucaaaauuacgccgcagucaaguaucacagaagcagagcugaccggauacggcacugugaccauggaauguagccccaggacaggucuugauuucaacgagaugguacuguugcaaauggaaaauaaggcuuggcucgugcaucggcagugguuucuggacuuaccucugccauggcuccccggggccgauacccagggcucuaacuggauacagaaagagacucuugucacauucaagaacccucacgcgaagaaacaagacgugguugugcugggaucccaggagggcgccaugcacacggcauugaccggggcuacugaaauucagaugucaagcggaaaucuacuguuuacaggucaucucaagugccgucugcgcauggacaaacuucaacugaagggcaugaguuauucuauguguaccgggaaauucaaggucgugaaggagaucgccgaaacacagcacggaacuaucguaguuagagugcaguacgagggcgaugguuccccaugcaaaauucccuucgagaucauggacuuggaaaagaggcauguccucgggcggcugauuaccgugaacccgauagucacggagaaagauagcccugugaauaucgaagcugagcccccauuuggcgacucguacauuaucaucggaguugaaccuggccaguuaaagcugaacugguucaaaaaggggucuuccauuggacaaauguuugagaccacaaugcgaggugccaagcgcauggcaauacuaggcgauacugccugggacuucgggucacucggaggcguguuuaccaguaucgguaaagcucugcaccagguauucggggcgauuuauggcgcagccuuuagcggagucuccuggacaaugaagauccuuauuggcgugguuaucacuuggauagggaugaacucuagaagcaccucauugagugugucccugguccucgugggaguagugacgcuguaccuuggcguuaugguccaggcugauagcgguuguguggugucuuggaaaaacaaggagcugaaaugcgggucaggaaucuucgucacagacaauguucauaccuggacugaacaguauaaguuucaacccgagaguccaagcaaguuggccuccgcaauucagaaagcccacgaagagggcaucugugguauuaggucugugacacggcucgaaaaccugauguggaagcagaucacccccgaguuaaaucacauacugucggagaacgaagugaaacuaacuauuaugaccggcgauaucaaggggauuaugcaggcuggaaaacgcagccucagaccucaaccaacagagcugaaguacuccuggaaaacguggggcaaggccaagaugcuuucaaccgaauugcauaaucagacuuuccugaucgacgggccggagacagcagaaugccccaacaccaauagggcguggaacagucucgagguagaggauuauggauuuggcgucuucacaacuaauauauggcugaaauuaaaggaacgucaggacguguuuugugacucuaaacugaugagcgcugccaucaaggauaaccgggcaguucacgccgacauggguuacuggauugaguccgcucuuaacgauaccuggaaaaucgaaaaggccucauucauugagguaaagagcugccauuggccuaaaucucacacguugugguccaaugggguccucgagagugaaaugaucauaccaaagaacuucgcaggacccgugagccagcacaauuaucgaccuggcuaccauacacaaaccgcugguccauggcaccugggcaaacuagagauggacuuuaacuucugugaagggacuaccguugugguaacaggagauugcggcaauagagggcccgcccugaggacuaccacagcgucuggaaagcucauuacggaguggugcugucgcuccugcacccugccgccucuucgguacagaggcgaagacgguuguugguaugggauggagaucaggccauugaaagagaaggaagagaaccuggucaauucauuagugacugccggacauggccagaucgauaacuuuagucucggugugcugggcauggcucuuuuccuggaagagauguugcgcacacgagucgggaccaagcacgcaauucuccugguugccgugagcuuuguaacucuaaucacaggaaauaugucguuccgggaccugggccgugugauggucauggugggggcuaccaugacggaugacauuggaaugggcguuacuuaccucgcccugcuugcagcguuuaaagugagacccaccuucgccgcugguuugcuguuaaggaagcucacauccaaagaacugaugaugaccacuauagggaucguccuucugucucagagcacaauuccugagaccauccuagagcucacagaugcccuggcauugggaaugauggugcugaagauuguucgcaacauggaaaaauaucaauuagcugugacuaucauggccauacucugcguccccaaugcaguaauccugcagaacgccuggaaggugucauguaccauucuugcuguugugagugucuccccacuguugcucacgucuagccagcagaaggcggacuggaucccucuggcccuaacaauuaaaggccugaaucccaccgcaaucuuucuuacuacccucucccggacaucaaagaaaagaagcuggccacugaacgaggcuauaauggccgugggcaugguaaguauuuuggccucuucccuguuaaagaaugauaucccgaugacugggccucucguggcuggaggucugcuuaccgucugcuacguucugacgggcaggagcgcagacuuggaacucgagcgagccgcggacgugcgcugggaagaucaagcugagaucucggggucaucucccauucugaguauaacaaucuccgaggacggaagcaugucuauuaaaaacgaagaggaagaacagacccuaacuauccugauucggacaggccuucucgugaucagcggucuguucccagucuccauacccaucaccgccgcagccugguauuugugggaggugaagaaacagagagcugggguuuuaugggauguaccuucaccacccccugugggaaaggcagaacuggaggacggcgccuacaggauuaagcagaaaggcauccucggguauagucaaauuggagcgggugucuacaaggaaggcacuuuucauacaauguggcacgugacccguggggcuguucugaugcacaaaggaaagcgcaucgagccgagcugggccgaugugaaaaaggaccuuauaucuuacggcgguggguggaagcuggaaggagaguggaaagagggcgaagagguccagguguuggcacuagaaccaggcaagaacccccgggccguacagacgaaaccugggcuguucaagacuaauaccggaacaauuggugcugucucccucgauuuuucaccaggcaccagugggagccccaucguggacaaaaagggaaagguugugggccuguaugguaacggggucgugacaagauccggaacuuacguuucugccaucgcacagaccgagaaaucgauugaagauaauccugagaucgaggacgauauauucaggaagaaacgacuuacgauuauggacuuacauccgggcgcuggcaagacaaaacgguaucugcccgccaucgugcgcgaagcgauuaagagagggcucaggacuuugauccuggccccaacccgggucguggcagcugagauggaagaggcccuccgaggacugccuauaagauaccaaacacccgcuauucgcgcagaacacaccgguagggagaucguagaucuuaugugucaugccacuuucaccaugcgucuguugagcccagugcggguuccuaacuauaaucuaaucauuauggacgaggcccacuuuacagaccccgcuucaaucgcggcaagaggcuacauuuccacgagggucgaaaugggggaggccgcuggaauauucaugacugccaccccaccgggcagucgcgauccuuuuccccagucuaacgcaccaaucauggacgaggaacgagagauucccgaaagaagcuggaacuccggucaugagugggugacagauuucaaggggaaaaccgugugguuugucccuucaaucaaggccggaaacgacaucgcugcgugccugcggaaaaauggcaagaaaguaauucagcucucuaggaagacuuucgauagcgaauauauaaagacacgcaccaacgacugggauuuugugguuacgacugacaucagugagaugggcgccaauuucaaagcagaacgugugauugauccaagacgguguaugaagcccgucaucuuaacagacggggaggagagggugauucuggcuggaccuaugccgguuacccacuccagcgccgcacaacgccgagguagaaucggccggaaccccaagaaugaaaacgaucaguacauauacaugggggagccccuugaaaaugacgaggacugcgcccacuggaaggaagcuaaaaugcugcucgauaacaucaacaccccugagggaauuauccccucuauguuugagccagaaagggagaagguggacgccauugauggcgaauaucgcuugagaggugaggcgaggaaaacuuucgucgaccugaugcggcguggggaucucccuguguggcuggcauaccgcguagccgcugaaggcaucaauuaugccgaccgaagaugguguuuugauggaauaaagaacaaucagauucuugaggagaacguggaaguugagaucuggacaaaggaaggcgagaggaaaaagcuaaaaccccgguggcuggacgcucgcauuuacucagauccauuggcauuaaaggaguucaaagaguucgccgcugggagaaagucccugacccucaaucugaucacagagauaggaaggcuuccuacuuuuaugacgcagaaggcccggaacgcacuggacaaucucgcggucuugcauaccgccgaagcugguggccgagccuauaaccacgcacugagugagcuaccggaaacacuggagacucuccuucuguuaaccuugcuggcuacagugaccgggggaaucuuccucuuucugaugagcggcaaagguauugggaagaugacucuuggcaugugcugcaucauuacggccucgauccugcucugguacgcacaaauacagccccauuggauugccgcuucuaucaucuuggaguucuuucugauuguguuacuaaucccagaaccugagaaacagagaacaccacaggauaaucaacugacauaugucguuauagcgauucucacugugguagccgcaaccauggcuaacgaaaugggauuccuugagaagaccaaaaaggacuuuggccugggguccaucgccacccagcagccagaaagcaauauuuuggauaucgaccugcgcccugccucagcauggacucucuacgcuguggccacaacguucauaacccccaugcugaggcacaguaucgagaacucuuccgucaaugugagccuuacugcgauugcuaaccaggccacaguucucaugggacuggguaagggcuggccguugucaaaaauggacaucggggugccacuguuagcaauuggauguuacagucaagucaauccuaucacccuaaccgccgcucugcuccuucugguagcacacuaugccauuaucggccccgguuugcaggcgaaggcuacacgggaggcccagaaacgugcagccgcugggauaaugaagaacccaacuguggauggcauuacgguuaucgaccuggaucccaucccuuacgacccgaaauuugaaaagcagcucggacaagugaugcugcuugucuuaugcgugacccagguccugaugaugagaacaacuugggcccucugugaggcauugacccuggcuacaggccccauuagcacccuaugggaagggaauccaggaagguucuggaacacuacgauagccguguccauggcgaacaucuuucgcggcucuuaucuggccggugcagggcuccuuuucagcauuaugaagaauacagcuaacacccggcgaggaacuggcaauaccggugagacacugggcgaaaaauggaagaacagauugaaugcccuggggaaauccgaguuucagaucuacaagaaaucaggcauucaagagguugauaggacucucgcaaaggaaggcaucaaacgcggggagaccgaccaucacgcugugucucggggaagugccaagcugagaugguucguagaacguaacuuagugacaccugagggcaaggucguugaucuugguugcgggaggggaggcuggucguauuacugugguggccugaaaaaugugcgggaggucaaggggcucacgaaaggaggccccgggcaugaggaaccuauaccaaugagcaccuauggauggaaccuagugcgccugcaguccggcguagacguguucuuuacucccccugaaaagugcgauacauugcugugugacaucggugagucuucaccaaaucccaccauugaagccgggcgaacucucagaguucuuaaccugguggagaauugguugaacaauaacacacaguucugcaucaaaguccugaauccguacaugccuagcgugauugagaagauggaagcgcuccagaggaaguacggaggcgcuuuaguccggaacccacugucccgcaacaguacccacgagauguauugggugucuaaugcaagcggcaacaucguuucauccguaaauaugauaaguagaaugcuuauuaacagguuuacgaugcgacauaaaaaggccaccuacgaacccgauguggaccuggggagcggaacacggaauaucgguaucgagucugaaacuccuaaccuagauauuauaggcaaacguaucgagaagauuaaacaagagcacgaaaccuccuggcacuaugaccaggaccauccauacaagacaugggcuuaucacgggucauacgagacuaagcagaccggaagcgccucgucuauggucaauggcgugguuagacuccugacaaaacccugggaugugaucccgaccgucacucagauggcaaugacggacacaaccccuuucggucaacagcgcguguuuaaggaaaaaguagauacuaggacccaggagcccaaggaagggaccaaaaaguugaugaagauuacggccgaguggcuguggaaagagcucggaaagaaaaagaccccacggauguguacuagagaagaguucacacgcaaagugaggaguaacgcugcgcuuggcgccaucuuuaccgacgaaaauaaguggaaauccgcacgagaggcuguugaggauagccgguucugggaacuggucgacaaggagagaaacuuacaucuggaaggcaagugcgagacuuguguguauaauaugauggggaaaagggaaaagaaauugggagaguuugguaaggccaaaggcucacgcgcaauaugguacauguggcucggggcccguuuccuggaguuugaagcucuaggauuccuuaacgaggaucacugguuuucccgggaaaauucucugagcggcguggagggugaagggcuccacaagcugggauacaucuugagagacgucaguaagaaagagggcggcgccauguaugcggaugacacagcagggugggauaccaggauuacacuggaggaccucaagaacgaagagaugguuacuaaucauauggaaggagagcacaagaaacuugccgaagcuaucuucaaacugaccuaccagaacaaagugguacgcgugcaacgaccuacgccccgggguaccgucauggacauuaucuccagaagggaucagcgcggcagcggacaggugggaacauauggcuuaaacacuuucaccaauauggaggcccaacugauuagacagauggagggugaagggguuuuuaagucuauacagcauuugacagugacugaggaaaucgcaguccagaacuggcucgcucgggugggaagggagcgucugucacgaauggccauuaguggcgacgauugcguaguuaaaccacuagacgaucgcuucgcuuccgcccuuaccgcacugaaugacaugggcaaggugagaaaagauauccaacagugggagcccagccggggguggaacgacuggacgcaggucccuuuuugcucucaccauuuccacgaacucaucaugaaggauggaagggugcugguggucccaugucgcaaucaggacgaguugauugguagagcgcggauaucgcaaggcgccggguggucauuaagggaaacagcuugccugggaaaaagcuacgcccagauguggucccucauguauuuucaccgacgugaucuuagacuggcagcuaacgccaucuguagugcaguuccgucucauugggugcccaccagccgcacuacaugguccauucacgcccggcaugaguggaugaccacugaagacaugcuaaccguauggaauaggguguggauccaggagaacccuuggauggaggauaagacaccagucgaaucaugggaggaaauucccuaccugggcaagagagaggaccaguggugcgguagucucaucggguugacgucucgcgcgaccugggcuaaaaauauacaaacugccaucaaccaggugcggagccugauuggaaaugaagaguauacagacuacaugccuuccaugaagagguuccgaagagaggaagaggaagcaggcguucuuugguga

SEQ ID NO: 15013 - RNA, 9876 nt, Artificial Sequence
  derived and/or modified CDS sequence (opt3) from DENV-2__GQ398313__SS-prME
accgcaggcgugaucauuaugcugauacccacagcuauggcauuccaccucacuacgagaaacggggagccucauaugaucgucgggaggcaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgugcagaggaucgagaccuggauacugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguacucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaagaacaggacaaacgauuugugugcaagcauucuauggucgauagaggcugggguaacggguguggacuauucggcaagggcgggaucgugaccugcgccauguuuacaugcaaaaagaauauggaaggaaaagugguccucccugagaaccuggaauacaccauuguuauaacuccacacagcggugaggagcaugcugugggcaaugacacggggaagcacggaaaagaaaucaagauuacaccgcaguccucaaucaccgaggccgaacuuacuggcuaugguaccguaacaauggaguguagucccaggaccgggcuggauuucaacgaaaugguguugcuccagauggaggacaaagcauggcugguccaccggcaaugguuuuuagaucugccucucccauggcuucccggcgcugacacucagggaagcaauuggauacagaaggagacacuggugacguucaagaacccucaugccaaaaagcaggacguuguggucuugggcucucaagaaggggcgaugcacaccgcccuaacuggagcaacagagauucagauguccucagguaaucugcucuuuaccggccaucugaaaugccgucuucgcauggauaagcugcaguugaaagggaugagcuacaguauguguacaggaaaguucaagaucgugaaagaaaucgcugagacucaacacggcaccauuguaaucagaguucaguaugagggugacgggucuccaugcaagauucccuucgaaauaauggaucucgagaaaaggcaugugcugggccgguuaaucacggucaacccgauuguggccgaaaaggacuccccugucaacaucgaggcugaacccccauuuggagauagcuacaucauuauaggcguggagccugggcagcugaaacuaaauugguucaagaagggaucgucuaucggucagauguuugagaccacaaugcgaggcgccaaacgcauggcaauucucggggacacugccugggauuucggaucccugggcgguguuuuuaccucaaucgggaaggcacuucaccaaguguucggcgcgauuuacggagcagccuuuaguggcguaagcuggacaaugaaaaucuugauaggggucaucauuacuuggaucggaaugaacuccagaucuaccagccugucagugagucucguucuggugggcgucgugacgcuuuaucugggugcuaugguacaggccgacuccgggugugugguuagcuggaagucuaaagaauugaagugcggaucaggcauuuucaucacagauaauguccacaccuggacugagcaguacaaguuucagcccgaaaguccaagcaaacucgcauccgccauacaaaaggcucaugaggaagguauuuguggcaucaggucugugacacggcuggagaacuuaauguggaaacagauuacccccgagcugaaucacauccuaucggaaaacgaggugaagcucacuauaaugaccggggacaucaaaggaauuaugcaggccggcaagcgcagccugagaccucagccaacagaacuuaaauauuccuggaagacgugggggaaggcaaaaauguugucaaccgagagucauaaucaaacuuuccugaucgauggaccggaaacagcggagugccccaacaccaauagggcuuggaacucucucgaggucgaagacuacggcuuugguguuuucacaacuaauauuuggcugaaguuacgugagaaacaggacguguuuugugauagcaagcugauguccgccgcaaucaaagacaaccgggccgugcacgcugauaugggguauuggauagaaucagcccuuaaugacaccuggaagauggagaaggcuucauucauugagguaaaaucuugccacuggccuaagucccauacguuguggaguaacggaguccucgaaagcgagaugaucauccccaaaaauuucgcuggccccgugucucagcacaacuaccgaccugguuaucauacacagaccgccggcccauggcaccuggggaagcuagaaauggauuuugacuucugugagggaacuaccguuguggucacagaagauugcggcaacagagggcccucccugaggacuaccacagcgucaggaaaacucauuacggaguggugcugucgcaguugcacccugccgccucuucgguacagaggcgaggacgguuguugguacgggauggaaaucaggccauugaaggagaaggaagagaaucuggugaacagcuuaguuacugccggacauggccaaauugauaauuuuucgcucggugugcugggcauggcucuuuuccuggaagagauguugcgcacacgaguagggaccaaacacgcaaugcuccuggucgccguguccuuugugacucuaauaacaggaaacaugucuuuccgggaccugggccgugucaugguuauggugggggcuaccaugacggaugacaucggaaugggcauuacuuaucucgcccugcuugcagcguuuaagguaagacccaccuucgccgcugguuugcuguuaaggaaacucacaagcaaggagcugaugauggccaccaucgggauugcacuucugucacagaguacuaucccugaaacaauacuagagcucaccgaugcucuggccuugggaaugauggugcugaaaaucguccgcaauauggaaaaguaccaguuagcagugacaauuauggccaucuccugcguucccaacgcugugauucuccaaaaugcguggaaggucucuuguacuauccuggccgcagugagcguuuccccacuucuguugaccucaagccagcagaaagcugacuggauaccucucgcccugacgauuaagggccuaaaccccacagccaucuuucugaccacucuuagucggaccucuaaaaagagauccuggccacucaaugaggcugugauggcagucggcaugguaagcauccuggccucgucauugcugaaaaacgacauuccgaugacagggccuuuaguggcgggaggucuccugacuguuugcuaugugcuuaccggcaggucugcugaucuggaauuggagcgagccgcagacgucaagugggaggaucaggccgaaauaaguggguccagccccauccucucuauuacgaucagcgaggacggauccaugucaauuaaaaaugaagaggaggaacaaacacugaccauccuaauacgcacuggccugcuugugaucagugguguauucccagugagcauucccaucacagcugcagccugguaccucugggaggucaagaagcagcgggcggggguucugugggaugugccuucuccacccccugugggaaaagcugaauuggaggacggcgccuauagaauuaagcagaggggcaucuuaggguacucccagauaggagccgguguauauaaagaaggcaccuuucacacuauguggcaugugacacguggggcaguucugaugcaccgcggaaagcggauugagccgucaugggcugaugucaaaaaggaccucaucaguuacggcgguggguggaagcuggagggagaauggaaagagggcgaagaggugcaaguccuugcccuggaaccaggcaagaaccccagagcagugcagaccaaaccuggguuguucaagacgaauacuggaaccaucggugcuguuagccuagauuuuuccccaggcacaucugggucgcccauuguggacaggaaaggaaaggucgugggccuguacgguaacgggguagucacccgaagcggagccuaugugucagcgaucgcccagacagagaaguccauagaggauaauccugaaauugaggacgauaucuuccggaaaaagcgccucacuauuauggaccugcauccgggcgcaggcaaaaccaagagauaccuucccgcuaucguuagggaagccauaaaacggggguuacgaacgcugauucucgcuccaacaagaguggucgcagccgagauggaagaggccuugcgcggacugccuaucagguaucagacucccgcuauccgugcggagcacaccggucgggaaauuguggaccucaugugucaugcaacauucaccaugagacugcuuaguccaguuagggugccuaacuacaaccugaucauuauggaugaggcccacuuuacugaccccgcuucuauagccgcacgcggcuauaucagcacccgagucgaaaugggggaggccgcuggaauuuucaugacagcgacgccaccgggcuccagagauccuuuuccccaaucaaaugccccaaucauggacgaggaacgggagauccccgaaaggucuuggaacagcggucacgagugggugacugauuucaaggggaagaccguaugguuugugccuaguauuaaagcaggaaaugacauagcugccugcuugcgcaagaacggcaaaaagguuauccagcuaucccguaaaacauucgauagcgaauacgucaagaccagagcaaaugacugggauuuuguggugacuacagacauuucugagaugggcgccaacuucaaggcugagcgggucaucgauccaaggcgcuguaugaaacccguaauucugaccgacggggaagaacgagugauccucgccggaccuaugccgguuacgcauucauccgcggcacagagacgggguaggauaggccgcaauccaaagaacgaaaaugaccaauauaucuacaugggggagcccuuagaaaacgaugaggacugcgcccacuggaaagaggcuaagaugcugcuugauaauauuaacacuccugaaggaaucauucccaguauguuugagccagaaagagagaaaguggacgccaucgauggcgaauacaggcugcggggugaggcucguaagacauucgucgaccucaugcgccgaggggauuugccuguguggcuggcauauagaguugccgcugagggcauaaauuacgccgacaggcggugguguuuugauggaauuaaaaacaaucagauccucgaagagaacguggaagucgagauuuggaccaaggagggcgaacgcaagaaacugaagcccagauggcuugacgcaaggaucuauagcgauccacuagcgcugaaagaguucaaggaguucgccgcugggcggaaaucguugaccuuaaaccugauaacugagaugggacgacucccuacauuuaugacccagaaggccagagacgcacuggauaaucuugcugugcugcauacagccgaagccgguggccgcgccuacaaccacgcucucucugaguugccggagacucuggaaacgcuacugcuccuuacccuguuagcgacaguaacugggggaaucuucuuguuucugauguccggcaaggguauugggaaaaugacccucggcaugugcugcaucauuacagccagcauccugcuuugguaugcacagauacaaccccacuggauugcugccucaaucauccuggaguucuuucucauuguguugcugaucccagaaccugagaagcagaggaccccacaggacaaucaguuaacuuacguugucauagccauucuaacggugguggcagcuaccauggccaacgaaaugggauuccuggagaaaacaaagaaagaccucggccuugggaguaucgcgacucaagagucugaauccaauauucuggauaucgacuugcggccagcuagcgccuggacccuguaugcagucgccacaaccuuuguuacuccuaugcuccgucauucaauagagaacaguagcgugaauguaucccugacagcuaucgcaaaccaggccacggugcuuaugggacucgguaagggcuggccccugucuaagauggauauuggggucccguugcuggcgaucggauguuacagccaggugaauccaauuaccuuaacugcugcccuacugcuccuuguugcacacuacgccaucauuggcccuggucugcaggcuaaagccacaagagaagcacaaaagagggcugccgcggggaucaugaaaaaccccaccguggacggcauaaccgucauugauuuggagccaauccccuaugacccuaaguucgaaaaacagcugggacagguaaugcuccugauccuuugcgugacacagguuuuaaugaugcgcacuacgugggcccugugugaggcacucaccuuggcuacaggcccgauuuccacucugugggaggggaaucccggacgguuuuggaacaccacaauagccgugucaauggcaaauaucuuccgaggcucuuaccuagcuggugccgggcugcucuuuaguauuaugaagaacaccacuaauacgagaaggggaacaggcaacaucggugaaacccuuggcgagaaguggaaaucgcgccugaaugccuugggaaagagcgaguuccaaauuuauaaaaaguccggaauccaggaggucgaucggacucuggcgaaagagggcauaaagagaggggaaaccgaccaucacgcugugucucguggaucagcaaaacucaggugguuugucgagcggaacauggugacaccagaaggcaagguuguggaucuggguugcgggcgcggaggcuggagcuacuauugugguggcuuaaagaacguacgagaggugaaagggcuuacuaagggaggcccugggcaugaagaacccaucccuauguccaccuacggauggaaucuggucagacuccagaguggcguugacguguucuucacaccacccgagaaaugcgauacgcuacugugugacauuggugaaucuagcccuaacccaaccaucgaggccgggaggacuuugcggguccugaaucucguggaaaacuggcuuaauaacaauacacaauuuugcauuaagguacugaaccccuauaugccgucagugaucgagaaaauggaaaccuugcagcgcaaguacggaggcgcucugguuagaaauccucucuccaggaacaguacucacgagauguacugggugagcaaugccacaggcaacauagucucuuccgugaauaugauuucacgaauguuaaucaaccgguucaccaugaagcacaaaaaggcaacguaugagccagaugucgaccuggggagcggaacccguaauaucgguauugaaucggagauacccaaccuugacaucauuggcaaaagaaucgaaaagauuaaacaggagcaugaaacaucuuggcacuacgaucaggaccauccuuauaagacuugggccuaccacgggaguuaugagaccaagcaaacaggauccgcuagcucaauggugaacggcguuguacgccugcuaacuaaaccaugggaugugguccccauggugacccagauggcgaugacagacaccacuccguuuggucagcagaggguuuucaaggagaaaguggauacgcggacacaagaaccuaaggaggggaccaaaaagcucaugaagaucacugccgaauggcuguggaaagaguugggaaagaaaaagacccccagaauguguacacgcgaggaauuuacgaggaaaguccgauccaaugcagcucugggcgccauauucaccgacgagaacaaguggaaaucugcacgggaagccguggaggauagcagauuuugggaacucaucgacagggagcgcaaucuucaccuggagggcaagugcgaaacuuguguauacaacaugauggggaagcgugagaaaaaguuaggagaguucgguaaagcuaagggcagucgggccauuugguauauguggcugggggcgagauuuuuggaguucgaagcacucggauuucugaaugaggaucauugguucuccaggggcaacagccuaucugguguggagggggaaggacuucaccgccugggcuacauccuccgagacguuagcaaaaaggagggcggggccauguacgcugaugacacagccggaugggacacccggauuacucuggaagauuugaagaaugaggaaauggucacaaaccauaugaaaggugagcacaagaaacuggcagaggcuaucuuuaagcucaccuaucagaauaaaguggugagaguccagaggccaacaccucgcggcacuguuauggacauuauaaguagacgggaucagaggggguccggacaagugggcaccuacggucuuaacacguucaccaauauggaagcccagcugauccgucagauggagggggaaggaauuuucaagagcauccaacauuuaacaguaacugaggagaucgcugugcagaacuggcuggcccgagucggccgcgaaagauugucucggauggcaauuucgggcgacgauugcgugguuaagccccucgacgauagguuugcgucagcccugaccgcucuaaaugacauggggaaagugcgcaaggauauacagcagugggagccaagcagaggauggaacgacuggacacaaguccccuucugcucccaccacuuucaugaacuugugaugaaagauggucggguacugguugugccuuguaggaaucaggacgagcucaucggccgagcccguauuagucagggggcaggauggucucugaaggaaacugcuugcuugggcaaaagcuaugcccagauguggaccuuaauguacuuccacagacgcgaucugcggcucgcagccaacgcgaucuguuccgcugucccaucacauugggugccgacgaguaggacaaccuggucuauucacgccaagcacgaguggaugacuacagaggacaugcuugcaguguggaacagagucuggauccaagaaaaucccuggauggaggacaagaccccuguugaaagcugggaggaagugccauaucuggguaaacgcgaggaucaguggugcgggucccuaauaggacugacuucacgggccaccugggcuaagaacauccagacagccauuaaucagguaaggagccucaucggcaacgaggaauacacggacuauaugcccucuaugaaacgauuuagacgggaggaagaggaagcaggcguguugugguga

SEQ ID NO: 15014 - RNA, 9876 nt, Artificial Sequence
  derived and/or modified CDS sequence (opt3) from DENV-2__GQ398285__SS-prME
accgcaggcgugaucauuaugcugauacccacggcuauggcauuccaccucacuacgcggaacggggagccucauaugaucgucggaaggcaggaaaaggguaaaagccuucuguuuaagaccgaggacggcguuaauaugugcacauugauggccauugauuuaggggaacugugugaggacacuaucaccuacaaaugcccauuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgugcagaggaucgagaccuggauacugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguacucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaagaacaggacaaacgauuugugugcaagcauucuauggucgauagaggcugggguaacggguguggacuauucggcaagggcgggaucgugaccugcgccauguuuacaugcaaaaagaauauggaaggaaaagugguccucccugagaaccuggaauacaccauuguuauaacuccacacagcggugaggagcaugcugugggcaaugacacggggaagcacggaaaagaaaucaagauuacaccgcaguccucaaucaccgaggccgaacuuacuggcuaugguaccguaacaauggaguguagucccaggauggggcuggauuucaacgaaaugguguugcuccagauggaggacaaagcauggcugguccaccggcaaugguuuuuagaucugccucucccauggcuucccggcgcugacacccagggaagcaauuggauacagaaggagacucuggugacauucaagaacccucaugccaaaaagcaggacguuguggucuugggcucucaagaaggggcgaugcacacggcccuaaccggagcaacugagauucagauguccucagguaaucugcucuuuacaggccaucugaaaugccgucuucgcauggauaagcugcaguugaaagggaugagcuacaguauguguaccggaaaguucaagaucgugaaagaaaucgcugagacacaacacggcacuauuguaaucagaguucaguaugagggugacgggucuccaugcaagauucccuucgaaauaauggaucucgagaaaaggcaugugcugggccgguuaaucaccgucaacccgauugugacggaaaaggacuccccugucaacaucgaggccgaacccccauuuggagauagcuacaucauuauaggcguggagccugggcagcugaaacuaaauugguucaagaagggaucgucuaucggucagauguuugagaccacaaugcgaggcgcuaaacgcauggccauucucggggacacugcaugggauuucggaucccugggcgguguuuuuaccucaaucgggaaggcccuucaccaaguguucggcacaauuuacggagcugcguuuaguggcguaagcuggacuaugaaaaucuugauaggggucaucauuaccuggaucggaaugaacuccagaucuacgagccugucagugagucucguucuggugggcgucgugacacuuuaucugggugcaaugguacaggccgacuccgggugugugguuagcuggaagucuaaagaauugaagugcggaucaggcauuuucaucaccgauaauguccacacuuggacagagcaguacaaguuucagcccgaaaguccaagcaaacucgcuuccgccauacaaaaggcacaugaggaagguauuuguggcaucaggucugugacccggcuggagaacuuaauguggaaacagauuacucccgagcugaaucacauccuaucggaaaacgaggugaagcucaccauaaugacagggggaaucaaaggcauuaugcaggccgggaagcgcagccugagaccucagccaacggaacuuaaauauuccuggaagaccuggggaaaggcuaaaauguugucaacugagagucauaaucaaacauuccugaucgacggcccggaaaccgccgagugccccaacacaaauagggcauggaacucucucgaggucgaagauuacgguuuugggguuuucacuaccaauauuuggcugaaguuacgugagaaacaggacguguuuugugacagcaagcugauguccgcggcuaucaaagauaaccgggccgugcacgcagacaugggauauuggauagaaucagcccuuaaugauacguggaagauggagaaggcuagcuucauugagguaaaaucuugccacuggccuaagucccauacauuguggaguaacggcguccucgaaagcgagaugaucauccccaagaaucuggccggucccgugucucagcacaacuaccgaccuggcuaucauacccagacugcagggccauggcaccuaggaaagcuggaaauggacuucgauuuuugugagggcaccacaguuguggucacugaagacugcgggaacagaggacccucccucaggaccacaacggcuucaggcaaacuggugaccgaguggugcugucgcaguugcacucuuccgccuuugcgguacagaggugaggauggguguugguacggaauggaaauuaggccacugaaggagaaggaagagaauuuaguuaacagccucgugacagccggccauggucaaaucgacaauuucucgcugggcguacuugggauggcgcuguuuuuggaagagaugcuccgcacccgagucggaacuaaacacgccauucugcuaguggcuguguccuucgucacacugauaaccggcaacaugucuuuucgggaucucgggcguguuauggugaugguaggagcaacgaugacugacgauaucggcaugggugugaccuaucuggcccuuuuggcugccuucaaggucagacccacauuugcagcggggcuguuacucaggaaacugaccagcaaggagcuuaugauggccacuauuggaaucgcucugcuaucacagaguacaauuccugaaaccauccucgagcugacagacgccuuggcacugggcaugaugguguuaaaaauaguucgcaauauggaaaaguaccagcucgcugugacuaucauggccauuuccugcguccccaacgcagugauccugcaaaaugccuggaagguuucuuguaccauucuugcugcggugagcgucuccccacuguugcucacgucaagccagcagaaagccgauuggaucccucuggcacuaacaauaaagggccugaaccccaccgcuauuuuccuuacuacccucagucggacaucuaaaaagagauccuggccacugaaugaggccaucauggccguagggauggugagcaucuuggcuucgucacugcucaaaaacgacauuccgaugacuggaccucuaguugccgguggccugcuuaccgugugcuauguccugacggggaggucugccgacuuggaacucgagcgagcggcugaugugaagugggaggaccaggccgaaauaaguggauccagccccauccugucuauuacaaucagcgaggauggcuccaugucaauuaaaaaugaagaggaggaacaaacccuaacuauccugauacgcacaggucuucucguaaucagugggguguuuccagucagcauucccaucaccgcagccgcuugguaccugugggagguuaagaagcagcgggcaggaguguugugggacgugccuucuccacccccugucggcaaagccgaauuagaggauggcgcguauagaauuaagcagagggggauccugggauacucccagauaggugcuggcguguauaaagaagggacuuuccacacaauguggcauguuacccguggagccguacucaugcaccgcggcaagcggauugagccgucaugggcagacgugaaaaaggaucugaucaguuacggugggggauggaaacuugagggcgaauggaaagagggcgaagagguccaagugcuggccuuggaaccagggaagaaccccagagcuguucagacgaaaccuggacuauuuaagacuaauaccgguacaaucggcgccgugagccuggacuucuccccagggaccucuggaucgcccauugucgauaggaaaggcaaggugguaggucucuacgggaacggagucgugacacgaagcggcgcauauguuucagcuaucgcccagacugagaaguccauagaggacaauccugaaauugaggaugacaucuuucggaaaaagcgccugaccauuauggaucuucauccgggcgcggggaaaacgaagagauacuuacccgccaucgugagggaagcaauaaaacggggacugcgaacacucauuuuggcuccaacuagagucguggccgcugagauggaagaggcacugcgcggucucccuaucagguaucagacccccgccauccgugccgagcacacaggccgggaaauuguugaccugaugugucaugcuaccuucacuaugagacuucugaguccagugagggucccuaacuacaacuugaucauuauggacgaggcgcacuucaccgaucccgcaucuauagccgcucgcggguauaucagcacacgaguggaaaugggagaggccgcaggcauuuuuaugacggccacuccaccggguuccagagacccuuucccccaaucaaaugcuccaaucauggaugaggaacgggagauccccgaaaggucuuggaacagcgggcacgaguggguaaccgacuuuaagggaaagacagugugguucguuccuaguauuaaagcgggcaaugauauagccgcaugccuacgcaagaacggcaaaaaggucauccagcugucccguaaaaccuuugacagcgaauacgugaagacuagagcuaaugauugggacuucguggucacaaccgauauuucugagaugggggccaacuuuaaggcagagcggguaaucgacccaaggcgcuguaugaaacccgugauucucacggauggagaggaacgaguuaucuuagccgguccuaugccggugacucauucauccgcugcccagagacggggcaggauagggcgcaauccaaagaacgaaaaugaccaauauaucuacaugggagagccccuggaaaacgacgaggauugcgcgcacuggaaagaggcaaagaugcuucuggacaauauuaacacaccugaaggcaucauucccaguauguucgagccagaaagagagaaagucgaugccaucgacggugaauacaggcucagaggggaggcucguaagaccuuuguggauuugaugcgccgaggcgaccugccuguuuggcucgccuauagaguggcugcagagggaauaaauuacgccgauaggcggugguguuucgacggcauuaaaaacaaucagauccuggaagagaacgucgaaguggagauuuggaccaaggagggggaacgcaagaaacuuaagcccagauggcuagaugcuaggaucuauagcgacccacuggccuugaaagaguuuaaggaguucgcagcgggacggaaaucguuaacucugaaccucauaacagagaugggucgacugccuaccuucaugacacagaaggccagaaaugcucuugauaaccuggccguacuccauacugcagaagcuggcgggcgcgccuacaaucacgcauugucugagcugccggagacgcuagaaacccugcuccuucugacauuauuggccacugugaccggaggcaucuuucuguuccucauguccgguaaggggauuggcaaaaugacacugggaaugugcugcaucauuaccgcuagcauccuucugugguaugcgcagauacaaccccacuggauugccgcaucaaucauccucgaguuuuucuugauuguucuguuaaucccagaaccugagaagcagaggacuccccaggacaaccagcuaacguacgucgugauagcuauucugaccguggucgccgccacaauggcaaaugaaaugggcuuucucgagaaaacuaagaaagaucuugggcugggaaguaucaccacacaagagucugaauccaacauuuuggacaucgaccugcggccagcuagcgccuggacccucuaugcgguugcuacuacauucgugacgccuaugcugcgucauucaauagagaauaguagcguaaacgugucccuuaccgccaucgcaaaucaggccacuguccucaugggucugggcaagggguggcccuugucuaagauggauauuggagugccgcuguuagcuaucggcuguuacagccagguuaacccaauuacacuaaccgcagcccugcuccuucugguggcgcacuacgcuaucauugguccuggguugcaggccaaagcaaccagagaagcccaaaagagggcugccgcaggcaucaugaaaaaucccacagucgacggaauaacuguaauugaucuggagccaauccccuaugacccuaaguuugaaaaacagcucggccaggugaugcugcuuaucuuaugcguuacacaggugcugaugaugcgcaccacaugggcucucugugaggccuugacucuggcgaccgggccgauuuccacacuaugggagggaaaccccggccgguucuggaauaccacuauagccgucucaauggcaaacaucuuucgagguucuuaccuggcuggggccggacuccuuuucaguauuaugaagaauacgacaaacaccagaaggggcacugguaauaucggcgaaacccugggggagaaguggaaaucgcgcuugaacgcacugggaaagagcgaauuucaaauuuauaaaaaguccggcauccaggagguggaucggacacucgcuaaagaggggauaaagagaggagaaacugaccaucacgccgucucucguggcucagccaaacugaggugguucguggagcggaacaugguuaccccagaagguaaggugguagauuuagggugcggacgcggcgguuggagcuacuauuguggcgggcuuaagaaugugcgagaggucaaaggacugacaaagggcgggccuggacaugaggaaccaaucccuauguccacguacggcuggaaccucguuagacuacagagugguguggacgucuuuuucaccccacccgagaaaugcgauacucuguugugugacauuggggaaucuagcccuaauccaacaaucgaggcgggaaggacccugcgggugcucaaccuuguagaaaauuggcugaacaauaacacucaauucugcauuaagguguugaaucccuauaugccgucaguuaucgagaaaauggaaacacugcagcgcaaguacggcggcgcucucgugagaaacccuuuauccaggaauaguacccacgagauguacugggucagcaacgcaacggggaauauagugucuuccgucaacaugauuucacgaaugcugaucaaucgguuuaccaugaagcacaaaaaggccacauaugagccagauguggaccuuggaagcgguacucguaacaucggcauugaaucggagauacccaaccuggauaucauugggaaaagaaucgaaaagauuaaacaggagcaugaaaccucuuggcacuacgaccaggaccauccuuauaagacaugggcuuaccacggaaguuaugagacuaagcaaaccggcuccgccagcucaaugguuaaugguguagugcgccuacucacaaaaccaugggaugucgugcccaugguuacccagauggcaaugacugacacgacaccguucgggcagcagaggguguuuaaggagaaagucgauacccggacucaagaaccuaaggagggaaccaaaaagcugaugaagaucacagccgaaugguuguggaaagagcugggcaaggagaaaacgcccagaauguguacccgcgaagaguucgcuaggaaggugcgauccaacgcggcccucggcgcaauauuuacugacgaaaauaaauggaagucugcucgggaggccguagaagauagcagauucugggagcuuaucgacagggagcgcaaccugcacuuagaagggaaaugcgagacauguguguacaauaugaugggaaagcgugaaaagaaacugggugaguuuggcaaggcaaaagggagucgggccauuugguauaugugguugggagcuagauuccucgaauuugaggcccugggcuuccuaaacgaggaucauugguuuuccagggaaaauagccuuucugguguugagggggaaggacugcaccgccucggcuacauccugcgagacgucucaaagaaagagggcggggcgauguacgcagaugacaccgccggaugggauacucggauuacauuggaagaccugaagaacgaggagauggugaccaaucauaugaagggugaacacaaaaagcucgcugaggccaucuucaaacuuacauaucagaacaagguggucagaguucagaggccaacuccucgcggcaccgugauggacauuauaaguagacgggaucagaggggguccggacaaguaggcacguacggucugaauaccuuuacaaacauggaagcacaguuaauccgucagauggagggggagggaauuuucaaaagcauccaacaucugacugcuaccgaagagaucgccgugcagaauugguuggcucgagucggccgcgaaagacucucucggauggccauuucgggcgacgauugcgugguuaagccccuggacgauagguucgcaucagcgcuaacagcccuuaacgacauggggaaggugcgcaaagauauacagcagugggagccaagcagaggauggaaugacuggacucaaguccccuuuugcucccaccacuuccaugaacuggugaugaaggauggucggguacucguugugccuuguaggaaccaggacgagcugaucggccgagcucguauuagucagggggccggauggucuuugaaagagaccgcaugcuuaggcaagagcuaugcucagauguggacgcugauguacuuucacagacgcgaucuccggcuugccgcaaacgccaucuguuccgcggucccaucacauugggugccgacaaguaggaccacuuggucuauucacgcuaaacacgaauggaugacaaccgaggacaugcuggccguguggaauagagucuggauccaagaaaaccccuggauggaggauaagacuccuguugaaagcugggaggaggugccauaucuagguaagcgcgaagaccaguggugcgggucccugauaggacucaccucacgggcaacaugggccaaaaauauccagacggcuauuaaccagguaaggagcuugaucggcaaugaggaauacaccgacuauaugcccucuaugaagcgauucagacgggaggaagaggaggccggcgugcugugguga

SEQ ID NO: 15015 - RNA, 9876 nt, Artificial Sequence
  derived and/or modified CDS sequence (opt3) from DENV-2__GQ398298__SS-prME
accgcaggagugaucauuaugcugauacccaccgcuauggcauuccaccucacuacgcgaaacggggagccucauaugaucgucggaaggcaggaaaaggguaaaagccuucuguuuaagaccgaggacggaguuaauaugugcacauugauggccauugauuuaggggaacugugugaggacacuaucaccuacaaaugcccauuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgugcagaggaucgagaccuggauacugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguacucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaagaacaggacaaacgauuugugugcaagcauucuauggucgauagaggcugggguaacggguguggacuauucggcaagggcgggaucgugaccugcgccauguuuacaugcaaaaagaauauggaaggaaaagugguccucccugagaaccuggaauacaccauuguuauaacuccacacagcggugaggagcaugcugugggcaaugacacggggaagcacggaaaagaaaucaagauuacaccgcaguccucaaucaccgaggccgaacuuacuggcuaugguaccguaacaauggaguguagucccaggaccgggcuggauuucaacgaaaugguguugcuccagauggaggacaaagcauggcugguccaccggcaaugguuuuuagaucugccucucccauggcuucccggcgcugacacucagggaagcaauuggauacagaaggagacacuggugacguucaagaacccucaugccaaaaagcaggacguuguggucuugggcucucaagaaggggcgaugcacaccgcccuaacuggagcaacagagauucagauguccucagguaaucugcucuuuaccggccaucugaaaugccgucuucgcauggauaagcugcaguugaaagggaugagcuacaguauguguacaggaaaguucaagaucgugaaagaaaucgcugagacucaacacggcaccauuguaaucagaguucaguaugagggugacgggucuccaugcaagauucccuucgaaauaauggaucucgagaaaaggcaugugcugggccgguuaaucacggucaacccgauuguggccgaaaaggacuccccugucaacaucgaggcugaacccccauuuggagauagcuacaucauuauaggcguggagccugggcagcugaaacuaaauugguucaagaagggaucgucuaucggucagauguuugagaccacaaugcgaggcgccaaacgcauggcaauucucggggacacugccugggauuucggaucccugggcgguguuuuuaccucaaucgggaaggcacuucaccaaguguucggcgcgauuuacggagcagccuuuaguggcguaagcuggacaaugaaaaucuugauaggggucaucauuacuuggaucggaaugaacuccagaucuaccagccugucagugagucucguucuggugggcgucgugacgcuuuaucugggugcuaugguacaggccgacuccgggugugugguuagcuggaagucuaaagaauugaagugcggaucaggcauuuucaucacagauaauguccacaccuggacugagcaguacaaguuucagcccgaaaguccaagcaaacucgcauccgccauacaaaaggcucaugaggaagguauuuguggcaucaggucugugacacggcuggagaacuuaauguggaaacagauuacccccgagcugaaucacauccuaucggaaaacgaggugaagcucacuauaaugaccggggacaucaaaggaauuaugcaggccggcaagcgcagccugagaccucagccaacagaacuuaaauauuccuggaagacgugggggaaggcaaaaauguugucaaccgagagucauaaucaaacuuuccugaucgauggaccggaaacagcggagugccccaacaccaauagggcuuggaacucucucgaggucgaagacuacggcuuugguguuuucacaacuaauauuuggcugaaguuacgugagaaacaggacguguuuugugauagcaagcugauguccgccgcaaucaaagacaaccgggccgugcacgcugauaugggguauuggauagaaucagcccuuaaugacaccuggaagauggagaaggccagcuucauugagguaaaaucuugccacuggccuaagucccauacguuguggaguaacggaguccucgaaagcgagaugaucauccccaagaauuucgcuggccccgugucucagcacaacuaccgaccugguuaucauacacagaccgccggcccauggcaccuggggaagcuagaaauggauuuugacuucugugagggaacuaccguuguggucacagaagauugcggcaacagagggcccucccugaggacuaccacagcgucaggaaaacucauuacggaguggugcugucgcaguugcacccugccgccucuucgguacagaggcgaggacgguuguugguacgggauggaaaucaggccauugaaggagaaggaagagaaucuggugaacagcuuaguuacugccggacauggccaaauugauaauuuuucgcucggucugcuuggcauggcucuguucuuggaagagaugcuccgcacacgaguggggaccaaacacgcaaugcugcuaguagucguguccuuugugacucugauaacaggaaacaugucuuuccgggaccucggccgugucaugguuauggugggggccaccaugacggaugacaucggaaugggcauuacuuaucuggcucuuuuggccgcauuuaagguaagacccaccuucgcggccggucuguuacucaggaaacugacaagcaaggagcuuaugauggcuaccaucgggauugcccugcuaucacagaguacuaucccugaaacaauacucgagcugaccgaugcauuggcucugggaaugaugguguuaaaaaucguccgcaauauggaaaaguaccagcucgccgugacaauuauggcaaucuccugcguucccaacgccgugauucugcaaaaugcuuggaaggucucuuguacuauccuugcggccgugagcguuuccccacuguugcucaccucaagccagcagaaagcagacuggauaccucuggcucuaacgauuaagggccugaaccccacagccaucuuucuuaccacucucagucggaccucuaaaaagagauccuggccacugaaugaggccaucauggcugugggcauggucagcauuuuggcaucgucacugcuaaagaacgacauaccgaugacagggccucucguagccggaggucugcuuacugugugcuauguucugaccggcaggucugcggauuuggaacucgagcgagcugccgacgugaagugggaggaucaggcagaaaucaguggguccagccccauucugucuaucacgauuagcgaggacggauccaugucaaucaaaaaugaagaggaggaacaaacacuaaccauacugauccgcacuggccuucucgucauuagugguguguucccaguaagcauccccauuacagccgcugcaugguaccugugggaggugaagaagcagcgggccggggucuugugggauguuccuucuccacccccugugggaaaagcggaauuagaggacggcgcuuauagaaucaagcagaggggcauacugggguacucccagauuggagccgguguguauaaagaaggcaccuuucacacuauguggcaugucacacguggggcagugcucaugcaccgcggaaagcggaucgagccgucaugggccgauaucaaaaaggaccugauuaguuacggcgguggguggaaacuugagggagaauggaaagagggcgaagagguucaaguacuggcuuuggaaccaggcaagaaccccagagccgugcagaccaaaccugggcuauucaagacgaauacuggaaccaucggugcagucagccuggauuuuuccccaggcacaucugggucgcccauaguggacaggaaaggaaagguugugggccucuacgguaacggggucgugacccgaagcggagcuuauguaucagccauugcgcagacagagaaguccaucgaggauaauccugaaauugaggacgauaucuuccggaaaaagcgccugacuauaauggaccuucauccgggcgccggcaaaaccaagagauacuuacccgcaauugucagggaagcuaucaaacgggggcugcgaacgcucaucuuggccccaacaagagugguugcugcagagauggaagaggcccugcgcggacucccuauuagguaucagacucccgccauccgugcugagcacaccggucgggaaauuguggaccugaugugucaugcgacauucaccaugagacuucugaguccagucagggugccuaacuacaacuugauaaucauggaugaggcacacuuuacugaccccgccucuauugcugcccgcggcuauaucagcacccgaguugaaaugggggaggcagccggaaucuucaugacagcuacgccaccgggcuccagagauccuuuuccccaaucaaaugcgccaauuauggacgaggaacgggagauacccgaaaggucuuggaacagcggucacgagugggugacugauuucaaggggaagaccgucugguuugugccuaguaucaaagccggaaaugacauugcagcuugccuacgcaagaacggcaaaaagguaauccagcugucccguaaaacauucgauagcgaauacgugaagaccagagccaaugacugggauuuuguugucacuacagacauuucugagaugggcgcaaacuucaaggccgagcgggugaucgauccaaggcgcuguaugaaacccgugauacucaccgacggggaagaacgagucaucuuagcuggaccuaugccgguaacgcauucauccgccgcgcagagacgggguaggauuggccgcaauccaaagaacgaaaaugaccaauauaucuacaugggggagccccuggaaaacgaugaggacugcgcacacuggaaagaggccaagaugcuucuggauaauauuaacacuccugaaggaaucauacccaguauguuugagccagaaagagagaaaguggacgcuauugauggcgaauacaggcuccggggugaggcccguaagacauucguugacuugaugcgccgaggggaucugccuguguggcucgcuuauagagucgcagccgagggcaucaauuacgcugacaggcggugguguuuugauggcauucgcaacaaucagauccuggaagagaacguggaaguugagauauggaccaaagagggcgaaagaaagaaacuuaaacccagguggcuagacgcccggaucuauagcgauccacuggcauugaaggaguucaaagaguucgcggccgggcgaaagucguuaacccugaaccucauuacugagaugggaagacugccuacauuuaugacccagaaagcucgcgacgcccuugauaaucuggcagugcuccauacagcugaagccgguggcagggcauacaaccacgccuugucugagcugccggagacucuagaaacgcugcuccuucugaccuuauuggcuacagucacugggggaaucuuccuguuucucauguccggcaaggguauugggaagaugacccugggcaugugcugcaucauaacagcgagcauucuucugugguaugcccagauccaaccccacuggaucgcagcuucaauuauccucgaguucuuuuugauagugcuguuaauuccagaaccugagaaacagcggacaccacaggacaaucagcuaacuuacguagugaucgccauucugacgguugucgccgcaaccauggcuaacgaaaugggauuccucgagaagaccaaaaaggaccuuggccuggggaguaucgccacucaagagucugaauccaauauauuggauaucgaccugcguccagcgagcgcuuggacccucuaugccguggcaacaaccuuugugacuccuaugcugagacauucaauugagaacaguagcgucaauguuucccuuacagccaucgcuaaccaggcaacggugcucaugggacuggguaaaggcuggcccuugucuaagauggauauugggguaccgcuguuagccaucggauguuacagccaggugaauccaauuacccuaacugcggcucugcuccuucuggucgcccacuacgcaaucauaggcccugguuugcaggccaaggcuacaagggaagcccaaaaacgcgcagcugccgggauuaugaagaaccccaccguggacggcaucaccguuaucgaucuggagccaauucccuaugacccuaaauucgaaaagcagcucggacaggugaugcugcuuauauuaugcgucacacagguacugaugaugcggacuacgugggcgcucugugaggccuugacccuggcaacaggcccgaucuccacucuaugggaggggaaucccggacgauuuuggaacaccacaauugcugugucaauggccaauaucuucagaggcucuuaccuggcuggugcugggcuccuuuuuaguauuaugaaaaacaccacuaauacgaggcgcggaacaggcaacaucggugaaacccugggcgagaaguggaagucgcgguugaaugcccuggggaaaagcgaguuccaaauauauaagaaauccggaauccaggagguugauagaacucucgccaaggagggcauuaaacguggggaaaccgaccaucacgcggugucuaggggaucagcuaagcugcggugguuugucgagcgcaacauggugacaccagaaggcaaagucguggauuuagguugcgggcgaggaggcuggagcuacuauugugguggccuuaagaacguuagagaggugaaggggcugacuaaaggaggcccugggcaugaagaacccaucccuauguccaccuacggauggaaucucguaaggcuacagaguggcguggacgucuucuucacaccacccgagaagugcgauacgcuguugugugacauuggugaaucuagcccuaacccaaccaucgaggcagggcggacucugcgcguucucaaucuuguggaaaacuggcugaauaacaauacacaauuuugcauaaaagucuugaaccccuauaugccgucagugauugagaagauggaaacccugcagagaaaauacggaggcgcccucguaaggaauccuuuaucccgaaacaguacucacgagauguacugggugagcaaugcuacaggcaacaucguuucuuccgugaauaugaucucacggaugcugauuaaccguuucaccaugaagcacaagaaagccacguaugagccagaugucgaccuugggagcggaaccagaaauauagguaucgaaucggagauucccaaccuggacaucauuggcaagcgcaucgagaaaauaaagcaggaacaugaaacaucuuggcacuacgaucaggaccauccuuauaaaacuugggcauaccacgggaguuaugagaccaagcaaacaggauccgccagcucaauggugaacggcgucgugaggcuacucacuaagccaugggauguuguacccauggugacccagauggcuaugacagacaccacuccguuuggucagcagcgggucuucaaagagaagguggauacgagaacacaagaaccuaaagaggggaccaagaaacugaugaagaucacugcggaaugguuguggaaggagcugggcaaaaagaaaacaccccgcauguguacaagggaggaauuuacgcgaaagguucgguccaaugccgcacucggcgcuauuuucaccgacgagaacaaauggaagucugccagagaagcaguggaggauagcagguuuugggaacuuaucgaccgcgagcguaaucugcacuuagagggcaaaugcgaaacuugugucuacaacaugauggggaagcgggagaagaaacugggagaguucgguaaggccaaaggcaguagagcuauuugguauaugugguugggggccagguuucucgaguucgaagcgcugggauuucuaaaugaggaucauugguucucccgcggcaacagccuuucugguguggagggggaaggacugcaccgacucggcuacauccugcgggacguaucaaagaaagagggcggggcaauguacgccgaugacacagcuggaugggacaccagaauuacuuuggaagaucugaagaaugaggaaauggugacaaaccauaugaagggugagcacaaaaagcucgccgaggcaauauuuaaacuuaccuaucagaauaagguugucagggugcagcgcccaacaccuagaggcacugugauggacaucauuagucggagggaucagcguggguccggacaagucggcaccuacggucugaacacguucaccaauauggaagcucaguuaauccgacagauggagggggaaggaaucuucaaaagcauucaacaucugacaguuacugaggagauagccgugcagaacugguuggcucgcguaggcagagaacggcucucuaggauggccaucucgggcgacgauugcguggucaagccccuggacgaucgcuuugcaucagcgcuaaccgcccuuaaugacauggggaaggugagaaaagauauucagcagugggagccaagccggggauggaacgacuggacacaaguucccuucugcucccaccacuuucaugaacuggugaugaaggaugguaggguccucgugguaccuugucgaaaucaggacgagcugaucggccgugcuagaauuagucagggggccggauggucuuugaaagaaacugcaugcuuaggcaagagcuaugcucagauguggacccugauguacuuccaccgccgggaucucaggcuugccgcaaacgccaucuguuccgcgguuccaucacauugggugccgacgaguagaacaaccuggucuauacacgcuaaacacgaguggaugacuacagaggacaugcuggccgucuggaaccgcguguggauccaagaaaaucccuggauggaggacaagaccccuguggaaagcugggaggaagucccauaucuagguaagcgggaggaucaguggugcgggucccugauuggacucacuucaagggcaaccugggccaaaaacauccagacagcuauuaaucagguucggagcuugaucggcaacgaggaauacacggacuauaugcccucuaugaagagauuuagaagggaggaagaggaagccggcgugcugugguga

SEQ ID NO: 15016 - RNA, 9876 nt, Artificial Sequence
  derived and/or modified CDS sequence (opt3) from DENV-2__GQ398301__SS-prME
accgccggcgugaucauuaugcugauacccacagcuauggcauuccaccucacuacgagaaacggggagccucauaugaucgucggaaggcaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgugcagaggaucgagaccuggauacugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguacucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaagagcaggacaaacgauuugugugcaagcauucuauggucgauagaggcugggguaacggguguggacuauucggcaagggcgggaucgugaccugcgccauguuuacaugcaaaaagaauauggaaggaaaagugguccucccugagaaccuggaauacaccauuguuauaacuccacacagcggugaggagcaugcugugggcaaugacacggggaagcacggaaaagaaaucaagauuacaccgcaguccucaaucaccgaggccgaacuuacuggcuaugguaccguaacaauggaguguagucccaggaccgggcuggauuucaacgaaaugguguugcuccagauggaggacaaagcauggcugguccaccggcaaugguuuuuagaucugccucucccauggcuucccggcgcugacacucagggaagcaauuggauacagaaggagacacuggugacguucaagaacccucaugccaaaaagcaggacguuguggucuugggcucucaagaaggggcgaugcacaccgcccuaacuggagcaacagagauucagauguccucagguaaucugcucuuuaccggccaucugaaaugccgucuucgcauggauaagcugcaguugaaagggaugagcuacaguauguguacaggaaaguucaagaucgugaaagaaaucgcugagacucaacacggcaccauuguaaucagaguucaguaugagggugacgggucuccaugcaagauucccuucgaaauaauggaucucgagaaaaggcaugugcugggccgguuaaucacggucaacccgauuguggccgaaaaggacuccccugucaacaucgaggcugaacccccauuuggagauagcuacaucauuauaggcguggagccugggcagcugaaacuaaauugguucaagaagggaucgucuaucggucagauguuugagaccacaaugcgaggcgccaaacgcauggcaauucucggggacacugccugggauuucggaucccugggcgguguuuuuaccucaaucgggaaggcucuucaccaaguguucggcgcgauuuacggagcagccuuuaguggcguaagcuggacaaugaaaaucuugauaggggucaucauuacuuggaucggaaugaacuccagaucuaccagccugucagugagucucguucuggugggcgucgugacgcuuuaucugggugcuaugguacaggccgacuccgggugugugguuagcuggaagucuaaagaauugaagugcggaucaggcauuuucaucacagauaauguccacaccuggacugagcaguacaaguuucagcccgaaaguccaagcaaacucgcauccgccauacaaaaggcucaugaggaagguauuuguggcaucaggucugugacacggcuggagaacuuaauguggaaacagauuacccccgagcugaaucacauccuaucggaaaacgaggugaagcucacuauaaugaccggggacaucaaaggaauuaugcaggccggcaagcgcagccugagaccucagccaacagaacuuaaauauuccuggaagacgugggggaaggcaaaaauguugucaaccgagagucauaaucaaacuuuccugaucgauggaccggaaacagcggagugccccaacaccaauagggcuuggaacucucucgaggucgaagacuacggcuuugguguuuucacaacuaauauuuggcugaaguuacgugagaaacaggacguguuuugugauagcaagcugauguccgccgcaaucaaagacaaccgggccgugcacgcugauaugggguauuggauagaaucagcccuuaaugacaccuggaagauggagaaggcaagcuucauugagguaaaaucuugccacuggccuaagucccauacguuguggaguaacggaguccucgaaagcgagaugaucaucccaaaaaauuucgcuggccccgugucucagcacaacuaccgaccugguuaucauacacagaccgccggcccauggcaccuggggaagcuagaaauggauuuugacuucugugagggaacuaccguuguggucacagaagauugcggcaacagagggcccucccugaggacuaccacagcgucaggaaaacucauuacggaguggugcugucgcaguugcacccugccgccucuucgguacagaggcgaggacgguuguugguacgggauggaaaucaggccauugaaggagaaggaagagaaucuggugaacagcuuaguuacugccggacauggccaaauugauaauuuuucgcucggugugcugggcauggcucuuuuccuggaagagauguugcgcacacgaguagggaccaaacacgcaaugcuccuggucgccgcuuccuuugugacucuaauaacaggaaacaugucuuuccgggaccugggccgugugauggucaugguuggggccaccaugacggaugacaucggaaugggcauuacuuaucucgcacugcuugcggccuuuaaggugagacccaccuucgcugccgguuugcuguuaaggaaacucacaagcaaggagcugaugauggcaaccaucgggauugcucuucugucacagaguacuaucccugaaacaauacuagagcucaccgaugcccuggcauugggaaugaugguacugaaaaucgugcgcaauauggaaaaguaccaguuagccgucacaauuauggcuaucuccugcgugcccaacgcgguuauucuccaaaaugccuggaaggugucuuguacuauccuggcagcugucagcguguccccacuucuguugaccucaagccagcagaaagccgacuggauaccucucgcccugacgauuaagggccuaaaccccacagcuaucuuucugaccacucuuagucggaccucuaaaaagagauccuggccacucaaugaggcaaucauggccguuggcauggugagcauucuggcgucgucauugcugaaaaacgacauaccgaugacagggccuuuagucgcuggaggucuccugacuguaugcuaugugcuuaccggcaggucugccgaucuggaauuggagcgagcagccgacguuaagugggaggaucaggcugaaaucaguggguccagccccauucucucuaucacgauuagcgaggacggauccaugucaaucaaaaaugaagaggaggaacaaacacugaccauacuaauccgcacuggccugcuugugauuaguggugucuucccagugagcauccccauuacagcagccgcgugguaccucugggagguaaagaagcagcgggcuggggugcugugggaugucccuucuccacccccuguuggaaaagccgaauuggaggacggcgcauauagaaucaagcagaggggcauauuaggguacucccagauuggagccgguguguauaaagaaggcaccuuucacacuauguggcaugugacacguggggcuguccugaugcaccgcggaaagcggaucgagccgucaugggccgaugugaaaaaggaccucaucaguuacggcgguggguggaagcuggagggagaauggaaagagggcgaagagguucaaguacuugcacuggaaccaggcaagaaccccagagcugugcagaccaaaccuggguuguucaagacgaauacuggaaccauuggugccgucagccuagauuuuuccccaggcacaucugggucgcccaucguggacaggaaaggaaagguugugggccuguacgguaacggggucgugacccgaagcggagcguauguaucagccauagcacagacagagaaguccauugaggauaauccugaaaucgaggacgauauuuuccggaaaaagcgccucacuaucauggaccugcauccgggcgcuggcaaaaccaagagauaccuucccgccauagucagggaagcuauuaaacggggguuacgaacgcugauccucgcaccaacaagagugguugccgccgagauggaagaggcuuugcgcggacugccuaucagguaucagacucccgcgauucgugcagagcacaccggucgggaaaucguggaccucaugugucaugccacauucaccaugagacugcuuaguccagucagggugccuaacuacaaccugauuauaauggaugaggcucacuuuacugaccccgccucuaucgcagcccgcggcuauauuagcacccgaguugaaaugggggaggcugcgggaaucuucaugacagccacgccaccgggcuccagagauccuuuuccccaaucaaaugcaccaaucauggacgaggaacgggagauucccgaaaggucuuggaacagcggucacgagugggugacugauuucaaggggaagaccgucugguuugugccuaguauaaaagcuggaaaugacaucgccgcaugcuugcgcaagaacggcaaaaagguaauucagcuaucccguaaaacauucgauagcgaauacgugaagaccagagccaaugacugggauuuuguugucacuacagacaucucugagaugggcgcuaacuucaaggccgagcgggugauugauccaaggcgcuguaugaaacccgugauccugaccgacggggaagagcgagucauacucgcgggaccuaugccgguaacgcauucauccgcagcccagagacgggguaggaucggccgcaauccaaagaacgaaaaugaccaauauauuuacaugggggagcccuuagaaaacgaugaggacugcgcucacuggaaagaggccaagaugcugcuugauaauaucaacacuccugaaggaauuauccccaguauguuugagccagaaagagagaaaguggacgcuauagauggcgaauacaggcugcggggugaggcacguaagacauucguugaccucaugcgccgaggggauuugccuguguggcuggccuauagagucgcugccgagggcauuaauuacgcagacaggcggugguguuuugauggaaucaaaaacaaucagauucucgaagagaacguggaaguugagaucuggaccaaggagggcgaacgcaagaaacugaagcccagauggcuugacgcgaggauauauagcgauccacuagcccugaaagaguucaaggaauucgcugccgggcggaaaucguugaccuuaaaccugaucacugagaugggacgacucccuacauuuaugacccagaaggcaagagacgcucuggauaaucuugccgugcugcauacagcagaagccgguggccgcgcuuacaaccacgcgcucucugaguugccggagacucuggaaacgcuacugcuccuuacccuguuagccacagucacugggggaauuuucuuguuucugauguccggcaaggguaucgggaaaaugacccucggcaugugcugcauuaucacagcaagcauacugcuuugguaugcucagauucaaccccacuggaucgccgccucaaucauucuggaguucuuucucaucguguugcugauaccagaaccugagaagcagaggaccccccaggacaaucaguuaacuuacguagugauugcaauccuaacgguugucgcugccaccauggcgaacgaaaugggauuccuggagaaaacaaagaaagaccucggccuugggaguauugcuacucaagagucugaauccaauauccuggauauagacuugcggccagccagcgcauggacccuguaugccguggcuacaaccuuugugacuccuaugcuccgucauucaaucgagaacaguagcgucaauguuucccugacagcaauugccaaccaggcgacggugcuuaugggacucgguaagggcuggccccugucuaagauggauaucgggguaccguugcuggcuauuggauguuacagccaggugaauccaaucaccuuaacugccgcacuacugcuccuugucgcccacuacgcuauuaucggcccuggucugcaggccaaagcaacaagagaagcucaaaagagggccgcggccgggauaaugaaaaaccccaccguggacggcauuaccguuaucgauuuggagccaauccccuaugacccuaaguucgaaaaacagcugggacaggugaugcuccugauucuuugcgucacacagguauuaaugaugcgcacuacgugggcacugugugaggcucucaccuuggccacaggcccgauauccacucugugggaggggaaucccggacgguuuuggaacaccacaaucgcagugucaauggcuaauauuuuccgaggcucuuaccuagccggugccgggcugcucuuuaguaucaugaagaacaccacuaauacgagaaggggaacaggcaacauuggugaaacccuuggcgagaaguggaaaucgcgccugaaugcguuggggaagagcgaauuccaaaucuauaaaaaguccggaauacaggagguugaucggacucuggcuaaagagggcaucaagagaggggaaaccgaccaucacgcagugucucguggaucagccaaacucaggugguuugucgagcggaacauggugacaccagaaggcaaggucguggaucuggguugcgggcgcggaggcuggagcuacuauugugguggcuuaaagaacguucgagaggugaaagggcuuacuaagggaggcccugggcaugaagagcccauuccuauguccaccuacggauggaaucugguaagacuccagaguggcguggacgucuucuucacaccacccgagaaaugcgauacgcuacugugugacaucggugaaucuagcccuaacccaaccauugaggcugggaggacuuugcggguucugaaucucguggaaaacuggcuuaauaacaauacacaauuuugcaucaagguccugaaccccuauaugccgucagugauagagaaaauggaaaccuugcagcgcaaguacggaggcgcccugguaagaaauccucucuccaggaacaguacucacgagauguacugggugagcaaugcaacaggcaacauuguuucuuccgugaauaugaucucacgaauguuaaucaaccgguucaccaugaagcacaaaaaggccacguaugagccagaugucgaccuggggagcggaacccguaauauugguauagaaucggagauccccaaccuugacauuaucggcaaaagaauugaaaagaucaaacaggagcaugaaacaucuuggcacuacgaucaggaccauccuuauaagacuugggcuuaccacgggaguuaugagaccaagcaaacaggauccgcgagcucaauggugaacggcgucgugcgccugcuaacuaaaccaugggauguuguacccauggugacccagauggccaugacagacaccacuccguuuggucagcagagggucuucaaggagaaaguggauacgcggacacaagaaccuaaggaggggaccaaaaagcucaugaagauaacugcagaauggcuguggaaagaguugggaaaggagaaaacccccagaauguguacacgcgaagaguuuacgaggaagguucgauccaaugcugcccugggcgcaaucuucaccgacgaaaacaaauggaagucugcccgggaggcuguggaagauagcagauuuugggagcucauugacagggagcgcaaucuucaccuggaaggcaaaugcgagacuugugucuacaacaugauggggaagcgugaaaagaaauuaggagaguucgguaaggccaaaggcagucgggcgaucugguauauguggcugggggcaagauuuuuggaauucgaggcccucggauuucugaaugaggaucauugguucuccaggggcaacagccuaucugguguggaaggggagggacuucaccgccugggcuacauucuccgagacguaucaaagaaagaaggcggggcuauguacgccgaugacacagcaggaugggacacccggaucacucuggaggauuugaagaaugaagagauggugacaaaccauaugaagggugagcacaaaaagcuggcugaagccauuuuuaaacucaccuaucagaauaagguugucagagugcagaggccaacaccucgcggcacugugauggacauaaucaguagacgggaucagaggggguccggacaagucggcaccuacggucuuaacacguucaccaauauggaggcucagcugauucgucagauggaaggggagggaaucuucaaaagcauccaacauuuaacaguuacugaggaaauugccgugcagaacuggcuggcacgaguaggccgcgagagauugucucggauggcgauaucgggcgacgauugcguggucaagccccucgacgauagguuugccucagcucugaccgcccuaaaugacauggggaaggugcgcaaagauauccagcagugggaaccaagcagaggauggaacgacuggacacaaguucccuucugcucccaccacuuucaugagcuugugaugaaggauggucggguccuggugguaccuuguaggaaucaggacgaacucauuggccgagcacguaucagucagggggcuggauggucucugaaagagacugccugcuugggcaagagcuaugcacagauguggaccuuaauguacuuccacagacgcgaucugcggcucgccgcgaacgcuauuuguuccgccguuccaucacauugggugccgacgaguaggacaaccuggucuauccacgcaaaacacgaguggaugacuacagaagacaugcuugccgucuggaacagaguguggauacaagagaaucccuggauggaagacaagaccccuguggagagcugggaagaggucccauaucuggguaagcgcgaggaucaguggugcgggucccuaaucggacugacuucacgggcuaccugggccaaaaacauucagacagcaaucaaucagguuaggagccucauuggcaacgaagaguacacggacuauaugcccucuaugaagcgauuuagacgggaagaggaagaggcuggcguguugugguga

SEQ ID NO: 15017 - RNA, 9876 nt, Artificial Sequence
  derived and/or modified CDS sequence (opt3) from DENV-2__GQ398312__SS-prME
accgccggcgugaucauuaugcugauacccacagcuauggcauuccaccucacuacgagaaacggggagccucauaugaucgucggaaggcaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgugcagaggaucgagaccuggauacugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguacucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaagagcaggacaaacgauuugugugcaagcauucuauggucgauagaggcugggguaacggguguggacuauucggcaagggcgggaucgugaccugcgccauguuuacaugcaaaaagaauauggaaggaaaagugguccucccugagaaccuggaauacaccauuguuauaacuccacacagcggugaggagcaugcugugggcaaugacacggggaagcacggaaaagaaaucaagauuacaccgcaguccucaaucaccgaggccgaacuuacuggcuaugguaccguaacaauggaguguagucccaggaccgggcuggauuucaacgaaaugguguugcuccagauggaggacaaagcauggcugguccaccggcaaugguuuuuagaucugccucucccauggcuucccggcgcugacacucagggaagcaauuggauacagaaggagacacuggugacguucaagaacccucaugccaaaaagcaggacguuguggucuugggcucucaagaaggggcgaugcacaccgcccuaacuggagcaacagagauucagauguccucagguaaucugcucuuuaccggccaucugaaaugccgucuucgcauggauaagcugcaguugaaagggaugagcuacaguauguguacaggaaaguucaagaucgugaaagaaaucgcugagacucaacacggcaccauuguaaucagaguucaguaugagggugacgggucuccaugcaagauucccuucgaaauaauggaucucgagaaaaggcaugugcugggccgguuaaucacggucaacccgauuguggccgaaaaggacuccccugucaacaucgaggcugaacccccauuuggagauagcuacaucauuauaggcguggagccugggcagcugaaacuaaauugguucaagaagggaucgucuaucggucagauguuugagaccacaaugcgaggcgccaaacgcauggcaauucucggggacacugccugggauuucggaucccugggcgguguuuuuaccucaaucgggaaggcucuucaccaaguguucggcgcgauuuacggagcagccuuuaguggcguaagcuggacaaugaaaaucuugauaggggucaucauuacuuggaucggaaugaacuccagaucuaccagccugucagugagucucguucuggugggcgucgugacgcuuuaucugggugcuaugguacaggccgacuccgggugugugguuagcuggaagucuaaagaauugaagugcggaucaggcauuuucaucacagauaauguccacaccuggacugagcaguacaaguuucagcccgaaaguccaagcaaacucgcauccgccauacaaaaggcucaugaggaagguauuuguggcaucaggucugugacacggcuggagaacuuaauguggaaacagauuacccccgagcugaaucacauccuaucggaaaacgaggugaagcucacuauaaugaccggggacaucaaaggaauuaugcaggccggcaagcgcagccugagaccucagccaacagaacuuaaauauuccuggaagacgugggggaaggcaaaaauguugucaaccgagagucauaaucaaacuuuccugaucgauggaccggaaacagcggagugccccaacaccaauagggcuuggaacucucucgaggucgaagacuacggcuuugguguuuucagcacaaauauuuggcugaaguuacgugagaaacaggacguguuuugugauuccaagcugaugucagccgcaaucaaagacaaccgggccgugcacgcugauaugggguauuggauagaaagcgcccuuaaugacacuuggaagauggagaaggcaucuuucauugagguaaaauccugccacuggccuaagagucauaccuuguggagcaacggaguccucgaaucugagaugaucaucccaaaaaauuucgcuggccccgugucccagcacaacuaccgaccugguuaucauacgcagacagccggcccauggcaccuggggaagcuagaaauggauuuugacuucugugagggaaccacuguuguggucaccgaagauugcggcaacagagggcccucacugaggacaacuaccgcgaguggaaaacucauuacagaguggugcugucgcagcugcacgcugccgccucuucgguacagaggcgaggacgguuguugguacgggauggaaaucaggccauugaaggagaaggaagagaaucuggugaacucguuaguuaccgccggacauggccaaauugauaauuuuucccucggugugcugggcauggcucuuuuccuggaagagauguugcgcacucgaguagggacaaaacacgcaaugcuccuggucgccgugucuuuugugacccuaauaacuggaaacaugagcuuccgggaccugggccgugucaugguuauggugggggcuacaaugaccgaugacaucggaaugggcauuacguaucucgcccugcuugcagcguuuaagguaagacccacuuucgccgcugguuugcuguuaaggaaacucaccucaaaggagcugaugauggccacaaucgggauugcacuucugagucaguccaccaucccugaaacuauacuagagcucacagaugcucuggccuugggaaugauggugcugaaaaucguccgcaauauggaaaaguaccaguuagcagugaccauuauggccaucucuugcguucccaacgcugugauucuccaaaaugcguggaaggucagcuguacaauccuggccgcaguguccguuucaccacuucuguugacuagcagucagcagaaagcugacuggauaccucucgcccugaccauuaagggccuaaaccccacggccaucuuucugacaacccuuucucggacuuccaaaaagagaagcuggccacucaaugaggcuaucauggcagugggcauggucucgauucuggccucaucuuugcugaaaaacgacauaccgaugaccgggccuuuaguagcgggaggucuccugacagugugcuauguucuuacuggcaggagugcugaucuggaauuggagcgagccgcagacgugaagugggaggaucaggccgaaaucuccgggagcucucccauucucagcaucaccauuuccgaggacggaucaaugaguaucaaaaaugaagaggaggaacaaacgcugacaauacuaauccgcaccggccugcuugucauuagcgguguguucccaguaucuauccccauuacugcugcagccugguaccucugggaggugaagaagcagcgggcggggguccugugggauguuccuuccccacccccugugggaaaagcugaauuggaggacggcgccuauagaaucaagcagaggggcauauuaggguacucacagauuggagcagguguguauaaagaaggcacauuucacaccauguggcaugucacucguggggccgugcugaugcaccgcggaaagcggaucgagccgaguugggcugauguuaaaaaggaccucaucagcuacggcgguggguggaagcuggagggagaauggaaagagggcgaagagguacaagugcuugcccuggaaccaggcaagaaccccagagcaguccagacaaaaccuggguuguucaagaccaauacgggaacuauuggugcugugucccuagauuuuucuccaggcaccucggggagccccaucguugacaggaaaggaaagguggucggccuguacgguaacggggugguaacacgaucaggagccuaugucuccgcgauagcccagaccgagaagaguauugaggauaauccugaaaucgaggacgauauuuuccggaaaaagcgccucacaaucauggaccugcauccgggcgcaggcaaaacuaagagauaccuucccgcuauagugagggaagccauuaaacggggguuacgaacccugauccucgcuccaacgagaguuguggcagccgagauggaagaggccuugcgcggacugccuaucagguaucagacacccgcuauucgugcggagcacacuggucgggaaaucgucgaccucaugugucaugcaaccuucacaaugagacugcuuucuccagugaggguuccuaacuacaaccugauuauaauggaugaggcccacuuuaccgaccccgcuagcaucgccgcacgcggcuauauuuccacucgaguggaaaugggggaggccgcuggaaucuucaugaccgcgacaccaccgggcucaagagauccuuuuccccaaucuaaugccccaaucauggacgaggaacgggagauucccgaaaggagcuggaacaguggucacgagugggucacggauuucaaggggaagacugugugguuuguaccuuccauaaaagcaggaaaugacaucgcugccugcuugcgcaagaacggcaaaaaggugauucagcuaagccguaaaaccuucgauucugaauacguuaagacaagagcaaaugacugggauuuugucgugaccacugacaucucagagaugggcgccaacuucaaggcugagcgggugauugauccaaggcgcuguaugaaacccgucauccugacagacggggaagagcgaguaauacucgccggaccuaugccggugacccauuccagugcggcacagagacgggguaggaucggccgcaauccaaagaacgaaaaugaccaauauauuuacaugggggagcccuuagaaaacgaugaggacugcgcccacuggaaagaggcuaagaugcugcuugauaauaucaacacgccugaaggaauuauccccagcauguuugagccagaaagagagaaaguugacgccauagauggcgaauacaggcugcggggugaggcucguaagacuuucguggaccucaugcgccgaggggauuugccugucuggcuggcauauagaguggccgcugagggcauuaauuacgccgacaggcggugguguuuugauggaaucaaaaacaaucagauucucgaagagaacguugaaguggagaucuggacaaaggagggcgaacgcaagaaacugaagcccagauggcuugacgcaaggauauauucggauccacuagcgcugaaagaguucaaggaauucgccgcugggcggaaaucuuugaccuuaaaccugaucaccgagaugggacgacucccuacuuuuaugacacagaaggccagagacgcacuggauaaucuugcuguccugcauaccgccgaagcagguggccgcgccuacaaccacgcucucuccgaguugccggagacacuggaaacucuacugcuccuuacgcuguuagcgaccgugacagggggaauuuucuuguuucugaugagcggcaaggguaucgggaaaaugacucucggcaugugcugcauuaucaccgccucaauacugcuuugguaugcacagauucaaccccacuggaucgcugccaguaucauucuggaguucuuucucaucguauugcugauaccagaaccugagaagcagaggacaccccaggacaaucaguuaaccuacgugguuauugccauccuaacugucguggcagcuacgauggccaacgaaaugggauuccuggagaaaaccaagaaagaccucggccuugggucuauugcgacacaagaguccgaaagcaauauccuggauauagacuugcggccagcuucagccuggacucuguaugcaguggccaccacauuugucaccccuaugcuccgucauaguaucgagaacagcuccguuaaugugucucugacugcuauugcaaaccaggccacaguacuuaugggacucgguaagggcuggccccugagcaagauggauaucggggugccguugcuggcgauuggauguuacucccaggucaauccaaucacguuaauugcugcccuacugcuccuuguggcacacuacgccaucauaggcccuggucugcaggcuaaagccaccagagaagcacaaaagagggcugccgcggggauuaugaaaaaccccacuguugacggcaucacagugaucgauuuggagccaauucccuaugacccuaaguucgaaaaacagcugggacaggucaugcuccugauacuuugcguaacccagguguuaaugaugcgcaccacaugggcccugugugaggcacucacuuuggcuacgggcccgaucucaacccugugggaggggaaucccggacgguuuuggaacacaacuauugccguuucuauggcaaauaucuuccgaggcaguuaccuagcuggugccgggcugcucuuuucgauuaugaagaacaccacaaauaccagaaggggaacuggcaacaucggugaaacgcuuggcgagaaguggaaaagccgccugaaugccuuggggaaguccgaauuccaaauauauaaaaagucuggaauccaggagguggaucggacacuggcgaaagagggcauuaagagaggggaaaccgaccaucacgcugucucacguggaagcgcaaaacucaggugguuuguggagcggaacauggucacuccagaaggcaaggugguugaucuggguugcgggcgcggaggcugguccuacuauugugguggcuuaaagaacgugcgagagguaaaagggcuuaccaagggaggcccugggcaugaagagcccaucccuaugaguacauacggauggaaucuggugagacuccagucuggcgucgacguuuucuucacuccacccgagaaaugcgauacccuacugugugacauuggugaaagcucaccuaacccaacaaucgaggccgggaggacguugcgggugcugaaucucgucgaaaacuggcuuaauaacaauacccaauuuugcauaaaggugcugaaccccuauaugccguccguaauugagaaaauggaaacuuugcagcgcaaguacggaggcgcucuggugagaaauccucucaguaggaacagcacacacgagauguacuggguuucuaaugccaccggcaacaucguguccucagucaauaugaucagccgaauguuaauuaaccgguucacuaugaagcacaaaaaggcaacauaugagccagauguggaccuggggucgggaacccguaauauagguaucgaaucugagauucccaaccuugacaucauuggcaaaagaaucgaaaagauaaaacaggagcaugaaacgaguuggcacuacgaucaggaccauccuuauaagaccugggccuaccacggguccuaugagacaaagcaaacuggaagcgcuucauccauggucaacggcgugguucgccugcuaaccaaaccaugggauguagugcccauggucacacagauggcgaugacugacaccacaccguuuggucagcagaggguguucaaggagaaaguugauacccggacucaagaaccuaaggaggggacgaaaaagcucaugaagaucacagccgaauggcuguggaaagaguugggaaagaaaaagacccccagaauguguacucgcgaggaauuuaccaggaaagugcgaucuaaugcagcucugggcgccauuuucacagacgagaacaaguggaaaagcgcacgggaagccgucgaggauaguagauuuugggaacucaucgacagggagcgcaaucuucaccuggagggcaagugcgaaacguguguguacaacaugauggggaagcgugagaaaaaguuaggagaauucgguaaagcuaagggcucccgggccauuugguauauguggcugggggcgagauuuuuggaguucgaagcacucggauuucugaaugaggaucauugguucagcaggggcaacucucuaucagguguagagggggaaggacuucaccgccugggcuacauccuccgagacgugaguaaaaaggagggcggggccauguacgcugaugacaccgccggaugggacacucggauuacacuggaagauuugaagaaugaggaaaugguuaccaaccauaugaaaggugagcacaagaaacuggcagaggcuauauuuaagcucacuuaucagaauaaagucgugagagugcagaggccaacaccucgcggcaccgucauggacaucauuuccagacgggaucagagggggagcggacaaguuggcacauacggucuuaacacuuucaccaauauggaagcccagcugauccgucagauggagggggaaggaaucuucaagucuauucaacauuuaacggugaccgaggagauagcuguacagaacuggcuggcccgagugggccgcgaaagauugucgcggauggcaaucucaggcgacgauugcgucgugaagccccucgacgauagguuugcgagcgcccugacagcucuaaaugacauggggaaaguucgcaaggauauucagcagugggagccauccagaggauggaacgacuggacucaagugcccuucugcagucaccacuuucaugaacuugucaugaaagauggucgggugcugguaguuccuuguaggaaucaggacgagcucaucggccgagcccguauuucucagggggcaggauggagccugaaggaaaccgcuugcuugggcaaauccuaugcccagauguggacauuaauguacuuccacagacgcgaucugcggcucgcagccaacgcgaucuguucagcugugccaagucauugggucccgacuucuaggaccacguggagcauacacgccaagcacgaguggaugacaaccgaggacaugcuugcaguguggaacagaguguggauccaagaaaaucccuggauggaggacaagacuccugucgaauccugggaggaaguuccauaucuggguaaacgcgaggaucaguggugcgggucacuaauuggacugacaagccgggccaccugggcuaagaacauccagacugccauuaaucaggugaggucucucaucggcaacgaggaauacaccgacuauaugcccuccaugaaacgauuuagacgggaggaagaggaagcaggcguauugugguga

SEQ ID NO: 15018 - RNA, 9876 nt, Artificial Sequence
  derived and/or modified CDS sequence (opt3) from DENV-2__GQ398289__SS-prME
accgcaggcgugaucauuaugcugauacccacggcuauggcauuccaccucacuacgagaaacggggagccucauaugaucgucggaagacaggaaaaggguaaaagccuucuguuuaagaccgaggacggcguuaauaugugcacauugauggcaauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgugcagaggaucgagaccuggauacugcggcauccuggcuucgccaucauggcagccauuuuggcuuacacaaucggcaccacgcacuuucagcgcgcacucauuuucauccugcugacugccguugcuccauccaugacaaugagaugcauagggauuucuaacagggauuuuguggaaggagucucggguggcucauggguggacaucguacucgagcacgggagcuguguuaccacuauggccaagaauaagcccacauuagauuucgaacugauuaaaaccgaggcgaagcagccugcaacgcuucggaaauauugcaucgaagccaaguugaccaacacaacuaccgagagucgcuguccaacacaaggagagcccucccugaaugaagaacaggacaaacgauuugugugcaagcauucuauggucgauagaggcugggguaacggguguggacuauucggcaagggcgggaucgugacuugcgcuauguuuaccugcaaaaagaauauggaaggaaaagugguccucccugagaaccuggaauacacaauuguuauaaccccacacagcggugaggagcaugccgugggcaaugacacugggaagcacggaaaagaaaucaagauuacgccgcaguccucaaucacagaggcagaacuuaccggcuaugguacuguaaccauggaguguagucccaggacagggcuggauuucaacgaaaugguguugcuccagauggaggacaaggcuuggcugguccaccggcaaugguuuuuagaucugccucucccauggcuucccggcgccgacacccagggaagcaauuggauacagaaggagacucuggugacauucaagaacccucaugcgaaaaagcaggacguuguggucuugggcucucaagaaggggccaugcacacggcacuaaccggagcuacugagauucagauguccucagguaaucugcucuuuacaggccaucugaaaugccgucuucgcauggauaagcugcaguugaaagggaugagcuacaguauguguaccggaaaguucaagaucgugaaagaaaucgccgagacacaacacggcacuauuguaaucagaguucaguaugagggugacgggucuccaugcaagauucccuucgaaauaauggaucucgagaaaaggcaugugcugggccgguuaaucaccgucaacccgauugugacggaaaaggacuccccugucaacaucgaggcugaacccccauuuggagauagcuacaucauuauaggcguggagccugggcagcugaaacuaaauugguucaagaagggaucgucuaucggucagauguuugagaccacaaugcgaggcgccaaacgcauggcaauucucggggacacugccugggauuucggaucccugggcgguguuuuuaccucaaucgggaaggcacuucaccaaguguucggcgcgauuuacggagcagccuuuaguggcguaagcuggacaaugaaaaucuugauaggggucaucauuacuuggaucggaaugaacuccagaucuaccagccugucagugagucucguucuggugggcgucgugacgcuuuaucugggugcuaugguacaggccgacuccgggugugugguuagcuggaagucuaaagaauugaagugcggaucaggcauuuucaucacagauaauguccacaccuggacugagcaguacaaguuucagcccgaaaguccaagcaaacucgcauccgccauacaaaaggcucaugaggaagguauuuguggcaucaggucugugacacggcuggagaacuuaauguggaaacagauuacccccgagcugaaucacauccuaucggaaaacgaggugaagcucacuauaaugaccggggacacaaaaggaaucaugcaggccggcaagcgcagccugagaccucagccaacggaacuuaaauauuccuggaagaccugggggaaggcaaaaauguugucaacugagagucauaaucaaacauuccugauugauggaccggaaaccgcggagugccccaacacaaauagggcuuggaacucucucgaggucgaagacuacggcuuugguguuuucacuaccaauaucuggcugaaguuacgugagaaacaggacguguuuugugauagcaagcugauguccgccgcaauuaaagacaaccgggccgugcacgcugauaugggguauuggaucgaaucagcccuuaaugacacguggaagauggagaaggccagcuucauagagguaaaaucuugccacuggccuaagucccauacauuguggaguaacggaguccucgaaagcgagaugauuauccccaaaaauuucgcuggccccgugucucagcacaacuaccgaccugguuaucauacccagacugccggcccauggcaccuggggaagcuagaaauggauuuugacuucugugagggaaccacaguuguggucacugaagauugcggcaacagagggcccucccugaggaccacaacggcgucaggaaaacucaucaccgaguggugcugucgcaguugcacucugccgccucuucgguacagaggcgaggacgguuguugguacgggauggaaauuaggccauugaaggagaaggaagagaaucuggugaacagcuuaguuacagccggacauggccaaaucgauaauuuuucgcucggugugcugggcauggcucuuuuccuggaagagauguugcgcacccgaguagggacuaaacacgcaauucuccugauagccgucuccuuugugacacuaaucaccggaaacaugucuuuccgggaccugggccgugugauggucaugguuggggcuacgaugacugaugacauuggaaugggcgugaccuaucucgcccugcuugcagcguuuaagguaagacccacauucgccgcugguuugcuguuaaggaaacucaccagcaaggagcugaugauggccacuaucgggauugcacuucugucacagaguacaaucccugaaaccauacuagagcucacagaugcucuggccuugggaaugauggugcugaaaaucguccgcaauauggaaaaguaccaguuagcagugacuauuauggccaucuccugcguucccaacgcugugauucuccaaaaugcguggaaggucucuuguaccauccuggccgcagugagcguuuccccacuucuguugacgucaagccagcagaaagcugacuggauaccucucgcccugacaauuaagggccuaaaccccaccgccaucuuucugacuacccuuagucggacaucuaaaaagagauccuggccacucaaugaggcuaucauggcagugggcauggucagcauucuggccucgucauugcugaaaaacgacauaccgaugacugggccuuuaguagcgggaggucuccugaccgugugcuauguucuuacgggcaggucugcugaucuggaauuggagcgagccgcagacgugaagugggaggaucaggccgaaaucaguggguccagccccauucucucuaucacaauuagcgaggacggauccaugucaaucaaaaaugaagaggaggaacaaacccugacuauacuaauccgcacaggccugcuugucauuagugguguguucccaguaagcauccccauuaccgcugcagccugguaccucugggaggugaagaagcagcgggcggggguccugugggauguuccuucuccacccccugugggaaaagcugaauuggaggacggcgccuauagaaucaagcagaggggcauauuaggguacucccagauuggagcugguguguauaaagaaggcacuuuucacacaauguggcaugucacccguggggccgugcugaugcaccgcggaaagcggaucgagccgucaugggcugauguuaaaaaggaccucaucaguuacggcgguggguggaagcuggagggagaauggaaagagggcgaagagguacaagugcuugcccuggaaccaggcaagaaccccagagcaguccagacgaaaccuggguuguucaagacuaauaccggaacaauuggugcugugagccuagauuuuuccccaggcaccucugggucgcccaucguugacaggaaaggaaagguggucggccuguacgguaacggggugguaacacgaagcggagccuaugucucagcgauagcccagacugagaaguccauugaggauaauccugaaaucgaggacgauauuuuccggaaaaagcgccucaccaucauggaccugcauccgggcgcaggcaaaacgaagagauaccuucccgcuauagugagggaagccauuaaacggggguuacgaacacugauccucgcuccaacuagaguuguggcagccgagauggaagaggccuugcgcggacugccuaucagguaucagacccccgcuauucgugcggagcacacaggucgggaaaucgucgaccucaugugucaugcaaccuucacuaugagacugcuuaguccagugaggguuccuaacuacaaccugauuauaauggaugaggcccacuuuaccgaccccgcuucuaucgccgcacgcggcuauauuagcacacgaguggaaaugggggaggccgcuggaaucuucaugacggcgacuccaccgggcuccagagauccuuuuccccaaucaaaugccccaaucauggacgaggaacgggagauucccgaaaggucuuggaacagcggucacgagugggucaccgauuucaaggggaagacagugugguuuguaccuaguauaaaagcaggaaaugacaucgcugccugcuugcgcaagaacggcaaaaaggugauucagcuaucccguaaaaccuucgauagcgaauacguuaagacuagagcaaaugacugggauuuugucgugacaaccgacaucucugagaugggcgccaacuucaaggcugagcgggugauugauccaaggcgcuguaugaaacccgucauccugacggacggggaagaacgaguaauacucgccggaccuaugccggugacucauucauccgcggcacagagacgggguaggaucggccgcaauccaaagaacgaaaaugaccaauauauuuacaugggggagcccuuagaaaacgaugaggacugcgcccacuggaaagaggcuaagaugcugcuugauaauaucaacacaccugaaggaauuauccccagucuguuugagccagaaagagagaaaguugacgccauagauggcgaauacaggcuccggggugaggcucguaagaccuucguggacuugaugcgccgaggggaucugccugucuggcucgcauauagaguggccgcugagggcauuaauuacgccgacaggcggugguguuuugauggaaucaaaaacaaucagauucuggaagagaacguugaaguggagaucuggaccaaggagggcgaacgcaagaaacuuaagcccagauggcuagacgcaaggauauauagcgauccacuggcguugaaagaguucaaggaguucgccgcugggcggaaaucguuaacucugaaccucaucacagagaugggacgacugccuaccuuuaugacacagaaggccagagacgcacuugauaaucuggcuguccuccauacugccgaagccgguggacgcgcauacaaccacgcuuugucugagcugccggagacgcuagaaacccugcuccuucugacauuauuggcgacugugaccgggggaauuuuccuguuucucauguccggcagggguaucgggaagaugacacugggcaugugcugcauuaucaccgccagcauacuucugugguaugcacagauucaaccccacuggaucgcugccucaaucauucucgaguucuuuuugaucguacuguuaauaccagaaccugagaaacagcggacuccccaggacaaucagcuaacguacgugguuauugccauccugaccgucguggcagcuacaauggccaacgaaaugggauuccucgagaagacuaaaaaggaccuuggccuggggaguauuaccacacaagagucugaauccaauaucuuggauauagaccugcguccagcgagcgcuuggacccucuaugccguggcaacuacauuugucacgccuaugcugagacauucaaucgagaacaguagcguuaaugugucccuuaccgccauugcuaaccaggcaacuguacucaugggacuggguaaaggcuggcccuugucuaagauggauaucggggugccgcuguuagccauuggauguuacagccaggucaauccaaucacacuaaccgcggcucugcuccuucugguggcccacuacgcaauuaucggcccugguuugcaggccaaggcuaccagggaagcccaaaaacgcgcagcugccgggauaaugaagaaccccacaguugacggcauuacugugaucgaucuggagccaauccccuaugacccuaaauucgaaaagcagcucggacaggucaugcugcuuauuuuaugcguaacacaggugcugaugaugcggaccacaugggcgcucugugaggccuugacucuggcaaccggcccgauauccacacuaugggaggggaaucccggacgauuuuggaacaccacuaucgcuguuucaauggccaauauuuucagaggcucuuaccuggccggugcugggcuccuuuuuaguaucaugaaaaacacgacaaauaccaggcgcggaacuggcaacauuggugaaacccugggcgagaaguggaagucgcgguugaaugcccuggggaaaagcgaguuccaaaucuauaagaaauccggaauacaggagguggauagaacacucgccaaggagggcaucaaacguggggaaacugaccaucacgcggucucuaggggaucagcuaagcugcggugguuuguggagcgcaacauggucaccccagaaggcaaagugguugauuuagguugcgggcgaggaggcuggagcuacuauugugguggccuuaagaacgugagagagguaaaggggcugacaaaaggaggcccugggcaugaagaaccaauuccuauguccacguacggauggaaucucgugaggcuacagaguggcgucgacguuuucuucaccccacccgagaagugcgauacucuguugugugacaucggugaaucuagcccuaacccaacaauugaggcagggcggacccugcgcgugcucaaucuugucgaaaacuggcugaauaacaauacucaauuuugcaucaaaguguugaaccccuauaugccgucaguaauagagaagauggaaacacugcagagaaaauacggaggcgcccucgugaggaauccuuuaucccgaaacaguacccacgagauguacuggguuagcaaugcuacgggcaacauugugucuuccgucaauaugaucucacggaugcugaucaaccguuucaccaugaagcacaagaaagccacauaugagccagauguggaccuugggagcggaacuagaaauauugguauagaaucggagauccccaaccuggacauuaucggcaagcgcauugagaaaaucaagcaggaacaugaaaccucuuggcacuacgaucaggaccauccuuauaaaacaugggcauaccacgggaguuaugagacuaagcaaaccggauccgccagcucaauggucaacggcgugguuaggcuacucacaaagccaugggauguagugcccauggucacccagauggcuaugacugacacgacaccguuuggucagcagcggguguucaaagagaagguugauaccagaacucaagaaccuaaagaggggaccaagaaacugaugaagauaacagcggaaugguuguggaaggagcugggcaaaaagaaaacgccccgcauguguaccagggaggaauuuacucgaaaagugcgguccaaugccgcacucggcgcuaucuucacagacgagaacaaauggaagucugccagagaagcagucgaggauagcagguuuugggaacuuauugaccgcgagcguaaucugcacuuagagggcaaaugcgaaaccuguguguacaacaugauggggaagcgggagaagaaacugggagaguucgguaaggccaaaggcaguagagcuaucugguauaugugguugggggccagguuucucgaguucgaagcgcugggauuucuaaaugaggaucauugguucucccgccgaaacagccuuucuggcguagagggugaagggcugcaccggcucggauacauucugagagacgugucaaagaaagagggcggcgcaauguacgccgaugacacugcugggugggacacaaggaucaccuuggaagaucugaagaaugaggaaaugguuacaaaccauaugaagggagagcacaaaaagcucgccgaggcaauuuuuaaacuuacuuaucagaauaaggucgugcgcgugcagagaccaaccccucgggguacggucauggacauaaucaguaggcgugaucagcgaggcuccgggcaaguuggaaccuacggccugaacacauucacuaauauggaagcucaguuaauucgccagauggagggugaagggaucuucaaaagcauccaacaucugaccgugacagaggagauugccguacagaacugguuggcuagagugggacgggaaaggcucucucgcauggccauaucgggcgacgauugcgucgugaagccccuggacgauagauuugcaucagcgcuaacugcccuuaaugacaugggcaagguucggaaagauauccagcagugggagccaagcaggggguggaacgacuggacccaagugcccuucugcucccaccacuuucaugaacuggucaugaaggauggacgagugcucguaguuccuugucguaaucaggacgagcugauugguagagcucgcaucagucagggcgccggguggucuuugaaagaaacggcaugcuuaggaaagagcuaugcucagauguggacacugauguacuuccaccggagggaucucagacuugccgcaaacgccauuuguuccgcggugccaucacauugggucccgaccagucgcacuacauggucuauccacgcuaaacacgaguggaugaccacugaggacaugcuggccguguggaaccggguguggauacaagaaaaucccuggauggaggacaagaccccugucgaaagcugggaggaaguuccauaucuaggcaagagggaggaucaguggugcgguucccugaucgggcucacaucacgagcaacgugggccaaaaacauucagaccgcuaucaaucaggugaggagcuugauuggaaacgaggaauacacugacuauaugcccucuaugaagcgguuuaggcgcgaggaagaggaagccggcguacugugguga

SEQ ID NO: 15019 - RNA, 9876 nt, Artificial Sequence
  derived and/or modified CDS sequence (opt3) from DENV-2__GQ398290__SS-prME
accgccggcgugaucauuaugcugauacccacagcuauggcauuccaccucacuacgagaaacggggagccucauaugaucgucggaaggcaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgugcagaggaucgagaccuggauacugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguacucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaagagcaggacaaacgauuugugugcaagcauucuauggucgauagaggcugggguaacggguguggacuauucggcaagggcgggaucgugaccugcgccauguuuacaugcaaaaagaauauggaaggaaaagugguccucccugagaacuucgaauacaccauuguuauaacuccacacagcggugaggagcaugcugugggcaaugacacggggaagcacggaaaagaaaucaagauuacaccgcaguccucaaucaccgaggccgaacugacuggcuaugguaccguaacaauggaguguagucccaggaccgggcuugauuuuaacgaaauggugcuguugcagauggaggacaaagcauggcucguccaccggcaaugguuccuggauuuaccucugccauggcuccccggcgcugacacucagggaagcaauuggauacagaaggagacacuugugacguuuaagaacccucaugccaaaaagcaggacguugugguccugggcucucaagaaggggcgaugcacaccgccuugacuggagcaacagagauucagauguccucagguaaucuacuguucaccggccaucucaaaugccgucugcgcauggauaagcuucagcugaaagggaugagcuacaguauguguacaggaaaguucaagaucgugaaagaaaucgcugagacucaacacggcaccauuguaaucagaguucaguaugagggugacgggucuccaugcaagauucccuuugaaauaauggauuuggagaaaaggcaugugcucggccggcugaucacggucaacccgauugugaccgaaaaggacuccccugucaacaucgaggccgaacccccauucggagauagcuacaucauuauaggcguggagccugggcaguuaaaacugaauugguuuaagaagggaucgucuaucggucagauguucgagacaacuaugcgaggcgcuaaacgcauggccauucuaggggacaccgcaugggauuuuggaucccucggcgguguuuucacaucaaucgggaaggcccugcaccaaguguuuggcgcuauuuacggagcggcauucaguggcguaagcuggacuaugaaaauccuuauaggggucaucauuaccuggaucggaaugaacuccagaucuacgagcuugucagugagucugguucucgugggcgucgugacacuguaucuuggugccaugguacaggcugacuccgggugugugguuagcuggaagucuaaagaacugaagugcggaucaggcauuuuuaucaccgauaauguccacacuuggacagagcaguacaaguuccagcccgaaaguccaagcaaauuggccuccgcaauacaaaaggcccaugaggaagguauuuguggcaucaggucugugacccggcucgagaaccugauguggaaacagauuacucccgaguuaaaucacauccugucggaaaacgaggugaagcuaaccauaaugacaggggacaucaaaggaauuaugcaggcuggcaagcgcagccucagaccucagccaacggaacugaaauauuccuggaagaccugggggaaggccaaaaugcuuucaacugagagucauaaucaaacauuuuugaucgauggaccggaaaccgcagagugccccaacacaaauagggcguggaacucucuggaggucgaagacuacggcuucgguguuuuuacuaccaauauuuggcucaagcugcgugagaaacaggacguguucugugauagcaaguuaauguccgcugccaucaaagacaaccgggcagugcacgccgauaugggguauuggauagaaucagcucugaaugacacguggaagauggagaaggccagcuucauugagguaaaaucuugccacuggccuaagucccauacacuuuggaguaacggagucuuggaaagcgagaugaucaucccaaaaaauuuugcaggccccgugucucagcacaacuaccgaccugguuaucauacccagacugcuggcccauggcaccucgggaagcuggaaauggauuucgaccuaugugagggaaccacaguuguggucacugaaaacugcggcaauagagggcccucccugaggaccacaacggccucaggaaaacucauuaccgaguggugcugucgcaguugcacucugccgccucuucgguacagaggcgaggaugguuguugguacgggauggaaaucaggccauugaaggagaaggaagagaaccuggugaauagcuuaguuacagcgggacauggccaaauugacaacuuuucgcucggugugcugggcauggcccuuuuccuggaagagauguugcgcacccgaguagggacuaaacacgcuauacuccuggucgcaguguccuuugugacacuaaucaccggaaauaugucuuuccgggaucugggccgugucaugguuauggugggggccacgaugacugacgauauuggaaugggcguaaccuaucucgcucugcuugccgcauuuaaggugagacccacauucgcggccgguuugcuguuaaggaaacucaccagcaaggagcugaugauggcuacuaucgggauugcccuucugucacagaguacaaucccugaaaccauacuagagcucacagacgcacuggcuuugggaaugaugguccugaaaaucgugcgcaacauggaaaaguaccaguuagccguuacuauuauggcaaucuccugcgugcccaaugccgucauucuccaaaacgcuuggaaggugucuuguaccauccuggcggccguuagcguguccccacuucuguugacgucaagccagcagaaagcagauuggauaccucucgcucugacaauuaagggccuaaaucccaccgccaucuuucugacuacccuuagucggacaucuaaaaagagauccuggccacucaacgaggccaucauggcugucggcaugguaagcauucuggcaucgucauugcugaaaaaugacauaccgaugacugggccuuuaguggccggaggucuccugaccguuugcuaugugcuuacgggcaggucugcggaccuggaauuggagcgagcugccgaugucaagugggaggaccaggcagaaaucaguggguccagccccauucucucuaucacaauuagcgaggauggauccaugucaaucaaaaacgaagaggaggaacaaacccugacuauacuaauccgcacaggccugcuugugauuagugguguauucccagugagcauccccauuaccgccgcugcaugguaccucugggaggucaagaagcagcgggccgggguucugugggacgugccuucuccacccccugugggaaaagcggaauuggaggauggcgcuuauagaaucaagcagaggggcauauuaggguacucccagauuggagccggugucuauaaagaaggcacuuuucacacaauguggcaugugacccguggggcaguucugaugcaccgcggaaagcggaucgagccgucaugggccgacguaaaaaaggaucucaucaguuacggcgguggguggaagcuggagggagaauggaaagagggcgaagaggugcaaguccuugcucuggaaccaggcaagaaucccagagccgugcagacgaaaccuggguuguucaagacuaacaccggaacaauuggugcaguuagccuagacuuuuccccaggcaccucugggucgcccaucguggauaggaaaggaaaggucgugggccuguacgguaaugggguagucacacgaagcggagcuuaugugucagccauagcgcagacugagaaguccauugaggacaacccugaaaucgaggaugacauuuuccggaaaaagcgccucaccaucauggaucugcauccgggcgccggcaaaacgaagagauaccuucccgcaauaguuagggaagcuauuaaacggggguuacgaacacugauccucgccccaacuagaguggucgcugcagagauggaagaggccuugcgcggacugccuaucagguaucagacccccgccauucgugcugagcacacaggucgggaaaucguggaccucaugugucaugcgaccuucacuaugagacugcuuaguccaguuagggugccuaacuacaaucugauuauaauggacgaggcacacuuuaccgaucccgccucuaucgcugcccgcggcuauauuagcacacgagucgaaaugggggaggcagccggaaucuucaugacggcuacuccaccgggcuccagagacccuuuuccccaaucaaacgcgccaaucauggaugaggaacgggagauucccgaaaggucuuggaauagcggucacgagugggugaccgacuucaaggggaagacaguaugguuugugccuaguauaaaagccggaaacgauaucgcagcuugcuugcgcaagaauggcaaaaagguuauucagcuaucccguaaaaccuucgacagcgaauacgucaagacuagagccaacgauugggacuuuguggugacaaccgauaucucugagaugggcgcaaauuucaaggccgagcgggucauugacccaaggcgcuguaugaaacccguaauccugacggauggggaagagcgagugauacucgcuggaccuaugccgguuacucauucauccgccgcgcagagacgggguaggaucggccgcaacccaaagaaugaaaacgaccaauauauuuacaugggggagcccuuagaaaaugacgaggauugcgcacacuggaaagaggccaagaugcugcuugacaacaucaauacaccugaaggaauuauccccaguauguuugagccagaaagagagaaaguggaugcuauagacggcgaauacaggcugcggggugaggcccguaagaccuucgucgaucucaugcgccgaggggacuugccuguguggcuggcuuauagaguugcagccgagggcauuaacuacgcugauaggcggugguguuuugacggaaucaaaaauaaccagauucucgaagagaacguggaagucgagaucuggaccaaggagggcgaacgcaagaaacugaagcccagauggcuugaugccaggauauauagcgacccacuagcacugaaagaguucaaggaauucgcggccgggcggaaaucguugacuuuaaaucugaucacagagaugggacgacucccuaccuuuaugacacagaaggcuagagaugcccuggacaaccuugcagugcugcauacugcugaagccgguggccgcgcauacaaucacgcccucucugaguugccggagacgcuggaaacccuacugcuccuuacacuguuagcuacuguaaccgggggaauuuucuuguuucugauguccggcagggguaucgggaagaugacacucggcaugugcugcauuaucaccgcgagcauacugcuuugguaugcccagauucaaccccacuggaucgcagcuucaaucauucuggaguucuuucucaucguguugcugauaccagaaccugagaaacagcggacuccccaggauaaccaguuaacguacguugucauugccauccuaaccgugguggccgcaacaauggcuaaugaaaugggauuccuggagaagacuaaaaaggaccucggccuugggaguauuaccacacaagagucugaauccaacauccuggacauagauuugcguccagccagcgcguggacccuguaugcugucgccacuacauuuguuacgccuaugcucagacauucaaucgagaauaguagcgugaacguaucccugaccgcaauugccaaucaggcuacugugcuuaugggacucgguaaaggcuggccccugucuaagauggacaucggggucccguugcuggcaauuggauguuacagccaggugaacccaaucacauuaaccgccgcgcuacugcuccuuguugcucacuacgccauuaucggcccuggucugcaggcaaaggccaccagggaagcucaaaaacgcgccgcagcugggauaaugaagaaucccacaguggauggcauuacugucaucgacuuggagccaauccccuaugauccuaaauucgaaaagcagcugggacagguaaugcuccugauucuuugcgugacgcagguuuuaaugaugcggaccacaugggcccugugugaggcgcucacuuuggccaccggcccgauauccacacugugggaggggaaccccggacgauuuuggaauaccacuaucgcagugucaauggcuaacauuuucagaggcucuuaccuagccggugcagggcugcucuuuaguaucaugaaaaauacgacaaacaccaggcgcggaacuggcaauauuggugaaacccuuggcgagaaguggaagucgcggcugaacacauuggggaaaagcgaauuccaaaucuauaagaaauccggaauacaggaggucgacagaacucuggcuaaggagggcaucaaacguggggaaaccgaucaucacgccgugucuaggggaucagccaagcuccggugguuugucgagcgcaacauggugacaccagaaggcaaaguuguggaccuggguugcgggcgaggaggcuggagcuacuauugugguggcuuaaagaauguaagagaggugaaggggcuuacgaaaggaggcccugggcaugaagagcccauuccuauguccaccuacggauggaaccuggucaggcuccagaguggcguugauguguucuucacuccacccgagaagugcgacacacuacugugugauaucggugaaucuagcccuaauccaaccauugaggcggggcggacuuugcgcguccugaaccucguggaaaauuggcuuaacaauaacacacaauuuugcaucaaaguacugaaucccuauaugccgucagugauagagaagauggaaaccuugcagagaaaauacggaggcgcucugguuaggaacccucucucccgaaauaguacgcacgagauguacugggugagcaacgcaaccggcaauauugucucuuccgugaacaugaucucacggauguuaaucaaucguuucacaaugaagcacaagaaagccacuuaugagccagacgucgaucuggggagcggaaccagaaacauugguauagaaucggagauccccaaccuugacauuaucggcaagcgcauugaaaaaaucaagcaggagcaugaaacaucuuggcacuacgaccaggaucauccuuauaaaacuugggcuuaccacgggaguuaugagaccaagcaaacaggauccgccagcucaauggugaauggcguuguaaggcugcuaaccaagccaugggacgugguccccauggugacucagauggcaaugacggauacaaccccguuuggucagcagcggguuuucaaagagaagguggacacuagaacccaagaaccuaaagaggggacaaagaaacucaugaagauaacggccgaauggcuguggaaggaguugggaaaaaagaaaaccccccgcauguguacuagggaggaauuuacacgaaagguccgguccaacgcugcgcugggcgccaucuucaccgaugagaauaaauggaagucugcaagagaagcuguggaggacagcagguuuugggaacucauugaucgcgagcguaaccuucaccuggagggcaaaugcgaaacuuguguauacaauaugauggggaagcgggagaagaaauuaggagaauucgguaaggccaaaggcaguagagcaaucugguauauguggcugggggccagguuuuuggaguucgaagcucucggauuucugaacgaggaccauugguucucccgcggcaauagccuaucugguguggagggggaaggacuucaccgacugggcuacauucuccgggauguuucaaagaaagagggcggggccauguacgcggacgauacagcaggaugggacaccagaaucacacuggaagacuugaagaacgaggaaauggucacuaaucauaugaagggugagcacaaaaagcuggccgaggcuauuuuuaaacucaccuaucagaacaagguggugaggguccagcgcccaacgccuagaggcaccguuauggauauaaucagucggagggaccagcguggguccggacaagugggcacauacggucuuaauacuuucaccaacauggaagcccagcugauucgacagauggagggggaaggaaucuucaaaagcauccaacauuuaacagcaacugaggagauugcuguacagaauuggcuggcccgcgugggcagagaacgguugucuaggauggcuauaucgggcgaugacugcgucgugaagccccucgaugaccgcuuugccucagcacugaccgcgcuaaacgauauggggaagguuagaaaagacauccagcagugggagccaagccggggauggaaugauuggacgcaagugcccuucugcucccaccacuuucaugaacuugucaugaaggacgguagggugcugguaguuccuugucgaaaccaggaugagcucauuggccgugccagaaucagucagggggcuggauggucucugaaagaaacagccugcuugggcaagagcuaugcacagauguggaccuuaauguacuuccaccgccgggaccugaggcucgcugccaacgcaauuuguuccgccgugccaucacauugggucccgacuaguagaacaaccuggucuauccacgcgaaacacgaguggaugacuaccgaggauaugcuugcuguguggaaucgcguguggauacaagaaaaccccuggauggaggacaagacaccugucgaaagcugggaggaaguuccauaucuggguaagcgggaggaccaguggugcgggucccuaaucggacugacgucaagggccaccugggcaaaaaauauucagacugccaucaaccaggugcgaagccucauuggcaaugaggaauacacagauuauaugcccucuaugaagagauuucggagggaggaagaggaagcuggcguauugugguga

SEQ ID NO: 15020 - RNA, 9876 nt, Artificial Sequence
  derived and/or modified CDS sequence (opt3) from DENV-2__GQ398284__SS-prME
accgccggcgugaucauuaugcugauacccacagcuauggcguuccaccucacuacgcggaauggggagccucauaugaucgucggaaagcaggaaaaggguaagagccuucuguuuaaaaccgaggacggcguuaauaugugcacauugauggccauugauuuaggggaacugugugaggacacuaucaccuacaagugcccacuacucaggcaaaacgaaccggaggauauugacuguuggugcaauuccacaucuaccugggugacuuauggaacauguaccacgacuggcgagcaccggcgcgaaaaacgaucaguggcgcuggugccccaugucgguauggggcuugagacccguacagaaacuuggaugaguagcgagggagcuuggaagcacgugcagcggaucgagaccuggauacugaggcauccuggcuucacaaucauggccgcuauuuuggccuacaccaucggcacgacucacuuucagcgggcucucauuuucauccugcugacagcaguugccccauccaugaccaugcgcugcauagggauuucuaacagagauuuuguggaaggagucucggguggcucauggguggacaucguccucgagcacgggagcuguguuacuacaauggcuaagaauaaacccaccuuagauuucgaacugauuaagacggaggccaaacagccugcgacccuuaggaaguauugcaucgaagcaaaauugacaaacacuaccacagagagucgguguccaacucaaggagagcccucccugaaugaggaacaggacaagcgcuuucuaugcaagcauucuaugguggaucgaggcugggguaacggguguggacucuucggcaaaggcgggaucguaaccugcgccauguuuacaugcaagaaaaauauggaaggaaagguggugcagccugagaaccuggaauacaccauugucauaacuccacacagcggugaggagcaugcuguuggcaaugacacggggaaacacggaaaggaaaucaaaauuacaccgcaguccucaaucaccgaggccgaacuuacuggcuaugguaccgugacaauggaguguagucccagaaccgggcuggauuucaacgaaaugguauugcuccaaauggaggacaaggcauggcuggugcacaggcagugguuuuuagaucugccucucccauggcuucccggcgcugacacucagggaagcaauuggauacagaaggagacacuggucacguucaaaaacccucaugccaagaaacaagacgugguugcguugggcucucaggaaggggccaugcacaccgcacuaacuggagcuacagagauucagauguccucagguaaucugcucuuuaccggccaucugaagugccggcuucguauggauaaacugcaauugaaggggaugagcuacaguauguguacaggaaaguucaaaaucgugaaggaaaucgccgagacucagcacggcaccauugucauccgcgugcaguaugagggugacgggucuccaugcaaaauucccuucgaaauaauggaucucgagaagagacauguacugggcagguuaaucacgguuaacccgauugugaccgaaaaagacuccccugucaacaucgaggcugaacccccauuuggagauagcuacaucauuauaggcguggagccugggcagcugaagcuaaauugguucaagaaaggaucgucuaucggucaaauguuugagacaacuaugcggggcgccaagcgaauggcaauucucggggacaccgccugggauuucggaucccugggcggugucuuuacaucaaucgggaaagcacuucaccagguguucggcgcgauuuaccgcgcagccuuuaguggaguuagcuggacuaugaagaucuugauaggcgugaucauuaccuggaucgggaugaacuccagaucuacgagccugucaguaagucucguccuggugggaguugugacacuuuaucugggcgcuaugguccaggccgacuccgguugugugguaagcuggaaaaauaaggaauugaagugcgggucuggaauuuucaucaccgauaacgugcacacuuggacagagcaguacaaauuucaacccgaaucaccaaguaagcucgcaagcgccauacagaaagcucaugaggaaggcauuugugguaucagguccguuacccggcuggagaauuuaauguggaagcagauuacucccgagcugaaccacauccuaucugaaaaugaggucaaacucaccauaaugacaggcgacaucaaggggauuaugcaggccggaaaacgcucgcugagaccucaaccaacggaacuuaaguauagcuggaagaccuggggcaaagcaaagauguuguccacugagucacauaaccagacauuccugaucgaugggccggaaaccgcggagugccccaauacaaacagggcuuggaauagucucgagguggaagacuacggauuuggcguguucacuaccaacauuuggcugaaauuacgugagaagcaggacgucuuuugugauucuaaacugaugagcgccgcaaucaaggacaaucgggccguucacgcugauauggguuauuggauagaauccgcccuuaacgacacguggaagauggagaaagcaucauucauugagguaaagagcugccacuggccuaaaucucauacauugugguccaauggggugcucgaaagugagaugaucaucccaaagaacuucgcuggacccguaagccagcacaacuaccgaccuggcuaucauacccaaacugccgguccauggcaccugggcaaacuagaaauggauuuugacuucugugaggggaccacagucgugguuacugaagauugcggaaauagaggccccucucugaggaccacaacggcguccgggaagcucauuaccgaguggugcugucgcucaugcacucugccgccucuucgguacagaggagaggacggcuguugguacgguauggaaaucaggccauugaaggagaaagaagagaaccuggugaauaguuuagucacagccgggcauggacagauugauaacuuuagccucggcgugcuggguauggcucuuuuccuggaagagauguugcgcacccgaguuggcacuaagcacgcaauacuccugguggccguaucguuugucacacuaaucaccgggaauauguccuuccgggaccugggacgugugauggugauggucggcgcuacgaugacugaugacauugggaugggaguuaccuaucucgcccugcuugcagcguuuaaagugagacccacauucgccgcuggcuugcuguuaaggaagcucaccucuaaagagcugaugauggccacuaucgguauugcacuucugagccagucaacaaucccugaaaccauacuagagcucacagaugcucuggccuuggggaugaugguacugaagaucgugcgcaacauggaaaaguaccaauuagcagucacuauuauggccaucaguugcgugcccaaugcuguuauucuccagaacgcguggaaaguguccuguaccauccuggccgcagucucugugagcccacuucuguugacguccucacagcagaaggcugacuggauaccucucgcccugacaauuaaaggacuaaaucccaccgccaucuuucugacuacccuuagccggacaaguaagaaaagaucuuggccacucaacgaggcuaucauggcaguuggcaugguguccauucuggccagcucguugcugaagaaugacauaccgaugacuggcccuuuagucgcagggggacuccugaccguaugcuaugugcuuacggguaggucagcugaucuggaauuggagcgagccgcagacguuaaaugggaggaucaagccgaaaucucuggcaguucccccauucucagcaucacaauuucugaggacgggagcauguccaucaagaacgaagaggaggaacagacccugacuauacuaauccgcacaggacugcuugugauuucaggcgucuucccagugaguauccccauuaccgcugcagccugguaccucugggagguaaagaaacagcgggcgggugugcugugggaugucccuagcccacccccuguugggaaggcugaauuggaggacggagccuauagaaucaaacagaggggcauauuaggcuacucucaaauuggggcaggaguguauaaggaagguacuuuucacacaauguggcaugugacccguggcgccguccugaugcaccgcgggaaacggaucgagccguccugggcugaugugaagaaggaccucaucucauacggaggcgguuggaaacuggagggggaauggaaggagggagaagagguucagguacuugcccuggaaccaggcaaaaaucccagagcagugcagacgaagccuggcuuguucaaaacuaacaccgggacaauuggagcugucagucuagauuuuagcccagguaccuccggcucucccaucguggacaggaaggggaagguugugggacuguacggcaauggugucgugacacgaucgggggccuauguaagcgcgauagcccagacugagaaaucaauugaggauaacccugaaaucgaggacgauauuuuccggaagaaacgccucaccaucauggaccugcauccgggagcaggcaagacgaaaagauaccuucccgcuauagucagggaagccauuaagcggggcuuacgaacacugauccucgcuccaacuagagugguugcagccgagauggaagaggccuugcgcgggcugccuaucagguaucaaacccccgcuauucgugcggagcacacaggacgggaaaucguggaccucaugugucaugcaaccuucacuaugagacugcuuuccccagucagggugccuaacuacaaucugauuauaauggaugaggcccacuuuaccgaccccgcuaguaucgccgcacgcgguuauauuucuacacgaguugaaaugggcgaggccgcugggaucuucaugacggcgacuccaccgggaagcagagauccuuuuccccaguccaacgccccaaucauggacgaggaacgggagauucccgaaaggucauggaacucuggccacgagugggugaccgauuucaaggguaaaacagucugguuugugccuagcauaaaggcagggaacgacaucgcugccugcuugcgcaaaaauggaaagaaaguaauucagcuaagucguaagaccuucgauuccgaauacgugaagacuagagcaaacgacugggauuuuguugucacaaccgacaucagcgagaugggcgccaauuucaaagcugagcgggugauugauccaaggcgcuguaugaagcccgugauccugacggacggcgaagaacgagucauacucgccgggccuaugccgguaacucauucuucagcggcacaaagacggggaaggaucggucgcaaccccaaaaaugaaaacgaccaguauauuuacaugggcgagccauuagaaaaugaugaggacugcgcccacuggaaggaggcuaaaaugcugcuugauaacaucaauacaccugaagggauuauccccuccauguuugagccagaaagagagaagguggacgccauagauggagaauacaggcugcggggcgaggcucguaaaaccuucguugaccucaugcgccgaggugauuugccuguguggcuggcauauagagucgccgcugaggggauuaacuacgccgacaggcggugguguuuugauggcaucaagaauaaccagauucucgaagagaacguggaaguugagaucuggaccaaggagggagaacgcaaaaagcugaaacccagauggcuugacgcaaggauauauagugauccacuagcgcugaaggaguucaaagaguucgccgcuggcagaaagagcuugacuuuaaaucugaucacagagauggggcgacucccuaccuuuaugacacagaaggccagagacgcacuggauaaccuugcugugcugcauacugccgaagcaggagguaaagccuacaaucacgcucucucggaguugccggagacgcuggaaacccuacugcuccuuacacuguuagcgacugucaccggcgggauuuucuuguuucugaugucuggaaagggcaucgguaaaaugacacucgggaugugcugcauuaucaccgccuccauacugcuuugguaugcacaaauucagccccacuggaucgcugccagcaucauucuggaguucuuucucaucguguugcugauaccagaaccugagaagcagcgcacuccccaggacaaccaauuaacguacguagugauugccauccuaaccguugucgcagcuacaauggccaaugaaaugggcuuccuggagaaaacuaagaaggaccucggacuuggcucaauuaucacccaggagagugaaucuaacauacuggauaucgacuugaggccagcguccgcuuggacacuguaugccguggcaaccacuuuugugacaccuaugcuccggcauagcauugaaaauucaagugucaacguuagccugacggccaucgcuaaucaggcaaccgugcuuauggggcucggaaaagguuggccccuguccaagauggauauuggcguaccguugcuggccaucggguguuacucucaggugaacccaauuacuuuaacagcggcucuacugcuccuugucgcccacuacgcaaucauaggaccuggccugcaagccaaagcuacccgugaagcccagaagagagcagcugccgguauuaugaaaaaucccaccguggacgggaucacaguuaucgauuuggagccaauucccuaugacccuaaguucgaaaagcagcugggccaggugaugcuccugauacuuugcgucacucaaguauuaaugaugaggacgaccugggcgcugugugaggcccucacauuggcaacuggaccgaucagcacccugugggagggcaaccccgggcgcuuuuggaauacaaccauugcuguguccauggccaacaucuuccggggaucauaccuagcaggcgcuggucugcucuuuucuauuaugaaaaauacuacgaacacacgaagagggaccggaaauaucggcgaaacucuuggugagaaguggaaaaguaggcugaacgccuugggcaagucggaguuccagauauauaaaaagagcgggauccaggagguugaucgcacccuggccaaagagggaauuaagcggggcgaaacagaccaucacgcgguguccagagggucugcuaagcuccguugguuugucgagaggaacauggugacuccagaaggaaaagucguggaucugggcugcgguagagggggauggucauacuauuguggcgguuuaaagaauguucgcgaggugaaaggccuuaccaaagggggaccuggccaugaagaacccaucccuaugagcacauacggguggaaccugguacgacuccaauccggaguggacgucuucuucacgccacccgagaaaugcgauacccuacugugugacauuggcgaaaguucuccuaauccaacuaucgaggcagguagaacauugaggguucugaaccucguggaaaauuggcuuaacaauaacacccaguuuugcauaaagguccugaaucccuauaugccgagcgugauugagaagauggaaacuuugcagcggaaauacgggggagcccugguacgcaacccucucucaagaaauuccacacacgagauguacugggugaguaacgcuaccggcaauaucguuagcucugugaacaugaucuccaggauguuaauuaaucgauucacgaugaagcacaaaaaggccaccuaugagccagaugucgaccugggcucagggacacggaacauaggaaucgaaagcgagauucccaaccuugacaucauugguaaacguaucgaaaagauaaagcaggagcaugaaacuucguggcacuacgaucaagaccauccuuauaaaaccugggcauaccacggcucuuaugagacaaagcagacugggagugccuccagcauggugaauggagucgugagacugcuaaccaaaccaugggauguuguacccauggugacacagauggcuaugaccgacacuacgccguuuggccagcaacgcgucuucaaggagaaaguggauacaaggacccaggaaccuaaggaggguacuaagaaacucaugaagaucaccgcggaauggcuguggaaagaguuggggaagaaaaagacaccccggauguguacgagagaggaauuuacccgcaaaguuaggucaaacgccgcacugggagcuauuuucacugacgagaauaaguggaaguccgcccgagaagcaguggaggauucucgguuuugggaacucgucgacagagagaggaaccuucaccuggagggcaaaugcgaaacauguguguacaauaugaugggcaagcgcgagaaaaaguuaggggaguucggaaaagccaaggguagccgugcuaucugguauauguggcugggcgcccgguuuuuggaguucgaagcgcucggguuucugaacgaggaucauugguucaguagaggaaauucccuaagcggcguagagggugaagggcuucacaggcugggauacauucuccgcgacgugucuaagaaagagggcggcgcaauguacgccgaugacaccgcugggugggacacucgaaucacacuggaagauuugaagaacgaggaaaugguuaccaaucauaugaaaggagagcacaagaaacuggccgaggcaauuuuuaagcucacauaucagaacaaggucgugcgggugcagagaccaacuccuagggguaccgucauggacauaaucucacgcagagaucaacggggcagugggcagguuggaacguacggccuuaauaccuucacaaacauggaagcucagcugauuaggcaaauggagggugaagggaucuucaaauccauccagcauuuaacugugaccgaggagauugccguacagaauuggcuggcucgugugggacgagaacgcuugagcagaauggccauaucuggcgacgauugcgucgugaagccccucgacgaucgguuugcaucggcgcugacagcccuaaacgacaugggcaaaguuaggaaggauauccagcaaugggagccaucacgcggguggaaugacuggacucaggugcccuucugcagccaccacuuucaugaacuugucaugaaagauggaagagugcugguaguuccuugucggaaccaggacgagcucauugguagggcucgaaucucccagggcgccggguggagucugaaggaaaccgcaugcuugggaaagucuuaugcucaaauguggacguuaauguacuuccaccguagagaucugcgccucgccgcaaacgccauuuguagcgcggugccaucccauugggucccgacaucacggaccacuuggaguauccacgcuaaucacgaguggaugacaaccgaggacaugcuugccguguggaacaggguguggauacaggaaaaucccuggauggaggacaaaacuccugucgaaucuugggaggaaguuccauaucugggcaagagagaggaucaguggugcgguagccuaaucgggcugaccucccgcgcaacaugggccaaaaacauucagacggcuaucaaucaagugcggucacucauuggaaacgaggaauacaccgacuauaugcccagcaugaagagguuucgaagagaggaagaggaagccggcguauugugguga

SEQ ID NO: 15021 - RNA, 9876 nt, Artificial Sequence
  derived and/or modified CDS sequence (opt3) from DENV-2__GQ398308__SS-prME
accgcaggcgugaucauuaugcugauacccacagcuauggcauuccaccucacuacgagaaacggggaaccucauaugaucgucggaaggcaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgugcagaggaucgagaccuggauacugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguacucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaagaacaggacaaacgauuugugugcaagcauucuauggucgauagaggcugggguaacggguguggacuauucggcaagggcgggaucgugaccugcgccauguuuacaugcaaaaagaauauggaaggaaaagugguccucccugagaaccuggaauacaccauuguuauaacuccacacagcggugaggagcaugcugugggcaaugacacggggaagcacggaaaagaaaucaagauuacaccgcaguccucaaucaccgaggccgaacuuacuggcuaugguaccguaacaauggaguguagucccaggaccgggcuggauuucaacgaaaugguguugcuccagauggaggacaaagcauggcugguccaccggcaaugguuuuuagaucugccucucccauggcuucccggcgcugacacucagggaagcaauuggauacagaaggagacacuggugacguucaagaacccucaugccaaaaagcaggacguuguggucuugggcucucaagaaggggcgaugcacaccgcccuaacuggagcaacagagauucagauguccucagguaaucugcucuuuaccggccaucugaaaugccgucuucgcauggauaagcugcaguugaaagggaugagcuacaguauguguacaggaaaguucaagaucgugaaagaaaucgcugagacucaacacggcaccauuguaaucagaguucaguaugagggugacgggucuccaugcaagauucccuucgaaauaauggaucucgagaaaaggcaugugcugggccgguuaaucacggucaacccgauuguggccgaaaaggacuccccugucaacaucgaggcugaacccccauuuggagauagcuacaucauuauaggcguggagccugggcagcugaaacuaaauugguucaagaagggaucgucuaucggucagauguuugagaccacaaugcgaggcgccaaacgcauggcaauucucggggacacugccugggauuucggaucccugggcgguguuuuuaccucaaucgggaaggcacuucaccaaguguucggcgcgauuuacggagcagccuuuaguggcguaagcuggacaaugaaaaucuugauaggggucaucauuacuuggaucggaaugaacuccagaucuaccagccugucagugagucucguucuggugggcgucgugacgcuuuaucugggugcuaugguacaggccgacuccgggugugugguuagcuggaagucuaaagaauugaagugcggaucaggcauuuucaucacagauaauguccacaccuggacugagcaguacaaguuucagcccgaaaguccaagcaaacucgcauccgccauacaaaaggcucaugaggaagguauuuguggcaucaggucugugacacggcuggagaacuuaauguggaaacagauuacccccgagcugaaucacauccuaucggaaaacgaggugaagcucacuauaaugaccggggacaucaaaggaauuaugcaggccggcaagcgcagccugagaccucagccaacagaacuuaaauauuccuggaagacgugggggaaggcaaaaauguugucaaccgagagucauaaucaaacuuuccugaucgauggaccggaaacagcggagugccccaacaccaauagggcuuggaacucucucgaggucgaagacuacggcuuugguguuuucagcacaaauauuuggcugaaguuacgugagaaacaggacguguuuugugauuccaagcugaugucagccgcaaucaaagacaaccgggccgugcacgcugauaugggguauuggauagaaagcgcccuuaaugacacuuggaagauggagaaggcaucuuucauugagguaaaauccugccacuggccuaagagucauaccuuguggagcaacggaguccucgaaucugagaugaucauccccaaaaauuucgcuggccccgugucccagcacaacuaccgaccugguuaucauacgcagacagccggcccauggcaccuggggaagcuagaaauggauuuugacuucugugagggaaccacuguuguggucaccgaagauugcggcaacagagggcccucacugaggacaacuaccgcgaguggaaaacucauuacagaguggugcugucgcagcugcacgcugccgccucuucgguacagaggcgaggacgguuguugguacgggauggaaaucaggccauugaaggagaaggaagagaaucuggugaacucguuaguuaccgccggacauggccaaauugauaauuuuucccucggugugcugggcauggcucuuuuccuggaagagauguugcgcacucgaguagggacaaaacacgcaaugcuccuggucgccgugucuuuugugacccuaauaacuggaaacaugagcuuccgggaccugggccgugucaugguuauggugggggcuacaaugaccgaugacaucggaaugggcauuacguaucucgcccugcuugcagcguuuaagguaagacccacuuucgccgcugguuugcuguuaaggaaacucaccucaaaggagcugaugauggccacaaucgggauugcacuucugagucaguccaccaucccugaaacuauacuagagcucacagaugcucuggccuugggaaugauggugcugaaaaucguccgcaauauggaaaaguaccaguuagcagugaccauuauggccaucucuugcguucccaacgcugugauucuccaaaaugcguggaaggucagcuguacaauccuggccgcaguguccguuucaccacuucuguugacuagcagucagcagaaagcugacuggauaccucucgcccugaccauuaagggccuaaaccccacggccaucuuucugacaacccuuucucggacuuccaaaaagagaagcuggccacucaaugaggcuaucauggcagugggcauggucucgauucuggccucaucuuugcugaaaaacgacauaccgaugaccgggccuuuaguagcgggaggucuccugacagugugcuauguucuuacuggcaggagugcugaucuggaauuggagcgagccgcagacgugaagugggaggaucaggccgaaaucuccgggagcucucccauucucagcaucaccauuuccgaggacggaucaaugaguaucaaaaaugaagaggaggaacaaacgcugacaauacuaauccgcaccggccugcuugucauuagcgguguguucccaguaucuauccccauuacugcugcagccugguaccucugggaggugaagaagcagcgggcggggguccugugggauguuccuuccccacccccugugggaaaagcugaauuggaggacggcgccuauagaaucaagcagaggggcauauuaggguacucacagauuggagcugguguguauaaagaaggcacauuucacaccauguggcaugucacucguggggccgugcugaugcaccgcggaaagcggaucgagccgaguugggcugauguuaaaaaggaccucaucagcuacggcgguggguggaagcuggagggagaauggaaagagggcgaagagguacaagugcuugcccuggaaccaggcaagaaccccagagcaguccagacaaaaccuggguuguucaagaccaauacgggaacuauuggugcugugucccuagauuuuucuccaggcaccucggggagccccaucguugacaggaaaggaaagguggucggccuguacgguaacggggugguaacacgaucaggagccuaugucuccgcgauagcccagaccgagaagaguauugaggauaauccugaaaucgaggacgauauuuuccggaaaaagcgccucacaaucauggaccugcauccgggcgcaggcaaaacuaagagauaccuucccgcuauagugagggaagccauuaaacggggguuacgaacccugauccucgcuccaacgagaguuguggcagccgagauggaagaggccuugcgcggacugccuaucagguaucagacacccgcuauucgugcggagcacacuggucgggaaaucgucgaccucaugugucaugcaaccuucacaaugagacugcuuucuccagugaggguuccuaacuacaaccugauuauaauggaugaggcccacuuuaccgaccccgcuagcaucgccgcacgcggcuauauuuccacucgaguggaaaugggggaggccgcuggaaucuucaugaccgcgacaccaccgggcucaagagauccuuuuccccaaucuaaugccccaaucauggacgaggaacgggagauucccgaaaggagcuggaacaguggucacgagugggucacggauuucaaggggaagacugugugguuuguaccuuccauaaaagcaggaaaugacaucgcugccugcuugcgcaagaacggcaaaaaggugauucagcuaagccguaaaaccuucgauucugaauacguuaagacaagagcaaaugacugggauuuugucgugaccacugacaucucagagaugggcgccaacuucaaggcugagcgggugauugauccaaggcgcuguaugaaacccgucauccugacagacggggaagaacgaguaauacucgccggaccuaugccggugacccauuccagugcggcacagagacgggguaggaucggccgcaauccaaagaacgaaaaugaccaauauauuuacaugggggagcccuuagaaaacgaugaggacugcgcccacuggaaagaggcuaagaugcugcuugauaauaucaacacgccugaaggaauuauccccagcauguuugagccagaaagagagaaaguugacgccauagauggcgaauacaggcugcggggugaggcucguaagacuuucguggaccucaugcgccgaggggauuugccugucuggcuggcauauagaguggccgcugagggcauuaauuacgccgacaggcggugguguuuugauggaaucaaaaacaaucagauucucgaagagaacguugaaguggagaucuggacaaaggagggcgaacgcaagaaacugaagcccagauggcuugacgcaaggauauauucggauccacuagcgcugaaagaguucaaggaguucgccgcugggcggaaaucuuugaccuuaaaccugaucaccgagaugggacgacucccuacuuuuaugacacagaaggccagagacgcacuggauaaucuugcuguccugcauaccgccgaagccgguggccgcgccuacaaccacgcucucuccgaguugccggagacacuggaaacucuacugcuccuuacgcuguuagcgaccgugacagggggaauuuucuuguuucugaugagcggcaaggguaucgggaaaaugacucucggcaugugcugcauuaucaccgccucaauacugcuuugguaugcacagauucaaccccacuggaucgcugccaguaucauucuggaguucuuucucaucguauugcugauaccagaaccugagaagcagaggacaccccaggacaaucaguuaaccuacgugguuauugccauccuaacugucguggcagcuacgauggccaacgaaaugggauuccuggagaaaaccaagaaagaccucggccuugggucuauugcgacacaagaguccgaaagcaauauccuggauauagacuugcggccagcuucagccuggacucuguaugcaguggccaccacauuugucaccccuaugcuccgucauaguaucgagaacagcuccguuaaugugucucugacugcuauugcaaaccaggccacaguacuuaugggacucgguaagggcuggccccugagcaagauggauaucggggugccguugcuggcgauuggauguuacucccaggucaauccaaucacguuaaccgcugcccuacugcuccuuguggcacacuacgccauuaucggcccuggucugcaggcuaaagccacuagagaagcacaaaagagggcugccgcggggauaaugaaaaaccccacaguugacggcauuaccgugaucgauuuggagccaauccccuaugacccuaaguucgaaaaacagcugggacaggucaugcuccugauucuuugcguaacccagguguuaaugaugcgcacaacuugggcccugugugaggcacucacguuggcuaccggcccgauaucaacacugugggaggggaaucccggacgguuuuggaacacuaccaucgccguuucuauggcaaauauuuuccgaggcaguuaccuagcuggugccgggcugcucuuuucgaucaugaagaacacaaccaauacuagaaggggaacgggcaacauuggugaaacacuuggcgagaaguggaaaagccgccugaaugccuuggggaaguccgaguuccaaaucuauaaaaagucuggaauacaggagguggaucggacccuggcgaaagagggcaucaagagaggggaaacugaccaucacgcugucucacguggaagcgcaaaacucaggugguuuguggagcggaacauggucaccccagaaggcaaggugguugaucuggguugcgggcgcggaggcugguccuacuauugugguggcuuaaagaacgugcgagagguaaaagggcuuacaaagggaggcccugggcaugaagaaccaauuccuaugaguacuuacggauggaaucuggugagacuccagucuggcgucgacguuuucuucaccccacccgagaaaugcgauacacuacugugugacaucggugaaagcucaccuaacccaacgauugaggccgggaggaccuugcgggugcugaaucucgucgaaaacuggcuuaauaacgauacucaauuuugcaucaaggugcugaaucccuauaugccguccguaauagagaaaauggaaacauugcagcgcaaguacggaggcgcuauugugagaaacccucugaguaggaauagcacccacgagauguacuggguuucuaacgccacuggcaauaucguguccucagucaacaugaucagccgaaugcucauuaaucgguucacaaugaagcacaaaaaggcaaccuaugagccagacguggacuuagggucgggaacgcguaacauagguaucgaaucugagauucccaaucuggauaucauuggcaaaagaaucgaaaagauaaaacaggagcaugaaaccaguuggcacuacgaccaggaucauccuuauaagacaugggccuaccacggguccuaugagacuaagcaaaccggaagcgcuucauccauggucaacggcgugguucgccuucugacaaaaccaugggacguagugcccauggucacucagauggcgaugaccgauacaaccccguuuggucagcagaggguguucaaggagaaaguugacacucggacgcaagaaccuaaggaggggaccaaaaagcuaaugaagaucacagccgaauggcucuggaaagagcugggaaagaaaaagacucccagaauguguacccgcgaggaauuuacaaggaaagugcgaucuaacgcagcuuugggcgccauuuucacggaugagaauaaguggaaaagcgcacgggaagccgucgaggacaguagauuuugggaacugaucgauagggagcgcaaccuccaccuugagggcaagugcgaaaccuguguguacaauaugauggggaagcgugagaaaaagcugggagaguucgguaaagcuaagggcucccgggccauuugguauaugugguuaggggcgagauuucuggaguucgaagcauugggauuucucaacgaggaccauugguucagcaggggcaauucucugucagguguagagggggaaggacuacaccgccuuggcuacauccugcgagaugugaguaaaaaggagggcggggccauguacgcugacgacacugccggaugggauacacggauuacccucgaagaccugaagaacgaggaaaugguuacuaaucauaugaaaggugagcacaagaaauuggcagaggcuauauuuaagcugacauaucagaacaaagucgugagagugcagaggccaaccccucgcggcacagucauggauaucauuuccagacgggaccagagggggagcggacaaguuggcacuuacggucucaauaccuucacgaacauggaagcccagcuuauccgucagauggagggggaaggaaucuucaagucuauucaacaucugaccgugacagaggagauagcuguacagaauugguuagcccgagugggccgcgaaagacugucgcggauggcaaucucaggcgaugacugcgucgugaagcccuuggaugacagguuugcgagcgcccucacugcucugaacgauauggggaaaguucgcaaggacauucagcagugggagccauccagaggauggaaugauuggacccaagugcccuucugcagucaccacuuucaugagcuagucaugaaagacggucgggugcuuguaguuccuuguaggaaccaggaugagcugaucggccgagcccguauuucucagggggcaggauggagccucaaggaaacagcuugccugggcaaauccuaugcccagauguggacuuugauguacuuccacagacgcgacuuacggcuggcagccaaugcgaucuguucagcugugccaagucauugggucccgaccucuaggacgacauggagcauacacgccaagcacgaguggaugaccacugaggacaugcucacaguguggaacagaguguggauccaagaaaaccccuggauggaggauaagaccccugucgaauccugggaggaaguuccauaucuugguaaacgcgaggaccaguggugcgggucacugauuggacuaacuagccgggcaaccugggccaagaauauccagacagcuauuaaccaggugaggucucugaucggcaaugaggaauacacggauuauaugcccuccaugaaacgauuuagacgggaggaagaggaagccggcguacucugguga

SEQ ID NO: 15022 - RNA, 9876 nt, Artificial Sequence
  derived and/or modified CDS sequence (opt3) from DENV-2__GQ398287__SS-prME
accgcaggagugauaauuaugcugauacccacagcuauggcuuuccaccucacuacgagaaacggggagccucauaugaucgucgggagacaggaaaaggguaaaagccuucuguuuaagaccgaggacggaguuaauaugugcacauugauggccauugauuuaggggaacugugugaggacacuaucaccuacaaaugcccauuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgugcagaggaucgagaccuggauacugcggcauccuggcuucgccaucauggcagccauuuuggcuuacacaaucggcaccacgcacuuucagcgcgcacucauuuucauccugcugacugccguugcuccauccaugacaaugagaugcauagggauuucuaacagggauuuuguggaaggagucucggguggcucauggguggacaucguucucgagcacgggagcuguguuaccacuauggccaagaauaagcccacauuagauuucgaacugauuaaaaccgaggcgaagcagccugcaacgcuucggaaauauugcaucgaagccaaguugaccaacacaacuaccgagagucgcuguccaacacaaggagagcccucccugaaugaggaacaggacaaacgauuugugugcaagcauucuauggucgauagaggcugggguaacggguguggacuauucggcaagggcgggaucgugacuugcgcuauguuuaccugcaaaaagaauauggaaggaaaagugguccucccugagaaccuggaauacacaauuguuauaaccccacacagcggugaggagcaugccgugggcaaugacacugggaagcacggaaaagaaaucaagauuacgccgcaguccucaaucacagaggcagaacuuaccggcuaugguacuguaaccauggaguguagucccaggacagggcuggauuucaacgaaaugguguugcuccagauggaggacaaggcuuggcugguccaccggcaaugguuuuuagaucugccucucccauggcuucccggcgccgacacccagggaagcaauuggauacagaaggagacucuggugacauucaagaacccucaugcgaaaaagcaggacguuguggucuugggcucucaagaaggggccaugcacacggcacuaaccggagcuacugagauucagauguccucagguaaucugcucuuuacaggccaucugaaaugccgucuucgcauggauaagcugcaguugaaagggaugagcuacaguauguguaccggaaaguucaagaucgugaaagaaaucgccgagacacaacacggcacuauuguaaucagaguucaguaugagggugacgggucuccaugcaagauucccuucgaaauaauggaucucgagaaaaggcaugugcugggccgguuaaucaccgucaacccgauugugacggaaaaggacuccccugucaacaucgaggcugaacccccauuuggagauagcuacaucauuauaggcguggagccugggcagcugaaacuaaauugguucaagaagggaucgucuaucggucagauguuugagaccacaaugcgaggcgccaaacgcauggcaauucucggggacacugccugggauuucggaucccugggcgguguuuuuaccucaaucgggaaggcacuucaccaaguguucggcgcgauuuacggagcagccuuuaguggcguaagcuggacaaugaaaaucuugauaggggucaucauuacuuggaucggaaugaacuccagaucuaccagccugucagugagucucguucuggugggcgucgugacgcuuuaucugggugcuaugguacaggccgacuccgggugugugguuagcuggaagucuaaagaauugaagugcggaucaggcauuuucaucacagauaauguccacaccuggacugagcaguacaaguuucagcccgaaaguccaagcaaacucgcauccgccauacaaaaggcucaugaggaagguauuuguggcaucaggucugugacacggcuggagaacuuaauguggaaacagauuacccccgagcugaaucacauccuaucggaaaacgaggugaagcucacuauaaugaccggggacaucaaaggaauuaugcaggccggcaagcgcagccugagaccucagccaacagaacuuaaauauuccuggaagacgugggggaaggcaaaaauguugucaaccgagagucauaaucaaacuuuccugaucgauggaccggaaacagcggagugccccaacaccaauagggcuuggaacucucucgaggucgaagacuacggcuuugguguuuucacaacuaauauuuggcugaaguuacgugagaaacaggacguguuuugugauagcaagcugauguccgccgcaaucaaagacaaccgggccgugcacgcugauaugggguauuggauagaaucagcccuuaaugacaccuggaagauggagaaggccagcuucauugagguaaaaucuugccacuggccuaagucccauacguuguggaguaacggaguccucgaaagcgagaugaucauccccaaaaaucuggcuggccccgugucucagcacaacuaccgaccugguuaucauacacagaccgccggcccauggcaccuagggaagcuggaaauggauuucgacuuuugugagggaacuaccguuguggucacagaagauugcggcaacagagggcccucccucaggacuaccacagcgucaggaaaacugauuacggaguggugcugucgcaguugcacccuuccgccuuugcgguacagaggcgaggacgguuguugguacgggauggaaaucaggccacugaaggagaaggaagagaauuuagugaacagccucguuacugccggacauggccaaauugauaauuucucgcugggugugcuuggcauggcucuguuuuuggaagagaugcuccgcacacgaguagggaccaaacacgcaauacugcuaaucgccgucuccuucgugacucugauuacaggaaacaugucuuuucgggaccucggccgugugauggucaugguuggggcuaccaugacggaugacaucggaaugggcgugacuuaucuggcccuuuuggcagcguucaagguaagacccaccuuugccgcuggucuguuacucaggaaacugacaagcaaggagcuuaugauggccaccauugggaucgcacugcuaucacagaguacuauaccugaaacaauccucgagcugaccgaugcuuuggcccugggaaugaugguguuaaaaauuguccgcaauauggaaaaguaccagcucgcagugacaaucauggccauuuccugcguucccaacgcugugauccugcaaaaugcguggaaggucucuuguacuauacuugccgcagugagcguuuccccacuguugcucaccucaagccagcagaaagcugacuggauuccucuggcccuaacgaucaagggccugaaccccacagccaucuuccuuaccacucucagucggaccucuaaaaagagauccuggccacugaaugaggcuauuauggcagugggcauggucagcauauuggccucgucacugcucaaaaacgacaucccgaugacagggccucuaguagcgggaggucugcuuacugugugcuauguucugaccggcaggucugcugauuuggaacucgagcgagccgcagacgugaagugggaggaucaggccgaaauuaguggguccagccccauccugucuauuacgaucagcgaggacggauccaugucaaucaaaaaugaagaggaggaacaaacacuaaccauccugauucgcacuggccuucucgucaucagugguguguuuccaguaagcauucccaucacagcugcagccugguaccugugggaggugaagaagcagcgggcgggggucuugugggauguuccuucuccacccccuguggaaaaagcugaguuagaagacggagccuauagaauaaagcagaggggcauucugggcuacucccagaucggggcaggaguguauaaagaggguaccuuccacacuauguggcaugucacacguggcgccgugcucaugcaccgcgggaagcggaucgagccgucaugggcugauguuaaaaaggaccugauuaguuacggaggcgguuggaaacuugaaggggaguggaaagaaggagaggaaguacaagugcuggccuuggagccaggcaagaaccccagagcaguccagaccaaaccuggccuauuuaagacgaauacugggaccaucggagcugugagccuggauuucuccccagguacaucuggcucgcccauaguugacaggaaagggaagguggucggacucuacggcaacggugugguaacccgaagcggggccuaugucucagcgauugcccagacagagaaguccaucgaagauaauccugagauugaagacgauaucuuucggaaaaagcgccugacuauaauggaccuucauccgggagcaggcaaaaccaagagauacuuacccgcuauugugagggaggccaucaaacggggccugcgaacgcucaucuuggcuccaacaagaguuguggcagccgaaauggaggaggcccugcgcgggcucccuauuagguaucagacucccgcuauccgugcggaacacaccggacgggagauugucgaccugaugugucaugcaacauucaccaugagacuucugaguccagugaggguuccuaacuacaacuugauaaucauggaugaagcccacuucacugaccccgcuucuauugccgcacgcgguuauaucagcacccgaguggagaugggcgaggccgcugggaucuuuaugacagcgacgccaccgggauccagagauccuuucccccaaucaaaugccccaauuauggacgaggaacgggaaauacccgagaggucuuggaacagcggccacgaaugggucacugauuuuaaggguaagaccgugugguucguaccuaguaucaaagcagggaaugacauugcugccugccuacgcaagaacggcaaaaaggugauccagcugucccguaaaacauuugauagcgaguacguuaagaccagagcaaaugacugggauuucgucgugacuacagacauuucugagaugggcgccaacuuuaaggcugaacgggugaucgauccaaggcgcuguaugaaacccgucauacucaccgacggcgaggaacgaguaaucuuagccgggccuaugccggugacgcauucauccgcggcacagagacggggaaggauuggucgcaauccaaagaacgagaaugaccaauauaucuacaugggcgaaccccuggagaacgaugaggacugcgcccacuggaaagaagcuaagaugcuucuggauaauauuaacacuccugaggggaucauacccagucucuucgaaccagagagagaaaaaguugacgccauugauggagaguacagguugcggggcgaggcucguaagacauuuguggaccugaugcgccgaggugaucucccugucuggcuggcauauagaguggccgcugaagggaucaauuacgccgacaggcggugguguuucgauggcauuaaaaacaaucagauccuugaggaaaacguugagguggagauauggaccaaggaaggagagcgcaagaaacuaaagcccagauggcuggacgcaaggaucuauagcgauccauuggcguuaaaagaauuuaaggaguucgccgcuggccggaaaucgcugacccucaaccugauuacugaaauggggcgacuuccuacauucaugacccagaaggccagagacgcacuggauaaucucgcugucuugcauacagccgaggcaggaggucgcgccuacaaccacgcucugucugagcuaccggaaacucuggagacgcuccuucuguuaaccuugcuggcgacagugacuggcgggaucuuucucuuccugauguccggaaggggcauugguaagaugacccuugggaugugcugcaucauaacagccagcauucugcucugguaugcacagauccaaccccacuggaucgcugccucaauuaucuuggaauuuuuccugauaguauuacuaauuccagagccugaaaaacagcggacaccacaggacaaucagcugacuuacgugguuaucgccauucucacggucguggcagcuaccauggccaacgagaugggcuuucuugagaagaccaaaaaggaccugggauugggcaguaucacuacccaagaaucugaguccaauauacuggauaucgaccuccguccagcgagcgcuuggacacuguaugccguggcaaccacuuucgucacaccuaugcuuagacauucaauugaaaacaguagcguuaaugugucccucacggccaucgcuaaccaggcaaccguacugaugggguugggaaaagguuggccccugucuaagauggauauuggcgugccguuacuagccaucggguguuacagccaggucaauccaauuacucugacagcggcucuccuucuguugguggcccacuacgcaaucauaggaccuggccugcaggccaaggcuaccagggaggcccaaaaacgcgcagcugccgguauuaugaagaaccccaccguugacgggaucacagugaucgaucucgaaccaauucccuaugacccuaaauuugagaagcagcugggccaggucaugcuuuuaauacugugcguaacucaggugcucaugaugcggacgaccugggcguugugugaggcccugacacuagcaacuggaccgaucuccacccugugggaaggcaaucccgggcgauucuggaacacaaccauugcuguuucaauggccaauaucuuuagaggaucuuaccucgcaggcgcuggucuucuguucaguauuaugaaaaacacuacgaauacaaggcgcgggaccggaaacaucggcgagacuuugggugaaaaguggaagucgcggcugaaugcccucggcaaaagcgaguuucaaauauauaagaaauccgggauccaggagguggauagaacccuggccaaggaaggaauuaaacguggcgagacagaccaucacgcggucucuagggggucagcuaaguuacggugguucguggaacgcaacauggucacuccagagggaaaagugguugaucuuggcugcggucgagggggauggagcuacuauuguggcggucugaagaacgugagagaaguaaagggccucaccaaagggggaccuggccaugaggagcccaucccuauguccacauacggguggaaucuagugaggcugcagaguggagucgacguauuuuucacgccacccgaaaagugcgauaccguguugugugacauuggcgagucuagcccuaacccaacuaucgaagcaggucggacacugcgcguccucaaucuuguggagaacuggcugaauaacaauacccaauucugcauaaaaguauugaaccccuauaugccgucagugauugaaaagauggagacucugcagagaaaauacgggggagcccucguuaggaauccuuuaucccgaaacaguacacacgagauguacugggugagcaaugcuaccggcaacaucgucucuuccgugaauaugaucucacggaugcugauuaaccguuuuacgaugaagcacaagaaagccaccuaugaaccagaugucgaccuuggcagcgggacaagaaauauaggaaucgagucggaaauucccaaccuggacaucauugguaagcgcaucgagaaaauaaagcaggaacaugagacuucuuggcacuacgaucaggaccauccuuauaaaaccugggcauaccacggcaguuaugagacaaagcaaacuggguccgccagcucaauggugaacggaguuguaaggcuacucaccaagccaugggaugugguccccauggugacacagauggcuaugaccgacacuacgccguucggccagcagcggguuuuuaaagaaaagguggauacaagaacccaagagccuaaagaagguacuaagaaacugaugaagaucaccgcggagugguuguggaaggagcuggggaaaaagaaaacaccccgcauguguacgagggaagaguucacccgaaagguccgguccaaugccgcacucggagcuauuuuuacugacgaaaacaaauggaagucugccagagaggcaguggaagauagcagguucugggagcuuaucgaccgcgagcguaaucugcacuuagaaggcaaaugcgagacauguguauacaacaugaugggcaagcgggaaaagaaacugggggaguuuggaaaggccaaagguaguagagcuauuugguauaugugguugggcgccagguuccucgaauuugaggcgcugggguuccuaaaugaggaucauugguuuucccgccgaaacagccuuucuggaguggaaggcgagggucugcaccggcucggguacauccugagagacguuucaaagaaagaaggaggcgcaauguacgccgaugacaccgcuggcugggacacuaggauuacauuggaggaucugaagaaugaagagauggucaccaaccauaugaagggggagcacaaaaagcucgccgaagcaauauucaaacuuacauaucagaauaagguggugcgcguccagagaccaacuccucggggaaccguuauggacaucauuaguaggcgugaucagcgagguuccggccaaguggggacguacggacugaacaccuuuacaaauauggaggcucaguuaauccgccagauggaaggcgaggguaucuucaaaagcauucaacaucugacuguaaccgaggaaauagccgugcagaacugguuggcuagagucgggcgggagaggcucucucgcauggccaucucgggagacgauugcgugguuaagccccuggacgauagauucgcaucagcgcuaacagcccuuaaugacaugggcaaggugcggaaagauauucagcagugggaaccaagcaggggcuggaacgacuggacucaaguccccuuuugcucccaccacuuccaugagcuggugaugaaggaugggcgaguacucguugugccuugucguaaucaggacgaacugaucggcagagcucgcauuagucagggugccggcuggucuuugaaagagaccgcaugcuuaggaaagagcuaugcucagauguggacgcugauguacuuucaccggagggaucucagacuugccgcaaacgccaucuguuccgcggucccaucacauugggugccgacaagucgcaccacuuggucuauacacgcuaaacacgaguggaugacaaccgaagacaugcuggccguguggaaccgggucuggauccaagagaaucccuggauggaagacaagacuccuguugagagcugggaagaggugccauaucuaggaaagagggaggaucaguggugcggcucccugauuggucucaccucacgagcaacaugggccaaaaacauccagacggcuauuaaucagguaaggagcuugaucgggaacgaagaguacaccgacuauaugcccucuaugaagcgguucaggcgcgaagaggaagaggccggagugcugugguga

SEQ ID NO: 15023 - RNA, 9876 nt, Artificial Sequence
  derived and/or modified CDS sequence (opt3) from DENV-2__GQ398302__SS-prME
accgccggcgugaucauuaugcugauacccacagcuauggcauuccaccucacuacgagaaacggggagccucauaugaucgucagcaggcaggaaaagggaaaaucccuucuguuuaagaccgaggacgguguuaauaugugcacauugauggccauugauuuaggcgaacugugugaggacacuaucaccuacaaaugcccacuacuccggcaaaacgaaccggaggauauugacuguuggugcaauucuacaucaaccugggugacuuaugggacauguaccacgacuggagagcaccgccgagaaaagcguaguguagcgcuggugccccaugucggcaugggucuugagaccagaacagaaacuuggaugagcuccgagggggcuuggaaacacgugcagaggaucgagaccuggauacugcggcauccuggauucacaaucauggccgcaauuuuggccuacaccaucggcacgacucacuuucagcgcgcucucauuuucauccugcugacagcaguugccccaucuaugaccaugagaugcauaggcauuucgaacagggauuuuguggaaggggucucaggagguagcuggguggacaucguacucgagcacggcaguuguguuacuacaauggcuaagaauaagcccaccuuagauuucgaacugauuaaaacggaggccaagcagccugcgacccuucggaaauauugcaucgaagcaaaguugacaaacacuaccacagagucccgcuguccaacucaaggggagcccucucugaaugaagagcaggacaaacgauuugugugcaagcauagcauggucgauagaggauggggcaacgguugugggcuauucggaaagggcggcaucgugaccugcgccauguuuacaugcaaaaagaauauggaagggaaagugguccucccugagaaccuggaauacaccauuguuauaacuccacacuccggagaggagcaugcuguggguaaugacacgggcaagcacgggaaagaaaucaagauuacaccgcagucaaguaucaccgaggccgaacuuacuggauauggcaccguaacaauggaguguagccccaggaccggucuggauuucaacgaaaugguguugcuccagauggaggacaaagcauggcugguccaccggcaaugguuuuuagaucugccucucccauggcuucccggggcugacacucagggcucuaauuggauacagaaggagacacuggugacguucaagaacccucaugccaaaaagcaggacguuguggucuugggaucccaagaaggcgcgaugcacaccgcccuaacuggggcaacagagauucagaugucaagcggaaaucugcucuuuaccggucaucugaaaugccgucuucgcauggauaagcugcaguugaaaggcaugaguuacucuauguguacagggaaguucaagaucgugaaagaaaucgcugagacucaacacggaaccauuguaaucagaguucaguaugagggcgacgguuccccaugcaagauucccuucgaaauaauggaucucgagaaaaggcaugugcuggggcgguuaaucacggucaacccgauuguggccgaaaaggacagcccugucaacaucgaggcugaacccccauuuggcgauucguacaucauuauaggaguggagccuggccagcugaaacuaaauugguucaagaaggggucuuccaucggacagauguuugagaccacaaugcgaggugccaaacgcauggcaauucucggcgacacugccugggauuucgggucacugggaggcguuuuuaccaguaucgguaaggcucuucaccaaguguucggggcgauuuacggcgcagccuuuagcggaguauccuggacaaugaaaaucuugauaggcgucaucauuacuuggaucgggaugaacucuagaagcaccucacugagugugucccucguucuggugggagucgugacgcuuuaucugggcgcuaugguacaggccgacagcgguugugugguuucuuggaagucaaaagaauugaagugcgggaguggaauuuucaucacagauaauguccacaccuggacugagcaguacaaguuucagcccgaaagcccauccaaacucgcaucugccauacaaaaggcucaugaggaaggcauuugugguaucaggucggugacacggcuggagaacuuaauguggaaacagauuacccccgagcugaaucacauccuaagcgaaaacgaggugaagcucacuauaaugaccggcgacaucaaagggauuaugcaggccggaaagcgcucccugagaccucagccaacagaacuuaaauauucauggaagacguggggcaaggcaaaaauguugaguaccgagucucauaaucaaacuuuccugaucgaugggccggaaacagcggagugccccaacaccaauagggcuuggaacagccucgaggucgaagacuacggauuuggcguuuucacaacuaauauuuggcugaaguuacgugagaaacaggacguguuuugugauuccaagcugaugucagccgcaaucaaagacaaccgggccgugcacgcugauauggguuauuggauagaaagcgcccuuaaugacaccuggaagauggagaaggcaucuuucauugagguaaaauccugccacuggccuaagagucauacguuguggagcaacgggguccucgaaucugagaugaucaucccaaaaaauuucgcuggacccgugucccagcacaacuaccgaccuggcuaucauacacagaccgccgguccauggcaccugggcaagcuagaaauggauuuugacuucugugaggggacuaccguuguggucacagaagauugcggaaacagaggccccucacugaggacuaccacagcgagugggaaacucauuacggaguggugcugucgcagcugcacccugccgccucuucgguacagaggagaggacggcuguugguacgguauggaaaucaggccauugaaggagaaggaagagaaucuggugaacucguuaguuacugccgggcauggacaaauugauaauuuuucccucggcgugcuggguauggcucuuuuccuggaagagauguugcgcacacgaguaggcaccaaacacgcaaugcuccuggucgccgugucuuuugugacucuaauaacagggaacaugagcuuccgggaccugggacgugucaugguuauggugggcgcuaccaugacggaugacaucgggaugggaauuacuuaucucgcccugcuugcagcguuuaagguaagacccaccuucgccgcuggcuugcuguuaaggaaacucacaucaaaggagcugaugauggccaccaucgguauugcacuucugagucaguccacuaucccugaaacaauacuagagcucaccgaugcucuggccuuggggaugauggugcugaaaaucguccgcaauauggaaaaguaccaguuagcagugacaauuauggccaucucuugcguucccaacgcugugauucuccaaaaugcguggaaggucagcuguacuauccuggccgcaguguccguuucaccacuucuguugaccagcagucagcagaaagcugacuggauaccucucgcccugacgauuaagggacuaaaccccacagccaucuuucugaccacucuuucucggaccuccaaaaagagaagcuggccacucaaugaggcuaucauggcagugggcauggucucgauucuggccucaucuuugcugaaaaacgacauaccgaugacaggcccuuuaguagcggggggacuccugacugugugcuauguucuuaccgguaggagugcugaucuggaauuggagcgagccgcagacgugaagugggaggaucaggccgaaaucuccggcagcucucccauucucagcaucacgauuuccgaggacgggucaaugaguaucaaaaaugaagaggaggaacaaacacugaccauacuaauccgcacuggacugcuugucauuagcggcguguucccaguaucuauccccauuacagcugcagccugguaccucugggaggugaagaagcagcgggcggguguccugugggauguuccuuccccacccccuguggggaaagcugaauuggaggacggagccuauagaaucaagcagaggggcauauuaggcuacucacagauuggggcaggaguguauaaagaagguaccuuucacacuauguggcaugucacacguggcgccgugcugaugcaccgcgggaagcggaucgagccgaguugggcugauguuaaaaaggaccucaucagcuacggaggcgguuggaagcuggagggggaauggaaagagggagaagagguacaagugcuugcccuggaaccaggcaagaaccccagagcaguccagaccaaaccuggcuuguucaagacgaauacugggaccauuggagcugugucccuagauuuuucuccagguacaucgggcagccccaucguugacaggaaagggaagguggucggacuguacggcaacggugugguaacccgaucaggggccuaugucuccgcgauagcccagacagagaagaguauugaggauaauccugaaaucgaggacgauauuuuccggaaaaagcgccucacuaucauggaccugcauccgggagcaggcaaaaccaagagauaccuucccgcuauagugagggaagccauuaaacggggcuuacgaacgcugauccucgcuccaacaagaguuguggcagccgagauggaagaggccuugcgcgggcugccuaucagguaucagacucccgcuauucgugcggagcacaccggacgggaaaucgucgaccucaugugucaugcaacauucaccaugagacugcuuucuccagugaggguuccuaacuacaaccugauuauaauggaugaggcccacuuuacugaccccgcuagcaucgccgcacgcgguuauauuuccacccgaguggaaaugggcgaggccgcugggaucuucaugacagcgacgccaccgggaucaagagauccuuuuccccaaucuaaugccccaaucauggacgaggaacgggagauucccgaaaggagcuggaacaguggccacgagugggucacugauuucaaggguaagaccgugugguuuguaccuuccauaaaagcagggaaugacaucgcugccugcuugcgcaagaacggaaaaaaggugauucagcuaagccguaaaacauucgauucugaauacguuaagaccagagcaaaugacugggauuuugucgugacuacagacaucucagagaugggcgccaacuucaaggcugagcgggugauugauccaaggcgcuguaugaaacccgucauccugaccgacggcgaagagcgaguaauacucgccgggccuaugccggugacgcauuccagugcggcacagagacggggaaggaucggucgcaauccaaagaacgaaaaugaccaauauauuuacaugggcgagcccuuagaaaacgaugaggacugcgcccacuggaaagaggcuaagaugcugcuugauaauaucaacacuccugaagggauuauccccagcauguuugagccagaaagagagaaaguugacgccauagauggagaauacaggcugcggggcgaggcucguaagacauucguggaccucaugcgccgaggugauuugccugucuggcuggcauauagaguggccgcugaggggauuaauuacgccgacaggcggugguguuuugauggcaucaaaaacaaucagauucucgaagagaacguugaaguggagaucuggaccaaggagggagaacgcaagaaacugaagcccagauggcuugacgcaaggauauauucggauccacuagcgcugaaagaguucaaggaauucgccgcuggccggaaaucuuugaccuuaaaccugaucacugagauggggcgacucccuacauuuaugacccagaaggccagagacgcacuggauaaucuugcuguccugcauacagccgaagcaggaggucgcgccuacaaccacgcucucuccgaguugccggagacucuggaaacgcuacugcuccuuacccuguuagcgacagugacuggcgggauuuucuuguuucugaugagcggaaagggcaucgguaaaaugacccucgggaugugcugcauuaucacagccucaauacugcuuugguaugcacagauucaaccccacuggaucgcugccaguaucauucuggaguucuuucucaucguauugcugauaccagaaccugagaagcagaggaccccccaggacaaucaguuaacuuacgugguuauugccauccuaacggucguggcagcuaccauggccaacgaaaugggcuuccuggagaaaacaaagaaagaccucggacuuggcucuauugcgacucaagaguccgaaagcaauauccuggauauagacuugcggccagcuucagccuggacccuguaugcaguggccacaaccuuugucacuccuaugcuccgucauaguaucgagaacagcuccguuaaugugucucugacagcuauugcaaaccaggccacgguacuuauggggcucggaaaggguuggccccugagcaagauggauaucggcgugccguugcuggcgauuggguguuacucccaggucaauccaaucaccuuaacugcugcccuacugcuccuuguggcacacuacgccauuaucggaccuggccugcaggcuaaagccacaagagaagcacaaaagagggcugccgcggguauaaugaaaaaccccaccguugacgggauuaccgugaucgauuuggagccaauccccuaugacccuaaguucgaaaaacagcugggccaggucaugcuccugauucuuugcguaacacagguguuaaugaugcgcacuacgugggcccugugugaggcacucaccuuggcuacaggaccgauaucaacucugugggagggcaaucccgggcgguuuuggaacaccacaaucgccguuucuauggcaaauauuuuccgaggaaguuaccuagcuggcgccggucugcucuuuucgaucaugaagaacaccacuaauacgagaagggggacaggaaacauuggcgaaacccuuggugagaaguggaaaagccgccugaaugccuugggcaaguccgaauuccaaaucuauaaaaagucugggauacaggagguggaucggacucuggcgaaagagggaaucaagagaggcgaaaccgaccaucacgcugucucacgugggagcgcaaaacucaggugguuuguggagcggaacauggucacaccagaaggaaaggugguugaucugggcugcggucgcgggggaugguccuacuauuguggcgguuuaaagaacgugcgagagguaaaaggccuuacuaaggggggaccuggccaugaagagcccauuccuaugaguaccuacggguggaaucuggugagacuccagucuggagucgacguuuucuucacaccacccgagaaaugcgauacgcuacugugugacaucggcgaaagcucaccuaacccaaccauugaggccgguaggacuuugcgggugcugaaucucgucgaaaacuggcuuaauaacaauacacaauuuugcaucaaggugcugaaccccuauaugccguccguaauagagaaaauggaaaccuugcagcgcaaguacgggggagcucuggugagaaauccucucaguaggaacagcacucacgagauguacuggguuucuaaugccacaggcaacauuguguccucagucaauaugaucagccgaauguuaaucaaccgguucaccaugaagcacaaaaaggcaacguaugagccagauguggaccugggcucggggacccguaauauuggaauagaaucugagauccccaaccuugacauuaucgguaaaagaauugaaaagaucaaacaggagcaugaaacaaguuggcacuacgaucaggaccauccuuauaagacuugggccuaccacggcuccuaugagaccaagcaaacagggagcgcuucauccauggucaacggagugguucgccugcuaacuaaaccaugggauguagugcccauggucacccagauggcgaugacagacaccacuccguuuggccagcagaggguguucaaggagaaaguugauacgcggacacaagaaccuaaggaggguaccaaaaagcucaugaagauaacugccgaauggcuguggaaagaguuggggaagaaaaagacccccagaauguguacacgcgaggaauuuacgaggaaagugcgaucuaaugcagcucugggagccaucuucaccgacgagaacaaguggaaaagcgcacgggaagccgucgaggauaguagauuuugggaacucauugacagggagcgcaaucuucaccuggagggcaagugcgaaacuuguguguacaacaugaugggcaagcgugagaaaaaguuaggggaauucggaaaagcuaaggguucccgggccaucugguauauguggcugggcgcgagauuuuuggaguucgaagcacucggguuucugaaugaggaucauugguucagcaggggaaacucucuaucaggcguagagggugaagggcuucaccgccugggauacauucuccgagacgugaguaaaaaggagggcggcgccauguacgcugaugacacagccgggugggacacccggaucacucuggaagauuugaagaaugaggaaaugguuacaaaccauaugaaaggagagcacaagaaacuggcagaggcuauuuuuaagcucaccuaucagaauaaagucgugagagugcagaggccaacaccucgcgguacugucauggacauaaucuccagacgggaucagaggggcagcgggcaaguuggaaccuacggccuuaacacguucaccaauauggaagcccagcugauucgucagauggagggugaagggaucuucaagucuauccaacauuuaacagugacugaggagauugcuguacagaacuggcuggcccgagugggacgcgaaagauugucgcggauggcaauaucaggcgacgauugcgucgugaagccccucgacgauagguuugcgagcgcccugaccgcucuaaaugacaugggcaaaguucgcaaggauauccagcagugggagccauccagaggguggaacgacuggacacaagugcccuucugcagucaccacuuucaugaacuugucaugaaagauggacgggugcugguaguuccuuguaggaaucaggacgagcucauuggucgagcccguaucucucagggcgcaggguggagccugaaggaaacugcuugcuugggaaaauccuaugcccagauguggaccuuaauguacuuccacagacgcgaucugcggcucgcagccaacgcgauuuguucagcugugccaagucauugggucccgacgucuaggacaaccuggagcauccacgccaagcacgaguggaugacuacagaggacaugcuugcaguguggaacagaguguggauacaagaaaaucccuggauggaggacaagaccccugucgaauccugggaggaaguuccauaucugggcaaacgcgaggaucaguggugcgguucacuaaucgggcugacuagccgggccaccugggcuaagaacauucagacagccaucaaucaggugaggucucucauuggaaacgaggaauacacggacuauaugcccuccaugaaacgauuuagacgggaggaagaggaagcaggcguauugugguga

SEQ ID NO: 15024 - RNA, 9876 nt, Artificial Sequence
  derived and/or modified CDS sequence (opt3) from DENV-2__GQ398272__SS-prME
accgccggcgugaucauuaugcugauacccacagcuauggcauuccaccucacuacgaggaacggggagccucauaugaucgucgggaggcaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgugcagaggaucgagaccuggauucugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguacucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaagaacaggacaaacgauuuaucugcaagcauucuaugguggauagaggcugggguaacggguguggacuauucggcaagggcgggauugucacaugcgccauguuuacaugcaaaaagaauauggaaggaaaaguggugcucccugagaaccuggaauacaccauagucaucacuccacacagcggugaggagcaugcuguuggcaaugacacggggaagcacggaaaagaaauuaagaucacaccgcaguccucaauaaccgaggccgaacuuacuggcuaugguaccgugacaauggaguguagucccaggaccgggcuggauuucaacgaaaugguauugcuccagauggaggacaaagcauggcuggugcaccggcaaugguuuuuagaucugccucucccauggcuucccggcgcugacacucagggaagcaauuggauucagaaggagacacuggucacguucaagaacccucaugccaaaaagcaggacgugguuguguugggcucucaagaaggggcgaugcacaccgcccuaacuggagcaacagagauccagauguccucagguaaucugcucuuuaccggccaucugaaaugccgucuucgcauggauaagcugcaguugaaagggaugagcuacaguauguguacaggaaaguucaagaucgucaaagaaauugcugagacucaacacggcaccaucgugauuagaguacaguaugagggugacgggucuccaugcaagauacccuucgaaaucauggaucucgagaaaaggcauguucugggccgguuaauuacggugaacccgaucgucaccgaaaaggacuccccugugaacaucgaggccgaacccccauuuggagauagcuacauuauaaucggcgucgagccugggcagcugaaacuaaauugguucaagaagggaucgucuauuggucagauguuugagacaacuaugcgaggcgcuaaacgcauggccauccucggggacaccgcaugggauuucggaucccugggcgguguguuuacaucaauugggaaggcccuucaccaaguuuucggcgcuaucuacggagcggcauuuaguggcgugagcuggacuaugaaaauauugaucgggguaauuaucaccuggauuggaaugaacuccagaucuacgagccugucagucagucucgugcugguuggcguggucacacuuuaucugggugugaugguacaggccgacuccgggugugugguuagcuggaagaauaaagaauugaagugcggaucuggcaucuucauaaccgauaacguccacacuuggacagagcaguacaaguuucagcccgaaucaccaaguaaacucgcuagcgccauucaaaaggcacaugaggaagguaucuguggcauuagguccgugacccggcuggagaauuuaauguggaaacagaucacucccgagcugaaccacauacuaucugaaaaugaggugaagcucaccaucaugacaggggacauuaaaggaaucaugcaggccggcaagcgcucgcugagaccucagccaacggaacuuaaauauagcuggaagaccugggggaaggcuaaaauguuguccacugagucacauaaccaaacauuccugauugauggaccggaaaccgccgagugccccaauacaaacagggcauggaauagucucgaggucgaagacuacggcuuugguguuuucucuacuaacaucuggcugaaguuacgugagaaacaggacguguuuugugauagcaagcugauguccgcggcuauaaaagacaaucgggccgugcacgcagauaugggguauuggauugaaucagcccuuaacgacaccuggaagauggagaaggcuagcuucaucgagguaaaaucuugccacuggccuaagucccauacguuguggaguaauggaguccucgaaagcgagaugaucauucccaagaacuucgccggccccgugucucagcacaacuaccgaccugguuaucauacacagaccgcaggcccauggcaccuggggaagcuagaaauggauuuugacuucugugagggaacuaccguuguggucacagaagauugcggcaauagagggcccucccugaggacuaccacagcuucaggaaaacucaucacggaguggugcugucgcaguugcacccugccgccucuucgguacagaggcgaggacgguuguugguacgggauggaaauuaggccauugaaggagaaggaagagaaccuggugaauagcuuaguuacugccggacauggccaaauagauaacuuuucgcucggugugcugggcauggcgcuuuuccuggaagagauguugcgcacacgaguagggaccaaacacgccauccuccuggucgcuguguccuuugugacucuaauuacaggaaauaugucuuuccgggaccugggccgugucaugguuauggugggggcaaccaugacggaugacaucggaaugggcguaacuuaucucgcccugcuugcugccuuuaaggugagacccaccuucgcagcggguuugcuguuaaggaaacucacaagcaaggagcugaugauggccaccauugggaucgcacuucugucacagaguacuauaccugaaacaauccuagagcucaccgaugcccuggcauugggaaugaugguccugaaaauugugcgcaacauggaaaaguaccaguuagcuguuacaaucauggccauuuccugcgugcccaaugcagucauccuccaaaacgccuggaaggugucuuguacuauacuggcugcgguuagcguguccccacuucuguugaccucaagccagcagaaagccgacuggauuccucucgcacugacgaucaagggccuaaaucccacagcuaucuuucugaccacucuuagucggaccucuaaaaagagauccuggccacucaacgaggccgucauggccguaggcauggugagcauucuggcuucgucauugcugaaaaaugacauaccgaugacagggccuuuaguugcaggaggucuccugacugugugcuauguccuuaccggcaggucugccgaucuggaauuggagcgagcggcugacgugaagugggaggaucaggccgaaaucaguggguccagccccauucucucuaucacgauuagcgaggacggauccaugucaaucaaaaacgaagaggaggaacaaacacugaccauacuaauccgcacuggccugcuuguaauuagugguguguucccagucagcauccccauuacagcagccgcuugguaccucugggagguuaagaagcagcgggcaggggugcugugggaugugccuucuccacccccugucggaaaagccgaauuggaggacggcgcguauagaaucaagcagaggggcauauuuggguacucccagauuggagcugguguguauaaagaaggcaccuuccacacuauguggcauguuacacguggggccguauuaaugcaccgcggaaagcggaucgagccgucaugggcagaugugaaaaaggaccugaucaguuacggcgguggguggaagcucgagggagaauggaaagagggcgaagagguccaagugcuggcccuugaaccaggcaagaaucccagagcuguucagaccaaaccugggcuguuuaagacgaacacuggaaccauuggugccgugagcuuggauuucuccccaggcacaucugggucgcccaucgucgacaggaaaggaaaggugguaggccuauacgguaauggggucgugacccgaagcggagcauauguuucagcuauagcccagacagagaaguccauugaggauaacccugaaaucgaggacgauauuuuccggaaaaagcgccugacuaucauggaccuccauccgggcgcgggcaaaaccaagagauaccugcccgccauagugagggaagcaauuaaacgggggcuucgaacguuaauccuggcuccaacaagagucguggccgcugagauggaagaggcacuccgcggauugccuaucagguaucagacucccgccauucgugccgagcacaccggucgggaaaucguugaccugaugugucaugcuacauuuaccaugagacuccugaguccagugagggucccuaacuacaaucuuauuauaauggaugaggcgcacuucacugaccccgcaucuaucgccgcucgcggcuauauuagcacccgaguggaaaugggggaggccgcaggaaucuuuaugacagccacgccaccgggcuccagagauccuuucccccaaucaaacgcuccaaucauggacgaggaacgggagauucccgaaaggucuuggaauagcggucacgaguggguaacugauuuuaaggggaagaccgugugguucguuccuaguauaaaagcgggaaacgacaucgccgcaugccugcgcaagaauggcaaaaaggucauucaguugucccguaaaacauuugauagcgaauacgugaagaccagagcuaacgacugggauuucguggucacuacagacaucucugagaugggcgccaauuuucgggcagagaggguaauugauccacgccgauguaugaagcccgugauccuaaccgacggggaagagagaguuauacuggccggaccuaugccggugacgcauucauccgcugcccagcggaggggucgcaucggcagaaaccccaaaaaugaaaacgaccaauauauuuacaugggggagccccucgaaaaugaugaggacugcgcgcacuggaaggaggcaaaaauguuacuggauaacaucaauacuccugaaggaauuauccccaguauguucgagccagaaagggagaaggucgacgccauagauggcgaauaccggcuucguggugaggcucgcaaaacauuuguggaccugaugcgaagaggggaucucccuguuugguuggccuauaggguggcugcagagggcauuaacuacgccgaccggcgcugguguuucgauggaaucaagaauaaccagauucuggaagagaacgucgaaguggagaucuggaccaaagagggcgaaagaaagaagcucaaacccagguggcuggacgcucggauauauagcgauccacuugcccuaaaggaguucaaagaauuugcagcggggcgaaagucgcugaccuugaauuuaaucacugagaugggaagacugccuacauucaugacccagaaagcccgcgacgcucucgauaaccuggccguacuucauacagcagaaguggguggcagggcuuacaaucacgcccugucugagcucccggagacuuuggaaacgcugcuacugcucacccuucuggcaacaguuacugggggaauauuuuuauucuugauguccggcaaggguaucgggaagaugacccugggcaugugcugcauuaucacagccagcauacuccugugguaugcucagauucaaccccacuggaucgcggccucaaucauucuugaguuuuuccugaucguccucuugauaccagaaccugagaaacagcggaccccacaggacaaccagcugacuuacguggugauugcaaucuuaacggucguugcugccaccauggccaaugaaaugggauuucuagagaagaccaaaaaggaccugggccucgggaguauuaucacucaagagucugaauccaacauacuugauaucgaccugcguccagcaagcgcuuggaccuuguaugccguggcgacaaccuucguaacuccuaugcugagacauucaauugagaauaguagcgugaacgucucccucacagcuaucgccaaucaggcaacggugcugaugggacuugguaggggcuggccccucucuaaaauggauauugggguuccgcuguuggccaucggauguuacagccaggugaacccaauuacccugaucgcugcauuacuacugcucgucgcccacuacgcgauaauuggcccuggucuucaggcuaaggccacucgcgaagcacaaaagcgggccgcugccgggaucaugaaaaaucccacaguagacggcaucaccgugauugaucuggagccaauacccuaugacccuaaguuugaaaaacaguugggacagguuaugcugcucgugcugugcgucacccaggugcuuaugaugcgaacaacuugggcauuaugugaggcucugacgcucgccaccggcccgaucuccacauugugggaggggaaccccggaagauucuggaauacuaccauugcggucucaauggccaacaucuuuaggggcucuuaccuggcuggugcugggcuacuguucaguauuaugaagaauacaaccaacacucgccggggaacgggcaauaucggugaaacacucggcgagaaauggaagucgagacuuaacgcccugggaaagagcgaauuucaaauauauaaaaaguccggaauccaggagguggaucguaccuuggcaaaagagggcauuaagagaggggaaacugaccaucacgcuguuucucggggaucagccaaacugcgcugguucguggagcgaaacaugguaaccccagaaggcaagguggucgaucucgguugcgggagaggaggcuggagcuacuauugugguggccugaaaaauguuagggaggugaagggguuaacaaagggaggcccugggcaugaagaaccaaucccuauguccacuuacggauggaaccuuguccggcugcagaguggcguggacguauucuuuaccccacccgagaaaugcgauacacuccuaugugacauuggugaaucuagcccuaauccaacgaucgaggccgggcgcacccugagaguguugaaccugguugaaaauuggcucaacaauaacacucaauucugcauaaaggugcuuaaucccuauaugccgucagucauugagaaaauggaaacacugcagaggaaguacggaggcgcguuggugcgaaacccucugucccggaauaguacccacgagauguacugggucagcaacgcuacuggcaauaucgugucuuccguuaacaugaucucacguaugcucauuaauagauuuacaaugaaacacaagaaggcaaccuaugagccagauguagacuuagggagcggaacgcgcaacauagguaucgaaaacgagauucccaaucuggacaucauuggcaaaaggaucgaaaagauaaaacaggagcaugaaaccucguggcacuacgaucaggaccauccuuauaagacaugggccuaccacgggucuuaugagacuaaacaaaccggaagugcuuccagcauggugaacggcgucgugcggcuucugacaaagccaugggauguugugcccauggucacucagauggccaugaccgacacaaccccguucggucagcagagaguguuuaaggagaaaguagauacucgcacgcaagaaccuaaggaggggaccaaaaagcuaaugaggaucacagcagaauggcucuggaaagagcugggaaagaagaaaacuccccgaauguguacccgggaggaguucacaagaaaggugaggucaaaugccgcuuugggcgcgauuuuuacggacgagaacaaauggaaguccgcccgcgaagcaguugaggauucucguuucugggaacuggucgaccgggagagaaaucuccaccuugagggcaaaugcgaaaccuguguguacaacaugauggggaagagggagaaaaagcugggagaauuugguaaggcuaaaggcagccgcgccaucugguauaugugguuaggggcacgauuccuggaguuugaagccuugggauuccucaaugaggaucauugguuuagucggggcaacucccugagcgguguggagggggaaggacuacacaaacuuggcuacauucugagagacgucucuaaaaaggagggcggggcuauguacgccgaugacacugcgggaugggacacaaggaucacccucgaagaucugaaaaaugaggaaaugguuacuaaccauaugaagggugagcacaagaaauuggcagaggccauuuucaagcugacauaucagaauaaagugguacgcgugcagagaccaaccccucggggcacagucauggacauaaucucaaggaaggaucagcgugggaguggacaagugggcacuuacggucucaacaccuucacgaauauggaagcucagcuuauucgacagauggagggggaaggaaucuuuaaauccauccaacaucugaccguuacagaggagauugccgugcagaacugguuagcacgcgucggcagagaacggcugagcaggauggcuauaucuggcgacgauugcgugguaaagcccuuggacgaucgcuucgccucggcucucacugcccugaaugacauggggaagguuagaaaagauauccagcagugggagccaucacggggauggaacgacuggacccaagugcccuuuugcagccaccacuuccaugagcuagucaugaaggaugguagggugcuuguggucccuugucgaaaccaggacgagcugauuggccgugcaagaaucucccagggggcgggauggagucucaaagaaacagccugccugggcaagucuuaugcucagauguggacuuugauguacuuucaccgccgggauuuaaggcuggccgcaaaugcuauuuguagcgccguuccaucccauugggugccgaccucaagaacgacauggaguauccacgcaaaacacgaguggaugaccacugaggacaugcucgccguauggaaccgcguguggauacaagaaaaucccuggauggaggacaagacaccugucgaaucuugggaggaagugccauaucuugguaagcgggaggaucaguggugcgggagccugaucggacuaaccuccagggcgacuugggcuaaaaacauucagaccgccaucaaucagguucgaucacugauuggcaacgaggaauacacagacuauaugcccagcaugaagagauuccggaaagaggaagaggaagcaggcgugcucugguga

SEQ ID NO: 15025 - RNA, 9876 nt, Artificial Sequence
  derived and/or modified CDS sequence (opt3) from DENV-2__GQ398292__SS-prME
accgcaggcguguucaucaugcugauucccacugcuauggcauuucaccucacuacgagaaacggggagccucauaugauagucgggaggcaggaaaaggguaaaagccuucuguucaagaccgaggacggcguuaauaugugcacauugauggccaucgauuuaggggaacugugugaggacacuauuaccuacaaaugcccacuacuccggcaaaacgaaccggaggauaucgacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgugcagaggauugagaccuggaucaugcggcauccuggcuuuacaauaauggccgcaauccuggccuacaccauuggcacgacucacuuccagcgcgcuuugaucuuuauucuccugacagcaguugccccauccaugaccaugagaugcaucgggauaucuaacagggauuucguggaaggagucucggguggcucauggguggacauuguacuggagcacgggagcuguguuacuacaauggcuaagaauaagcccacccucgauuuugaauuaaucaaaacggaggccaagcagccugcgacccugcggaaauauugcauugaagcaaaacuuacaaacacuaccacagagagucgcuguccaacucaaggagagcccuccuugaaugaagaacaggacaaacgauucgugugcaagcauucuauggucgauagaggcugggguaacggguguggacuguuuggcaagggcgggaucgugaccugcgccauguucacaugcaaaaagaauauggaaggaaaagugguccuaccugagaaccucgaauacaccaucguuauuacuccacacagcggugaggagcaugcugugggcaaugacacggggaagcacggaaaagaaauaaagaucacaccgcaguccucaauuaccgaggccgaacugacuggcuaugguaccguaacaauggaguguagucccaggaccgggcuugauuuuaacgaaauggugcuguugcagauggaggacaaagcauggcucguccaccggcaaugguuccuggauuuaccucugccauggcuccccggcgcugacacucagggaagcaauuggauccagaaggagacacuugugacguuuaagaacccucaugccaaaaagcaggacguugugguccugggcucucaagaaggggcgaugcacaccgccuugacuggagcaacagagauacagauguccucagguaaucuacuguucaccggccaucucaaaugccgucugcgcauggauaaacuucagcugaaagggaugagcuacaguauguguacaggaaaguucaagauugugaaagaaaucgcugagacucaacacggcaccaucguaauuagaguucaguaugagggugacgggucuccaugcaagauccccuuugaaauuauggauuuggagaaaaggcaugugcucggccggcugauaacggucaacccgaucguggccgaaaaggacuccccugucaacauugaggcugaacccccauucggagauagcuacaucaucauuggcguggagccugggcaguuaaaacugaauugguuuaagaagggaucgucuauaggucagauguucgagaccacaaugcgaggcgccaaacgcauggcaauccuaggggacacugccugggauuuuggaucccucggcgguguuuucaccucaauugggaaggcucugcaccaaguguuuggcgcgaucuacggagcagccuucaguggcguaagcuggacaaugaaaauucuuaucggggucauaaucacuuggauuggaaugaacuccagaucuaccagcuugucagugagucugguucucgugggcgucgugacgcuguaucuuggugcuaugguacaggccgacuccgggugugugguuagcuggaagucuaaagaacugaagugcggaucaggcaucuuuauuacagauaauguccacaccuggacugagcaguacaaguuccagcccgaaaguccaagcaaauuggcauccgccauccaaaaggcucaugaggaagguauauguggcauuaggucugugacacggcucgagaaccugauguggaaacagaucacccccgaguuaaaucacauucugucggaaaacgaggugaagcuaacuaucaugaccggggacauaaaaggaaucaugcaggccggcaagcgcagccucagaccucagccaacagaacugaaauauuccuggaagacgugggggaaggcaaaaaugcuuucaaccgagagucauaaucaaacauuuuugauugauggaccggaaacagcggagugccccaacaccaauagggcuuggaacucucuggaggucgaagacuacggcuucgguguuuuuacaacuaauaucuggcucaagcugcgugagaaacaggacguguucugugauagcaaguuaauguccgccgcaauuaaagacaaccgggccgugcacgcugauaugggguauuggaucgaaucagcccugaaugacaccuggaagauggagaaggcaucauucauagagguaaaaucuugccacuggccuaagucccauacgcuuuggaguaacggagucuuggaaagcgagaugauuauccccaagaauuuugcuggccccgugucucagcacaacuaccgaccugguuaucauacacagaccgccggcccauggcaccucgggaagcuggaaauggauuucgacuuuugugagggaacuaccguuguggucacagaagauugcggcaacagagggcccucccuaaggacuaccacagcgucaggaaaacugaucacggaguggugcugucgcaguugcacccucccgccucugcgguacagaggcgaggacgguuguugguacgggauggaaauuaggccacuuaaggagaaggaagagaauuuggugaacagccugguuacugccggacauggccaaaucgauaauuucucguuaggugugcucggcauggcucuguuucuugaagagaugcugcgcacacgaguagggaccaaacacgcaauguugcucgucgccguguccuucgugacucugauuacaggaaacaugucuuuucgggaccuaggccgugucaugguuauggugggggcuaccaugacggaugacauaggaaugggcaucacuuaucuggcccuccuggcagcguucaagguaagacccaccuuugccgcuggucuuuugcugaggaaauuaacaagcaaggagcucaugauggccaccauugggaucgcacugcuuucacagaguacuauuccugaaacaauccuggagcuaaccgaugcucucgcccugggaaugaugguguugaaaauaguccgcaauauggaaaaguaccagcuggcagugacaaucauggccauuuccugcguucccaacgcugugaucuuacaaaaugcguggaaggucucuuguacuauucucgccgcagugagcguuuccccacugcuucugaccucaagccagcagaaagcugacuggaucccuuuggcccucacgauaaagggccugaaccccacagccauuuuccuaaccacucugagucggaccucuaaaaagagauccuggccacuuaaugaggcuaucauggcagugggcauggucagcauccucgccucgucacuguugaaaaacgacauuccgaugacagggccucugguagcgggagguuuacucacugugugcuauguucugaccggcaggucugcugaucuugaacuggagcgagccgcagacgugaagugggaggaucaggccgaaauaaguggguccagccccaucuugucuauuacgaucagcgaggacggauccaugucaauuaaaaaugaagaggaggaacaaacacucaccauccugauacgcacuggccuacuggucaucagugguguguuuccaguaagcauucccaucacagcugcagccugguaccuuugggaggugaagaagcagcgggcggggguccucugggauguuccuucuccacccccugugggaaaagcugaacuggaggacggcgccuauagaauuaagcagaggggcaucuugggguacucccagauaggagccgguguguauaaagaaggcaccuuccacacuauguggcaugucacacguggggcaguguuaaugcaccgcggaaagcggauugagccgucaugggcugauguuaaaaaggaccugaucaguuacggcgguggguggaagcucgagggagaauggaaagagggcgaagagguacaagugcuggcccuugaaccaggcaagaaccccagagcaguccagaccaaaccugggcuguuuaagacgaauacuggaaccaucggugcugugagcuuggauuucuccccaggcacaucugggucgcccauuguugacaggaaaggaaagguggucggccuauacgguaacggggugguaacccgaagcggagccuaugucucagcgaucgcccagacagagaaguccauagaggauaauccugaaauugaggacgauaucuuccggaaaaagcgccugacuauuauggaccuccauccgggcgcaggcaaaaccaagagauaccugcccgcuaucgugagggaagccauaaaacgggggcuucgaacguuaauucuggcuccaacaagaguuguggcagccgagauggaagaggcccuccgcggauugccuaucagguaucagacucccgcuauccgugcggagcacaccggucgggaaauugucgaccugaugugucaugcaacauuuaccaugagacuccugaguccagugaggguuccuaacuacaaccuuaucauuauggaugaggcccacuucacugaccccgcuucuauagccgcacgcggcuauaucagcacccgaguggaaaugggggaggccgcuggaauuuuuaugacagcgacgccaccgggcuccagagauccuuucccccaaucaaaugccccaaucauggacgaggaacgggagauccccgaaaggucuuggaacagcggucacgagugggucacugauuuuaaggggaagaccgugugguucguaccuaguauuaaagcaggaaaugacauagcugccugccugcgcaagaacggcaaaaaggugauccaguugucccguaaaacauuugauagcgaauacguuaagaccagagcaaaugacugggauuucgucgugacuacagacauuucugagaugggcgccaacuuuaaggcugagcgggugaucgauccaaggcgcuguaugaaacccgucauucuaaccgacggggaagaacgaguaauccuggccggaccuaugccggugacgcauucauccgcggcacagagacgggguaggauaggccgcaauccaaagaacgaaaaugaccaauauaucuacaugggggagccccucgaaaacgaugaggacugcgcccacuggaaagaggcuaagauguuacuggauaauauuaacacuccugaaggaaucauucccaguauguucgagccagaaagagagaaaguugacgccaucgauggcgaauacaggcuucggggugaggcucguaagacauuuguggaccugaugcgccgaggggaucucccugucugguuggcauauagaguggccgcugagggcauaaauuacgccgacaggcggugguguuucgauggaauuaaaaacaaucagauccuggaagagaacguugaaguggagauuuggaccaaggagggcgaacgcaagaaacucaagcccagauggcuggacgcaaggaucuauagcgauccacuugcgcuaaaagaguucaaggaauuugccgcugggcggaaaucgcugaccuugaacuuaauaacugagaugggacgacugccuacauucaugacccagaaggccagagacgcacucgauaaucuggcuguccuucauacagccgaagccgguggccgcgccuacaaccacgcucugucugagcucccggagacuuuggaaacgcugcuacugcucacccuucuggcgacagugacugggggaaucuuuuuauucuugauguccggcaaggguauugggaaaaugacccugggcaugugcugcaucauuacagccagcauccuccugugguaugcacagauacaaccccacuggauugcugccucaaucauccuugaguuuuuccugauuguacucuugaucccagaaccugagaagcagaggaccccacaggacaaucagcugacuuacgugguuauagccauuuuaacggucguggcagcuaccauggccaacgaaaugggauuucuagagaaaacaaagaaagaccugggccucgggaguaucgcgacucaagagucugaauccaauauucuugauaucgaccugcggccagcuagcgccuggaccuuguaugcaguggccacaaccuucgucacuccuaugcugcgucauucaauagagaacaguagcguuaaugugucccucacagcuaucgcaaaccaggccacgguacugaugggacuugguaagggcuggccccucucuaagauggauauuggggugccgcuguuggcgaucggauguuacagccaggucaauccaauuacccugacugcugccuuacuacugcucguggcacacuacgccaucauuggcccuggucuucaggcuaaagccacaagagaagcacaaaagagggcugccgcggggaucaugaaaaaccccaccguugacggcauaaccgugauugaucuggagccaauccccuaugacccuaaguuugaaaaacaguugggacaggucaugcugcucauccugugcguaacacaggugcuuaugaugcgcacuacgugggccuuaugugaggcacugacccucgcuacaggcccgauuuccacuuugugggaggggaaucccggacgguucuggaacaccacaauagccguuucaauggcaaauaucuuucgaggcucuuaccuggcuggugccgggcuacuguucaguauuaugaagaacaccacuaauacgagaaggggaacaggcaacaucggugaaacccucggcgagaaguggaaaucgcgccuuaaugcccugggaaagagcgaauuucaaauuuauaaaaaguccggaauccaggagguggaucggacuuuggcgaaagagggcauaaagagaggggaaaccgaccaucacgcugucucucguggaucagcaaaacugaggugguucguggagcggaacauggucacaccagaaggcaaggugguugaucucgguugcgggcgcggaggcuggagcuacuauugugguggccugaagaacgugcgagagguaaaaggguuaacuaagggaggcccugggcaugaggaacccaucccuauguccaccuacggauggaaucuugugagacugcagaguggcgucgacguuuucuuuacaccacccgagaaaugcgauacgcuccuaugugacauuggugaaucuagcccuaacccaaccaucgaggccgggaggacucugcggguguugaaucuggucgaaaacuggcucaauaacaauacacaauucugcauuaaggugcuuaaccccuauaugccgucaguaaucgagaaaauggaaacccugcagcgcaaguacggaggcgcuuuggugagaaauccucuguccaggaacaguacucacgagauguacuggguuagcaaugccacaggcaacauagugucuuccgucaauaugauuucacgaaugcucaucaaccgguuuaccaugaagcacaaaaaggcaacguaugagccagauguggacuuagggagcggaacccguaauaucgguauugaaucggagauacccaaccuggacaucauuggcaaaagaaucgaaaagauuaaacaggagcaugaaacaucuuggcacuacgaucaggaccauccuuauaagacuugggccuaccacgggaguuaugagaccaagcaaacaggauccgcuagcucaauggucaacggcgugguucgccuucugacuaaaccaugggauguagugcccauggucacccagauggcgaugacagacaccacuccguucggucagcagaggguguuuaaggagaaaguugauacgcggacacaagaaccuaaggaggggaccaaaaagcuaaugaagaucacugccgaauggcucuggaaagagcugggaaagaaaaagacccccagaauguguacacgcgaggaguucacgaggaaagugcgauccaaugcagcuuugggcgccauauuuaccgacgagaacaaguggaaaucugcacgggaagccgucgaggauagcagauucugggaacugaucgacagggagcgcaaucuccaccuugagggcaagugcgaaacuuguguguacaacaugauggggaagcgugagaaaaagcugggagaauuugguaaagcuaagggcagucgggccauuugguauaugugguuaggggcgagauuccuggaguuugaagcauugggauuccucaaugaggaucauugguuuuccaggggcaacagccugucugguguagagggggaaggacuacaccgccuuggcuacauccugcgagacgugagcaagaaggagggcggggccauguacgcugaugacacagccggaugggacacccggauuacucucgaagaucugaagaaugaggaaaugguuacaaaccauaugaaaggugagcacaagaaauuggcagaggcuaucuucaagcugaccuaucagaauaaagucgugagagugcagaggccaacaccucgcggcacugucauggacauuauaaguagacgggaucagaggggguccggacaaguuggcaccuacggucucaacacguucaccaauauggaagcccagcuuauccgucagauggagggggaaggaauuuuuaagagcauccaacaucugacagugacugaggagaucgcuguacagaacugguuagcccgagugggccgcgaaagacugucucggauggcaauuucgggcgacgauugcgucgugaagcccuuggacgauagguucgcgucagcccucaccgcucugaaugacauggggaaaguucgcaaggauauacagcagugggagccaagcagaggauggaacgacuggacacaagugcccuuuugcucccaccacuuccaugagcuagucaugaaagauggucgggugcuuguaguuccuuguaggaaucaggacgagcugaucggccgagcccguauuagucagggggcaggauggucucucaaggaaacugcuugccugggcaaaagcuaugcccagauguggaccuugauguacuuucacagacgcgauuuacggcuggcagccaacgcgaucuguuccgcugugccaucacauugggucccgacgaguaggacaaccuggucuauucacgccaagcacgaguggaugacuacagaggacaugcucgcaguguggaacagaguguggauccaagaaaaucccuggauggaggacaagaccccugucgaaagcugggaggaaguuccauaucuugguaaacgcgaggaucaguggugcgggucccugauaggacuaacuucacgggccaccugggcuaagaacauccagacagccauuaaucaggugaggagccugaucggcaacgaggaauacacggacuauaugcccucuaugaaacgauucagacgggaggaagaggaagcaggcguacucugguga

SEQ ID NO: 15026 - RNA, 9876 nt, Artificial Sequence
  derived and/or modified CDS sequence (opt3) from DENV-2__GQ398267__SS-prME
accgccggaaucauuauaaugaugauccccacagugauggcuuuccaccugacuacgcgaaacggggagccucauaugauugucagcaggcaggaaaagggaaaaucccuccuuuuuaagaccgagaaugguguuaacaugugcacccugauggcaauggacuugggcgaauuaugugaggauacuaucaccuacaauugcccacugcugcggcaaaacgaaccggaggacauugauuguuggugcaauucuacaucaaccugggugacuuaugggacauguaccgccacgggagagcaccgccgagaaaaacguaguguugcgcucgugccccaugucggcaugggucuggagacuagaaccgaaacauggaugagcuccgagggggcuuggaagcacgcccagaggaucgagacuuggauacuucggcauccuggauucaccaucauggcagccauucuggcuuacacaaucggcaccacguauuuucagcgcguguugauuuucauccuccugacugcaguuacaccaucuauggccaugaggugcauaggcauuucgaacagggacuuuguggaaggggucucaggagguagcuggguggauaucguacuggagcacggcaguuguguuaccacuauggcuaaaaauaagcccacacucgacuucgaauuaauuaagaccgaggccaaacacccugcgacgcugcggaaguacugcguggaagcaaaacuuaccaacacaacuaccgccucccgcuguccaacacagggggagcccucuuugaaugaggaacaagauaagcgauuugucugcaaacauagcaugguggacagaggauggggcaacgguugugggcuguucggaaagggcggcaucgugacuugcgcuauguuuaccugcaagaaaaauauggaggggaaggucguucagccugaaaaccuagaguauacaaucgugauuaccccacacuccggagaagagaaugccguagguaacgauacuggcaaacaugggaaggagauaaaagugacgccgcagucaaguaucacagaagcagagcucaccggauacggcacugucaccauggaauguagccccaggacaggucuggacuucaaugagauggugcuucugcagauggaaaacaaggcuugguugguucaccggcaaugguuucucgaucugccuuuaccauggcugcccggggccgacacccagggcucuaacuggauucagaaagagacucucgugacauucaagaauccucacgcgaagaaacaggaugucgugguacuuggaucccaagagggcgccaugcauacggcacugaccggggcuacugaaauccagaugucaagcggaaacuugcuauuuacaggucaccugaagugccgucuccgcauggacaaacugcagcuuaagggcaugaguuauucuauguguaccgggaaauucaagguugugaaggagauagccgaaacacaacauggaacuauugucaucagagugcaguacgagggcgacgguuccccaugcaaaauccccuucgagauuauggaucuggaaaagaggcacgucuuggggcggcucaucaccgugaauccgauuguuacggagaaagacagcccugugaacauagaagcugagcccccauuuggcgauucguacaucauuaucggaguagaaccuggccagcugaaguuaucuugguucaaaaagggguccucaaucggacagauguuugagaccacaaugcgaggugccaagcgcauggcaauucugggcgacacugccugggauuucgggagucuaggaggcgucuuuaccagcauagguaaagcucuccaucaaguguucggggcgaucuauggcgcagccuuuuccggaguuucuuggacaaugaagauucugaucggcguggucauuacuuggaucgggaugaauagcagaucaaccagucuuuccgugagcuugguacuggugggaguugucacgcucuaccugggcgugauggugcaggcugacucugguugugucguuucauggaaaaacaaggagcuuaaaugcgggaguggaauauucaucacagauaaugugcacaccuggacugaacaguauaaguuucagcccgagagcccauccaagcuggccucugcaauucaaaaagcccacgaagagggcaucugugguauuaggucggugacacgguuggaaaaccucauguggaagcagaucacccccgagcugaaucauauauuaacugagaacgaaguaaaacugaccauuaugacaggcgacaucaaggggauuaugcaggcuggaaaacgcagccuaagaccucagccaacggagcucaaguacuccuggaaagccuggggcaaggcaaagaugcugucaaccgaacuucacaaucauacuuucuugaucgaugggccggagacagcggaaugccccaacaccaauagggcuuggaacagucuggaggucgaggacuauggauuuggcguguucacaacuaauauauggcucaaacugaaggaacgucaagauguauuuugugacucuaaauuaaugagcgccgcaaucaaggacaaccgggccgugcacgcugauauggguuacuggauugaguccgcccugaacgacaccuggaaaaucgaaaaggcaucauucauugaggucaagagcugccacuggccuaaaucucauacgcuuugguccaaugggguguuggagagugaaaugaucauaccaaagaacuucgcuggacccguuagccagcacaauuaucgaccuggcuaccauacacagaccgccgguccauggcaccucggcagacuggagauggauuuugacuucugugaagggacuaccgugguagucacagaggauugcggaaacaggggccccucucuacgcacuaccacagcguccgggaaacugauuacggaauggugcugucggucaugcacccucccgccucugagauacaggggagaggacggcuguugguaugguauggagauccgcccacuuaaggaaaaagaggaaaauuuggugaacagucuggugacugccgggcauggacagaucgauaauuuuagcuuaggcguccucgguauggcucuguuccuugaggaaaugcugcgaacacggguuggcaccaagcacgcaauuuugcucguggccguaucguuugugacucugaucacagggaacauguccuuccgugaccuaggaagagucauggugaugguuggcgcuaccaugacggaugacauugggaugggagugacuuaccuggcccuccuggcagcguuuaaggucaggcccaccuucgccgcuggccuuuugcugcgcaaauuaacaucuaaggagcucaugaugaccacuauagguaucgugcugcuuagccaaucaacaauuccugagaguauccuggaacuaaccgaugcccucgcacuggggaugaugguuuugaaaauugugcggaauauggagaaguaucagcuggcugucacaaucauggccauauuaugcguacccaacgcagugauccuccagaaugccuggaaaguuuccuguacuacccuggcuguggucucugugagcccacuucuguugacguccucacaacagaaggcggacuggauuccucucgcccugacaaucaagggacuaaaccccaccgcaauuuuucugacuacccuuagcagaacaaguaaaaagaggucuuggccacucaaugaagcuaucauggccguaggcaugguguccauacuggccagcucguugcugaaaaacgauauuccgaugacuggcccuuuagucgcugggggacuccugaccguuugcuacgugcuuacgggucgaucagcagaccuggaguuggaacgcgccgcggacgugcggugggaggagcaggcugaaaucucuggcaguucccccauccucagcauuacaauaucugaggaugggagcauguccaucaagaaugaagaggaggaacagacccugacuauucuaaucagaacaggacugcuugucauuucaggccucuucccagugaguauccccauaaccgccgcagccugguaucugugggagguuaaaaagcaaagggcugguguauugugggacgugccuagcccacccccugucgggaaagcagaauuagaggauggagccuaccguaucaagcagaagggcauucugggcuauucucagaucggggcgggaguguacaaagaagguacuuuucacacaauguggcauguuacccgcggcgcugugcucaugcacaaggggaaacggauugagccguccugggccgacgucaagaaagaucugaucucauacggaggcgguuggaaacuugagggggaauggaaggagggagaagaggugcagguacuggcauuggaaccaggcaaaaaccccagagccguccaaacgaagccuggccuauucaaaacuaacaccgggacaauaggagcugugagucuggacuuuagcccagguaccuccggcucucccauuguugauaagaaagggaagguggucggacucuauggcaauggugugguuacaaggucggggacuuacgugagcgccaucgcacagaccgagaagucaaucgaggacaacccugaaauugaggaugacaucuucagaaagaaacggcugacgauaauggaucuucauccgggagcuggcaaaacaaagcgcuauuuacccgccauugucagagaagcgaucaaaaggggccugcggacucucauuuuggccccaacccgagugguagcagcugagauggaagaggcccugagagggcucccuauccgcuaccagacacccgcuauaagggcagagcacaccggacgugaaauuguggaccugaugugucaugccacuuucaccaugcggcuucuguccccaaucagaguuccuaauuauaacuugaucauuauggaugaggcccacuuuacagaccccgcuaguaucgcggcaagggguuacauuucuacgcgcgucgaaaugggcgaggccgcugggauauucaugacugccaccccaccgggaagccgagacccuuuuccccaguccaaugcaccaaucauggaugaggaaagagagauucccgaacggucauggaacucuggccacgagugggugacagacuucaaggguaagaccgugugguuugucccuagcaucaaagccgggaaugauaucgcugcgugccuaaggaagaacggcaagaagguaauucaacugagucgcaaaacuuucgacuccgaauauauaaagacacguaccaaugauugggacuuugugguuacgacugauaucagcgagaugggcgccaacuucaaggcagagagagugauugacccacggagguguaugaaacccgucauccucacagauggcgaagaacgcgugauuuuagcugggccuaugccgguuacccauucuucagccgcacagcgaagaggacggguggguaggaauccaaagaacgaaaaugaccaguacaucuacaugggcgagccccuggaaaacgaugaggacugcgcccacuggaaagaggcuaagaugcuucuggacaauauaaacaccccugaagggaucauucccuccauguuugagccagaacgcgagaaagucgaugccaucgacggagaauauagacucaggggcgaggcgcggaagacuuucguggauuugaugcgucgcggugaccugccuguauggcucgcauaccgaguggccgcugaggggauuaacuaugccgauagaaggugguguuuugacggcguuaaaaauaaccaaauccuggaagagaaugucgaaguggagauauggacaaaggagggagaacggaagaaacuuaagccccgcuggcuagaugcuagaauuuacagugacccacuggcauugaaagaguucaaggaguucgccgcuggcaggaagucguuaacccugaaccucaucacagagauggggcggcugccuacuuuuaugacgcagaaggccaagaaugcacuugauaaccuggcggugcuccauaccgccgaagcuggaggucgagccuauaaucacgcauugagcgagcugccggagacacuagaaacucugcuccuucugaccuuauuggcuacagucaccggcgggauuuuccuguuucucaugucuggaaaaggcaucgguaagaugacucuggggaugugcugcauaaucacggccuccauucuucugugguacgcacagauccagccccacuggauugccgcuagcaucauacucgaguucuuuuugauuguucuguuaaucccagaaccugagaaacaaagaacaccccaggacaaccagcuaacauaugugguaaucgcgauucugacuguggucgccgcaaccauggcuaaugaaaugggcuuccucgagaagaccaagaaggauuuuggacuuggcucaaucaccacucagcaaccagagaguaacauacuggacauugauuugcgcccugccucugccuggacacuguacgcaguggcuacgaccuucaucacucccaugcucaggcauuccauugaaaauagcucaguuaacgugagucugacagccaucgcgaaucaggcuaccguccuuauggggcucggaaaggguuggccgcugagcaaaauggacauaggcguaccauugcuggccaucggguguuacucccaggugaacccuauuaccuuaaucgcagcccuacugcuccuuguugcucacuaugcaauuaucggacccggccugcaggccaaggcgacacgggaggcucaaaaacgugccgcagccgguauuaugaagaauccaacuguggacgggaugacggucaucgauuuggaccccauaccuuacgauccgaaauuugaaaagcagcugggccaggugaugcuccugguccuuugcgugacccagguuuuaaugaugagaacaacuugggcucugugugaggcccucaccuuggcaacaggacccauuucuacccugugggaaggcaacccagggagguucuggaauacuacgaucgcugugagcauggccaacaucuuucgcggauccuaucuagcgggcgccggucuacucuucucaauuaugaagaacacagcaaauacccggcgagggacuggaaacauaggcgagacccuuggugagaaauggaagaauagacugaacgcuuugggcaaaucugaauuucaaaucuacaagaaaagugggauucaggagguagacaggacacuggccaaggaaggaaucaaacgcggcgagacugaucaucacgcagugucgcgggggagcgcuaagcucagaugguucgucgagcguaaucugguuaccccugaaggaaagguggucgacuuaggcugcgguagagggggaugguccuauuacuguggcggucuuaaaaacgugaaggagguaaaaggccugacaaaagggggacccggccaugaagaaccuauuccaaugucuacguauggguggaaucucgugcggcuacagucaggaguugauguguucuuuacacccccugaaaaaugcgacacucuguugugugauaucggcgagagcuccccaaaccccacagucgaggccggucgcacccugcgagugcucaaucuugucgaaaacuggcugaauaacaauacucaauucugcauaaagguguugaacccguacaugccuaguguuaucgagaagauggaagcccugcagagaaaauacgggggagcgcucguaaggaauccauuaucucggaacagcacacacgagauguauugggugucaaacgcuuccggcaauauugucaguagcgugaacaugaucucucgcaugcugauuaauagauuuaccaugaggcacaagaaagcaacguacgaacccgacguugaucuuggcuccgggacccgaaacaucggaauagagucagagacaccuaaucuggacauuaucgguaagcggaucgagaaaauuaagcaggagcaugaaacuagcuggcacuaugaucaggaccauccauacaagaccugggccuaucacggcucguacgagacaaaacaaacugggucugcuaguuccauggugaacggagucgugcgucuacucaccaagcccugggacguaauaccgauggugacacagauggccaugaccgauacuacgccuuucggccagcagagaguuuuuaaagaaaaggucgacacacgcacccaagagcccaaagaggguacuaagaagcugaugaaaaucaccgcagaaugguuguggaaggagcuggggaaaaagaaaacaccaaggauguguacgcgggaagaguucaccagaaaggugcgcagcaaugccgcucucggagcgauuuuuacugaugagaacaaauggaagucagccagggaagcaguggaggacuccggcuucugggaacuugucgauaaggagcgaaaucugcacuuagaaggcaaaugcgagacauguguuuauaacaugauggggaagcgggagaaaaagcugggagaauuugguaaagcuaagggcucuagagccaucugguacaugugguugggggcaagguuccucgaguuugaagcccugggauuccuaaaugaggaccauugguuuagccgcgaaaacagucuuuccggcguggagggugaggggcugcacaagcucggauacauucugcgugauguaagcaaaaaggaaggcggcgcuauguaugccgacgauaccgcggggugggacacucggaucacauuggaggaucugaaaaaugaagagauggugaccaaccauauggaaggagagcacaagaaacucgcagaggccauauucaaacuuacauaccagaauaaggucgugagaguucagaggccuacuccccgcgguaccgugauggacaucauuucucgacgggaccagagaggcucagggcaagucgugacguauggacugaacaccuucacaaacauggaagcucaguuaaucaggcagauggagggcgaagguguauuuaaaaguauucaacagcugacuguuaaggaggagaucgccgugaaaaauugguugauucgcgucgggagagaacggcucuccaggauggcaauaagcggagaugacugcguggugaagccacuggaugaccguuucgcuucugcccuaaucgcucuuaacgauaugggcaaaguccgaaaggacauucagcagugggagcccucgcgcggcuggaaugauuggacccaaguuccuuuuugcucacaucacuuccacgaacugaucaugaaggacgggagagugcucguagugccaugucggaaccaggaugagcugaucggaagggcccgcauuagccagggugcaggcugguccuugagagaaacagcgugcuuagggaaaaguuacgcccagauguggucucugauguauuuucaucggagggaccuccgacuugcugccaaugcaauauguagcgcugucccgucccacugggugcccacuucacguaccacguggaguauccaugccacacacgaguggaugaccacugaggauaugcugacaguuuggaacagaguguggauucaagaaaauccuuggauggaggacaagaccccagucgaaucuugggaggaaauccccuaccuaggaaaacgcgaggaucaguggugcggcagccugauuggucucacuucccgggcaaccugggccaagaacauccagacagcgauaaaucaggugaggucauugaucgggaacgaggaauauacggacuacaugccuagcaugaaaagauuccgccgggaggaagaggaagcuggaguacugugguga

SEQ ID NO: 15027 - RNA, 9876 nt, Artificial Sequence
  derived and/or modified CDS sequence (opt3) from DENV-2__GQ398266__SS-prME
accgccggcaucauuauaaugaugauccccacagugauggcuuuccaccugacuacgagaaacggggagccucauaugauugucagcaggcaggaaaagggaaaaucccuccuuuuuaagaccgagaaugguguuaacaugugcacacugauggcaauggacuugggcgaauuaugugaggauacuaucaccuacaauugcccacugcuacggcaaaacgaaccggaggacauugauuguuggugcaauucuacaucaaccugggugacuuaugggacauguaccgccacgggagagcaccgccgagaaaaacguaguguagcgcucgugccccaugucggcaugggucuggagacuagaaccgaaacauggaugagcuccgagggggcuuggaagcacgcccagaggaucgagacuuggauacuucggcauccuggauucaccaucauggcagccauucuggcuuacacaaucggcaccacguauuuucagcgcguguugauuuucauccuccugacugcaguuacaccaucuauggccaugagaugcauaggcauuucgaacagggacuuuguggaaggggucucaggagguagcuggguggauaucguacuggagcacggcaguuguguuaccacuauggcuaaaaauaagcccacacucgacuucgaauuaauuaagaccgaggccaaacacccugcgacgcugcggaaguacugcguggaagcaaaacuuaccaacacaacuaccgccucccgcuguccaacacagggggagcccucuuugaaugaggaacaagauaagcgauuugucugcaaacauagcaugguggacagaggauggggcaacgguugugggcuguucggaaagggcggcaucgugacuugcgcuauguuuaccugcaagaaaaauauggaggggaaggucguucagccugaaaaccuagaguauacaaucgugauuaccccacacuccggagaagagaaugccguagguaacgauacuggcaaacaugggaaggagauaaaagugacgccgcagucaaguaucacagaagcagagcucaccggauacggcacugucaccauggaauguagccccaggacaggucuggacuucaaugagauggugcuucugcagauggaaaacaaggcuugguugguucaccggcaaugguuucucgaucugccuuuaccauggcugcccggggccgacacccagggcucuaacuggauucagaaagagacucucgugacauucaagaauccucacgcgaagaaacaggaugucgugguacuuggaucccaagagggcgccaugcauacggcacugaccggggcuacugaaauccagaugucaagcggaaacuugcuauuuacaggucaccugaagugccgucuccgcauggacaaacugcagcuuaagggcaugaguuauucuauguguaccgggaaauucaagguugugaaggagauagccgaaacacaacauggaacuauugucaucagagugcaguacgagggcgacgguuccccaugcaaaauccccuucgagauuauggaucuggaaaagaggcacgucuuggggcggcucaucaccgugaauccgauuguuacggagaaagacagcccugugaacauagaagcugagcccccauuuggcgauucguacaucauuaucggaguagaaccuggccagcugaaguuaucuugguucaaaaagggguccucaaucggacagauguuugagaccacaaugcgaggugccaagcgcauggcaauucugggcgacacugccugggauuucgggagucuaggaggcgucuuuaccagcauagguaaagcucuccaucaaguguucggggcgaucuauggcgcagccuuuuccggaguuucuuggacaaugaagauucugaucggcguggucauuacuuggaucgggaugaauagcagaucaaccagucuuuccgugagcuugguacuggugggaguugucacgcucuaccugggcgugauggugcaggcugacucugguugugucguuucauggaaaaacaaggagcuuaaaugcgggaguggaauauucaucacagauaaugugcacaccuggacugaacaguauaaguuucagcccgagagcccauccaagcuggccucugcaauucaaaaagcccacgaagagggcaucugugguauuaggucggugacacgguuggaaaaccucauguggaagcagaucacccccgagcugaaucauauauuaacugagaacgaaguaaaacugaccauuaugacaggcgacaucaaggggauuaugcaggcuggaaaacgcagccuaagaccucagccaacggagcucaaguacuccuggaaagccuggggcaaggcaaagaugcugucaaccgaacuucacaaucauacuuucuugaucgaugggccggagacagcggaaugccccaacaccaauagggcuuggaacagucuggaggucgaggacuauggauuuggcguguucacaacuaauauauggcucaaacugaaggaacgucaagauguuuuuugugacucuaaauuaaugagcgccgcaaucaaggacaaccgggccgugcacgcugauauggguuacuggauugaguccgcccugaacgacaccuggaaaaucgaaaaggcaucauucauugaggucaagagcugccacuggccuaaaucucauacgcuuugguccaaugggguguuggagagugaaaugaucauaccaaagaacuucgcuggacccguuagccagcacaauuaucgaccuggcuaccauacacagaccgccgguccauggcaccucggcagacuggagauggauuuugacuucugugaagggacuaccgugguagucacagaggauugcggaaacaggggccccucucuacgcacuaccacagcguccgggaaacugauuacggaauggugcugucggucaugcacccucccgccucugagauacaggggagaggacggcuguugguaugguauggagauccgcccacuuaaggaaaaagaggaaaauuuggugaacagucuggugacugccgggcauggacagaucgauaauuuuagcuuaggcguccucgguauggcucuguuccuugaggaaaugcugcgaacacggguuggcaccaagcacgcaauuuugcucguggccguaucguuugugacucugaucacagggaacauguccuuccgugaccuaggaagagucauggugaugguuggcgcuaccaugacggaugacauugggaugggagugacuuaccuggcccuccuggcagcguuuaaggucaggcccaccuucgccgcuggccuuuugcugcgcaaauuaacaucuaaggagcucaugaugaccacuauagguaucgugcugcuuagccaaucaacaauuccugagaguauccuggaacuaaccgaugcccucgcacuggggaugaugguuuugaaaauugugcggaauauggagaaguaucagcuggcugucacaaucauggccauauuaugcguacccaacgcagugauccuccagaaugccuggaaaguuuccuguacuacccuggcuguggucucugugagcccacuucuguugacguccucacaacagaaggcggacuggauuccucucgcccugacaaucaagggacuaaaccccaccgcaauuuuucugacuacccuuagcagaacaaauaaaaagaggaguuggccacucaacgaagcuaucauggccguaggcauggugucuauacuggccuccagcuugcugaaaaaugauauuccgaugacuggcccuuuagucgcugggggacuccugaccguuugcuacgugcuuacgggucgaucggcagaccuggaguuggaacgcgccgcggacgugcggugggaggagcaggcugaaaucucaggcucuagucccauccucuccauuacaauaagcgaggaugggucuaugagcaucaagaacgaagaggaggaacagacccugacuauucuaaucagaacaggacugcuugucauuuccggccucuucccagugucaauccccauaaccgccgcagccugguaucugugggagguuaaaaagcaaagggcugguguauugugggacgugccuaguccacccccugucgggaaagcagaauuagaggauggagccuaccguaucaagcagaagggcauucugggcuauagccagaucggggcgggaguguacaaagaagguacuuuucacacaauguggcauguuacccgcggcgcugugcucaugcacaaggggaaacggauugagccgucuugggccgacgucaagaaagaucugaucuccuacggaggcgguuggaagcuugagggggaauggaaggagggagaagaggugcagguacuggcauuggaaccaggcaaaaaccccagagccguccaaacgaagccuggccuauucaaaacuaauaccgggacaauaggagcugugucacuggacuuuaguccagguaccagcggcucccccauuguugauaagaaagggaagguggucggacucuauggcaacggugugguuacaaggucugggacuuacgugucggccaucgcacagaccgagaagagcaucgaggacaauccugaaauugaggaugacaucuuccgaaaaaagcggcugacgauaauggaucuucauccgggagcuggcaaaacaaagcgcuauuuacccgccauugucagagaagcgaucaaaaggggccugcggacucucauuuuggccccaacccgagugguagcagcugagauggaagaggcccugagagggcucccuauccgcuaccagacacccgcuauaagggcagagcacaccggacgugaaauuguggaccugaugugucaugccacuuucaccaugcggcuucugucaccaaucagaguuccuaacuauaauuugaucauuauggaugaggcccacuuuacagaccccgcuuccaucgcggcaagggguuacauuaguacgcgcgucgaaaugggcgaggccgcugggauauucaugacugccaccccaccgggaucucgagacccuuuuccccagagcaacgcaccaaucauggaugaggaaagagagauucccgaacgguccuggaauucaggccacgagugggugacagacuucaaggguaagaccgugugguuugucccuucuaucaaagccgggaacgauaucgcugcgugccuaaggaagaauggaaaaaagguaauucaacugagccgcaaaacuuucgacagugaauauauaaagacacguaccaacgauugggacuuugugguuacgacugauaucuccgagaugggcgccaauuucaaggcagagagagugauugacccacggagguguaugaaacccgucauccucacagauggcgaagagcgcgugauuuuagcugggccuaugccgguuacccauagcucugccgcacagcgaagaggacggguggguaggaacccaaagaaugaaaacgaccaguacaucuacaugggcgagccccuggaaaaugaugaggacugcgcccacuggaaagaggcuaagaugcuucuggacaacauaaacaccccugaagggaucauucccucaauguuugagccagaacgcgagaaagucgaugccaucgacggagaauauagacucaggggcgaggcgcggaagacuuucguggauuugaugcgucgcggugaccugccuguauggcucgcauaccgaguggccgcugaggggauuaauuaugccgauagaaggugguguuuugacggcguuaaaaacaaucaaauccuggaagagaacgucgaaguggagauauggacaaaggagggagaacggaagaaacuuaagccccgcuggcuagaugcuagaauuuacuccgacccacuggcauugaaagaguucaaggaauucgccgcuggcaggaaaaguuuaacccugaaucucaucacagagauggggcggcugccuacuuuuaugacgcagaaggccaagaacgcacuugauaaucuggcggugcuccauaccgccgaagcuggaggucgagccuauaaccacgcauugagcgagcugccggagacacuagaaacucugcuccuucugaccuuauuggcuacagucaccggcgggauuuuccuguuucucaugucgggaaaaggcaucgguaagaugacucuggggaugugcugcauaaucacggccucuauucuucugugguacgcacagauccagccccacuggauugccgcuuccaucauacucgaguucuuuuugauuguucuguuaaucccagaaccugagaaacaaagaaccccccaggacaaucagcuaacauaugugguaaucgcgauucugacuguggucgccgcaaccauggcuaacgaaaugggcuuccucgagaagacaaaaaaggauuuuggacuuggcagcaucaccacucagcaaccagagucaaauauacuggacauugauuugcgcccugccagugccuggacacuguacgcaguggcuacgaccuucaucacucccaugcucaggcauucuauugaaaacuccagcguuaaugugucacugacagccaucgcgaaccaggcuaccguccuuauggggcucggaaaggguuggccgcugaguaaaauggacauaggcguaccauugcuggccaucggguguuacagccaggugaauccuauuaccuuaaucgcagcccuacugcuccuuguugcucacuaugcaauuaucggacccggccugcaggccaaggcgacacgggaggcucaaaaacgugccgcagccgguauuaugaagaacccaacuguggacgggaugacggucaucgauuuggaccccauaccuuacgauccgaaauuugaaaagcagcugggccaggugaugcuccugguccuuugcgugacccagguuuuaaugaugagaacaacuugggcucugugugaggcccucaccuuggcaacaggacccauuuccacccugugggaaggcaauccagggagguucuggaacacuacgaucgcugugucuauggccaacaucuuucgcggaagcuaucuagcgggcgccggucugcucuucuccauuaugaagaauacagcaaacacccggcgagggacuggaaauaccggcgagacacuuggugagaaauggaagaacagacugaaugcuuugggcaaaucagaauuucaaauauacaagaaaucugggauccaggagguagacaggacucuggccaaggaaggaauuaaacgcggcgagaccgaucaucacgcagugagucgggggucggcuaagcucagaugguucgucgagcguaaccugguuacaccugaaggaaagguggucgacuuaggcugcgguagggggggauggagcuauuacuguggcggucuuaaaaaugugaaggagguaaaaggccugacgaaggggggacccggccaugaagagccuaucccaauguccaccuauggguggaaccucgugcggcuacagucuggaguugauguguucuuuacucccccugaaaaaugcgacacacuguugugugauauuggcgagucaagcccaaaucccaccgucgaggccggucgcacucugcgagugcucaaccuugucgaaaauuggcugaacaauaacacacaauucugcaucaagguguugaauccguacaugccuuccguuauagagaagauggaagcccugcagagaaaauacgggggagcgcucguaaggaacccauuaagucggaacucuacccacgagauguauugggugagcaaugcuucaggcaacaucgucuccagugugaauaugauuagccgcaugcugaucaacagauuuacgaugaggcacaagaaagcaaccuacgaacccgacguugaucuuggcucugggacacgaaauauuggaaucgaguccgagacuccuaaccuggacauaauugguaagcggaucgaaaaaaucaagcaggagcaugaaaccucauggcacuaugaucaggaccauccauacaagacaugggccuaucacggcagcuacgagacuaaacaaaccgggucggcuucuaguauggugaauggagucgugcgucuacucacaaagcccugggacguaauuccgauggugacccagauggccaugacugauacgacaccuuucggccagcagagaguuuuuaaagaaaaggucgacacccgcacucaagagcccaaagaggguaccaagaagcugaugaaaauaacagcagaaugguuguggaaggagcuggggaaaaagaaaacgccaaggauguguacccgggaagaguucacuagaaaggugcgcuccaacgccgcucucggagcgaucuuuacagaugagaauaaauggaagagcgccagggaagcaguggaggacucaggcuucugggaacuugucgauaaggagcgaaaccugcacuuagaaggcaaaugcgagaccuguguuuauaauaugauggggaagcgggagaaaaagcugggagaauuugguaaagcuaagggcuccagagccauuugguacaugugguugggggcaagguuccucgaguuugaagcccugggauuccuaaacgaggaccauugguuuucucgcgaaaauagccuuaguggcguggagggugaggggcugcacaagcucggauacauccugcgugauguauccaaaaaggaaggcggcgcuauguaugccgacgauacugcggggugggacacacggauuaccuuggaggaucugaaaaacgaagagauggugacaaaucauauggaaggagagcacaagaaacucgcagaggccaucuucaagcuuacuuaccagaacaaggucgugagaguucagaggccuaccccccgcgguacggugauggacauaaucagccgacgggaccagagaggcucugggcaagucgugaccuauggacugaacacauucacuaauauggaagcucaguuaauuaggcagauggagggcgaagguguauuuaaaucaauccaacagcugaccguuaaggaggagauugccgugaaaaacugguugauccgcgucgggagagaacggcucaguaggauggcaauuuccggagaugacugcguggugaagccacuggaugaccguuucgcuagcgcccuaacagcucuuaaugauaugggcaaaguccgaaaggacauacagcagugggagcccucucgcggcuggaacgauuggacucaaguuccuuuuugcucgcaucacuuccacgaacugaucaugaaggacgggagagugcucguagugccaugucggaaucaggaugagcugauuggaagggcccgcaucucacagggugcaggcuggagcuugagagaaaccgcgugcuuagggaaauccuacgcccagauguggagucugauguauuuucaucggagggaccuccgacuugcugccaacgcaaucuguucugcugucccgagccacugggugcccacgucccguacaaccuggucaauucaugccacucacgaguggaugacaaccgaggauaugcugacuguuuggaauagaguguggauacaagaaaacccuuggauggaggacaagaccccagucgaaaguugggaggaaauccccuaccuaggaaaacgcgaggaucaguggugcggcucucugauuggucucacaagccgggcaacgugggccaagaauauccagaccgcgauuaaccaggugagguccuugaucgggaaugaggaauauacugacuacaugccuucaaugaaaagauuccgccgggaggaagaggaagcuggaguacugugguga

SEQ ID NO: 15028 - RNA, 9876 nt, Artificial Sequence
  derived and/or modified CDS sequence (opt3) from DENV-2__GQ398265__SS-prME
accgccggcaucauuauaaugaugauccccacagugauggcuuuccaccugacuacgagaaacggggagccucauaugauugucagcaggcaggaaaagggaaaaucccuccuuuuuaagaccgagaaugguguuaacaugugcacacugauggcaauggacuugggcgaauuaugugaggauacuaucaccuacaauugcccacugcuacggcaaaacgaaccggaggacauugauuguuggugcaauucuacaucaaccugggugacuuaugggacauguaccgccacgggagagcaccgccgagaaaaacguaguguagcgcucgugccccaugucggcaugggucuggagacuagaaccgaaacauggaugagcuccgagggggcuuggaagcacgcccagaggaucgagacuuggauacuucggcauccuggauucaccaucauggcagccauucuggcuuacacaaucggcaccacguauuuucagcgcguguugauuuucauccuccugacugcaguuacaccaucuauggccaugagaugcauaggcauuucgaacagggacuuuguggaaggggucucaggagguagcuggguggauaucguacuggagcacggcaguuguguuaccacuauggcuaaaaauaagcccacacucgacuucgaauuaauuaagaccgaggccaaacacccugcgacgcugcggaaguacugcguggaagcaaaacuuaccaacacaacuaccgccucccgcuguccaacacagggggagcccucuuugaaugaggaacaagauaagcgauuugucugcaaacauagcaugguggacagaggauggggcaacgguugugggcuguucggaaagggcggcaucgugacuugcgcuauguuuaccugcaagaaaaauauggaggggaaggucguucagccugaaaaccuagaguauacaaucgugauuaccccacacuccggagaagagaaugccguagguaacgauacuggcaaacaugggaaggagauaaaagugacgccgcagucaaguaucacagaagcagagcucaccggauacggcacugucaccauggaauguagccccaggacaggucuggacuucaaugagauggugcuucugcagauggaaaacaaggcuugguugguucaccggcaaugguuucucgaucugccuuuaccauggcugcccggggccgacacccagggcucuaacuggauucagaaagagacucucgugacauucaagaauccucacgcgaagaaacaggaugucgugguacuuggaucccaagagggcgccaugcauacggcacugaccggggcuacugaaauccagaugucaagcggaaacuugcuauuuacaggucaccugaagugccgucuccgcauggacaaacugcagcuuaagggcaugaguuauucuauguguaccgggaaauucaagguugugaaggagauagccgaaacacaacauggaacuauugucaucagagugcaguacgagggcgacgguuccccaugcaaaauccccuucgagauuauggaucuggaaaagaggcacgucuuggggcggcucaucaccgugaauccgauuguuacggagaaagacagcccugugaacauagaagcugagcccccauuuggcgauucguacaucauuaucggaguagaaccuggccagcugaaguuaucuugguucaaaaagggguccucaaucggacagauguuugagaccacaaugcgaggugccaagcgcauggcaauucugggcgacacugccugggauuucgggagucuaggaggcgucuuuaccagcauagguaaagcucuccaucaaguguucggggcgaucuauggcgcagccuuuuccggaguuucuuggacaaugaagauucugaucggcguggucauuacuuggaucgggaugaauagcagaucaaccagucuuuccgugagcuugguacuggugggaguugucacgcucuaccugggcgugauggugcaggcugacucugguugugucguuucauggaaaaacaaggagcuuaaaugcgggaguggaauauucaucacagauaaugugcacaccuggacugaacaguauaaguuucagcccgagagcccauccaagcuggccucugcaauucaaaaagcccacgaagagggcaucugugguauuaggucggugacacgguuggaaaaccucauguggaagcagaucacccccgagcugaaucauauauuaacugagaacgaaguaaaacugaccauuaugacaggcgacaucaaggggauuaugcaggcuggaaaacgcagccuaagaccucagccaacggagcucaaguacuccuggaaagccuggggcaaggcaaagaugcugucaaccgaacuucacaaucauacuuucuugaucgaugggccggagacagcggaaugccccaacaccaauagggcuuggaacagucuggaggucgaggacuauggauuuggcguguucacaacuaauauauggcucaaacugaaggaacgucaagauguuuuuugugacucuaaauuaaugagcgccgcaaucaaggacaaccgggccgugcacgcugauauggguuacuggauugaguccgcccugaacgacaccuggaaaaucgaaaaggcaucauucauugaggucaagagcugccacuggccuaaaucucauacgcuuugguccaaugggguguuggagagugaaaugaucauaccaaagaacuucgcuggacccguuagccagcacaauuaucgaccuggcuaccauacacagaccgccgguccauggcaccucggcagacuggagauggauuuugacuucugugaagggacuaccgugguagucacagaggauugcggaaacaggggccccucucuacgcacuaccacagcguccgggaaacugauuacggaauggugcugucggucaugcacccucccgccucugagauacaggggagaggacggcuguugguaugguauggagauccgcccacuuaaggaaaaagaggaaaauuuggugaacagucuggugacugccgggcauggacagaucgauaauuuuagcuuaggcguccucgguauggcucuguuccuugaggaaaugcugcgaacacggguuggcaccaagcacgcaauuuugcucguggccguaucguuugugacucugaucacagggaacauguccuuccgugaccuaggaagagucauggugaugguuggcgcuaccaugacggaugacauugggaugggagugacuuaccuggcccuccuggcagcguuuaaggucaggcccaccuucgccgcuggccuuuugcugcgcaaauuaacaucuaaggagcucaugaugaccacuauagguaucgugcugcuuagccaaucaacaauuccugagaguauccuggaacuaaccgaugcccucgcacuggggaugaugguuuugaaaauugugcggaauauggagaaguaucagcuggcugucacaaucauggccauauuaugcguacccaacgcagugauccuccagaaugccuggaaaguuuccuguacuacccuggcuguggucucugugagcccacuucuguugacguccucacaacagaaggcggacuggauuccucucgcccugacaaucaagggacuaaaccccaccgcaauuuuucugacuacccuuagcagaacaaauaaaaagaggaguuggccacucaacgaagcuaucauggccguaggcauggugucuauacuggccuccagcuugcugaaaaaugauauuccgaugacuggcccuuuagucgcugggggacuccugaccguuugcuacgugcuuacgggucgaucggcagaccuggaguuggaacgcgccgcggacgugcggugggaggagcaggcugaaaucucaggcucuagucccauccucuccauuacaauaagcgaggaugggucuaugagcaucaagaacgaagaggaggaacagacccugacuauucuaaucagaacaggacugcuugucauuuccggccucuucccagugucaauccccauaaccgccgcagccugguaucugugggagguuaaaaagcaaagggcugguguauugugggacgugccuaguccacccccugucgggaaagcagaauuagaggauggagccuaccguaucaagcagaagggcauucugggcuauagccagaucggggcgggaguguacaaagaagguacuuuucacacaauguggcauguuacccgcggcgcugugcucaugcacaaggggaaacggauugagccgucuugggccgacgucaagaaagaucugaucuccuacggaggcgguuggaagcuugagggggaauggaaggagggagaagaggugcagguacuggcauuggaaccaggcaaaaaccccagagccguccaaacgaagccuggccuauucaaaacuaauaccgggacaauaggagcugugucacuggacuuuaguccagguaccagcggcucccccauuguugauaagaaagggaagguggucggacucuauggcaacggugugguuacaaggucugggacuuacgugucggccaucgcacagaccgagaagagcaucgaggacaauccugaaauugaggaugacaucuuccgaaaaaagcggcugacgauaauggaucuucauccgggagcuggcaaaacaaagcgcuauuuacccgccauugucagagaagcgaucaaaaggggccugcggacucucauuuuggccccaacccgagugguagcagcugagauggaagaggcccugagagggcucccuauccgcuaccagacacccgcuauaagggcagagcacaccggacgugaaauuguggaccugaugugucaugccacuuucaccaugcggcuucugucaccaaucagaguuccuaacuauaauuugaucauuauggaugaggcccacuuuacagaccccgcuuccaucgcggcaagggguuacauuaguacgcgcgucgaaaugggcgaggccgcugggauauucaugacugccaccccaccgggaucucgagacccuuuuccccagagcaacgcaccaaucauggaugaggaaagagagauucccgaacgguccuggaauucaggccacgagugggugacagacuucaaggguaagaccgugugguuugucccuucuaucaaagccgggaacgauaucgcugcgugccuaaggaagaauggaaaaaagguaauucaacugagccgcaaaacuuucgacagugaauauauaaagacacguaccaacgauugggacuuugugguuacgacugauaucuccgagaugggcgccaauuucaaggcagagagagugauugacccacggagguguaugaaacccgucauccucacagauggcgaagagcgcgugauuuuagcugggccuaugccgguuacccauagcucugccgcacagcgaagaggacggguggguaggaacccaaagaaugaaaacgaccaguacaucuacaugggcgagccccuggaaaaugaugaggacugcgcccacuggaaagaggcuaagaugcuucuggacaacauaaacaccccugaagggaucauucccucaauguuugagccagaacgcgagaaagucgaugccaucgacggagaauauagacucaggggcgaggcgcggaagacuuucguggauuugaugcgucgcggugaccugccuguauggcucgcauaccgaguggccgcugaggggauuaauuaugccgauagaaggugguguuuugacggcguuaaaaacaaucaaauccuggaagagaacgucgaaguggagauauggacaaaggagggagaacggaagaaacuuaagccccgcuggcuagaugcuagaauuuacuccgacccacuggcauugaaagaguucaaggaauucgccgcuggcaggaaaaguuuaacccugaaucucaucacagagauggggcggcugccuacuuuuaugacgcagaaggccaagaacgcacuugauaaucuggcggugcuccauaccgccgaagcuggaggucgagccuauaaccacgcauugagcgagcugccggagacacuagaaacucugcuccuucugaccuuauuggcuacagucaccggcgggauuuuccuguuucucaugucgggaaaaggcaucgguaagaugacucuggggaugugcugcauaaucacggccucuauucuucugugguacgcacagauccagccccacuggauugccgcuuccaucauacucgaguucuuuuugauuguucuguuaaucccagaaccugagaaacaaagaaccccccaggacaaucagcuaacauaugugguaaucgcgauucugacuguggucgccgcaaccauggcuaacgaaaugggcuuccucgagaagacaaaaaaggauuuuggacuuggcagcaucaccacucagcaaccagagucaaauauacuggacauugauuugcgcccugccagugccuggacacuguacgcaguggcuacgaccuucaucacucccaugcucaggcauucuauugaaaacuccagcguuaaugugucacugacagccaucgcgaaccaggcuaccguccuuauggggcucggaaaggguuggccgcugaguaaaauggacauaggcguaccauugcuggccaucggguguuacagccaggugaauccuauuaccuuaacagcagcccuacugcuccuuguugcucacuaugcaaucauuggacccggccugcaggccaaggcgacucgggaggcucaaaaacgugccgcagccgguaucaugaagaacccaacgguggacgggaugaccgucauugauuuggaccccaucccuuacgauccgaaauuugaaaagcagcugggccaggugaugcuccugguccuuugcgugacacagguuuuaaugaugagaacuaccugggcucugugugaggcccucacauuggcaaccggacccauauccacucugugggaaggcaauccagggagguucuggaacacgacaauugcugugucuauggccaacaucuuucgcggaagcuaucuagcgggcgccggucugcucuucuccaucaugaagaauaccgcaaacacucggcgagggaccggaaauacaggcgagacucuuggugagaaauggaagaacagacugaaugcuuugggcaaaucagaauuucaaauuuacaagaaaucugggauacaggagguagacaggacccuggccaaggaaggaaucaaacgcggcgagacagaucaucacgcagugagucgggggucggcuaagcucagaugguucgucgagcguaaccugguuacgccugaaggaaagguggucgacuuaggcugcgguagggggggauggagcuauuacuguggcggucuuaaaaaugugaaggagguaaaaggccugaccaaggggggacccggccaugaagagccuauuccaauguccacuuauggguggaaccucgugcggcuacagucuggaguugauguguucuuuacacccccugaaaaaugcgacacccuguugugugauaucggcgagucaagcccaaaucccacugucgaggccggucgcacacugcgagugcucaaccuugucgaaaauuggcugaacaauaacacccaauucugcauuaagguguugaauccguacaugccuuccguuaucgagaagauggaagcccugcagagaaaauacgggggagcgcucguaaggaacccauuaagucggaacucuacgcacgagauguauugggugagcaaugcuucaggcaacauagucuccagugugaauaugaucagccgcaugcugauuaacagauuuaccaugaggcacaagaaagcaacauacgaacccgacguugaucuuggcucugggacucgaaauaucggaauugaguccgagaccccuaaccuggacaucauagguaagcggauugaaaaaaucaagcaggagcaugaaacaucauggcacuaugaucaggaccauccauacaagacuugggccuaucacggcagcuacgagaccaaacaaacagggucggcuucuaguauggugaauggagucgugcgucuacucaccaagcccugggacguaaucccgauggugacucagauggccaugacggauacaaccccuuucggccagcagagaguuuuuaaagaaaaggucgacacucgcacccaagagcccaaagaggguacaaagaagcugaugaaaauuacggcagaaugguuguggaaggagcuggggaaaaagaaaaccccaaggauguguacucgggaagaguucacaagaaaggugcgcuccaacgccgcucucggagcgauauuuaccgaugagaauaaauggaagagcgccagggaagcaguggaggacucaggcuucugggaacuugucgauaaggagcgaaaccugcacuuagaaggcaaaugcgagacuuguguuuauaauaugauggggaagcgggagaaaaagcugggagaauuugguaaagcuaagggcuccagagccaucugguacaugugguugggggcaagguuccucgaguuugaagcccugggauuccuaaacgaggaccauugguuuucucgcgaaaauagccuuaguggcguggagggugaggggcugcacaagcucggauacauucugcgugauguauccaaaaaggaaggcggcgcuauguaugccgacgauacagcggggugggacacccggaucacauuggaggaucugaaaaacgaagagauggugacuaaucauauggaaggagagcacaagaaacucgcagaggccauuuucaagcuuaccuaccagaacaaggucgugagaguucagaggccuacgccccgcgguaccgugauggacaucauaagccgacgggaccagagaggcucugggcaagucgugacauauggacugaacacuuucaccaauauggaagcucaguuaaucaggcagauggagggcgaagguguauuuaaaucaauucaacagcugacaguuaaggaggagaucgccgugaaaaacugguugauucgcgucgggagagaacggcucaguaggauggcaaucuccggagaugacugcguggugaagccacuggaugaccguuucgcuagcgcccuaacugcucuuaaugauaugggcaaaguccgaaaggacauucagcagugggagcccucucgcggcuggaacgauuggacccaaguuccuuuuugcucgcaucacuuccacgaacugauaaugaaggacgggagagugcucguagugccaugucggaaucaggaugagcugaucggaagggcccgcauuucacagggugcaggcuggagcuugagagaaacggcgugcuuagggaaauccuacgcccagauguggagucugauguauuuucaucggagggaccuccgacuugcugccaacgcaaucuguucugcugucccgagccacugggugcccacaucccguaccacuuggucaauccaugccacacacgaguggaugaccacugaggauaugcugaccguuuggaauagaguguggauucaagaaaacccuuggauggaggacaagacaccagucgaaaguugggaggaaauacccuaccuaggaaaacgcgaggaucaguggugcggcucucugaucggucucacgagccgggcaaccugggccaagaauauucagacugcgaucaaccaggugagguccuugauugggaaugaggaauauacagacuacaugccuucaaugaaaagauuccgccgggaggaagaggaagcuggaguacugugguga

SEQ ID NO: 15029 - RNA, 9876 nt, Artificial Sequence
  derived and/or modified CDS sequence (opt3) from DENV-2__KX702403__SS-prME
accgccggcgugaucgucaugcugauuccaacagcuauggcguuccaccucacuacgagaaacggggagccucauaugauaguuggaaggcaggaaaaggguaaaagccuucuguuuaagaccgaggacggcgugaauaugugcacauugauggccaucgauuuaggggaacugugugaggacacuauuaccuacaaaugcccacugcuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucauccugauucugcucacagcaguggccccauccaugaccaugagaugcaucgggauaucuaacagggauuucgucgaaggagugucggguggcucauggguagacauuguuuuagagcacgggagcugugugacuacaauggcuaagaauaagcccacccuggauuuugaacuuaucaaaacggaggccaagcagccugcgaccuugcggaaauauugcauugaagcaaagcugacaaacacuaccacagagagucgcuguccaacucaaggagagcccucccuaaaugaagaacaggacaaacgauucaucugcaagcauucuauggucgauagaggcugggguaacggguguggacucuuuggcaagggcgggaucgugaccugcgccauguucacaugcaaaaagaauauggaaggaaaaauugugcagccugagaaccuggaauacaccauagucaucacuccacacagcggugaggagcaugcuguuggcaaugacacggggaagcacggaaaagaaauuaagaucacaccgcaguccucaaccacugaggccgaacuuaccggcuaugguacagugaccauggaguguagucccaggacugggcuggauuuuaacgaaaugguauugcuccaaauggaggacaaagcauggcuggugcaccggcagugguucuuagaucugccucucccauggcuucccggcgcugacacacagggaagcaauuggauacagaaggagacgcuggucaccuuuaagaacccucaugccaaaaagcaagacgugguuguguugggcucucaggaaggggcgaugcacacugcccuaacaggagcaaccgagauucagauguccucagguaaucuacucuucacaggccaucugaaaugccgucuucgcauggauaagcugcaauugaaagggaugagcuacaguauguguacuggaaaguuuaagaucgucaaagaaaucgcugagacccagcacggcacgauugugaucagaguacaguaugagggugacgggucuccaugcaagauucccuucgaaauaaccgaucucgagaaaaggcauguucugggccgguuaaucacagugaacccgauugucacugaaaaggacuccccugugaacaucgaggccgaacccccauucggagauagcuacaucauugucggcguggagccugggcagcugaaacuaaauugguuuaagaagggaucgucuauaggucaaauguucgagaccacaaugcgaggcgcuaaacgcauggccauccucggggacacugcaugggauuuuggaucccugggcgguguuuucaccucaauugggaaggcccuucaccagguguuuggcgcuaucuacggagcggcauucaguggcguaagcuggacgaugaaaauuuugaucggggucauaaucacauggauuggaaugaacuccagaucuaccagccugucagugagucucguucuggugggcgucgugacucuuuaucugggugccaugguacaggcugacuccggguguaucgugagcuggaagaauaaagaauugaagugcggaucuggcauuuuuaucacagauaacguucacaccuggacugagcaguacaaguuccaacccgaaucaccaaguaaacucgccagcgcaauacagaaggcccaugaggaagguauuuguggcaucagguccgucacccggcuggagaauuuaauguggaaacagauuacacccgagcugaaccacauccuaucugaaaaugaggugaagcucacgauaaugaccggggacaucaaaggaauuaugcaggcuggcaagcgcucgcugagaccucaaccaacugaacuuaaauauagcuggaagacaugggggaaggccaaaauguuguccaccgagucacauaaccagacauuucugaucgauggaccggaaacugcagagugccccaauaccaacagggcguggaauagucucgagguggaagacuacggcuucggugucuuuacgacaaacauuuggcugaaguuacgugagaaacaggacguuuucugugauucuaagcugaugagcgcugccaucaaagacaaucgggcagugcacgccgauaugggguauuggauagaauccgcucuuaacgacaccuggaagauggagaaggccucauuuauugaggugaaaagcugccacuggccuaagucucauacuuugugguccaauggaguacucgaaagugagaugaucauccccaagaacuucgcaggccccgucagccagcacaacuaccgaccugguuaucauacccaaacagcuggcccauggcaccuggggaagcuagaaauggauuucgacuuuugugagggaacuaccgugguugugacagaagauugcgagaaaagaggccccucucugaggacgaccacugccuccgggaagcucauuacagaguggugcugucgcucaugcacccugccgccucuucgguacagaggagaagacggcuguugguacgguauggagaucaggccauugaaggaaaaagaggaaaaucuggucaacaguuuagugacugcggggcauggacagauugauaauuucagccucggcguucuggguauggcccuuuuucuggaggagauguugcgcacacgagugggcaccaagcacgcuauacuccugguagcacuaucguucgucacgcugaucacugggaacauguccuuucgggaccucggacgugugauggugauggucggcgccaccaugacagaugacauugggaugggaguuaccuaucuggcucuuuuggccgcauucaaagugagacccacuuuugcggccggccuguuacucaggaagcugacaucuaaagaacuuaugauggcuaccaucgguauugcccugcuaagccagucaacacucccugagacuauccuggaauugaccgaugcacuggcuuuagggaugauggcccucaagauaguacgcaauauggagaaguaccaacuggcagugacgaucauggccauuaguugcguccccaacgcugugauccuucagaaugcguggaaaguuuccuguacaauucuggccgcagugucugucagcccauugcuccugaccuccucacagcagaaggcugacuggaucccucuagcccugacuauaaaaggacuuaaccccaccgccauuuuccucacaacucugagccggaccaguaagaaaagaucuuggccauugaaugaagcuaucauggcagugggcaugguuuccauccuggccagcucguuacucaagaacgacauuccgaugacgggcccucugguggcagggggacuucugacagucugcuauguauugaccgguaggucagcugaucucgagcuggagcgagccgcagacgugaaaugggaagaucaagccgagauaucuggcaguucccccauccuaagcauuacuaucucugaagacgggagcauguccauuaagaaugaggaggaagaacagacacugaccauccuuauacgcacuggacuccugguuaucucaggcguguuuccagucaguauucccaucacagcugcagccugguacuugugggaagugaagaaacagcgggcggguguauuaugggaugugccuagcccacccccugucgggaaggcugagcuggaagacggagccuauagaauuaaacagaggggcauccucggcuacucucaaauaggggcaggaguuuauaaggaggguaccuuccacacgauguggcaugugacucguggcgccgugcugaugcaccgcgggaaacggauugagccguccugggcugaugucaagaaggaccuuaucucauacggaggcgguuggaaacuggaaggggaguggaaggaaggagaggaagugcagguuuuggcccuagagccaggcaaaaaccccagagcaguacagaccaagccuggcaucuuuaaaacaaauaccgggacaauuggagcugugagucuggauuucagcccagguacuuccggcucucccaucgucgacaggaaggggaaggugguuggacucuacggcaacgguguggucacccgaucgggggccuaugugagcgcgauagcccagacggagaaaucaauugaagauaauccugagaucgaagacgauauuuuucggaagaaacgccugacaaucauggaccuucauccgggagcaggcaagacuaaaagauacuuacccgcuauaguaagggaggccauuaagcggggccugcgaacccucaucuuggcuccaacaagagucguggcagccgaaauggaggaggcccugcgcgggcucccuaucagguaucaaacccccgcuauucgugcggaacacacuggacgggagaucguugaccugaugugucaugcaaccuucacaaugagacuucuguccccagugagggucccuaacuacaacuugauuauaauggaugaagcccacuucacggaccccgcuaguaucgccgcacgcgguuauauuucuacucgaguggagaugggcgaggccgcugggaucuuuaugaccgcgacaccaccgggaagcagagauccuuucccccaguccaaugccccaaucauggacgaggaacgggaaauucccgagaggucauggaacucuggccacgaauggguuaccgauuuuaaggguaaaacugugugguucgucccuagcauaaaggcagggaaugacaucgcugccugccuacgcaaaaacggaaagaaagugauucagcugagucguaagacauuugauuccgaguacguaaagaccagagcaaaugacugggauuucgugguuacgacugacaucagcgagaugggcgccaacuuuaaagcugaacgggucauugauccaaggcgcuguaugaagcccgugauccucacagacggcgaggaacgagugauauuagccgggccuaugccggucacccauucuucagcggcacaaagacggggaaggaucggucgcaaucccaagaacgagaaugaccaguauauuuacaugggcgaaccccuggagaacgaugaggacugcgcccacuggaaggaagcuaaaaugcuucuggauaauaucaacaccccugaggggauuauccccuccauguucgaaccagagagagaaaagguagacgccauagauggagaguacaggcuccggggcgaggcucguaaaacuuuuguggacuugaugcgccgaggugaucugccuguuuggcucgcauauaagguggccgcugaagggauuaauuacgccgacagaaagugguguuucgauggcaucaaaaacaaucagauucuggaggaaaacgucgagguggagaucuggacaaaggaaggagagaggaagaaacuuaaaccccgguggcuagacgcacgcauauauagugauccacuggcguugaaagaauuuaaggaguucgccgcuggcagaaagagcuuaacccugaaccucaucacagaaauggggaggcugccuacuuucaugacgcagaaggcccggaaugcacuugacaaccuggcuguucuccauaccgccgaggugggagguaaagcauacacacacgccuugucggagcugccggaaacucuagagacccugcuccuucugacauuauuggcugcggucaccggcgggauuuuucuguuccucaugucuggaaagggcaucgguaaaaugacucuggggaugugcugcauuaucacggccuccauacuucugugguaugcacaaauucagccccacuggaucgcugccagcaucauucucgaauuuuucuugaucgugcuguuaauaccagagccugaaaagcagcgaacaccacaggauaaucaacuaacauacguagugauugccauccugacuguugucgcagcuaccauggccaacgagaugggcuuucucgagaagaccaagaaagaccuuggauucggcucaauuaccacucaggaaagugagucuaauauccuggacauagauuugagaccagcguccgcuuggacacuguaugccguggcaacgaccuuugugacuccuaugcuccgccauagcaucgaaaacucaagugucaauguuagccugacagccauugcuaaccaggcaaccgugcuuauggggcucggaaaagguuggccccuguccaaaauggacaucggcguaccguugcuggccauuggguguuacucucaggugaauccaaucaccuuaacagcggcucuacugcuccuugucgcccacuacgcaauuaucggaccuggccugcaagccaaagcuacuagggaggcccagaagcgggcagcugccgguauaaugaagaaccccacgguggaugggauuaccguuaucgacuuggaaccaaucccccaugauccuaaauucgagaagcagcugggccaggugaugcuccugauucuuugcgucacacaaguauuaaugaugcguacuaccugggcgcugugugaggcccucacauuggcaaccggaccgauaagcacucugugggaaggcaaucccgggagauuuuggaacacgacaaucgcuguguccauggccaauauuuucaggggaucauaucuagcaggcgcuggucugcucuuuucuaucaugaaaaacaccacuaauacccgccgggggacaggaaacguuggcgagacucuuggugaaaaguggaaaagucgacugaaugccuugggcaagucggaguuccagauuuacaaaaagagcgggauccaggagguggacagaacccuggccaaggaaggaauaaaaaggggcgagacagaucaccaugcggucucccgcgggucugcuaagcuccggugguuuguggaaagaaacauggucacgccagagggaaaagugguugaccugggcugcggucgugggggauggucauauuacuguggcgguuuaaagaacgugagggaaguaaaaggccuuaccaaagggggaccuggccacgaggagcccaucccuaugagcacuuauggguggaaucuggugcggcuccaauccggagucgauguuuucuucacaccacccgaaaagugcgacacccuacugugugauauuggcgagaguucuccuaacccaacuaucgaagcaggucgcacauugcgagugcugaaucucgucgagaacuggcuuaauaacaauacccaguuuugcauuaaagugcugaaccccuacaugccgagcguaaucgaaaagauggagacguugcagagaaaauaugggggagcccuggugaggaauccucucucacggaacuccacccacgagauguacuggguuaguaaugcuacaggcaacauagugagcucugucaauaugauuucccgcauguuaaucaacagauucacuaugaagcauaaaaaggccaccuacgaaccagacguggaucugggcucagggacaaggaauaucggaauugagagcgaaacucccaaccuugacauaaucgguaagcgaauugagaaaaucaagcaggaacacgagaccucguggcauuaugaccaagaucacccuuacaaaacaugggcauaucacggcucuuacgagaccaagcagacugggagugccuccagcauggucaacggagugguucggcugcuaacgaaaccaugggacguagugcccauggucacacagauggcuaugaccgauacuaccccguuuggccagcaacguguguucaaggaaaagguugacacaagaacgcaggagccuaaagaagguaccaagaaacucaugaagauuacugcggaguggcuguggaaagaguuggggaaggagaaaacaccccgcauguguaccagggaggaauuuacucggaaggugagaucaaaugccgcacugggagcugucuucacagaugagaacaaguggaaauccgcccgcgaagcaguggaggacggcagguuuugggagcucguagaucgagaacggaaucuucaucuggagggcaagugcgaaaccuguguguauaacaugauggggaaaagagagaagaaauuaggagaguucgguaaggccaagggcucuagggcuaucugguacauguggcugggggcccgcuuuuuggaguucgaggcgcucggauuucugaaugaagaccacugguucagccguggcaacagucuauccgguguugagggggaaggacuucaucggcugggcuauauacucagagaggucggcaaaaaggaagggggagcaauguacgccgaugacacagcugguugggauacuaggaucacccuggaggacuugaaaaaugaggaaauggugacgaaccacaugaagggcgagcauaaaaagcuggccgaagcaauuuuuaagcucaccuaccagaauaaagugguccgcguucagcgaccaacaccucgggggacugugauggacaucauuagcagaaaggaucaaaggggaucuggccagguagguaccuaugggcuuaacacauucacuaauauggaggcucagcugauccgccaaauggagggagaaggcauuuucaaaucaauacagcacuuaaccgccacggaggaaacagcugugcagaacuggcuggccagagucggccgggagagguugagucguauggcaaucuccggggacgauugcgugguuaagcccauugacgaucgauuugcgagcgcccucaccgcucugaaugacaugggaaaagugcgcaaggauauccagcaaugggaaccaucuagagguuggaacgacuggacucagguccccuucugcucgcaccauuuucacgagcuagugaugaaggauggccggguacuuguugugccuuguaggaaucaggacgagcugaucgggcgcgccagaauuucacagggagcaggcuggagccucaaagaaacagcuugccuggguaaguccuacgcccaaauguggaccuugauguauuuccaucggagggauuuacgacuggcagccaacgcgauauguagugcugucccaucucacugggugccgacuagccguaccacaugguccauccacgccaaacaugaguggaugacgaccgaagacaugcucgcaguguggaacagagucuggauucaggagaaucccuggauggaagauaagacuccuguugagucaugggaggaagugccauaccuugggaaacgcgaggaccaguggugcggaagucugaucggccuaacaucucgggccaccugggcuaagaacauucagacugccaucaaucaaguaaggagccugauaggcaacgaaggguauacagacuacaugcccuccaugaagagauuucgccgggaggaagaggaggcaggagugcucugguga

SEQ ID NO: 15030 - RNA, 9876 nt, Artificial Sequence
  derived and/or modified CDS sequence (opt3) from DENV-2__KX702404__SS-prME
accgccggcgugaucgucaugcugauucccacagcuauggcauuccaccucacuacgagaaacggggagccucauaugauaguuggaaggcaggaaaaggguaaaagccuucuguuuaagaccgaggacggcgugaauaugugcacauugauggccaucgauuuaggggaacugugugaggacacuauuaccuacaaaugcccacuacuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaagagcaggacaaacgauuuaucugcaagcauucuauggucgauagaggcugggguaacggguguggacuauucggcaagggcgggaucgugaccugcgccauguuuacaugcaaaaagaauauggaaggaaaagugguccagccugagaaccucgaauacaccauuguuauaacuccacacagcggugaggagcaugcugugggcaaugacacggggaagcacggaaaagaaaucaagauuacaccgcaguccucaaccacugaggccgaacugaccggcuaugguacaguaaccauggaguguagucccaggacugggcuugauuucaacgaaauggugcuguugcaaauggaggacaaagcauggcucguccaccggcagugguuucuggauuuaccucugccauggcuccccggcgcugacacacagggaagcaauuggauccagaaggagacgcuugugaccuucaagaacccucaugccaaaaagcaagacguugugguccugggcucucaggaaggggcgaugcacacugccuugacaggagcaaccgagauacagauguccucagguaaucuacuguuuacaggccaucucaaaugccgucugcgcauggauaagcuucaacugaaagggaugagcuacaguauguguacuggaaaguucaaggugguaaaagaaauugcugagacccagcacggcacgaucguuaucagagugcaguaugagggugacgggucuccaugcaagauucccuucgaaaucaccgauuuggagaaaaggcauguccucggccggcugauuacagugaacccgauagucacugaaaaggacuccccugugaacaucgaggccgaacccccauuuggagauagcuacauuaucguuggcguggagccugggcaguuaaaacugaauugguucaagaagggaucgucuaucggucaaauguuugagaccacaaugcgaggcgcuaaacgcauggccauucuaggggacacugcaugggauuucggaucccucggcgguguauuuaccucaauagggaaggcccugcaccaggucuucggcgcuaucuacggagcggcauuuaguggcgugagcuggacgaugaaaauucuuaucgggguuauuaucacauggauaggaaugaacuccagaucuaccagcuugucagugagucugguccucgugggcguagugacucuguaucuuggugccaugguucaggcugacuccgggugugucgugagcuggaagaauaaagaacugaagugcggaucuggcaucuucauuacagauaacgugcacaccuggacugagcaguacaaguuucaacccgaaucaccaaguaaauuggccagcgcaauccagaaggcccaugaggaagguauuuguggcaucagguccgucacccggcucgagaaucugauguggaaacagauaacacccgaguuaaaccacauucugucugaaaaugagaucaagcuaacgauuaugaccggggacaucaaaggaauaaugcaggcuggcaagcgcucgcucagaccucaaccaacugaacugaaauauagcuggaagacaugggggaaggccaaaaugcuuuccaccgagucacauaaccagacauucuugaucgauggaccggaaacugcagagugccccaauaccaacagggcguggaauagucuggagguugaagacuacggcuuugguguguucacgacaaacauuuggcucaagcugcgugagaaacaggacguguuuugugauucuaaguuaaugagcgcugccaucaaagacaaucgggcaguacacgccgauaugggguauuggauugaauccgcucugaacgacaccuggaagauggagaaggccucauucaucgaggucaaaagcugccacuggccuaagucucauacucuuugguccaauggaguguuggaaagugagaugauaauuccaaaaaacuucgcaggccccguuagccagcacaacuaccgaccugguuaucauacccaaacagcuggcccauggcaccucgggaagcuggaaauggauuuugacuucugugagggaacuaccguggucgugacagaagauugcggcaauagagggcccucucuaaggacgaccacugccuccggaaaacugaucacagaguggugcugucgcucaugcacccucccgccucugcgguacagaggcgaggacgguuguugguacgggauggaaaucaggccacuuaaggagaaggaagagaacuugguuaauagucuggugacugcgggacauggccagauugauaacuuuagcuuagguguacucggcauggcccuguuccuugaagagaugcugcgcacacgagucgggaccaaacacgcuaucuugcucguggcacugucguuugugacgcuaauuacuggaaauauguccuuccgggaccugggccgugucaugguuauggugggggccaccaugacagaugacauaggaaugggcguaaccuaucucgcucugcuugccgcauuuaaggugagacccacuuucgcggccgguuugcuguuaaggaaacucacaucuaaggagcugaugauggcuaccaucgggauugcccuucugagccagucaacacuaccugaaacuauccucgagcugaccgaugcauuggcucugggaaugauggccuuaaaaauuguccgcaacauggaaaaguaccaacucgcagugacgaucauggccauaaguugcguucccaaugcugugauccugcagaacgcguggaaggucuccuguacaauucuugccgcagugucuguuagcccacuguugcucaccuccucacagcagaaagcugacuggaucccucuggcccuaacuauuaagggccugaaucccaccgccaucuuucuuacaacucucagccggaccaguaaaaagagaucuuggccacugaacgaggcuauaauggcagugggcauggucuccauuuuggccagcucgcuguuaaaaaaugacaucccgaugacggggccucucguagcgggaggucugcuuacagugugcuauguucugaccggcaggucagcugauuuggaacucgagcgagccgcagacgugaagugggaggaucaagccgaaaucucugggaguucccccauucugagcauaacuaucucugaggacggaagcauguccauuaaaaacgaagaggaggaacagacacuaaccauccugauucgcacuggccuucucgucaucucagguguguucccaguaaguauacccaucacagcugcagccugguaccugugggaggugaagaagcagcgggcgggggucuugugggauguuccuagcccacccccuguggaaaaagcugaguuagaagacggagccuauagaauuaagcagaggggcauccugggcuacucucaaauuggggcaggaguguauaaagaggguaccuuucacacgauguggcaugucacucguggcgccgugcucaugcaccgcgggaagcggaucgagccguccugggcugauguuaaaaaggaccugauaucauacggaggcgguuggaagcuugaaggggaguggaaagaaggagaggaaguacaggugcuggccuuggagccaggcaagaaucccagagcaguccagaccaaaccuggcauuuucaagacaaacaccgggacaaucggagcugugagucuagauuuuagcccagguacuuccggcucucccaucguugacaggaaagggaagguggucggacuguacggcaauggugugguaacccgaucgggggccuaugucagcgcgauugcccagacggagaagucaaucgaagauaacccugagauagaagacgauauuuuccggaaaaagcgccucacaaucauggaccugcauccgggagcaggcaaaacuaagagauaccuucccgcuauugugagggaggccaucaaacggggcuuacgaacccugauacucgcuccaacaagaguuguggcagccgaaauggaggaggccuugcgcgggcugccuauuagguaucaaacccccgcuauccgugcggaacacacuggacgggagaucgucgaccucaugugucaugcaaccuucacaaugagacugcuuuccccagugaggguuccuaacuacaaucugauuaucauggaugaagcccacuuuacggaccccgcuaguauugccgcacgcgguuauauaucuacucgaguggagaugggcgaggccgcugggaucuucaugaccgcgacaccaccgggaagcagagauccuuuuccccaguccaacgccccaauuauggacgaagagcgggaaauccccgagaggucauggaauucuggccacgaaugggucaccgauuucaaggguaagacugugugguuuguaccuagcaucaaagcagggaacgacauugcugccugcuugcgcaagaauggaaaaaaggugauacagcuaagucguaaaacauucgauuccgaguacguuaagaccagagcaaacgacugggauuuugucgugacgacugacaucagcgagaugggcgccaauuucaaggcugaacgggugauugauccaaggcgcuguaugaaacccgucauccugacagacggcgaggaacgaguaauucucgccgggccuaugccggugacccauucuucagcggcacaaagacggggaaggaucggucgcaacccaaagaaugagaacgaccaguauauauacaugggcgaacccuuagagaaugaugaggacugcgcccacuggaaagaagcuaagaugcugcuugauaacaucaauaccccugaggggauuauccccuccauguuugaaccagagagagaaaaaguugacgccauugauggagaguacaggcugcggggcgaggcucguaagacuuucguggaccucaugcgccgaggugauuugccugucuggcuggcauauaaaguggccgcugaagggaucaacuacgccgacagaaagugguguuuugauggcauaaagaauaaccagauucucgaggaaaacguugagguggagaucuggacaaaagaaggagagaggaagaaacugaagccccgguggcuugacgcacgcauuuauagugauccacuagcgcugaaagaauucaaggaguucgccgcuggcagaaagagcuugaccuuaaaucugaucacagaaauggggaggcucccuacuuuuaugacgcagaaagcccggaacgcacuggacaaucuugcuguccugcauaccgccgaggugggagguaaggcauacacacacgcccucucggaguugccggaaacucuggagacccuacugcuccuuacacuguuagcugcgguaaccggcgggauauucuuguuucugaugucuggaaaaggcaucgguaagaugacucucgggaugugcugcauuaucacggccuccauucugcuuugguaugcacaaauccagccccacuggauagcugccagcauuauccuggaauucuuucucaucguguugcugauuccagagccugaaaaacagcgaaccccccaggauaaccaauuaacauacguugucaucgccauacuaacugugguggcagcuaccauggccaaugagaugggcuuccuggagaagacaaagaaagaccucggauuuggcucaauuaccacucaggaaagugagucuaacauccuugacauugaucugagaccagcguccgcuuggacauuguaugccgucgcaacgaccuucguuacuccuaugcugcgccauagcaucgaaaauucaagugugaacguaagccucacagccauagcuaaucaggcaaccgugcugauggggcuuggaaaggguuggccccucuccaaaauggacaucggcgucccgcuguuggccauuggguguuacucucaggugaacccaaucacccugacagcggcuuuacuacugcucguugcccacuacgcaauuaucggaccuggccuucaagccaaggcuacuagggaggcccagaaacgggcagcugccgguauuaugaagaaucccacgguggaugggaucaccgucauagaccuggaaccaauucccuaugauccuaaguuugagaaacaguugggccagguaaugcugcucauccugugcgugacacaaguucuuaugaugcguacuaccugggcguuaugugaggcccugacacucgcaaccggaccgaucagcacuuugugggaaggcaaccccgggagauucuggaauacgacaauugcuguguccauggccaacauauuuaggggaucauaccuggcaggcgcuggucuacuguucucuaucaugaagaauaccacuaacacccgccgggggacaggaaaugucggcgagacucucggugaaaaauggaagagucgacuuaacgcccugggcaaaucggaguuucagauuuauaagaaaagcgggauccaggagguggacagaaccuuggccaaggaaggaauuaagaggggcgagacagaucaucacgcggucucccgcgggucugcuaaacugcggugguucguggaaagaaacaugguuacgccagagggaaaggugguagaccucggcugcggucgugggggauggucauacuauuguggcggucugaaaaaugugagggaagucaagggcuuaaccaaagggggaccuggccaugaggagcccaucccuaugagcacuuacggguggaaccuuguucggcugcaauccggaguggaugucuucuuuacaccacccgaaaagugcgacacccuccuaugugauauaggcgagaguucuccuaauccaacuaucgaagcaggucgcacacugcgaguguugaaccugguagagaauuggcucaacaauaacacccaguucugcauuaaggugcuuaaucccuauaugccgagcguuaucgaaaaaauggagacgcugcagagaaaguacgggggagccuuggugaggaacccucugucacggaauuccacccacgagauguacugggucaguaacgcuacaggcaauauugugagcucugucaacaugaucucccgcaugcucauaaauagauuuacuaugaaacacaagaaagccaccuaugaaccagacguggauuuaggcucagggacaaggaacauuggaaucgagagcgaaauccccaaccuggacauuguugguaagcgaauagagaagaucaaacaggaacaugagacuucguggcacuacgaccaagaucauccuuauaagaccugggcauaccacggcucuuaugagacaaaacagaccgggagugccuccagcaugguaaauggagugguccggcuucugacuaagccaugggacgugguucccauggugacgcagauggcuaugacagauaccacuccguucggccagcaacgugucuuuaaagaaaagguggacaccagaacacaggagccuaaggaagguacgaaaaagcuaaugaaaauuaccgcggaguggcucuggaaggagcuggggaaagaaaagacuccccgcauguguacaagggaggaauucacccggaaaguaagaucaaacgccgcauugggagcuguguuuacuaaugagaacaaguggaaguccgcccgcgaagcaguugaggauggcagguucugggagcuggucgaccgagaacggaaucuccaccuugagggcaaaugcgaaacauguguguacaacaugauggggaagagagagaaaaagcugggagaauuugguaaagccaagggcucuagggcuaucugguauaugugguuaggggcccgcuuccuggaguuugaggcguugggauuccucaaugaagaucauugguuuagccguggcaacagucuguccgguguggagggggaaggacuacaccggcuuggcuacauucugagagaggucggcaagaaagaagggggagcaauguacgccgacgauaccgcugguugggacacaaggaucacucucgaggaucugaagaaugaggaaaugguuaccaaccauaugaaaggcgagcacaagaaauuggccgaagcaauauucaagcugacguaucagaauaaggugguacgcgugcagcgaccaaccccucgggggacagucauggacaucauuagcagaaaagaccaaaggggaucuggccagguggguacuuacgggcucaacaccuucacaaauauggaggcucagcuuauccgccaaauggagggagaaggcauuuuuaagucaauccagcaucugacugccaccgaggaaauugcuguucagaacugguuagccagagugggccgggagaggcugagucguauggcaauauccggggaugacugcgucgugaaacccaucgaugaccgauucgcgagcgccuugacggcucucaaugauaugggaaagguacgcaaagacauucagcaaugggaaccaucuagagguuggaacgauuggacacagguucccuuuugcucgcaccacuuccaugagcuggugaugaaggacggccggguccuaguggugccuuguaggaaccaggaugagcuuaucgggcgcgccagaaucucacagggagcaggcuggagccugaaggaaaccgcuugccucgguaaauccuaugcccaaauguggacucugauguacuuucaccggagggacuugcgauuagcagccaaugcgauuuguagugcugucccaucucauuggguuccgacaagccguaccacuugguccauacacgccaagcacgaguggaugaccacagaagauaugcuggcaguguggaacagaguauggauccaggagaaucccuggauggaagacaaaacgccuguggagucaugggaggaagucccauaucucgggaagcgcgaggaucaguggugcggaagucuuauuggccugaccucucgggccacuugggcuaaaaacauccagacagccauuaaucaagugaggagccuaaucggcaacgaaggguacaccgacuauaugcccuccaugaagagauuccgccgggaggaagaggaggcaggaguucugugguga

SEQ ID NO: 15031 - RNA, 9873 nt, Artificial Sequence
  derived and/or modified CDS sequence (opt3) from DENV-2__JQ686088__SS-prME
accacaggcaugaucauuaugcugauacccacugugauggccuuccaccucacgaccagaaacggggagccucauaugaucgucagcaggcaggacaagggaaaaucccuucuguuuaagacaaaagaugguacuaauaugugcaccuugauggcuauggacuuaggcgaacugugugaggauacaauuaccuacaagugcccauuccuaaaacaaaacgaaccggaggacaucgauuguuggugcaauucuacuucaacauggguuaccuaugggacguguacuaccacaggagaacaccggcgcgagaagcgaaguguggcacucguaccccaugugggcaugggucuggagacucguaccgaaacauggaugagcuccgagggggccuggaagcacgcgcagagaauugaaaccuggauccuuaggcauccuggauuuacgauaauggcugccauccuggcauacacuauuggcacaacccacuuccagcgggucuugaucuuuauucuccugacugccguggcuccaucuaugacaaugcgcugcaucggcauagcaaacagagacuucguugagggggugucgggagguucaugggucgauauugugcuggagcacggcagcuguguaaccacgauggccaaaaauaagcccacccucgacuuugaauuaaucaaaacagaggcuaagcagccugccacucugaggaaauauugcauugaagcgaagcuuaccaacacaacuaccgauagucgguguccaacacaaggggagcccuccuugaaugaagagcaggacaagcgcuucguuugcaaacauucuaugguggaucgaggauggggcaacgguugugggcuguuuggaaagggcggcaucgucaccugcgcaauguucacuugcaaaaagaauaugaaagggaagaucgugcagccugagaaccuagaauacacgauugugauaacaccacacagcggagaggaacaugccgucgguaaugacaccggcaaacacgggaaggagguuaagaucacuccgcaguccucaauuaccgaagcugagcucacaggauauggcaccgugacuauggaguguagucccagaacaggucuggauuuuaacgaaaugguacuucugcaaauggaggacaaagccugguuggugcacaggcagugguuccucgaccugccuuuaccauggcugcccggggcagauacgcagggcagcaauuggauccagaaggaaacccucgucacuuuuaaaaacccucaugcuaagaaacaagacgugguugugcuuggaucucaggagggcgccaugcacacagcgcugaccggggccacagaaauacagauguccucaggaaauuugcuauucacuggucaucugaagugccggcuccguauggauaagcugcaacuuaaaggcaugagcuacaguauguguaccgggaaguucaaagucgugaaggagauugcagagacgcagcacggaaccaucguaauccgcguucaguaugaaggcgacgguucuccaugcaaaauucccuuugagaucauggaucuggaaaagagacauguguuggggaggcucauuacagucaacccgauagugacugagaaggaccggccugucaacaucgaggcugaacccccauucggcgauuccuacauuaucaucggaguggagccuggccagcugaaauuaaauugguuuaagaaagggagcucgauuggacaaauguucgaaaccacaaugcgaggugccaagcgcauggcuauacugggcgacacugccugggauuuugggucucuaggaggcguuuucaccuccaucgguaaagcacuccaccagguguuuggggccauuuacggcgcugcguucucaggaguaaguuggacgaugaagauccugauuggcgucaucauaacauggaucgggaugaacagcagauccaccucucuuagcgugucauugguucuggugggaauugucacucucuaucugggcgugaugguacaggcagacagugguugugugguuuccuggaagaauaaagagcuuaagugcgggaacggaaucuuugucacagauaaugugcacaccuggacugaacaguacaaauuccaacccgagagcccaucuaagcuggccucagcuauucagaaagcccaugaggaaggcaucugugguauaaggagugugacccgguuggagaaccucauguggaagcagauuacacccgaacugaaucacaucuuaagcgagaacgaagucaaacugacgauuaugaccggcgacaucaaggggauaaugcagguuggaaagcgcucccuacaaccucagccaacugagcucagauauucuuggaaaacauggggcaaggcaaaaaugcugucgaccgagcuucauaaucagacauuuuugaucgacgggccggaaacugccgagugccccaacaccaauagggcuuggaacagccuggaaguggaggauuacggauucggcguguuuacgacaaauauuuggcucaagcugcgugaaaaacaggacguauucugugauuccaaguuaaugucagccgcaaucaaggacaaccgggcgguccacgcugauauggguuauuggauugagagugcccugaaugacaccuggaaaaucgagaaggcaucuuucauagaagugaaaagcugccacuggccuaagucccauacucuuuggucaaacgggguuuuggagagcgaaaugauuaucccaaaaaaccucgccggacccgugucucaacacaauaaccgaccuggcuacuauacccagacagcugguccauggcaucugggcaagcuagagauggauuuugacuucuguaaggggacuaccgucgugguuacagaggauugcggaaauagaggccccucccugaggacgaccacugccagugggaaacucaucacagaauggugcugucgcagcugcacccugccgccucuucgguacagaggagaggacggcuguugguacgguauggaaauuaggccauugaaggagaaagaagagaaccuggugaauucuuuaguaacugcagggcacggacagaucgauaacuuuucccucggcauucuggguauggcucuuuuccuggaggaaauguugcgcacacgagucggcaccaagcaugccauacuccugguggcggugucauuugucacgcuaaucacugggaauaugaguuuccgggaccugggacguguuauugugaugguaggcgccaccaugacagaugacaucgggaugggagugaccuaucucgcucugcuugcagccuuuaaagucagacccacuuucgcugccggcuugcuguuaaggaagcucacaagcaaggagcugaugaugaccacaauugguaucgugcuucugucgcaauccucuauaccugaaacuauccuagagcucaccgacgcacuggcguuggggaugaugauucugaaaaugguucgcaacauggaaaaguaccaguuagccgugacgaucauggcuauucucugcguccccaaugccgugauccugcagaacgcauggaaaguuagcuguacaauacuugcuguggucucaguaaguccacuguugcucaccuccucucagcaaaaggccgauuggauuccuaucgcacugacuaucaaaggacuaaaucccaccgccauuuuucugacaacucuuagccggaccuccaagaaaagaucauggccacucaacgaggcuauaauggcggugggcaugguuagcauccuggccaguucuuugcugaagaaugacauuccgaugacgggcccuuuaguggcagggggacuccugacagucugcuaugugcuuaccgguagguccgcugaucuggaguuggaacgagccgccgacguaaagugggaggaucaggcugaaaucagcggcucgucacccauucucucuaucacuauaagugaggacggguccaugagcaucaaaaacgaagaggaggaacagacacugaccauucuaauccgcacuggacugcuuguggucucuggccucuucccaguuagcgugcccauuacagcagccgcgugguaccugugggaggugaagaaacagcgggcuggugucuugugggaugugccuuccccacccccugccgggaaggcagaauuagaggacggagccuauagaaucaaacaaaagggcauacugggcuacucacagauuggggcuggaguuuauaaggaggguaccuuucacacgauguggcacguaacuaggggcgcagugcucaugcauaaagggaagcguaucgaaccgaguugggccgaugucaaaaaggaccugaucagcuacggaggcgguuggaaacuugagggggaauggaaggagggagaagaggugcagguucuggcguuggagccaggcaagaauccccgcgcugugcagaccaaaccuggccuauucaagacaaacaccgggacaauuggagccgucucucuggauuuuuccccagguacuucaggcagucccaucguggacaaaaaggggaaaguagucggacucuacggcaacggugugguuacccggagcggggcauauguguccgccauagcucaaacggaaaagucuauugaggauaauccugaaaucgaggacgacauuuucagaaagaggcgacugacaaucauggaucuucacccgggagccggcaaaacuaagcgguacuuacccgcaauaguccgcgaagcuauuaaaagaggccugaggacccucaucuuggccccaacacgggugguugcggccgagauggaggaagcacugcgagggcucccugugagauaucagacccccgcuauccgcgccgagcauacuggaagggaaauugucgaccugaugugucacgcuaccuucacaaugcgucuucugucgccaauccgggugccuaacuacaauuugauuauaauggaugaggcacauuuuacggaccccgccagcaucgccgcuagagguuauauuucaacuaggguagaaaugggcgaggcggcagggaucuucaugaccgccacaccaccgggaucccgcgauccuuuuccccagaguaacgcuccaaucauggacgaggaacgagagauucccgaaagaucuuggaauagcggccacgagugggugaccgauuucaaggguaaaacuguuugguuugucccuuccauaaagacagggaacgacaucgccgcaugccuacggaagaauggaaaaagggugauucaacugucacgcaagaccuucgauucugaguacaucaaaacgcguacuaacgacugggauuuuguggucacaaccgacauuagcgaaaugggcgccaauuucaaggcucagagaguaaucgacccacggagguguaugaaacccgugauacucaccgauggcgaggaacgcguuaucuuagcggggccuaugccggugacucacaguuccgccgcacagcgaggaagagucggucggaacccaaagaaugagaacgaccaguauauuuacaugggcgaaccccuggagaaugaugaggacugcgcucauuggaaagaagccaagaugcuucuggauaacaucaauacaccugaggggauuauccccagcauguuugaaccagagagggaaaagguggacgcaauagauggagaguaccgccucagaggcgaggccaggaaaaccuucguugacuugaugcggcguggugaucugccuguguggcucgcuuauaaggucgccgcggaagggauuaacuacgcagaccgccgaugguguuuugauggcacaagaaacaaucaaauccuggaggaaaacguggagguagaaauuuggacuaaagagggagagaggaagaaacuuaagccccgguggcuagacgcccgcaucuaugcugauccacuggccuugaaggaauucaaagaguucgcugcaggcagaaagucuuuaacgcugaaucucauaaccgaaauggggaggcugccuacauuuaugacucagaaagugcgggacgcccuugacaaccuggcuguucuccacaccgccgaggcaggagguaaggcguacaaucaugccuugaacgagcugccggaaacacuagagacccugcuccuucugacuuuauuggcuacggucaccggcgggaucuuccuguuucucaugucaggacgaggcauugguaaaaugacacuggggaugugcugcaucauuacugccuccauccuucugugguaugcacagauacagccccacuggauugcugccaguaucauccucgaauucuuuuugauugugcuguuaaucccagagccugaaaagcaaagaaccccccaggauaaucagcuaacauacguggucauagcaauucugaccguuguggccgcuacuauggcgaacgagaugggcuuccucgagaagacaaaaaaggaccuuggacugggcagcaucguaacgcagcaaccagaaucgaauauuuuggauaucgaccugcgcccugccucugcauggacccucuaugcuguggccacuacauuuauaacccccaugcugaggcacuccaucgagaacagcucagucaaugugagucuuaccgccauugcaaaccaggcuacaguucucauggggcugggaaaagguuggccguugucuaagauggauaucggcgugccacuguuagccauuggguguuacucccaggucaauccuaucacucuaacggcggcucuguuccuccuuguagcccauuacgcaauuaucggacccggccugcaggccaaagcuacccgggaagcacaaaagcgugccgcggcugguauaaugaagaacccaacaguggacgggauuacuguuaucgauuuggaccccaucccuuaugauccgaaauuugagaagcagcugggccaggugaugcuccugguccuuugcgugacccaagucuuaaugaugagaacaaccugggcccugugugaagcacucacuuuggccacgggacccgugagcacacugugggagggcaauccagggagguucuggaacaccacuauugcuguuucaauggccaauauauuucgcggaaguuaccuagcaggcgcuggucugcucuucagcaucaugaaaaacaccacauccgcccggcgagggacuggaaacauuggcgagacccuuggugaaaaguggaaaucuagacugaaugcguugggcaagagcgaguuucagaucuauaaaaaguccgggauucaggaaguggacaggacacuggccaaggagggaaucaaacgcggcgaaacggaucaccaugcaguaucacgggggucugcuaagcucagaugguucguggagcguaaccuggucaccccugagggaaaaguuguggacuuaggcugcgguagggggggauggaguuacuauuguggcggucuuaagaauguccgggaagugaaaggccugacuaaggggggacccggccacgaggaaccuauaccaaugucgacauacggguggaaccucguacgccuacagagcggaguggauguuuucuuuauccccccugagcgaugcgacacccuguugugugacauuggcgaguccucuccaucacccacuguggaagccgguagaacacugaggguccucaaucuuguggagaacuggcugagcaauaacacccaauucugcgucaagguguugaauccguauaugccuuccguuaucgaaaaaauggaggcacugcagcggaagcaugggggagcucucguacgcaacccauuaaguagaaauucuacgcacgaaauguacugggugagcaacgccucaggcaauauugucuccagugugaacaugaucagcaggaugcugauaaaucgauuuaccaugcggcacaaaaaggccacauacgagcccgauguugaccuuggcucugggacucguaacauuggaaucgaguccgaaaccccuaaccuggauaucauugguaaaagaauagagaagaucaagcaggaacaugagacaucauggcacuaugaccaggaucauccauacaaaacuugggcguaucacggcagcuacgaaaccaagcaaacagggucggcuucuaguauggugaauggagucgugcgccuacucaccaaacccugggacguagugccgaugguuacucagauggcaaugacggauacaaccccuuucggccagcagagggucuuuaaggagaaaguggacacucggacccaagagcccaaggaagguacaaagaaacugaugagaauuacggccgagugguuguggaaggaacuggggaaaaagaaaaccccacgcauguguacuagggaggaauucacaaagaaagugcgauccaacgcugcccucggagcaaucuuuaccgaugagaauaaguggaagagcgcccgggaggcugucggcgacggcagauucugggaacuuguugauaaagagaggaaccugcacuuagaagggaagugcgagacuuguguguauaauaugaugggaaaacgcgagaagaaacugggugaauuuggcaaggcgaaggggucacgugccauuugguacaugugguugggagcacgguuccucgaguuugaagcucugggcuuccuaaacgaggaccauugguuuuccagagaaaauucucuuagcgguguagagggggagggacugcacaaacucggcuauauccugagggaagugaguaagaaagagggcggggccauguacgcagacgauacagccggaugggacacccgcauaacaaucgaagauuugaagaacgaggaaaugauuacuaaucauauggagggugagcacaaaaagcuggcugaagccaucuuccgacucaccuaccagaacaaggucgugcggguucagagaccuacgcccaggggcaccgugauggacauuaucucccgcagagaucaacgggggagcggacaggucggcacauauggucuuaauacuuucaccaacauggaggcgcagcugauuaggcagauggaaggggagggaguguuuaaaucuauacaacauuuaacagcagccgaagagaucgcuguacagaauuggcugguucgugugggccgagagcgcuugucaagaauggccauuaguggcgacgauugcgucgugaagccacucgacgaucgguucgcaagggcucugacugcccuaaacgacauggggaaagugcgcaaggauauccagcagugggaacccuccagaggauggaaugacuggacccaagucccuuuuugcagccaccacuuccaugagcuuaucaugaaagauggucggauucugguugugccauguaggaaccaggacgaacucauaggccgagcucguaucucucagggggccggauggucgcugagagagacggcaugcuugggcaagucauacgcgcagauguggagcuuaauguauuuucaccgccgggaccugaggcucgccgcuaacgccauuuguuccgcaguaccgagucauugggugcccacaucuagaaccacuuggagcauccacgcuucccacgaguggaugacaaccgaagauaugcuuacugucuggaaucgcguguggauucaagagaacccuuggauggaagacaagaccccaguugagucaugggaagagauccccuaccuggguaaacgggaggaucaguggugcgggagucuaauaggacugacaucuagggccacgugggcaaagaauauccagaccgccauuaaccaggugcgaagccucaucggcaaugaagaguauacugacuacaugccuuccaugaaaagauuccggagggaagaggaagaggcgggcgucuugugguga

SEQ ID NO: 15032 - RNA, 9876 nt, Artificial Sequence
  derived and/or modified CDS sequence (opt3) from DENV-2__KF479233__SS-prME
accgcaggcgugaucauuaugcugauacccacggcuauggcauuccaccucacuacgagaaacggggaaccucauaugaucgucagcaggcaggaaaagggaaaaucccuucuguuuaagaccgaagacgguguuaauaugugcacauugauggcaauggauuuaggcgaacugugugaggacacuauuaccuacaacugcccauuacuccggcaaaaugaaccggaggauaucgacuguuggugcaacucuacaucaaccugggugacuuaugggacauguaccgcgacgggagagcaccgccgagaaaaacguaguguugcucuggugccccaugucggcaugggucuugagacuagaaccgaaacauggaugagcuccgagggggccuggaagcacgcacagaggauugagacuuggauccugcggcauccuggauucaccauaauggccgcuaucuuggcauacacaauuggcaccacguauuuucagcgcgugcucaucuucauucugcugacugccguugcuccaucuaugacaaugagaugcaucggcauaucgaauagggauuuuguggaaggggucucaggagguagcuggguggacauuguacucgagcacggcaguuguguuaccacuauggccaaaaacaagcccacauuagauuucgaacugaucaagaccgaggcgaaacagccugcaacgcuucggaaguacugcauugaagccaaauugaccaauacaacuaccgcuucccgcuguccaacacaaggggagcccucucugaacgaggaacaggacaagcgauuugugugcaaacacagcauggucgauagaggauggggcaaugguugugggcuauucggaaagggcggcaucgugacuugcgccauguuuaccugcaagaaaaacauggaggggaagaucgugcagccugaaaaucucgaguauacaauugucguuaccccacauuccggagaagagaacgcaguggguaaugacacuggcaaacacgggaaggagauaaaaguaacgccgcagucaaguaucacagaagcugagcugaccggauacggcacugugaccauggaauguagccccaggacaggucuugauuucaacgagaugguccuguugcaaauggaaaauaaggccuggcucgugcaucggcagugguuucuggacuuaccucugccauggcuccccggggcggauacccagggcucuaacuggauucagaaagagacucuuguuacauucaagaacccucacgccaagaaacaagacguggucgugcugggaucccaggagggcgcaaugcacacggcuuugaccggggccacugaaauccagaugucaagcggaaaucuacuguuuacaggucaucucaagugccgucugcgcauggacaaacuucaacugaagggcaugaguuauucuauguguaccgggaaauucaagguaguuaaggagauagcugaaacacagcacggaacuauuguggucagagugcaguacgagggcgaugguuccccaugcaaaauccccuucgagaucauggacuuggaaaagaggcauguccucgggcggcugauuaccgugaacccgaucguuacggagaaagauagcccugugaauauugaagccgagcccccauuuggcgacucguacauaaucauuggaguagaaccuggccaguuaaagcugucuugguucaaaaagggguccucaaucggacaaauguuugagaccacaaugcgaggugcaaagcgcauggccauccuaggcgauacugcuugggacuucgggagucucggaggcgucuuuaccagcauugguaaagcgcugcaccagguguucggggcaauauauggcgccgcuuuuuccggaguuucuuggacaaugaagauccuuauuggcguggucaucacuuggauugggaugaacagcagaucaaccaguuuguccgugagccugguacucgugggaguugucacgcuguaccuuggcgugauggugcaggccgauucugguugugucguuucauggaaaaauaaggagcugaaaugcgggaguggaaucuucauaacagacaacgugcauaccuggacugaacaguauaaguuucaacccgagagcccauccaaguuggcaucugccauccagaaagcucacgaagagggcauuugugguaucaggucggugacacggcucgaaaaucugauguggaagcagauuacccccgaguuaaaccacauccugagcgagaaugaaguaaaacuaacuauaaugaccggcgauauuaaggggaucaugcaggccggaaaacgcucccucagaccucaaccaacagagcugaaguacucauggaaaacguggggcaaggcaaagaugcuuaguaccgaaccgcagaaccagacuuucuugauugacgggcccgagacagcggaaugcccuaauaccaacagggcuuggaacucucuggaggucgaggauuauggauuuggcguguucacaacuaacaucuggcucaaacugaaggaacgucaggacguauuuugugacagcaaauuaauguccgccgcaauaaaggauaaucgggccgugcaugcugacauggguuacuggaucgagucagcccugaacgauaccuggaaaauugaaaaggccagcuucaucgaggucaagucuugccacuggccaaaaucccauacgcuuuggaguaacgggguguuggagagcgaaaugauuauccccaagaauuucgcuggaccuguuucucaacacaacuaucgaccaggcuaccacacacagaccgccggucccuggcaucucggcaaacuggagauggacuuugauuucugugaagggacuaccgugguagucacagaggacugcggaaauagaggcccgucccuaaggacuaccacagcgucagggaagcugauaacggaauggugcugucgcaguugcacccucccuccacugcgguacaaaggagaggauggcuguugguaugguauggagauuagaccccuuaaggaaaaggaggaaaacuuggugaauagccuggugacugccgggcacggacagaucgacaacuuuucguuaggcguccucgguauggcucuguuccuugaggaaaugcugaggacacgcguuggcaccaaacaugcaguguugcucguagccguguccuuuaugacucugaucacagggaauaugucuuuccgagaucuaggacgggucauggugaugguuggcgcugccaugaccgacgauauugggaugggagugacguaccuggcacuccuggcggccuuuaagguccguccuacuuucgcugccggccuuuugcugagaaaauuaaccagcaaggagcucaugaugacaaccaucgguauugugcugcuuucacaaaguacuauacccgagacaauccuggaacuaaccgacgcacucgcucuggggaugaugauuuugaaaaucguuaggaacauggagaaguaucagcuggccgugacaauuauggcaaucuuaugcgucccaaaugccguaauacuccagaacgcuuggaagguguccuguacuauccuggcgguugugucugucagcccucuucuguugaccuccucacagcaaaaagccgauuggauuccccucgcacugacgaucaagggacuaaauccaacagcuauuuuucugaccacucuuagccgcaccaacaaaaagcggaguuggccgcucaaugaagccaucauggccgugggcaugguaucuauacuggcuuccagcuugcugaaaaacgacauuccuaugacaggccccuuaguggcagggggacuccugacugucugcuacguucuuaccgguagaucggccgaccuggaguuggaaagggcggcugaugugcgaugggaggaccaggccgagaucucaggcucuaguccaauccucuccauuacgauaagcgaagaugggucuaugagcaucaagaaugaggaagaggagcagacacugaccauucuaauccgcacuggacugcuugugauuuccggccucuuccccgucucaaucccuauaacagcagccgcuugguaucugugggaagugaaaaagcagcgggccgguguuuugugggacguaccaagucccccuccgguggggaaggccgaguuagaagauggagcguacagaaucaaacaaaagggcauucugggcuauagccagaucggggcuggagucuacaaagaggguaccuuucacacuauguggcaugugacaaggggcgccguucucaugcacaaggggaaacguauugaaccaucuugggcagacgugcgcaaggaucugaucuccuacggaggcgguuggaaacuugagggggaguggaaagaaggagaggaaguccaggugcuggccuuggagcccggcaagaacccucgggcuguacagaccaaaccaggccuauucaagacgaacacugggaccauaggagccgucucacuggacuuuagucccgguacaagcggcuccccuauuguggauaaaaaggggaagguugugggacucuauggcaauggugucgugaccagaucugggacauacguuucggcaaucgcucaaacugagaaaagcaucgaggacaacccggagauugaagaugacaucuucaggaagaaacgacugaccauaauggaucuucaccccggagccggcaagacgaaacgguauuuaccagcgauugugcgcgaggccaucaagagaggccugaggacacucauuuuggcaccuacucgggucguggcugccgaaauggaggaagcucugcgagggcuccccaucagauaccagaccccagcaauacgcgccgagcauacaggaagggagauuguagaccugaugugucacgccaccuucacuaugcgucuucugucaccugugcggguucccaauuauaacuugaucaucauggacgaagcucauuuuaccgauccagcguccauugcagccagagguuacaucaguacaagggucgagaugggcgaagcugccgggauuuucaugacggcaacuccgccuggaucucgcgaccccuuuccacagagcaaugcccccauaauggaugaggagcgagaaaucccugagagauccuggaacucaggccacgaaugggugaccgacuucaaggguaaaacagugugguuugucccaucuauuaaggcugggaaugauaucgcggccugccuacggaaaaacggaaagaaaguaauccaacugagcaggaagaccuucgacagugaguauauuaagacucgcacaaaugauugggacuuugugguuaccacggauauauccgaaaugggcgcaaacuucaaagcugagcgugugaucgaccccagacgguguaugaagccugucauucucacugauggcgaggaaagggugaucuuagccgggccgaugccaguuacacauagcucugcagcccagcgccgaggaagaauuggucggaaucccaaaaacgagaaugaccaguacaucuacaugggcgaaccucuggagaacgacgaagauugcgcucacuggaaggaggccaaaaugcuucuggacaauauaaacacccccgaggggaucauuccaucaauguuugaaccugagagggaaaagguggaugcgaucgacggagaguaucgccucagaggcgaagcaaggaaaaccuucgucgaguugaugcggcguggugaucugcccguguggcucgccuaccgcguagcugccgaggggauuaacuaugcugaccgaagaugguguuuugauggcaucaagaauaaccagauacuggaagagaauguggaaguugagauuuggacuaaggagggagagaagaagaaacuuaagccaagguggcuagacgcacggaucuacuccgauccucuggccuugaaagaguucaaggaguucgcugccggccgcaagaguuuaacaaugaaccugauuaccgagauggggagacucccgacauuuaugacucaaaaagcaaggaaugcgcuggacaaccuugccguccugcacacggcugaagccggaggucgggcauauaaucaugcucucagcgaguugcccgagacccuggaaacacuacugcuccuuacucuguuagccaccgugacaggcgggaucuucuuguuucugaugucgggaaagggcauagguaaaaugacccucgggaugugcugcaucauuacugcaucuauccugcuuugguacgcccagauucagccacacuggaucgcugcguccauaauucuggaguucuuucucaucguguugcugaucccugaacccgagaagcagcgaacgccacaagauaaccaguuaaccuaugucguuauugccauccuaacagugguagcagcuacuauggccaaugaaaugggcuuccuggagaaaaccaagaaggacuuuggacucggcagcauagugacacagcagccugagucaaacauucuugauaucgaccugagacccgccagugcauggaccuuguacgcugucgccacuacauucauuacgccgaugcugcgccauucuaucgaaaauuccagcgugaacguuucacucaccgcgauagcuaaucaagccacugugcugauggggcuuggaaaagguuggccacucaguaagauggacaucggcgucccucuguuggcaauuggguguuacagccagguaaaccccaucacacugaccgccgcuuuacuacugcucguggcacacuaugccauuaucggaccaggccuucaggcgaaagcuaccagggaggcccagaagcgggcagccgcugguauuaugaaaaaucccacaguugaugggaucacugugauagaccuggauccuauuccguacgaccccaaguuugaaaagcaauugggccaggucaugcugcucgugcugugcgucacacaggugcuuaugaugcguaccacaugggccuuaugugaggcacugacucucgcuaccggaccaaucuccacauugugggaaggcaacccugggagauucuggaauaccacuaucgccguuucuauggcgaacauuuuuaggggaagcuaucuggccggcgcaggucuacuguucuccauaaugaaaaacacggcuaauacacgccgggggaccggaaacacuggcgagacccucggugagaaguggaaaaaucgacuuaacucacugggcaagucugaauuucaaaucuacaaaagaagugggauucaggagguggauaggacauuggccaaggaaggaaucaaacgcggcgagacugaccaccaugcaguaucgcgggggagcgcuaagcugagaugguucguggagcguaaucucgucacccccgaaggaaagguuauggaucugggcugcgguaggggagggugguccuauuacuguggcggucuaaagaaugugcgggaggucaagggccuuacaaaagggggaccuggccacgaagaaccaauucccaugucuacguauggguggaaucuggugcgccuccagucaggaguagacguguucuuuaccccuccagaaaagugcgauacucuacugugugacaucggcgagagcucccccaacccgacaguugaggccggucgaaccuugagagugcugaaucucgucgaaaacuggcuuaauaacaauacucaguucugcauaaaagugcugaacccuuacaugccaagugucaucgagaagauggaaacauugcaaaggaaguacgggggagcccuggugcggaauccccucucucgcaacagcacccaugagauguauuggguuucaaacgcguccggcaauauuguaaguagcgugaacaugaucucuagaauguuaauuaauagguuuacgaugcgacacaaaaaggcuaccuacgaaccugaugucgaccugggcuccgggacacggaacaucggaauagagucagagauuccaaaucuugauaucaucgguaaacguauugaaaagauaaaacaggagcaugaaacuagcuggcacuaugaccaggaccaccccuacaagaccugggcauaucauggcucguacgagacaaagcagacugggucugccaguuccauggugaacggaguugugagacugcuaaccaaaccgugggaugucaucccuauggugacacaaauggcuaugaccgacacuacgcccuucggccagcagcgcguauuuaaggaaaaaguggauacaaggacccaggagccaaaggaggguacuaaaaagcucaugaagauuaccgccgaauggcuguggaaagaguuggggaagaaaaagacaccucggauguguacgagagaagaguucacccgcaaaguuaggagcaaugcagcccugggagcuaucuuuacugacgagaacaaguggaaaucagcgcgagaagccgucgaggauucccgguucugggaacucguggacaaggagagaaaucuucaccuggaaggcaagugcgagacauguguguauaacaugaugggcaaaagggagaagaaaauuggggaauuuggaaaggcaaaagguucucgcgcuaucugguacaugugguuaggcgcccguuuccuggaguuugaagcauugggguuccucaaugaggaucauugguuuagccgggaaaacagucuguccggagucgagggcgagggucuacacaaacuuggguacauacugagagaaguuagcaagaaagagggaggcgccauguaugcugacgauaccgccggcugggacacuaggaucacacucgaagaucugaagaaugaggaaauggugaccaaccacauggagggggagcauaaaaaguuggcggaagcaauuuucaaacugacauaccaaaauaagguagugcgcguccagcgacccacuccacggggaaccgugauggacaucauuucuagaagggaccagcgcgguucaggccaaguugggacguauggacucaacaccuucacaaacaugggcgcccagcuuaucagacagauggagggugaagggguguuuaagaguauucagcaccugacuaccacagaggaggucgcugugcaagauugguuagcccggguaggaagggaacgucugucccgaauggcaauaagcggcgacgauugcguugugaaacccuuggacgaucgcuucgcuucugcccucacugcucugaaugacaugggcaaggucagaaaagauauccagcagugggagccuucgcggggguggaacgacuggacccaggugccauuuugcucacaucacuuccaugaacuaauuaugaaggauggaagggugcuugucguuccgugucgcaaucaagacgagcugaucgguagagcccggaucagccagggcgcaggguggucccucagggaaacggcgugccugggaaaaaguuacgcccagauguggucuuugauguauuuucaccgacgugauuuaagacuggcugccaacgcaauuuguagcgcugugcccucccacuggguaccuacaucacgcaccacuuggaguauacaugcccggcacgaguggaugacaaccgaggacaugcucacuguguggaauagggucuggauccaggaaaacccauggauggaggauaagacccccguggaaucuugggaggaaauuccuuaccuuggcaagagagaggaccaauggugcgguagccugaucgggcuaacaucccgcgcaacgugggccaaaaauauucagaccgcgaucaaccagguucggucacugauaggaagcgaggaauauacugacuacaugccaucuaugaagagguuccgaagagaggaagaggaagcuggcgugcucugguga

SEQ ID NO: 15033 - RNA, 9876 nt, Artificial Sequence
  derived and/or modified CDS sequence (opt3) from DENV-2__KX372564__SS-prME
accgccggcaucauuauaaugaugauccccacagugauggcuuuccaccugacuacgagaaacggggagccucauaugauugucagcaggcaggaaaagggaaaaucccuccuuuuuaagaccgagaaugguguuaacaugugcacacugauggcaauggacuugggcgaauuaugugaggauacuaucaccuacaauugcccacugcuacggcaaaacgaaccggaggacauugauuguuggugcaauucuacaucaaccugggugacuuaugggacauguaccgccacgggagagcaccgccgagaaaaacguaguguagcgcucgugccccaugucggcaugggucuggagacuagaaccgaaacauggaugagcuccgagggggcuuggaagcacgcccagaggaucgagacuugggugcuucggcauccuggauucaccauaauggcagccauccuggcuuacacaauuggcaccacguauuuucagcgcguuuugaucuucauucuccugacugcaguggccccaucuaugacaaugagaugcaucggcauaucgaacagggacuuugucgaaggggugucaggagguagcuggguagauauuguucuggagcacggcaguugugugaccacuauggcuaaaaauaagcccacacucgacuucgaauuaaucaagaccgaggccaaacacccugcgacgcugcggaaguacugcauugaagcaaaacuuaccaacacaacuaccgccucccgcuguccaacacagggggagcccucuuugaaugaggaacaagauaagcgauuugucugcaaacauagcaugguggacagaggauggggcaacgguugugggcuguucggaaagggcggcaucgugacuugcgcuauguuuaccugcaagaaaaauauggaggggaagaucguccagccugaaaaccuagaguauacaauuguuauaaccccacacuccggagaagagaaugccguggguaacgauacuggcaaacaugggaaggagaucaaaguaacgccgcagucaaguauuacagaagcagagcucaccggauacggcacugugaccauggaauguagccccaggacaggucuggacuucaaugagaugguccuucugcagauggaaaacaaggcuugguuggugcaccggcaaugguuucucgaucugccuuuaccauggcugcccggggccgacacccagggcucuaacuggauccagaaagagacucucguuacauucaagaauccucacgcgaagaaacaggauguggucgugcuuggaucccaagagggcgccaugcauacggcacugaccggggcuacugaaauacagaugucaagcggaaacuugcuauuuacaggucaccugaagugccgucuccgcauggacaaacugcagcuuaagggcaugaguuauucuauguguaccgggaaauucaagguaguuaaggagauugccgaaacacaacauggaacuaucgugaucagaguccaguacgagggcgacgguuccccaugcaaaauucccuucgagaucauggaucuggaaaagaggcacguguuggggcggcucauuaccgucaauccgauagugacggagaaagacagcccuguuaacaucgaagcugagcccccauuuggcgauucguacauuaucaucggaguggaaccuggccagcugaaguuaucuugguucaaaaagggguccucaauuggacagauguuugagaccacaaugcgaggugccaagcgcauggcaauacugggcgacacugccugggauuucgggagucuaggaggcguauuuaccagcaucgguaaagcucuccaucaagucuucggggcgauuuauggcgcagccuuuuccggagugucuuggacaaugaagauccugauuggcguugugaucacuuggauagggaugaauagcagaucaaccagucuuuccgucagcuuggugcugguaggagugguuacgcucuaccugggcgucauggugcaggcugacucugguuguguggucucauggaaaaacaaggagcuuaaaugcgggaguggaaucuucauuacagauaauguucacaccuggacugaacaguauaaguuucagcccgagagcccauccaagcuggccucugcaauccaaaaagcccacgaagagggcauuugugguaucaggucggugacacgguuggaaaaccucauguggaagcagauaacccccgagcugaaucauauuuuaacugagaacgaagugaaacugaccaucaugacaggcgacauuaaggggaucaugcaggcuggaaaacgcagccuaagaccucagccaacggagcucaaguacuccuggaaagccuggggcaaggcaaagguacugucaaccgaacuucacaaucauacuuucuugauagaugggccggagacagcggaaugccccaacaccaauagggcuuggaacagucuggaggucgaggacuauggauuuggcguguucacaacuaauaucuggcucaaacugaaggaacgucaagauguuucuugugacagcaaauuaauguccgccgcaauuaaggacaaccgggccgugcacgcugauauggguuacuggaucgagucagcccugaacgacaccuggaaaauugaaaaggcaagcuuuaucgaggucaagucuugccacuggccuaaaucccauacgcuuuggaguaaugggguguuggagagcgaaaugauaauuccaaagaacuucgcuggacccguuucucagcacaauuaucgaccuggcuaccauacacagaccgccgguccauggcaccucggcagacuggagauggauuucgacuuuugugaagggacuaccgugguagucacagaggauugcggaaacaggggccccucccuacgcacuaccacagcgucagggaaacugaucacggaauggugcugucggaguugcacccucccgccucugagauacaggggagaggacggcuguugguaugguauggagauccgcccacuuaaggaaaaagaggaaaauuuggugaacagccuggugacugccgggcauggacagauugauaauuucucguuaggcguccucgguauggcucuguuucuugaggaaaugcugcgaacacggguuggcaccaagcacgcaaucuugcucguggccguauccuucgugacucugauuacagggaacaugucuuuucgugaccuaggaagagucauggugaugguuggcgcuaccaugacggaugacauagggaugggagugacuuaccuggcccuccuggcagcguucaaggucaggcccaccuuugccgcuggccuuuugcugcgcaaauuaacaagcaaggagcucaugaugaccacuaucgguauugugcugcuuucacaaaguacaaucccugagaccauucuggaacuaacagaugcccucgcacuggggaugaugguuuugaaaaucgugcggaauauggagaaguaucagcuggcugucacuauaauggccaucuuaugcguacccaacgcagugauucuccagaaugccuggaaaguuuccuguaccgcucuggcgguggucucugugagcccacuucuguugacguccucacaacagaagacagacuggaucccucucgcccugaccauuaagggacuaaaccccacugcaaucuuccugaccacacuuagcagaacuaguaaaaagaggucuuggccacucaaugaagcuauaauggccguaggcaugguguccauucuggccagcucguuuuugaaaaacgauaucccgaugaccggcccucuggucgcugggggauuacucacgguuugcuacgugcugacaggucgaucagcagaccuugagcuggaacgcgccgcggacauccggugggaggagcaggcugaaauuucuggcaguucccccauauugagcaucaccauuucugaggaugggagcauguccaucaagaaugaagaggaggaacagacucucacaauucugaucagaaccggacuacuggugauaucaggccuuuucccagucaguauccccauuacugccgcagccugguaucucugggaggugaaaaagcaaagggcugguguucugugggacguaccuagcccacccccuguggggcgugcagaauuggaggauggagccuaccgcaucaaacagaagggcauuuuaggcuauucucagaucggggcgggagucuacaaggaagguacauuucacaccauguggcaugugacgcggggcgcuguucugaugcacaaagggaagagaauagagccguccugggccgacgugaaaaaggaucucauuucauacggaggcgguuggaaacuggagggggaauggaaggagggagaagagguccaggugcuugcacuggaaccaggcaagaaccccagggccguacaaacuaaaccuggcuuguucaagaccaacacagggaccaucggagcugucagucuagacuuuagcccagguacauccggcucucccaucguggauaaaaaggggaaaguugugggacuguauggcaauggugucgugacucgaucggggaccuacguuagcgccauugcacagacggagaagucaaucgaggacaacccugaaauagaggaugacauuuuccggaagaaacgccucacaaucauggaucugcauccgggagcuggcaagacuaaaagauaucuucccgccauugugagggaagcgaucaagcggggcuuacgaacccugauacucgccccaacaagagucguggcagcugagauggaagaggccuugcgcgggcugccuauuagguaccagacccccgcuauccgugcagagcacacuggacgggaaaucguagaccucaugugucaugccaccuucacaaugagacugcuuuccccaauuagggugccuaauuauaaccugaucauuauggaugaggcccacuuuacggaccccgcuaguauagcggcacgcgguuacaucucuacucgaguugaaaugggcgaggccgcugggauuuucaugaccgccacaccaccgggaagcagagacccuuuuccccaguccaaugcaccaaucauggaugaggaacgggagauccccgaaaggucauggaacucuggccacgagugggucaccgacuucaaagguaagacugugugguuugugccuagcauuaaggccgggaaugauauagcugcgugcuugcgcaaaaacggaaagaaagucauccaacuaagucguaagacauucgacuccgaauauauuaaaaccagaacgaaugauugggacuuuguagugacuacagauaucagcgagaugggcgccaacuucaaggcagagcggguuauugacccaaggcgcuguaugaagcccgugauccugaccgauggcgaagagcgagucauacucgcugggccuaugccggugacccauucuucagccgcacagagacggggaaggguuggucgcaauccaaaaaacgaaaaugaccaguacaucuacaugggcgagcccuuagaaaacgaugaggacugcgcccacuggaaggaggcuaaaaugcugcuugacaauauuaacacuccugaagggaucauucccuccauguuugagccagaaagagagaagguggaugccaucgacggagaauauaggcugcggggcgaggcgcguaaaacauucgucgaucucaugcgccgaggugacuugccuguguggcuggcauacagaguagccgcugaggggauaaacuaugccgauaggcggugguguuuugacggcgugaagaauaaccaaauucucgaagagaauguugaagucgagaucuggaccaaagagggagaacgcaagaagcugaaacccagauggcuugaugcuaggauuuacagugacccacuagcacugaaggaguucaaagaauucgccgcuggccggaagagcuugacauuaaaccugaucacugagauggggcgacucccuacguuuaugacccagaaagccagaaaugcacuggauaaccuugcggugcugcauacagccgaagcuggaggucgcgccuauaaucacgcacucucggaguugccggagacucuggaaacccuacugcuccuuacacuguuagcuaccgugacuggcgggauauucuuguuucugaugucuggaaagggcaucgguaagaugacgcucgggaugugcugcauugucaccgccuccauccugcuuugguacgcacagauucagccccacuggaucgccgcuagcauaauucuggaguucuuucucaucguuuugcugaucccagaaccugagaaacaaaggacaccccaggacaaccaguuaacuuaugugguaauugcgauccuaaccguggucgccgcaacaauggcuaaugaaaugggcuuccuggagaagaccaaaaaggauuuuggacucggcucaauaacuacacagcaaccagagaguaacauucuugacaucgaucugcggccugccucugccuggacguuguacgcaguggcuaccacuuucauuacacccaugcugcgucauuccaucgaaaauagcucaguuaacgugagucucaccgccauagcgaaucaggcuaccguccugauggggcuuggaaaagguuggccgcucagcaagauggacaucggcguaccacuguuggccauuggguguuacucccaggugaacccuaucacacugacugcagccuuacuacugcucguugcucacuaugcaauuaucggacccggccuucaggccaaggcgacgagagaggcucaaaaaagggccgcagccgguauuaugaagaauccaaccguggacgggaucacagucauagaucuggaccccauuccuuacgauccgaaauuugaaaagcaguugggccaggugaugcugcucguccugugcgugacucagguucuuaugaugcgcaccacaugggcuuuaugugaggcccugacccucgcaacuggacccaucucuacguugugggaaggcaacccagggcgguucuggaauacaaccaucgcugugagcauggccaacauuuuucgaggauccuaucuggcgggcgccggucuacuguucucaauaaugaaaaacacugcaaauaccagaagggggacaggaaacacuggcgagacccucggugagaaguggaagaaucgccuuaacgcucugggcaaaucugaauuucaaaucuacaagaaaagugggauucaggagguagaccggacauuggccaaggaaggaaucaaaagaggcgagacggaucaucacgcagugucgcgugggagcgcuaagcugaggugguucgucgagcggaaucucguuaccccugaaggaaaaguggucgaccugggcugcggucgcgggggaugguccuauuacuguggcgguuuaaagaacgugaaggagguaaaaggccuuacuaaggggggacccggccaugaagagccuauuccaaugucuacauauggguggaaucuggugcgacuccagucaggaguugauguguucuuuacccccccugaaaaaugcgacacucuacugugugauaucggcgagagcuccccaaaccccacagucgaggccgguagaaccuugagggugcugaaucucgucgaaaacuggcuuaauaacaauacgcaauucugcauaaaggugcugaacccguacaugccuaguguuaucgagaaaauggaagccuugcagcggcgcuacgggggagcgcugguaagaaauccacucucuaggaacagcacccacgagauguauugggugucaaacgcuuccggcaauauugucaguagcgugaacaugaucucucgaauguuaauuaaucgguuuacaaugcgucacaagaaggcaacuuacgaacccgacguugaucugggcuccgggaccagaaacaucggaauagagucagaggugccuaaucuugacauuaucgguaaacgcaucgaaaagauuaaacaggagcaugaaacaagcuggcacuaugaucaggaccauccauacaagacuugggccuaucacggcucguacgagaccaaacaaacagggucugcuaguuccauggucaacggagugguaaggcugcuaaccaagcccugggacgugauaccgaugguuacucagauggccaugacggauacaaccccuuucggccagcagcgggucuuuaaggaaaaaguggacacuagaacccaagagcccaaggaggguacaaaaaagcucaugaaaaucacggcagaauggcuguggaaggaguuggggaagaaaaagaccccacgcauguguacuagggaagaguucacacgaaaagugcggagcaaugccgcucugggagcgauuuuuaccgaugagaacaaguggaaaucagccagagaagcagucgaggacuccggcuucugggaacucguugauaaggagaggaaucuucaccuggaaggcaaaugcgagacuuguguguauaacaugauggggaagcgcgagaagaaauuaggagaauuugguaaggcuaaaggcucucgugccaucugguacauguggcugggggcacgguucuuggaguuugaagcccucggauuccugaaugaggaccauugguuuagcagagaaaacagucuauccggcguagagggugaggggcuucacaagcugggauacauucucagggaugugagcaaaaaggaaggcggcgcuauguaugccgacgauacagcggggugggacacccgcaucacacuggaggauuugaagaaugaagagauggucacuaaccauauggaaggagagcacaaaaagcuggcagaggccauauuccgacucaccuaccagaauaaagugguucgggugcagagaccuacgcccagggguaccgucauggacaucauuucucgcagagaccagcggggcucagggcaagugguaacauauggacuuaacacuuucaccaacauggaagcucagcugaucaggcagauggagggcgaagguguuuuuaagaguauucaacauuuaacagccacugaggagaucgcagugaaaaauuggcugguccguguggggcgagaacgcuuguccagaauggcuauuagcggagaugacugcguggucaagccauucgaugaccgguuugccaacgcucucaccgcccugaaugauaugggcaagguuaggaaagacauacagcagugggagcccucucgcggcuggaacgauuggacgcaggugccuuucugcucgcaccacuuucaugaacuaaucaugaaggacgggagaguacuuguggucccaugucggaaucaagaugagcugauuggaagggcacgaaucucacagggugcgggcuggagccuccgugaaacagccugccuggggaaauccuacgcucagauguggaguuugauguauuuccacagacgcgacuuacggcuggccgcaaacgcuaucuguucugccgugccgagccauuggguucccaccuccaggacuacauggucaauucacgcaacccacgaguggaugacuaccgaggauaugcucacaguguggaauagagucuggauacaggaaaacccuuggauggaggacaagacgccaguggaaaguugggaggaaauccccuaccuuggaaaacgcgaggaucaauggugcggcucucugauuggucuaaccagccgggccacuugggcgaagaauauccagacagcuauuaaccagguaaggucccugaucgggaaugaggaauauaccgacuacaugccuucaaugaagcgauuuagacgggaggaagaggaagccggaguucucugguga

SEQ ID NO: 15034 - RNA, 9873 nt, Artificial Sequence
  derived and/or modified CDS sequence (opt3) from DENV-2__KX274130__SS-prME
agcgccgcuacccugcuccuucuggugcccacaaucauggcauuccacuugacuacgagaaacggcgagccucauaugauugucgccaggcacgaaaaggggaaauccuuaauauuuaagaccgagaauggaguuaacaugugcacacugauggcgauggaccuaggugaacucugugaggaaacugugaccuacaaaugcccauaucugaagcagucugagccggaggauaucgacuguuggugcaauacaaccucaacuuggguaacauacggcaccuguaguagcuccggggaacaucggcgcgagaaacgaucuguggcucuugccccccacgucggaaugggccuggaaacgcguacugagaccuggaugucgucagagggugcauggaagcaugcccaaagaauugaaaacuggaucuugaggcacccuggguauacagugauggcugcagccauugcuauggccaucggaacuaauaacuuccagcgggcgcucauauuuguucugcugaccgcaguggccccaagcaugacaaugcgcugcgucggcaucgcuaauagagauuucguggagggcguaagugggggauccuggguugacauugugcucgaacacgguucuugugucaccacgauggccaagaacaaacccacuuuagauuuugagcugacaaagaccgaagcaaaacuuccugcuacuuugaggaaguacugcaucgaggccaaacugacaaauaccacgaccgagagccgguguccaacacagggcgaacccucccuaccugaggaacaggacaagcgcuucauuugccgacauucacucguggauagaggguggggaaacggcuguggucuguuugggaagggaggcaucgugacuugcgcgauguucaccugcaaaaaguauauggagggcaaaauaguccaaccagaaaaucuugaguacacaguugccgugacuccgcacaguggggaggaacauagcguaggaaacgacaccgguaagcacggccaggaugugaaaauuacaccccagucuuccaucaccgagacugcacuggaaggguauggaucaauuagcauggaguguaguccuaggacgggcuuggacuuuaaugaaaugguccuccugcagauggaggauaaggcuugguuagugcaccggcaaugguuccuggaccucccacuucccuggcugccugguucugauacacagggguccaacuggguucagaaagagaccuuggugacuuuuaagaauccacaugccaagaaacaggacgucgugguacuaggcagccaagaaggagcuaugcacucggcccugaccggcgcaacagagauccagaugaccucugggaaccuccuguucacuggacaucuuaagugccgucugcgcauggacaaauuggaacucaaggguauguccuacucaauguguacaggcaaauuuaagguugugaaggagaucgccgagacgcagcacgggaccauugucauaagagugcaauacgaaggagagggcagucccugcaaaaucccguucgaaauuauggaucuggagaagaaacaugucuuagguaggcugaucacugugaacccuauaauuacagaaaaggacaaacccaccaauaucgaggcugagccaccuuucggggauagcuauauccuaauuggcguugaacccggacagcucaagaugaacugguuuaagaaaggcuccucuaucgggcagauguucgagacaacuaugcggggagcgaagcgaauggcaauucugggugacaccgccugggauuuuggcagccuugggggaguguucaauucaauaggcaaagcuuugcaccagguauuuggugccgucuacaacgcagccuucagugggguguccuggacgaugaagauccugauuggcguuaucaucaccuggauuggaaugaauagccgcucuacaucaaugaguauaacucucgugauggucggccuggugacccuuuaucuggggguagugguucaagcugacagcggaugugucguguccuggaaaacaaaggaauugaagugcggcucugguaucuuugugacugauaacguccacguuuggaccgagcaguacaaauuccagccagaaucgcccgccaagcucgcagcggcuauuaaaaaggcccaugaggaggggguguguggaaucagaagcgugacgaggcuggaaaauauuauguggaaacagaucacaccugaguuaaaccacauacugaccgaaaaugacguaaaggucacuaucaugacaggcgauauuaaagguauccuacaacagggccggcgcgcacucagaccacagccgaccgagcugaaguauuccuggaagucaugggggaaaaguaagauugugucuagcgaaacucauaaccagaccuuucuuaucgacggacccgagacaacggagugcccugauaccaauagggccuggaacuccuuggaaguugaggacuacggcuucgggcuguuuucaacuaauauauggcuccgucugcgggaaaaacaagacacauuaugugauagcaagcugaugucugcugccgugaaagacgagcgagcaauucacgcugauaugggauauuggaucgaguccaagcuuaacggcaguuggaagauugaaaaagccagcuucuuggaggucaagucuugcaccuggccaagaucccacacacucuggucaaauggugugcuggaaagugagaugaucauacccaaaaaccuagggggaccuguuagccagcauaacuacaggccaggcuacuauacucagaccacgggucccuggcaccugggcaagcucgaaauggacuuugauuacugugaggggacaaccgugaucguaacugaggaaugcaauaaccgcggaccgucgcugcggaccacaacugcguccggcaaacuuauuaccgaguggugcuguagaucuugcacaaugccuccauugagguucaagggggaagacggauguugguauggcauggagauccgcccccugaaggaaaaagaggagaauuuagucaacagccucgugacggccggucaugggcagauugauaauuucucacugggaauccuuggcauagcucuguuuuuggaagaggugaugaagagucgaauugguaucaaacacaccaucggcaugacuauuaucacauuccuccugcuagucaccgggaacguuuccuaccgggaccugggacgugugauucucaugguaggcucuacuauggcagaugaaauggggaugggagugacauaucuggcccuuuuggcuaccuuuagaauaaggccuacguucgcccuggcauuaaugauccgcaagcucacuagcaaagagcugcuuauggcgaccauuggcaucguccugauugcccaaugcgacgugcccgguacaauccuagaaauaaccgaugcuugugcccucgggcugauguugcugaagaugacucgggaguuagagagauaccagcucgcaguuacacugcuuucccugaccugcaucccaaaugcuacaauuauguggggagccuggaaggugacuuguaccaucuugacgcucgucucaauggcaccucuguuucuaacaaccagcaggcagaaaacugacugggugcccguugcccugaguauuuauggccuuaacccaaccgcuaucuacuucacaacucucgcgaaggccaaaaagauacgaucuuggccgcugaaugaagcagugauggcugucggcaugguauccauuuuggccagcucgcuguuacgcaacgauaucccuauggccgggccccucguggcuggaggucugcuuacccugugcuacguuuugacgggccggucagcagaccucgagcuggaaaaaucugccgacaucaaguggaaugaugacgcggagauuaguggguccagcccaauaaucaacguggcugucucugaggauggaagcauguccauuaaagacgaagaggaagagaauacacuaaccauccugauuagaacuggccuucucgccaucucagguauguaucccauggcaauaccugccacagcugcagugugguacuuuugggaagccaggaagcaacgugcggggguacugugggaugugccaagucccccuccgaccggaaaggcugaguuggaggaaggcgccuaucgcaucaaacagcggggcauuuucggguacagccagaucggagcaggugucuauaaggagggcacuuuucauacaauguggcacguuaccagagggucuguguuaauguguaaaggaaagaggcuggaaccauccugggccgacgugaaaaaggaucucauuucauacggcgguggguggcgacuggacggagaguggacggaaggcgaggagguccaggugcuugcucuggaacccggcaagaacccucgggccguucaaacuaaaccagggauguucaagaccgauacaggacgcaucggugcaguaaguuuggacuuugcucccggcaccagcggguccccuauaauugauaaaaagggaaaagugaucggccuauaugguaauggggucgugaugaagucuggagccuacguuucgagcaucgcgcagacagagaagagagaagacgagauuccggaaaucgaggaugacauauucaggaaacggcgacugacuauuauggaccuccaccccggcgccggcaagaccaaaagauaccugccagcaaucgugcgcgaggcuauuaagagggggcuucguacguuaauccuggccccuacacgggucguggcugcagaaauggaggaagcccucagaggauugcccauaagguaucagacuccagccauucgcgcugagcauaccggucgagagaucguagaucugaugugccacgcgacauuuaccaugagacuccugucaccuguccgggugcccaacuacaaccuuaucauuauggacgaagcacauuucacugauccagccuccaucgcugccaggggcuauauugcaacccgcguugagaugggggaagccgcuggaauauucaugacagcgacgccgccuggcaguaaagaccccuuuccacagucuaaugcccccaucauggaugaggaacgugagauuccugagagaagcuggaacuccggucacgaauggaucacugacuucgaggggaagaccgugugguuugucccaucaauccgggcaggaaaugauauugcuacaugucugaggaagaacggcaaaaaggugauacaauugucucgcaaaaccuucgacacugaauacaucaagacacgaaauaacgauugggacuuuguugugaccacggauauuagcgagaugggcgccaauuucaaagcagaaagagucaucgacccccggaggugcaugaagccugugauucuaacugacggggaggagcgcguaauccuggccggaccgaugccagugacacccaguuccgcugcccagagaaggggucggauaggccguaacccuaagaaugaaaacgaucaguauaucuacaugggggagccccucgaaaaugacgaggauugcgcgcauuggaaagaagcaaagauguuacuggacaacauuaauaccccagagggaaucauuccugccauguuuggccccgagcgcgaaaaaaccgaugcuaucgacggugaguaucgacuuagaggggaaagcaggaagacuuucguugagcugaugcggcgcggcgaucucccagucugguuggccuacaaaguggcuucugagggauacucauaugcagacagaaggugguguuuugaaggcgugaagaacaaucagauacuggaggaaaaccucgaggucgaaauuuggacaaaagagggggagcggaagaagcugcgaccuaaauggcuugaugccagaaccuacuccgacccgcaagcucuaaaggauuucaaagaauuugccgcaggacgcaagaguacaacucugaacuugaucgcggaguuagguaggcugcccacguauaugacccagaaaacacgggacgcccucgauaaucuggcuguacuucacacugccgaagagggcgggcgugcauaccagcacgcuauuagcgaacugccagagacccucgagacauugcugcuacugugccuccuugccaccgugucgggaggcguuuuccuguucuuaaugucugguaaggggaucggcaagauguccaugggauugggcuguauaaucacugcaagcgggcugcucugguaugcccaaauucagccucauuggaucgcugcgucaauuauccuggaauuuuuccuuauagugcugcucauucccgagccagaaaaacagagaacgccucaggacaaccaauugaccuacgucgugaucgccauccugacauuaguugcagcuacuauggccaaugagaugggauaucuagaaaagaccaaaaaggaccuggguuuuggcaaccccuacguggccagucacgaggcagcuauucucgauaucgaccuucauccggccucugcguggacacuguacgcugucgccaccacuuugauaacaccaaugcugaggcacuccauugagaauagcucaacgaacgugagucucaccgcaaucgccaaucaggcuacuguacugauggggcuuggaaaaggcuggccucucagccgcauggaucugggugugcccuugcuggcauuagggugcuauucccagguuaacccacuaacacugaccgccucucuccuucuguugauuggccacuacgcgaucauaggacccggccugcaggcuaaggccacccgggaagcacaaaagcgaacagccgcugggaucaugaaaaauccuacugucgacggaauuacggugaucgauauugagccgauccccuaugacccaaaguucgaaaaacagcucggccaggugaugcugcuugucuuauguguugcccaggugcugaugaugagaaccacaugggcaaugugcgaggcucucacuauugccaccgguccuaucagcacauugugggaggggaaccccggaaaguuuuggaauaccacuauagcgguauccauggccaacauuuucaggggcucauaccuggcaggugcuggccuacuguuuucuaucaugaaaaauacggugacagggcgccggggaaccggcgucgccggggaaacucucggagagaaguggaagaucaaacuuaacggccuggguagaaccgauuuccaaacauauaagcguagugggauuauagaaguggacaggacuuuggcaaaagagggaaucaagcggggcgaaaccaaucaucacgcuguuucgcgcgguagcgccaaacugcgaugguuuguggagagaaaccucgucaagccugagggcaaaguaauugaucugggguguggaaggggcgggugguccuacuauugcggaggcuuaaagaaugugacagaaguuaagggucuuacgaaagggggaccaggccaugaggaacccaucccuaugucuaccuacggcuggaaccuggugcggcuccagucaggggucgacguguucuuuacuccacccgagaagugugauacacuacugugcgacauuggagaaagcuccccgaacccuaccaucgaggccggucgcacuuugagaguccugaauaugguggagaacuggcucggcaauaaccaguucuguauaaaaguucuuaauccauacaugcccagugugaucgaaaagauggagaaccugcagaggaaauuugggggaacauugguacgaaauccucugucucggaacagcacccacgaaauguauugggugucaaaugcguccggcaacauugucaguagcguuaauaugaucucucguaugcucauuaacagauucacgaugaagcauaagaaaccaaccuacgagcaagauguggacuuagguuccgggacacgcaaugucggaaucgaaacugagaagcccaaccuggagauaauuggcaaaaggaucgaaaagaucaaagacgagcacaagcagaccuggcacuaugaucuugaccauccguacaagacaugggcuuaucacggcucauacgaaacuaaacagaccgggagcgcaucgucuaugauuaauggagugguaaagcugcuaacaaaaccuugggaugugauacccaugguuacccaaauggccaugacugacacgacaccauucggucagcagcggguguuuaaggagaaagucgauaccagaacuccugagcccaaggaaggcaccaagaaacucaugaagcugacagcuaaaugguugugggccgagcuggggcgccauaaggugccaaggaugugcacgcgagacgaauucaccaacaaaguccggaguaacgcagccaugggagcuguguuuacugaggaaaauagaugguccagcgcgaaggaggccguugaggaugaagcauucugggaccucguagauagggagcgcaaacuucaccugcagggcaagugcgaaacauguguguauaacaugauggguaagcgugagaaaaaguuaggggaauuuggacgggcuaaaggcucaagagccaucugguacauguggcugggcgcaagguucuuggaguuugaggcccucggguuccugaaugaagaccacugguuuucccgcgagaacucucuaagcggagucgaaggugagggccuucauaagcugggguacauucuccgagaaaucggagcuaaagauggcgguaugauguaugccgacgacaccgcggggugggauacucgggugacagaggaggaccugaagaaugaagagaugauuagugaacaaaugaagggagagcacagaaccuuggcagaggccaucuucaaacugacauaccagaacaagguugugaggguccagcgccccacuccuaaaggcaccgugauggauauaaucuccagacgggaccagaggggcagcgggcaaguaggaacguauggucucaauaccuuuacaaacauggaagcucagcuuauucgucagauggagggcgaagggcuguuccgagauaucucuaaguuaacuauucaggaggaaaccgccauccugacaugguugaaagagaagggacgcgacagacucucacggauggcaauuaguggcgaugacugcgugguuaagccagucgaugacagguuugcucaugcccugacugcucuaaaugauauggguaaagugcgcaaggacauacaacagugggaggccuccaaaggguggaacgauuggacccaggugccguucuguagccaccauuuccacgaaaucauuaugaaggacggaagaaaacuugucguucccugccggaaucaagacgagcugaucggcagggcacgaaucucucagggcgcggggugggcccucaaggaaacggcuugucugggaaaggccuacgcacagauguggucguugauguauuuucaccguagagauuuacgccuggcugccaacgcaauuugcucagccgugccuagccauuggguaccaacaucccggaccacuuggaguauacacgcgcaucaccaguggaugacaaccgaggacaugcucgauguguggaauagggucuggauccuugaaaaccccuggauggacgauaaaacuugugugaagucuugggaggagguuccuuaccuggguaaaagagaagaccaauggugcggcagccuaauugggcugaccucccgcgcuacaugggccaagaauaucaaaguggcaauugagcagguccggucacucaucggaaaggaagaguauacggauuacaugccaaguaugaagagguucaaacaggaacagucuaccgagggcgccuugugguga

SEQ ID NO: 15035 - RNA, 9876 nt, Artificial Sequence
  derived and/or modified CDS sequence (opt3) from DENV-2__GU289914__SS-prME
agcgcaggaaugaucauuaugcugauacccaccgugauggcuuuccaccucacaacuagaaacggggagccucauaugaucgucuccaggcaggaaaagggaaaaucucuucuguuuaagacggaggacgguguuaauaugugcaccuugauggcaauggauuuaggcgaacugugugaggacacaauuacuuacaacugcccauuacuccggcaaaaugaaccggaggauaucgacuguuggugcaacucaaccaguacaugggugaccuaugggacuuguacaaccacgggagagcaccgccgagaaaaacguagcguagcccuggugccccaugucggcaugggucuugagacuagaaccgaaacauggauguccucugagggggcguggaagcacgcucagaggauugagacuuggauccugcggcauccuggauucaccauaauggccgcaaucuuggccuacacaauuggcaccacgcacuuucagcgcgcucucaucuucauucugcugacugcaguggccccaucgaugacaaugagaugcaucggcauaucaaauagggauuuuguugaaggggugagcggagguaguugggucgacauugugcucgagcacggcuccuguguaaccacuauggcuaaaaacaagcccacauuagauuucgaacugaucaagaccgaggccaaacagccugcgacgcuucggaaguauugcauugaagcaaaauugaccaauacaacuaccgagucucgcuguccaacacaaggggagcccagccugaacgaggaacaagacaagcgauuuguuugcaaacauuccaugguggauagaggauggggcaaugguugugggcuauucggaaagggcggcaucgucacuugcgccauguuuaccugcaagaaaaacauggaagggaagguggugcagccugagaaucucgaauacacaaucgucguuaccccacacucaggagaggagcaugcuguggguaacgacacuggcaaacacgggaaggaaauuaaaguaacgccgcagaguagcauaacagaggccgaacugaccggauauggcacugugaccauggaguguucucccaggacaggucuugauuucaaugaaaugguccuguugcaaauggagaacaaggcauggcucgugcaccggcagugguuucuggacuuaccucugccauggcuccccggggcugauacccagggcuccaauuggauccagaaagagacucuuguuacauucaagaacccucaugccaagaaacaagacguggucgugcugggaucacaggaaggcgcgaugcacacggccuugaccggggcaacugagauucagaugagcaguggaaaccuacuguuuacaggucaucucaagugccgucugcgcauggacaaacuucaacugaagggcaugucuuacuccauguguaccgggaaauucaagguaguuaaggaaaucgcugagacacagcacggaacuauagugauuagaguccaguaugagggcgaugguagcccaugcaaaauccccuucgaaaucauggacuuggagaagaggcaugugcucgggcggcugauuaccgucaauccgaucgugacggaaaaagauucgccuguuaacauugaggccgaacccccauuuggcgacucuuacauaaucauuggaguggauccuggccaguuaaagcugaauugguucaaaaagggguccucaaucggacaaauguuugagaccacaaugcgaggugcuaagcgcauggccauccuaggcgacacugcaugggauuucgggagucucggaggcguauuuaccagcauugguaaagcccugcaccaggucuucggggcuauauacggcgcggcauuuuccggagugucuuggacaaugaagauccuuauuggcguuaucauuacuuggaucgggaugaacagcagaucaaccaguuuguccgugagccugguccucgugggaauaguaacgcuguaucuuggcgugaugguucaggccgacucugguugugucgugucauggaaaaauaaggagcugaaaugcgggaguggaaucuucauuacagauaacgugcacaccuggacugaacaguacaaguuucaacccgagagcccauccaaguuggcuucugccauccagaaagcacaggaagagggcauuugugguaucaggucggucacacggcucgaaaaucugauguggaagcagauaacccccgaguuaaaccauauucuggccgagaaugaaguuaaacuaacuaucaugaccggcgacauuaaggggaucaugcaagcuggaaaacgcagccucagaccucagccaacagagcugaaguauuccuggaaaacguggggcaaggccaagaugcuuucaaccgaaagucacaaccagacuuucuugauagaugggccggagacagcagaaugccccaauaccaacagggcguggaacucucuggagguggaggacuacggauuuggcguguucacaacuaacaucuggcucaaacugaaggaaaaacaggacgcuuuuugugauagcaaguuaauguccgccgcaauuaaagacaaucgugccguacaugcugauauggguuauuggaucgagucagcccugaacgacaccuggaagauugaaaaggccagcuucaucgaggucaaaaacugccacuggccuaagucucacacgcuuugguccaaugggguguuggagagugaaaugauaauucccaagaaucucgcuggacccguuagccaacauaauuaccggccuggcuaucacacacagaucgccgguccauggcaucugggcaagcuagagauggauuucgacuuuugugaugggaccacuguggucgugaccgaagacugcggaaaccgaggccccucucugagaacaacuaccgcguccgggaaacucaucacagaguggugcuguaggucaugcacgcugccgccucuucgcuaccggggagaagauggcuguugguacgguauggagauuagaccauugaaggagaaggaagagaaucugguuaacaguuuagugaccgccgggcacggacagguagacaauuucagccucggcguccuggguauggcucuuuuucuggaagagauguugaggacucgcgugggcacaaaacaugcaauccuccugguggccgucucguucguuacccuaauuacugggaacauguccuuucgagaucugggacgggugguagugauggucggcgcuacaaugaccgacgauauagggaugggagugacguaucucgcccugcuugcagcguucaagguucgucccacuuuugccgcuggcuugcuguuaagaaaacucaccucuaaggaacugaugaugacaaccaucgguauugugcuucugagccaaucaacuaucccugagacaauucuagagcucaccgacgcccuggcauuggggaugaugguccugaaaauggugaggaauauggaaaaguaccaguuagcuguuacaaucauggccauacucugcgugcccaacgcagucauccugcagaaugccuggaagguaaguuguacuauucuugcugugguuuccgugucuccacuguugcucaccagcucccagcagaaaacggacuggaucccucuggcgcuaacaauuaagggacugaaccccaccgccaucuuccuuacuacccucucacgcacaagcaaaaagcggaguuggccacugaaugaggcaauaauggcugucggcauggugucuauuuuggccuccagccugcucaaaaacgauaucccgaugacuggcccucuaguagccgggggacugcuuaccgugugcuauguccugacggguagaucggcugacuuggaacucgagagggcagccgauguuaagugggaagaccaggcggagaucucaggcucuagucccauucuguccauaacaaucagcgaggaugggucuaugagcauuaaaaaugaagaggaggaacagacccuaacuauccugauucgaacaggacuucucgugaucuccggccuguuuccagugucaauacccaucaccgcugccgcaugguacuugugggaggucaagaagcagcgcgccgguguguuaugggacguuccuaguccacccccuauggggaaagcugaacuggaggauggagcauaucggauuaagcaaaaaggcauccucggcuacagccagauuggggccggaguauauaaggaagguacuuuccacacaauguggcacgugaccagaggcgcgguccugaugcauaaagggaagaggaucgagccgucuugggcugacgugaagaaagaucuuauauccuacggaggcgguuggaagcuggaaggggaguggaaagagggagaagagguucagguguuggcccuagaaccaggcaagaacccccgugcaguccagacgaaaccuggccuguuucgcacuaacgccgggaccauuggagcugugucacucgacuucaguccagguacaagcggcucccccaucaucgauaagaaggggaaaguagucggacuguacggcaauggugugguuacccggucuggggccuaugugucggcaauugcucaaacagaaaagagcaucgaagacaacccugagauagaggaugacauuuuuagaaaaaggcgacuuacuaucauggacuuacacccgggagccggcaagaccaaacgguaccugcccgcgauuguccgcgaagccaucaagagaggccucaggacguugauacuggcaccaacacgggugguugcugccgagauggaagaggcucuccgagggcugccuauuagauaucagacucccgcaauccgcgccgaacauaccggaagggagaucguggaucuuaugugucacgccacauucaccaugcgucuguugucaccaguccgggugccuaauuacaaccuaauuaucauggacgaggcucauuucacugaucccgcguccauugcagccagagguuauauaaguaccaggguagaaaugggcgaggcugccgggaucuuuaugacagcaacgccaccgggaucucgcgacccuuucccccagagcaaugccccaauuaucgaugaggaacgagagauccccgaaagauccuggaacucaggccacgagugggugacugacuuuaaggguaaaaccguuugguucgucccuucuauuaaggcugggaaugauauagcggccugccugcggaaaaacggaaagaaagugauccaacucagcaggaagacauuugacagugaauacgugaagacccgcacuaaugauugggacuucgucguaacaaccgauauuuccgagaugggcgcaaacuuuaaagcugaacgugugaucgacccaagacgguguaugaagcccguuauuuuaacggacggcgaggagagggugauccuggccgggccuaugccggucacucacagcucugcagcccagcgccgaggaagaauaggucggaaucccaaaaacgaaaaugaucaguauaucuacaugggcgagccccuugaaaacgacgaggauugcgcucauuggaaggaagccaaaaugcugcucgacaauauuaacacaccugaggggaucauucccucaauguucgagccagaaagggagaagguggaugcgaucgacggagaauaccgcuugagaggcgaggcaaggaaaaccuuuguugaucugaugcggcguggugaccucccuguguggcuggccuauaaggucgcugccgaagggauaaacuacgcugaucgccgaugguguuucgacggcauuaagaauaaccagauccuugaggagaauguggaaguagagauuuggaccaaagaaggagagagaaagaaacuaaagcccagguggcuggaugcacggaucuauuccgacccauuggccuuaaaagaguuuaaggaguucgcugccggccgcaagagucugacucucaaccugauaacagagauggggagacuuccuaccuucaugacacaaaaagcaagggaugcgcuggacaaucucgccguguugcacacugcugaagccggaggucgggcauacaaccaugcucugagcgagcuaccggaaacgcuggagacccuccuucuguuaacauugcuggccacuguuaccggcgggaucuuucucuuccugaugucgggacgaggcauugguaagaugacacuugggaugugcugcaucauuaccgcaucuauccugcucugguaugcccagauacagccccacuggauugcugcguccaucaucuuggaguuuuuccugauugucuuacuaaucccagaaccugagaaacagagaacuccccaagacaaucagcugacguacguggugauagccauucucaccgucguugcagcuacaauggccaacgaaaugggcuuucuugagaagacuaaaaaggaucugggauugggcagcaucgccacccagcagccagaaucaaauauucuggacaucgaucuccgcccugcaagugcuuggacacuguaugccguggcgaccacuuucguaacacccaugcuuaggcacucuauagagaacuccagcgugaaugucucacucacggcuaucgccaaccaagcaaccgugcugaugggguugggaaaggguuggccgcugaguaaaauggacauuggcguuccauuacuagccaucggguguuacagccaggugaauccuauuacucugacagcugcacuccuucuguuggucgcccauuacgcgaucauuggacccggccugcaggcuaaggccacccgggaggcacagaaacgugccgcugccgguaucaugaagaacccaaccguagaugggauaacagugauugaccucgaucccaucccuuaugacccgaaauuugaaaagcaacugggccagguuaugcuuuuagugcugugcgucacucaggugcucaugaugagaacgaccugggcauugugugaggcucugacacuagccacuggacccaucuccacccugugggaaggcaauccagggagguucuggaacacaaccauugcggucucuauggccaauauauuucgcggaagcuaccucgcaggcgcuggucuucuguucuccaucaugaagaacacuacgaacacacggcgagggaccggaaauauuggcgagacuuugggugaaaaauggaagucaagacugaacgcccucggcaaaucugaguuucaaaucuauaagaaaagugggauucaggagguggauaggacccuggcaaaggaaggaaucaaacgcggcgagacagaccaccaugcuguuucgcgggggagcgccaaguuaagaugguucguggaacguaauaugguaacuccugagggaaagguggucgaucuuggcugcgguaggggagggugguccuacuauuguggcggucugaaaaacguucgggaggugaagggccucaccaaagggggacccggccacgaggaaccuauaccaaugucuacauacggguggaaucuaguccgccugcagucaggaguggacguauuuuucaucccaccugaaaagugcgauacguugcugugugacauuggcgagagcuccccaaaccccaccguggaagccggucgaacucucagaguucuuaaucugguggagaacugguugaauaacaauacacaguucugcaucaaaguccugaacccguauaugccuagugugauugagaagauggaaacccuccaaaggaaguacgggggagcguuaguccggaauccacugucucgcaacagcacucaugagauguacugggugucaaaugcuuccggcaacaucguuaguagcguaaacaugauaucuagaaugcuuauuaauagguuuacaaugcgacacaaaaaggcaaccuaugaacccgacguggaucugggcuccgggacgcggaacaucggaaucgagucagaaauuccuaaucuagacauaaucgguaaacguauugagaagaucaaacaggagcacgaaaccagcuggcauuacgaucaggaccacccauauaagacaugggccuaccauggcucguaugagacuaagcagaccgggucugcuaguuccauggucaacggagugguuagacuccugacaaaacccugggauguggucccgauggugacucaaauggccaugaccgacacaaccccuuucggccagcagcgcguauuuaaggaaaaaguggauacuaggacgcaggagcccaaggaagguaccaaaaaguugaugaagauuacagcagaguggcuguggaaagagcucgggaagaaaaagacuccacggauguguaccagagaagaguucacacgcaaaguuaggagcaaugccgcucuuggagcgaucuuuacggacgaaaacaaguggaaaucagcccgagaggcagucgaggauucccgguucugggaacugguggacaaggagagaaauuuacaccuggaaggcaagugcgagaccuguguguacaacaugaugggcaaaagggaaaagaaauugggggaguuuggaaaggcuaaagguucucgcgccauaugguauauguggcucggcgcacguuuccuggaguuugaagcccuaggguuccuuaaugaggaucacugguuuagccgggaaaacagucuguccggagucgagggcgaaggucuccauaagcugggguacaucuugagagacguuagcaagaaagagggaggcgcuauguacgccgacgauacugcgggcugggacacaaggauuacccuggaggaucucaagaaugaagagauggugacuaaccacauggaaggggagcauaagaaacuugcagaagccaucuucaaacugacauaucaaaauaaaguagugcgcguccagcgaccuaccccacggggaacagugauggacauuaucucuagaagggaucagcgcgguucaggccaaguugggacuuacggauuaaacaccuuuacgaauauggaggcucagcugauuagacagauggagggcgaagguguguucaagaacauacagcacuugaccgucacagaggaaaucgccgugcaaaacuggcucgcacggguagggagggagcgucugagucgaauggcuauuuccggagacgauugcguugugaaaccacuagacgaucgcuucgccagcgcucuuacugcccugaaugacaugggcaagaucagaaaagauauccagcagugggagcccucucggggcuggaacgacuggacccaggucccuuuuugcucgcaucacuuccacgaacucauuaugaaggaugggagggugcugguggucccaugucgcaaucaagacgaguugauaggcagagcacggaucucacagggugcgggcuggagcuuaagggaaacagccugccuggggaaauccuaugcucagauguggagucucauguacuuucaucgacgugaccuuagacuggccgcaaacgcuauuuguucugccguuccgagccacugggugcccacuucccgcaccacguggucaauccaugcaaagcacgaguggaugacaaccgaagauaugcuaacuguauggaaucggguguggauucaggagaacccuuggauggaggacaagacaccagucgaaaguugggaggaaauccccuaucugggaaaaagggaggaucaauggugcggcucucucauagguuugaccagcagagccacuugggcgaagaauauccaggcugccauuaaccaggugcgcucccugaucgggaaugaagaguacaccgacuauaugccuucaaugaaacgguucaggcgagaggaagaggaagcaggaguucuuugguga

SEQ ID NO: 15036 - RNA, 9876 nt, Artificial Sequence
  derived and/or modified CDS sequence (opt3) from DENV-2__AY858036__SS-prME
accgccggcaucauuauaaugaugauccccacagugauggcuuuccaccugacuacgagaaacggggagccucauaugauugucagcaggcaggaaaagggaaaaucccuccuuuuuaagaccgagaaugguguuaacaugugcacacugauggcaauggacuugggcgaauuaugugaggauacuaucaccuacaauugcccacugcuacggcaaaacgaaccggaggacauugauuguuggugcaauucuacaucaaccugggugacuuaugggacauguaccgccacgggagagcaccgccgagaaaaacguaguguagcgcucgugccccaugucggcaugggucuggagacuagaaccgaaacauggaugagcuccgagggggcuuggaagcacgcccagaggaucgagacuugggugcuucggcauccuggauucaccauaauggcagccauccuggcuuacacaauuggcaccacguauuuucagcgcguuuugaucuucauucuccugacugcaguggccccaucuaugacaaugagaugcaucggcauaucgaacagggacuuugucgaaggggugucaggagguagcuggguagauauuguucuggagcacggcaguugugugaccacuauggcuaaaaauaagcccacacucgacuucgaauuaaucaagaccgaggccaaacacccugcgacgcugcggaaguacugcauugaagcaaaacuuaccaacacaacuaccgccucccgcuguccaacacagggggagcccucuuugaaugaggaacaagauaagcgauuugucugcaaacauagcaugguggacagaggauggggcaacgguugugggcuguucggaaagggcggcaucgugacuugcgcuauguuuaccugcaagaaaaauauggaggggaagaucguccagccugaaaaccuagaguauacaauuguuauaaccccacacuccggagaagagaaugccguggguaacgauacuggcaaacaugggaaggagaucaaaguaacgccgcagucaaguauuacagaagcagagcucaccggauacggcacugugaccauggaauguagccccaggacaggucuggacuucaaugagaugguccuucugcagauggaaaacaaggcuugguuggugcaccggcaaugguuucucgaucugccuuuaccauggcugcccggggccgacacccagggcucuaacuggauccagaaagagacucucguuacauucaagaauccucacgcgaagaaacaggauguggucgugcuuggaucccaagagggcgccaugcauacggcacugaccggggcuacugaaauacagaugucaagcggaaacuugcuauuuacaggucaccugaagugccgucuccgcauggacaaacugcagcuuaagggcaugaguuauucuauguguaccgggaaauucaagguaguuaaggagauugccgaaacacaacauggaacuaucgugaucagaguccaguacgagggcgacgguuccccaugcaaaauucccuucgagaucauggaucuggaaaagaggcacguguuggggcggcucauuaccgucaauccgauagugacggagaaagacagcccuguuaacaucgaagcugagcccccauuuggcgauucguacauuaucaucggaguggaaccuggccagcugaaguuaucuugguucaaaaagggguccucaauuggacagauguuugagaccacaaugcgaggugccaagcgcauggcaauacugggcgacacugccugggauuucgggagucuaggaggcguauuuaccagcaucgguaaagcucuccaucaagucuucggggcgauuuauggcgcagccuuuuccggagugucuuggacaaugaagauccugauuggcguugugaucacuuggauagggaugaauagcagaucaaccagucuuuccgucagcuuggugcugguaggagugguuacgcucuaccugggcgucauggugcaggcugacucugguuguguggucucauggaaaaacaaggagcuuaaaugcgggaguggaaucuucguuacagauaaugugcacaccuggacugaacaguauaaguuucagcccgagagcccauccaagcuggccucugcaauucaaaaagcccacgaagagggcaucugugguauuaggucggugacacgguuggaaaaccucauguggaagcagaucacccccgagcugaaucauauauuaagcgagaacgaaguaaaacugacuauuaugaccggcgacaucaaggggauuaugcaggcuggaaaacgcucccuaagaccucagccaacagagcucaaguacucauggaaaacguggggcaaggccaagaugcugaguaccgaacuucacaaucauacuuucuugaucgaugggccggagacagcagaaugccccaacaccaauagggcguggaacucucuggaggucgaggacuauggauuuggcguguucacaacuaauauauggcucaaacugaaggaacgucaagauguuuuuugugacagcaaauuaauguccgcugccaucaaggacaaccgggcagugcacgccgauauggguuacuggauugagucagcucugaacgacaccuggaaaaucgaaaaggccagcuucauugaggucaagucuugccacuggccuaaaucccauacgcuuuggaguaaugggguguuggagagcgaaaugaucauaccaaagaacuucgcaggacccguuucucagcacaauuaucgaccuggcuaccauacacagaccgcugguccauggcaccucggcagacuggagauggauuuugacuucugugaagggacuaccgugguagucacagaggauugcggaaacaggggccccucccuacgcacuaccacagccucagggaaacugauuacggaauggugcugucggaguugcacccucccgccucugagauacaggggagaggacggcuguugguaugguauggagauccgcccacuuaaggaaaaagaggaaaauuuggugaacagccuggugacugcggggcauggacagaucgauaauuuuucguuaggcguccucgguauggcccuguuccuugaggaaaugcugcgaacacggguuggcaccaagcacgcuauuuugcucguggcaguauccuuugugacucugaucacagggaacaugucuuuccgugaccuaggaagagucauggugaugguuggcgccaccaugacggaugacauugggaugggagugacuuaccuggcucuccuggccgcauuuaaggucaggcccaccuucgcggccggccuuuugcugcgcaaauuaacaagcaaggagcucaugaugaccacuauagguaucgugcugcuuucacaaaguacaauuccugagaccauccuggaacuaacagaugcucucgcccuggggaugaugguuuugaaaauugugcggaauauggagaaguaucagcuggcagucacuaucauggcuauauuaugcguacccaacgccgugauccuccagaaugcauggaaaguuuccuguaccacgcuggccguggucucugugagcccacuucuguugacauccucacaacagaaggcugacuggauuccucucgcgcugaccaucaagggacuaaaccccacugccauuuuucugaccacacuugcaagaacuagcaaaaagaggaguuggccacucaaugaagcuaucauggccguaggcauggugucuauacuggccuccagcuugcugaaaaacgauauuccgaugaccggcccuuuagucgcugggggacuccugacgguuugcuacgugcuuacaggucgaucggcagaccuggaguuggaacgcgccgcggacgugcggugggaggagcaggcugaaaucucaggcucuagucccauccucuccauuaccauaagcgaggaugggucuaugagcaucaagaaugaagaggaggaacagacucugacaauucuaaucagaaccggacugcuugucauuuccggccucuucccagugucaauccccauaacugccgcagccugguaucugugggagguuaaaaagcaaagggcugguguauugugggacgugccuaguccacccccugucgggaaagcagaauuagaggauggagccuaccguaucaagcagaagggcauucugggcuauagccagaucggggcgggaguguacaaagaagguacauuucacaccauguggcauguuacgcgcggcgcugugcucaugcacaaggggaaacggauugagccgucuugggccgacgucaagaaagaucugaucuccuacggaggcgguuggaagcuugagggggaauggaaggagggagaagaggugcagguacuggcauuggaaccaggcaaaaaccccagagccguccaaacuaagccuggccuauucaaaaccaacacagggaccauaggagcugugucacuggacuuuaguccagguacaagcggcucccccauuguugauaagaaagggaagguggucggacucuauggcaauggugugguuacuaggucugggaccuacgugucggccaucgcacagacggagaagagcaucgaggacaacccugaaauugaggaugacaucuuccgaaaaaagcggcugacaauaauggaucuucauccgggagcuggcaaaacuaagcgcuauuuacccgccauugucagagaagcgaucaaaaggggccugcggacccucauuuuggccccaacacgagugguagcagcugagauggaagaggcccugagagggcucccuauccgcuaccagacccccgcuauaagggcagagcacacuggacgugaaauuguggaccugaugugucaugccaccuucacaaugcggcuucugucaccaaucagaguuccuaauuauaacuugaucauuauggaugaggcccacuuuacggaccccgcuuccaucgcggcaagggguuacauuaguacucgcgucgaaaugggcgaggccgcugggauauucaugaccgccacaccaccgggaucucgagacccuuuuccccagagcaaugcaccaaucauggaugaggaaagagagauucccgaacgguccuggaacucaggccacgagugggugaccgacuucaaggguaagacugugugguuugucccuucuaucaaagccgggaaugauaucgcugcgugccuaaggaagaacggaaaaaagguaauucaacugagccgcaaaacauucgacagugaauauauaaagacccguacgaaugauugggacuuugugguuacuacagauaucuccgagaugggcgccaacuucaaggcagagagagugauugacccacggagguguaugaaacccgucauccucaccgauggcgaagagcgcgugauuuuagcugggccuaugccgguuacccauagcucugccgcacagcgaagaggacggguggguaggaauccaaagaacgaaaaugaccaguacaucuacaugggcgagccccuggaaaacgaugaggacugcgcccacuggaaagaggcuaagaugcuucuggacaauauaaacacuccugaagggaucauucccucaauguuugagccagaacgcgagaaagucgaugccaucgacggagaauauagacucaggggcgaggcgcggaagacauucguggauuugaugcgucgcggugaccugccuguauggcucgcauaccgaguggccgcugaggggauuaacuaugccgauagaaggugguguuuugacggcguuaaaaauaaccaaauccuggaagagaaugucgaaguggagauauggaccaaggagggagaacggaagaaacuuaagccccgcuggcuagaugcuagaauuuacuccgacccacuggcauugaaagaguucaaggaauucgccgcuggcaggaaaaguuuaacacugaaccucaucacugagauggggcggcugccuacguuuaugacccagaaggcccgaaaugcacuugauaaccuggcggugcuccauacagccgaaacuggagguagagcuuauaaucacgccuugagcgagcugccggagacccuagaaacacugcuccuucugaccuuauuggcaacugucacgggcgggauuuuccuguuucucaugucgggaaagggcaucgguaaaaugacccuggggaugugcugcauaaucacagcuucuauucuucugugguacgcccagauccagccccacuggauugcagccuccaucauacucgaguucuuuuugauuguucuguuaaucccagaaccugagaagcaacgcacuccccaggacaaccagcuaaccuaugugguaaucgcuauucugacaguggucgcggccaccauggcaaaugaaaugggcuuccucgagaaaacuaagaaagauuuuggacuuggcagcaucacaacgcagcaaccagagucaaacauacuggacauugauuugaggccugcuagugccuggacccuguacgccguggcaacuacauucaucacccccaugcuccggcauucuauugaaaauuccagcguuaacgugucacugaccgcuaucgccaaucaggcgacaguccuuauggggcucggaaaggguuggccgcugaguaagauggacauaggcguaccauugcuggcuaucggguguuacagccaggugaacccuauuacuuuaacggccgcacuacugcuccuuguugcccacuaugcuaucauuggacccggccugcaggcaaaagccacccgugaggcgcaaaagagagcugccgcagguaucaugaaaaauccaacaguggacgggauuacugucaucgauuuggaccccauaccuuacgauccgaaguuugaaaaacagcugggccaggugaugcuccugguccuuugcgugacccagguuuuaaugaugaggacaaccugggcccugugugaggcucucacuuuggccacgggacccauuuccacacugugggaaggcaacccagggcgcuucuggaauaccacuaucgcagugucuauggcuaacaucuuucggggaagcuaucuagccggcgcgggucugcucuucuccauuaugaagaacaccgccaauacacgaagagggacuggaaacaccggcgagacacuuggugagaaguggaaaaauaggcugaacgcauugggcaagucagaauuucaaauauacaaaaagucugggauccaggagguagaccgcacgcuggcuaaagaaggaauuaagcggggcgagaccgaucaucacgccgugaguagagggucggcaaaacuccguugguucgucgagaggaaucugguuacuccugaaggaaagguggucgacuuaggcugcggucgggggggauggagcuauuacuguggcggucuuaagaacgugaaagagguaaagggccugacaaaagggggacccggccaugaagagccuaucccaauguccaccuauggguggaaucucgugcgccuacagucuggaguugauguguucuuuacucccccugaaaagugcgacacacuguugugugauauuggcgagucaagcccaaaccccaccgucgaggcuggucgaacgcugagagugcucaaucuugucgaaaacuggcugaauaacaauacccaauucugcaucaaaguguugaacccguacaugccuuccguuauagagaagauggaagcccugcagaggaaguacgggggagcccucguacggaauccauuaagucgcaacucuacacacgagauguauugggugagcaacgcgucaggcaauaucgucuccagugugaacaugauuagcagaaugcugaucaauagguuuacuaugcgacacaaaaaggcuaccuacgaacccgacguugaucuuggcucugggacacggaacauuggaaucgaguccgagacuccuaaucuggacauaauugguaaacguaucgaaaagaucaaacaggagcaugaaaccucauggcacuaugaucaggaccauccauacaagacaugggcauaucacggcagcuacgagaccaagcaaacugggucggccucuaguauggugaacggagucgugagacuacucacgaaacccugggacguaauuccgauggugacacagauggcuaugaccgauacuaccccuuucggccagcagcgcguuuuuaaggaaaaagucgacacaaggacgcaagagcccaaggaggguaccaaaaagcugaugaagauaacugccgaaugguuguggaaagagcuggggaagaaaaagacaccacggauguguaccagagaagaguucacucgcaaagugagguccaaugcagcccucggagcuaucuuuacagaugagaacaaguggaaaagcgcgcgagaagccguggaggacucagaauucugggagcuugucgauaaggaacggaaucugcacuuagagggcaagugcgagaccuguguuuauaacaugaugggcaaaagagaaaagaaacugggggaguuuggaaaggcaaaagguuccagggcuauuugguacaugugguugggcgcccgcuuccucgaauuugaggcacugggguuccuaaaugaagaccauugguuuucucgugagaacagccuuaguggaguggagggcgaaggucugcacaagcucggguacauccugcgggauguauccaagaaagagggaggcgccauguaugcugacgauacagccggcugggacacuagaauuaccuuggaagaucugaagaaugaggaaauggugacgaaccauauggagggggagcacaaaaagcucgcggaagcaaucuucaggcuuaccuaccagaauaaagucgugcgcguucagcgaccuacaccccggggaacugugauggacauaaucagcagaagggaccagcgcgguucuggccaagucgugaccuaugggcugaacacauucacuaacauggaggcccaguuaauuagacagauggaaggagagggcguauuuaagucaauccaacaucugaccguuacggaggaaauugcugugaagaauugguugguccggguggguagggagcgucucagucgaauggccaucuccggggaugacugcguggucaaaccacuggaugaccgcuucgcaagcgcucuaacagcccuuaacgauaugggaaagguuagaaaagacauucagcagugggaacccucucggggcuggaaugauuggacccaggugccuuuuugcucgcaccacuuccaugagcugauaaugaaggacggcaggguacucguggucccaugucgcaaccaagaugaacugaucgggagagcucggauuucacagggagccgguuggagcuugagggagacugcaugcuuaggcaaauccuacgcgcagauguggagucugauguauuuucaccgacgugaccucagacuugccgcuaaugccaucuguucugcagugccgagccauuggguucccacaucccgcaccacuuggucaauccacgcuacccacgaguggaugacaacggaagauaugcugaccguguggaaccgggucuggauucaggagaauccuuggauggaagacaagacuccaguggagaguugggaagagauacccuaccuagggaagagggaggaucaauggugcggaucucugaucggccucacaagcagagccaccugggcaaaaaacauucagacugccaucaaucagguacgcuccuugauugguaacgaagaguauacagacuacaugccuucaaugaagcgguucaggcgagaagaggaagaggcggggguucugugguga

SEQ ID NO: 15037 - RNA, 9876 nt, Artificial Sequence
  derived and/or modified CDS sequence (opt3) from DENV-2__HQ332184__SS-prME
accgcaggcgugaucauuaugcugauaccaacagcuauggcauuccaccucacuacgcggaacggggagccucauaugaucgucgguaggcaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguugcgcuggugccccaugucgguauggggcuugagacccguacagaaacuuggaugaguagcgagggagcuuggaaacacgugcagaggaucgagaccuggauacugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguccucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaagaacaggacaaacgauuuaucugcaagcauucuaugguggauagaggcugggguaacggguguggacuauucggcaagggcgggauuguaaccugcgccauguuuacaugcaaaaagaauauggaaggaaaaguggugcagccugagaaccucgaauacaccauagucaucacuccacacagcggugaggagcaugcuguuggcaaugacacggggaagcacggaaaagaaauuaagaucacaccgcaguccucaauaaccgaggccgaacugacuggcuaugguaccgugacaauggaguguagucccaggaccgggcuugauuucaacgaaaugguacuguugcaaauggaggacaaagcauggcucgugcaccggcagugguuucuggauuuaccucugccauggcuccccggcgcugacacucagggaagcaauuggauucagaaggagacacuugucacguucaagaacccucaugccaaaaagcaagacgugguugugcugggcucucaggaaggggcgaugcacaccgccuugacuggagcaacagagauccagauguccucagguaaucuacuguuuaccggccaucucaaaugccgucugcgcauggauaaacuucaacugaaagggaugagcuacaguauguguacaggaaaguucaagaucgucaaagaaauugcugagacucagcacggcaccaucgugauuagaauacaguaugagggugacgggucuccaugcaagauccccuucgaaauuacggauuuggagaaaaggcauguacucggccggcugaucaccguuaacccgaucgugauugaaaaggacuccccugucaacauagaggccgaacccccauuuggagauagcuacaucauuaucggcguggagccugggcaguuaaaacugaauugguucaagaagggaucgucuauuggucaaauguuugagacaacuaugcgaggcgcuaaacgcauggccauccuaggggacaccggaugggauuucggcucccucgguggggucuuuacaucaauaggcaaggcacugcaccagguguucggagccaucuacggcgcugcguuuagugggguuagcuggacuaugaaaauucuuaucggagugguaauuaccuggaucggcaugaacuccagaucuacgagcuugucagucagucuggugcucguugguguggucacacuguaucuuggggcaauggugcaggccgacuccggauguguagugagcuggaagaauaaagaacugaagugcggcucugguauauucauuaccgauaacguucacacuuggacagagcaguacaaguuucaacccgaaucaccaaguaaauuggcuagcgccauccagaaggcacaugaggaaggcauuugugggaucagguccgucacccggcucgagaaucugauguggaaacagauaacucccgaguuaaaccacauccugucugaaaaugaggugaagcuaaccauuaugacaggagacacgaaaggcaucaugcaggccgggaagcgcucgcucagaccucaaccaaccgaacugaaauauagcuggaagacuuggggaaaggcuaaaaugcuuuccacagagucacauaaccagaccuucuugauugauggcccggaaacagccgagugccccaauacuaacagggcauggaauagucuggagguggaagacuacgguuuuggggucuucaccacgaacaucuggcucaagcugcgugagaaacaggacguauuuugugauucuaaguuaaugagcgcggcuauaaaagacaaucgggccgugcacgcagauaugggauauuggauugaauccgcccugaacgacacauggaagauggagaaggcuucauucaucgaggugaaaagcugccacuggccuaagucucauacccuuugguccaauggcguauuggaaagugagaugaucauucccaagaauuucgccggucccgucagccagcacaacuaccgaccuggcuaucauacucaaaccgcagggccauggcaccucggaaagcuggaaauggauuuugacuucugugagggcacaacugugguugugaccgaagauugcgggaauagaggacccucucuaaggacaacgaccgcuuccggcaaacugaucacugaguggugcugucgcucaugcacacucccgccucugcgguacagaggugaggacggguguugguacggaauggaaauuaggccacuuaaggagaaggaagagaacuuggucaauagucuggugaccgccggccauggucagauagauaacuuuagcuuaggcguucucgggauggcgcuguuccuugaagagaugcugcgcacucgagugggaacaaaacacgccaccuugcucguagcugcaucguuugucacgcugaucacuggcaauauguccuuccgggaccuagggcgugugauggugauggucggagccaccaugacagaugacauuggcauggguguuaccuaucuggcucuccuggccgcauuuaaggugagacccacuuucgcggccgggcuuuugcugaggaaauuaacaucuaaggagcucaugauggcuaccaucggaauuacacugcuuagccagucaacuaucccugaaaccauacuggagcuaacggaugcccucgcacugggcaugaugguauugaaaaucgugcgcaacauggaaaaguaccaacuggcugucacaauuauggccaucaguugcgugcccaaugcaguuauuuuacggaacgccuggaagguguccuguaccauccucgcugcggucucugugagcccacugcuucugacuuccucacagcagaaagccgacuggauaccuuuggcacucaccauuaagggccugaaucccacagcuaucuuucuaacuacccugagcagaacgaguaaaaagaggucuuggccacuuaacgaggccaucauggccguugggaugguguccauucucgcuagcucgcuguugaaaaaugacauaccgaugacaggaccucuggucgccgguggauuacucaccguaugcuaugugcugacugggcgaucagcagaucuugaacuggagcgcgcggcugacguuaagugggaggaucaggccgaaaucucuggaaguucccccauuuugagcaucacaauuucugaggacggcagcauguccaucaaaaacgaagaggaggaacaaacccucacuauacugauccggacaggucuacuggugauuucaggggucuucccagugaguauccccauuaccgcagccgcuugguaccuuugggagguaaagaagcagagagcaggagugcucugggaugucccuagcccacccccuguuggcaaagccgaacuggaggacggcgcguauaggaucaagcagcgugggauauugggauacucucagauuggugcuggcguguauaaagaagggacguuucacacuauguggcaugugacccgcggagccgucuuaaugcaccggggcaagagaaucgagccguccugggcagaugugaaaaaggaccugaucucauacggugggggauggaagcucgagggcgaauggaaagagggcgaagagguucaaguacuggcccuugaaccagggaagaaucccagggcugugcagacaaaaccuggaauuuucaagaccaacacagguacuaucggcgccgucagucuggauuuuagcccagggaccuccggaucucccauaguggaccgaaaaggcaagguuguggguuuguacgggaauggagucgugacgcggucgggcgcauauguaagcgcuauugcccagacagagaagucaaucgaggauaacccugaaauugaggacgauaucuuccgcaaaaagagacuaacuauaauggaccugcauccgggcgcggggaaaaccaagagguaccuccccgccauuguccgggaagcaaucaaacgaggacugagaacacuuaucuuagcuccaacccgcgugguugccgcugagauggaagaggcacugaggggucucccuauucguuaucagacucccgccaucaaggccgagcacaccggccgggaaauuguggacuugaugugucaugcuacauucacgaugagacugcucuccccagucagggugccuaacuacaaucugauaaucauggaugaggcgcacuuuacugaccccgcaaguauugccgcucgcggguauaucucuacccgaguugaaaugggagaggccgcaggcaucuucaugacagccaccccaccggguagcagagauccuuuuccccaauccaacgcuccaauuauggacgaggaacgggagauacccgaaaggucauggaacucugggcacgagugggugacugauuucaagggaaaaacagucugguuugugccuagcaucaaggcgggcaacgacauugccgcaugccuucgcaaaaauggcaagaaaguaauccagcugagucguaagaccuucgauuccgaauacgugaagacgagagcuaacgacugggauuuuguugucacuacagacauuagcgagaugggggccaauuucaaagcagagcgggugaucgauccaaggcgcuguaugaagcccgugauauugaccgacggagaagaacgagucauccuagccgguccuaugccgguaacccauucuucagcugcccagagacggggcaggauugggcgcaaccccaaaaaugaaaacgaccaauauaucuacaugggagagccccuggaaaaugaugaggacugcgcgcacuggaaggaggcaaaaaugcucuuagauaacauuaauacuccugaaggcaucauacccuccauguuugagccagaaagagagaagguggacgccauugauggugaauacaggcugagaggggaagcucguaaaacauucguugaccuuaugcgccgaggcgaucugccuguguggcucgccuauaaggucgcugcagagggaaucaacuacgccgacagaaagugguguuuugauggcauuaaaaauaaccagaucuuggaagagaacguggaaguugagauauggaccaaggagggggaaaggaaaaagcugaaaccccgguggcucgacgcucgcaucuauagugauccacuggcccuuaaggaguucaaggaguucgcagcgggaagaaaaagccuaacacugaauuugauuacugagauggguagguuaccuacguuuaugacccagaaggcccggaacgcucuggacaaucucgccgugcugcauacagcagaagcuggcgggcgagccuacaaccacgcacuuucggagcugccggagacucucgaaaccuugcugcuacugacacuccuugccaccgucacuggaggcaucuuccuguuuuuaaugucugguaaagggauuggcaagaugacguugggaaugugcugcaucauaaccgcuuccgugcugcucugguaugcgcagauucaaccccacuggaucgccgcaagcaucauucuggaguucuuucuuaucguacugcucauaccagaaccugagaaacagagaacaccccaggauaaucaguugacuuacgugguuauugcuauccugaccgucguggccgccacaauggcaaacgaaaugggcuucuuagagaagaccaagaaagaccuagggcugggaucaauuacuacacaagagagugaaucuaauauccucgacauagaucuucgcccagcuuccgccuggacgcuguaugcgguggcuaccacuuuugucacaccuauguugaggcauagcaucgagaacucaaguguuaaugugagccugaccgccauugcaaaccaggccaccguacucaugggucugggcaagggguggccccuuuccaaaauggacaucggagugccgcuccuggcuauuggcuguuacucucaggucaauccaaucacauugacugcagcccuguuacuacugguggcgcacuacgcuauuaucgguccugggcuccaggccaaggcaacgcgggaagcccaaaaacgugcugccgcaggcauaaugaagaaccccaccguugauggaauuacagugaucgaccuugagccaauccccuaugauccuaaguucgaaaaacagcugggccaggucauguugcugauucucugcguaacucaggugcugaugaugagaaccacaugggcucuuugugaggccuuaacccuggcgacugggccgauaagcacgcucugggagggaaaucccggcagguuuuggaacacaaccaucgccguuuccauggcaaauauuuuccgcgguucauacuuggcuggggccggacugcuauuuucuaucaugaagaacacuaccaauacacggcgaggcacugguaacauuggcgaaacccugggggagaaauggaagaguagacucaacgcacuuggaaaaucggaguuccaaaucuauaagaaaagcggcauacaggagguggacaggacacuggcuaaggaggggaucaagcgcggagaaacggaucaucacgccgucucccggggcucugccaaauugagaugguuuguggagcguaauauggucaccccagaagguaaggugguugaccuggggugcggaaggggcgguuggucauacuauuguggcgggcucaaaaacgugcgggagguaaagggacugacuaaaggcgggccuggacaugaggaaccaauuccuaugagcacauacggcuggaauuuagugcgccuucaguccggugucgauguuuucuucaccccacccgagaagugcgacacucugcucugugauaucggggaaaguucuccuaacccaacaauugaggcgggacgaacccuaagagugcugaauuuggucgaaaacuggcugaauaacaauacgcaauuuugcaucaaggugcucaaccccuauaugccgagcguaauagagaaaauggaaacccuucagaggaaguacggcggcgcucuggugcggaauccuuugucacgcaacuccacacacgagauguacuggguuaguaaugcaacugggaacauugugagcucugucaauaugaucuccagaaugcugaucaacagguucaccaugaaacacaagaaagccacauaugagccagacguggaucucggaucagguacucgaaacauuggcauagaaagcgagauccccaauuuagacauuaucgggaagcggauugaaaagaucaaacaggagcaugaaaccucguggcacuacgaccaggaucauccuuauaagacaugggcuuaccacggaucuuaugagaccaaacaaacuggcagugccuccagcauggucaacggugugguucgucugcuuacgaagccaugggacguagugcccauggucacacagauggcaaugaccgauacuaccccguuugggcagcagagaguguucaaagagaagguugacacacgcacgcaagaaccuaaggagggaaccaaaaagcugaugaggauaacugccgaauggcuauggaaagagcucggcaagaaaaagacaccccggauguguaccagagaggaauuuacucgcaaagugaggucaaaugcugcgcugggcgccaucuucacagaugagaacaaguggaaguccgcacgagaagcugucgaggacgggcgguuuugggaauugguggauaaagagagaaaucugcaccucgagggaaagugcgaaaccuguguauacaacaugauggguaaaagggagaagaaacuuggcgaguucgggaaggccaagggaucucgcgcaauuugguauauguggcugggcgccagauuuuuagaguucgaagcucugggauuuuugaaugaggaccauugguucagccgggggaacagucucuccggaguggagggcgaaggccugcacagacuaggguacauccuuagggauguuggcaaaaaggaggguggcgccauguacgcggacgauacagcagggugggacacucgcauuacccuggaagaccucaaaaaugaggaaauggucacgaaccauaugaagggagagcacaaaaagcuggccgaggcuaucuuuaaguugaccuaucagaauaaaguggugcgaguccagcggccaacaccuagaggcacuguuauggauauuauaagcaggcgcgaccagagagguucugggcaagugggaaccuacggccugaacacauucacuaauauggaagcccagcucauccggcagauggagggcgaagggauuuucaagucaauccaacaucuuaccgcaacggaggagaucgcuguacagaacuggcuggccagggugggacgugaacgauuaagucgcauggcuauuuccggugaugacugcgucgugaaacccauagaugacagauuugccagcgcacugacagcguugaaugauaugggcaagguucggaaagacauccagcagugggagccaucuaggggguggaacgauuggacccaagugcccuucugcucgcaccacuuucaugaacucgucaugaaggacggacgcgugcugguaguuccuuguagaaaccaggaugagcuaauuggccgggccaggaucucacagggugcuggguggagccuuaaggaaacugccugccugggaaaauccuaugcacagauguggacacucauguacuuccaccgacgugaccugagauuggcugccaaugcaauuuguagugccgugccaucucauugggucccgaccagccgcacuaccugguccauccacgcgaagcacgaguggaugacaacggaggauauguuagcuguguggaaccggguguggauacaagaaaaucccuggauggaggacaaaaccccugucgaaucaugggaggaaguuccauaucugggcaagagggaggaccaguggugcggcagucucaucgggcuuacuucuagagccacaugggccaaaaacauucagaccgccaucaaucaggugcgcagccugauuggaaacgaggaauacacugauuauaugcccuccaugaagcgguuuaggcgagaggaagaggaagcugguguacuaugguga

SEQ ID NO: 15038 - RNA, 9876 nt, Artificial Sequence
  derived and/or modified CDS sequence (opt3) from DENV-2__HQ332185__SS-prME
accgccggcgugaucauuaugcugauacccacagcuauggcauuccaccucacuacgagaaacggggagccucauaugaucgucggaaggcaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgugcagaggaucgagaccuggauacugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguacucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaagagcaggacaaacgauuuaucugcaagcauucuaugguggauagaggcugggguaacggguguggacuauucggcaagggcgggauugucaccugcgccauguuuacaugcaaaaagaauauggaaggaaaaguggugcagccugagaaccucgaauacaccauagucaucacuccacacagcggugaggagcaugcuguuggcaaugacacggggaagcacggaaaagaaauuaagaucacaccgcaguccucaauaaccgaggccgaacugacuggcuaugguaccgugacaauggaguguagucccaggaccgggcuugauuucaacgaaaugguacuguugcaaauggaggacaaagcauggcucgugcaccggcagugguuucuggauuuaccucugccauggcuccccggcgcugacacucagggaagcaauuggauucagaaggagacacuugucacguucaagaacccucaugccaaaaagcaagacgugguugugcugggcucucaggaaggggcgaugcacaccgccuugacuggagcaacagagauccagauguccucagguaaucuacuguuuaccggccaucucaaaugccgucugcgcauggauaagcuucaacugaaagggaugagcuacaguauguguacaggaaaguucaagaucgucaaagaaauugcugagacucagcacggcaccaucgugauuagaauacaguaugagggugacgggucuccaugcaagauccccuucgaaauuacggauuuggagaaaaggcauguacucggccggcugaucaccguuaacccgaucgugauugaaaaggacuccccugucaacauagaggccgaacccccauuuggagauagcuacaucauuaucggcguggagccugggcaguuaaaacugaauugguucaagaagggaucgucuauuggucaaauguuugagacaacuaugcgaggcgcuaaacgcauggccauccuaggggacaccgcaugggauuucggaucccucggcggugucuuuacaucaauagggaaggcccugcaccagguguucggcgcuaucuacggagcggcauuuaguggcguuagcuggacuaugaaaauucuuaucggggugguaauuaccuggaucggaaugaacuccagaucuacgagcuugucagucagucuggugcucguuggcguggucacacuguaucuuggugccauggugcaggcugacuccggguguguagugagcuggaagauaaaagaacugaagugcggaucuggcauuuucaucaccgauaauguucacacuuggacagagcaguacaaguuucaacccgaaucaccaaguaaauuggccagcgcaauucagaaggcccaugaggaagguaucuguggcauaagguccgucacccggcucgagaaccugauguggaaacagaucacucccgaguuaaaucacauucugucugaaaacgaggugaagcuaaccaucaugacaggggacacgaaaggaauuaugcaggcuggcaagcgcucgcucagaccucaaccaaccgaacugaaauauagcuggaagacuugggggaaggccaaaaugcuuuccacagagucacauaaucagaccuucuugaucgauggaccggaaacagcagagugccccaacacuaauagggcguggaacagucuggagguggaagacuacggcuuuggugucuucaccacgaauauauggcucaagcugcgugagaaacaggacguuuuuugugauucuaaguuaaugagcgcugccauuaaaaacaaucgggcagugcacgccgacaugggguauuggaucgaauccgcucugaacgauacauggaagauggagaaggccucauucaucgaggugaaaagcugccacuggccuaagucucauacccuuugguccaauggaguauuggaaagugagaugauuaucccaaaaaacuucgcaggccccgucagccagcacaacuaccgaccugguuaucauacucaaaccgcuggcccauggcaccucgggaagcuggaaauggacuuugauuucugugagggaacaacugugguugugaccgaagacugcggcaauagagggcccucucuaaggacaacgaccgccuccggaaaacugauuacugaguggugcugucgcucaugcacacucccgccucugcgguacagaggcgaggaugguuguugguacgggauggaaauaaggccacuuaaggagaaggaagagaacuuggucaauagucuggugaccgcgggacauggccagaucgacaacuuuagcuuagguguucucggcauggcccuguuccuugaagagaugcugcgcacucgaguggggacaaaacacgcuauuuugcucguagcagucucguuugugacccugaucacgggaaauauguccuuccgggaucuaggccgugugauggucaugguuggggccacuaugaccgacgauauuggaaugggcgugacauaucuggcucuccuggccgcauuuaagguaagacccaccuucgcggccggucuuuugcugaggaaauuaacuucuaaggagcucaugauggcuacaaucgggauaacccugcuuagccagucaacaaucccugaaacuauucuggagcuaaccgacgcccucgcacugggaaugaugguguugaaaaucguccgcaacauggaaaaguaccaacuggcugugacgauuauggccaucaguugcguucccaaugcagugauauuacggaacgccuggaaggucuccuguacaauucucgcugcggugucuguuagcccacugcuucugaccuccucacagcagaaagccgauuggaucccuuuggcacucacuaucaagggccugaaucccaccgcuauuuuucuaacaacucugagcagaaccaguaaaaagaggucuuggccacuuaacgaggccauaauggccgugggcauggucuccauccucgcuagcucgcuguugaaaaaugacauuccgaugacggggccucugguagcaggagguuuacucacagugugcuauguucugaccggccgaucagccgaccuugaacuggagcgcgcggcugaugugaagugggaggaccaggccgaaaucucugggaguucccccauuuugagcaucacuauaucugaggauggaagcauguccaucaaaaacgaagaggaggaacaaacacucaccauucugauccggacuggccuacuggucauuucagguguguucccaguaaguauccccauaacagcagccgcuugguaccuuugggaggugaagaagcagagagcagggguccucugggacguuccuagcccacccccugugggaaaagccgaacuggaggauggcgcguauaggauuaagcagcguggcaucuugggguacucucagaucggagcugguguguauaaagaaggcaccuuucacacgauguggcaugucacucgcggggccguguuaaugcaccggggaaagagaauugagccguccugggcagacguuaaaaaggaucugaucucauacggcgguggguggaagcucgagggagaauggaaagagggcgaagagguacaagugcuggcccuugaaccaggcaagaaucccagggcuguccagaccaaaccugggauauucaagacaaacaccggaacaauuggugccgugagucuggacuuuagcccaggcacuuccgggucucccaucguugaucgaaaaggaaagguggucggcuuguacgguaauggggugguaacccggucgggagcauaugucagcgcuauugcccagacggagaagucaaucgaggacaacccugaaauagaggaugacauuuuccgcaaaaagagacuaacaaucauggaucugcauccgggcgcgggcaaaacuaagagguaccuccccgccaucgugcgggaagcaauuaaacgagggcugagaacccuuaucuuagcuccaacacgcguuguggccgcugagauggaagaggcacugaggggacucccuauucguuaucagacccccgccauaaaggccgagcacacuggucgggaaaucgucgacuugaugugucaugcuaccuucacaaugagacugcucuccccagugaggguuccuaacuacaaucugauuaucauggacgaggcgcacuuuacggaucccgcaaguaucgccgcucgcggcuauauuucuacucgaguggaaaugggggaggccgcaggaauauucaugaccgccacaccaccgggcagcagagacccuuuuccccaauccaacgcuccaaucauggaugaggaacgggagauucccgaaaggucauggaauucuggucacgagugggucaccgacuucaaggggaaaacugugugguuuguaccuagcaucaaggcgggaaacgauauugccgcaugccuucgcaaaaauggcaagaaagugauccagcugagucguaagacauucgacuccgaauacguuaagaccagagcuaacgauugggacuuugucgugacgacugauauaagcgagaugggcgccaauuucaaagcagagcgggugaucgacccaaggcgcuguaugaagcccgucauuuugacagauggggaagagcgaguaauccuagccggaccuaugccggugacccauucuucagcugcccagagacgggguaggauuggccgcaacccaaaaaaugaaaacgaccaauauaucuacaugggggagccccuggaaaaugacgaggauugcgcgcacuggaaggaggcaaaaaugcucuuagacaacauaaauaccccugaaggaauuauccccuccauguuugagccagaaagagagaagguugaugccauugacggcgaauacaggcugcggggugaggcucguaaaacuuucguggaucuuaugcgccgaggggaccugccugucuggcucgccuauaagguggcugcagagggcaucaacuacgccgauagaaagugguguuuugacggaauaaaaaauaaccagaucuuggaagagaacguugaaguggagauuuggacaaaggagggcgaaaggaaaaagcugaaaccccgguggcucgaugcucgcaucuauagugacccacuggcccuuaaggaguucaaggaauucgcagcggggagaaaaagccuaacccugaauuugauuacagagaugggaagguuaccuacuuuuaugacgcagaaggcccggaacgcucuggauaaucucgccguccugcauaccgcagaagcugguggccgagccuacaaccacgcacuuucggagcugccggagacacucgaaacuuugcugcuacugacccuccuugccacagugaccgggggaaucuuccuguuuuuaaugucuggcaaagguauagggaagaugacuuugggcaugugcugcauuaucacggcuuccguacugcucugguaugcgcagauccaaccccacuggauugccgcaagcaucauacuggaguucuuucuuauugugcugcucaucccagaaccugagaaacagagaaccccccaggacaaucaguugacauacguugucauugcuauccugacugugguggccgccaccauggcaaacgaaaugggauucuuagagaagacaaagaaagaucuaggccuggggucaauaaccacucaagagagugaaucuaauauccucgacauugaccuucgcccagcuuccgccuggacacuguaugcggucgcuacgaccuuuguuacuccuauguugaggcauagcaucgagaacucaagugugaauguaagccugacagccauugcaaaccaggccaccgugcucaugggacuggguaagggcuggccccuuuccaaaauggauaucggggucccgcuccuggcuauuggauguuacucucaggugaauccaaucaccuugacagcagcccuguuacuacugguugcgcacuacgcuauaauuggcccuggucuccaggccaaggcaacucgggaagcccaaaaacgugcugccgcagggaucaugaagaaccccacgguggacggcaucaccgucauugaucuugagccaauacccuaugacccuaaguucgaaaaacagcugggacagguaauguugcugauccucugcgugacacagguucugaugaugagaacuaccugggcucuuugugaggccuuaacacuggcgaccggcccgauuagcacucucugggaggggaaucccggaagguuuuggaacacgacaaucgccguguccauggcaaauauuuuccgcggcucauacuuggcuggugccgggcugcuauuuucuaucaugaagaacaccacuaauacccggcgaggaacaggcaacauaggugaaacucugggcgagaaauggaagaguagacucaacgcacuugggaaaucggaauuccaaaucuauaagaaaagcggaauucaggaggucgauaggacccuggcuaaggagggcaucaagcgcggggaaacagaccaucacgccgugucccggggaucugccaaauugagaugguuugucgagcguaauauggugacgccagaaggcaagguuguggaucuggguugcgggaggggaggcuggucauacuauugugguggccucaaaaacguacgggaggugaaggggcugaccaaaggaggcccugggcaugaagagcccauuccuaugagcacuuacggauggaauuuaguccgccuucaguccggcguugacguguucuucacaccacccgagaagugcgauacccugcucugugacaucggugaaaguucuccuaacccaacuauagaggcggggcgaacacuaagaguccugaauuugguggaaaacuggcugaauaacaauacccaauuuugcauuaagguacucaaccccuauaugccgagcgugaucgagaaaauggaaacgcuucagaggaaguacggaggcgcucugguucggaauccuuugucacgcaacuccacccacgagauguacugggugaguaaugcaacaggcaacaucgucagcucugugaauaugauuuccagaaugcugauaaacagguucacuaugaaacacaagaaagccaccuaugagccagaugucgaccucgggucaggaacacgaaacaucgguauugaaagcgagauccccaauuuagauauuaucggcaagcggauagaaaagaucaaacaggagcaugaaacuucguggcacuacgaccaggaccauccuuauaagaccugggcuuaccacgggucuuaugagacaaaacaaaccggaagugccuccagcauggugaacggcguuguacgucugcuuacuaagccaugggaugugguccccauggugacgcagauggcaaugacagacaccacuccguuuggucagcagagaguuuucaaagagaagguggauacccgcacacaagaaccuaaggaggggacgaaaaagcugaugaggauuaccgccgaauggcuauggaaagagcucggaaagaaaaagacuccccggauguguacaagagaggaauuuacccgcaaagucaggucaaaugcugcgcugggcgccaucuucacugacgagaacaaguggaaguccgcacgagaagcuguggaggauggccgguuuugggaauugguagacaaagagagaaaucugcaccucgaggggaagugcgaaacauguguguacaacaugaugggaaaaagggagaagaaacuuggugaauucggcaaggccaaggggucucgcgcaauuugguauauguggcugggagcccguuuuuuagaguucgaagcucugggcuuuuugaaugaggaucauugguucagccgggguaacagucucuccgggguugagggagaaggccugcacagacuaggcuacauccuuagggacgucgggaaaaaggagggaggugccauguacgcggaugacaccgcaggcugggauacacgcauuacucuggaagaccucaaaaaugaggaaauggugaccaaccauaugaagggggagcacaaaaagcuggccgaggcuauauuuaaguugacguaucagaauaaagugguccgaguucagcggccaaccccuagaggaacagugauggacaucauuagcaggcgcgaucagagaggcucuggucaaguagggacuuacggacugaacaccuucacaaauauggaagcccagcucauccggcagauggagggcgaaggcaucuucaagucaauucaacaucuuacugcaaccgaggagauagcugugcagaacuggcuggccagggucgggcgugaacgauuaagucgcauggcuaucuccggagacgauugcgugguuaaacccauugacgauagauuugccagcgcacugacggcguugaaugacauggguaaggugcggaaagauauccagcagugggagccaucuaggggcuggaacgacuggacacaaguccccuucugcucgcaccacuuucaugaacucgugaugaaggaugggcgcguacugguugugccuuguagaaaccaggacgagcuaauuggacgggccaggaucucacagggcgcugguuggagccuuaaggaaaccgccugccuggggaaauccuaugcacagauguggacucucauguacuuccaccgacgugaucugagauuggcugccaaugcaauauguagugccgucccaucucauugggugccgacaagccgcaccacuugguccauccacgcgaagcacgaguggaugaccacagaggacauguuagcuguguggaaccgggucuggauucaagaaaaucccuggauggaggauaaaacgccuguugaaucaugggaggaagugccauaucugggaaagagggaggaccaguggugcggcagucucaucggccuuaccucuagagccacuugggcaaaaaacauucagacagccaucaaucagguacgcagccugauagggaacgaggaauacaccgacuauaugcccuccaugaagcgguuuaggcgagaggaagaggaagcuggagugcuaugguga

SEQ ID NO: 15039 - RNA, 9876 nt, Artificial Sequence
  derived and/or modified CDS sequence (opt3) from DENV-2__HQ332186__SS-prME
accgccggcgugaucgucaugcugauucccacagcuauggcauuccaccucacuacgagaaacggggagccucauaugauaguuggaaggcaggaaaaggguaaaagccuucuguuuaagaccgaggacggcgugaauaugugcacauugauggccaucgauuuaggggaacugugugaggacacuauuaccuacaaaugcccacuacuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaagagcaggacaaacgauuuaucugcaagcauucuauggucgauagaggcugggguaacggguguggacuauucggcaagggcgggaucgugaccugcgccauguuuacaugcaaaaagaauauggaaggaaaagugguccagccugagaaccucgaauacaccauuguuauaacuccacacagcggugaggagcaugcugugggcaaugacacggggaagcacggaaaagaaaucaagauuacaccgcaguccucaaucaccgaggccgaacugacuggcuaugguaccguaacaauggaguguagucccaggaccgggcuugauuucaacgaaauggugcuguugcaaauggaggacaaagcauggcucguccaccggcagugguuucuggauuuaccucugccauggcuccccggcgcugacacucagggaagcaauuggauacagaaggagacacuugugacguucaagaacccucaugccaaaaagcaagacguugugguccugggcucucaggaaggggcgaugcacaccgccuugacuggagcaacagagauucagauguccucagguaaucuacuguuuaccggccaucucaaaugccgucugcgcauggauaagcuucaacugaaagggaugagcuacaguauguguacaggaaaguucaagaucgugaaagaaaucgcugagacucagcacggcaccauuguaaucagaguucaguaugagggugacgggucuccaugcaagauucccuucgaaauaacggauuuggagaaaaggcaugugcucggccggcugaucaccgucaacccgauugugaucgaaaaggacuccccugucaacaucgaggccgaacccccauuuggagauagcuacauuauaaucggcguggagccugggcaguuaaaacugaauugguucaagaagggaucgucuauuggucaaauguuugagacaacuaugcgaggcgcuaaacgcauggccauccuaggggacaccgcaugggauuucggaucccucggcgguguuuuuacaucaauugggaaggcccugcaccagguguucggcgcuaucuacggagcggcauuuaguggcguaagcuggacuaugaaaauacuuaucggggucgugauuaccuggaucggaaugaacuccagaucuacgagcuugucaguuagucuggugcucgucggcgugguaacacuguaucuuggugccauggugcaggcugacuccggguguguugucagcuggaagaauaaagaacugaagugcggaucuggcauuuucaucaccgauaacgugcacacuuggacagagcaguacaaguuucaacccgaaucaccaaguaaauuggccagcgcaauacagaaggcccaugaggaagguauuuguggcaucagguccgugacccggcucgagaaucugauguggaaacagauuacucccgaguuaaaccacauccugucugaaaaugaggucaagcuaaccauaaugacaggggacacgaaaggaaucaugcaggcuggcaagcgcucgcucagaccucaaccaaccgaacugaaauauagcuggaagacuugggggaaggccaaaaugcuuuccacagagucacauaaccagaccuucuugauugauggaccggaaacagcagagugccccaauacuaacagggcguggaauagucuggagguugaagacuacggcuuugguguguucaccacgaacaucuggcucaagcugcgugagaaacaggacguguuuugugauucuaaguuaaugagcgcugccauuaaagacaaucgggcaguacacgccgauaugggguauuggaucgaauccgcucugaacgacacauggaagauggagaaggccucauucauagaggucaaaagcugccacuggccuaagucucauaccuucugguccaauggagugcuugaaagugagaugauuaucccaaaaaacuuugcaggccccguuagccagcacaacuaccgaccugguuaucauacucaaaucgcuggcccauggcacuuggggaagcucgaaauggauuucgacuuuugugagggaaccacaguggucgugacugaagauugcggcaauagagggcccucucugaggaccacaacggccuccggaaaacuaauuaccgaguggugcugucgcucaugcacucugccgccucuccgguacagaggcgaggacgguuguugguacgggauggaaaucaggccacugaaggagaaggaagagaaccuuguuaauaguuuggugacagcgggacauggccagauugauaacuucagccuggguguauuaggcauggcccucuuucuggaagagaugcuucgcacccgagucgggacuaaacacgcuauacuguugguggcagugucguucgucacacucaucaccggaaauauguccuuucgggaccugggccguguuauggugaugguaggggccacgaugacugaugacauuggaaugggcgugaccuaucuagcucugcucgccgcauucaaggucagacccacauuugcggccggucugcuuuugaggaaacugaccucuaaggaguuaaugauggcuacuaucgggauuacacuccugagccagucaaccaucccugaaacaauacuugagcugacugaugcccuagcacucggaaugauggugcugaaaaucguucgcaacauggaaaaguaccaauuggcugugaccauuauggccaucaguugcguccccaaugcagugauucugcggaacgccuggaagguuuccuguacgaucuuagcugcggugucugucagcccacuccugcuuacauccucacagcagaaagccgacuggauaccucuggcauugaccauuaagggccucaaucccacugcuaucuuccugaccacacuaagcagaacuaguaaaaagaggucuuggccacugaacgaggccaucauggccguaggcaugguguccauucuugcuagcucgcuccugaaaaaugacauaccgaugaccgggccuuugguugcaggaggucuguuaacggugugcuauguccucacaggccgaucagccgaucuggaacuugagcgcgcggcugacgugaagugggaggaucaggccgaaaucucugggaguucccccauucugagcaucaccauuucugaggacggaagcauguccaucaaaaacgaagaggaggaacaaacuuugacaauacucauccggaccggccugcuaguaauuucagguguguuuccagucaguauccccauuacugcagccgcuugguaccugugggagguuaagaagcagagagcaggggugcuuugggaugugccuagcccacccccugucggaaaagccgaacucgaggacggcgcguauaggaucaagcagcguggcauacugggguacucucagauuggagcugguguguauaaagaaggcacauuccacaccauguggcauguuacgcgcggggccguauugaugcaccggggaaagagaaucgagccguccugggcagaugugaaaaaggacuuaaucucauacggcgguggguggaagcuggagggagaauggaaagagggcgaagagguccaagugcucgcccuggaaccaggcaagaaucccagggcuguucagacuaaaccugggauuuuuaagaccaacacaggaaccaucggugccgugagucuugauuucagcccaggcacauccgggucucccauagucgaccgaaaaggaaaggugguaggccuguacgguaauggggucgugacucggucgggagcauauguuagcgcuauugcccagaccgagaagucaaucgaggauaacccugaaauugaggacgauaucuuccgcaaaaagagauugacgauaauggaccuacauccgggcgcgggcaaaacaaagagguaccugcccgccauugugcgggaagcaaucaaacgagggcucagaacucugauccuugcuccaacccgcgucguggccgcugagauggaagaggcauuaaggggacugccuauucguuaucagacacccgccaucaaggccgagcacaccggucgggaaauuguugaccucaugugucaugcuacuuuuaccaugagauugcuguccccagugagggucccuaacuacaaucucauaaucauggaugaggcgcacuucacagaccccgcaaguauugccgcucgcggcuauaucucuacgcgaguggaaaugggggaggccgcaggaaucuuuaugacugccaccccaccgggcagcagagauccuuucccccaauccaacgcuccaauuauggacgaggaacgggagauacccgaaaggucauggaauucuggucacgaguggguaacagauuuuaaggggaaaaccgugugguucguuccuagcaucaaggcgggaaacgacauugccgcaugccugcgcaaaaauggcaagaaagucauccagcuuagucguaagacuuuugauuccgaauacgugaagacaagagcuaacgacugggauuucguggucaccacggacauuagcgagaugggcgccaauuuuaaagcagagcggguaaucgauccaaggcgcuguaugaagcccgugauacugacugacggggaagagcgaguuaucuuggccggaccuaugccggugacacauucuucagcugcccagagacgggguaggauuggccgcaacccaaaaaaugaaaacgaccaauauaucuacaugggggagccccuagaaaaugaugaggacugcgcgcacuggaaggaggcaaaaaugcugcucgauaacauuaauaccccugaaggaaucauacccuccauguucgagccagaaagagagaaggucgacgccauugauggcgaauacagguuacggggugaggcucguaaaaccuuuguggaccugaugcgccgaggggaucuuccuguuuggcuggccuauaagguggcugcagagggcaucaacuacgccgacagaaagugguguuucgauggaauuaaaaauaaccagauccucgaagagaacgucgaaguggagauauggacuaaggagggcgaaaggaaaaaguugaaaccccgguggcuggacgcucgcaucuauagugauccacucgcccugaaggaguucaaggaauuugcagcggggagaaaaagccuuacacuaaaucugauuaccgagaugggaagguugccuacauucaugacucagaaggcccggaacgcuuuagacaaucuggccguacuccauacggcagaagcugguggccgagccuacaaccacgcacugucggagcuuccggagacccuggaaacacucuugcugcuaacucugcucgccaccgugacagggggaaucuuucuuuuccugaugucuggcaaagguauugggaagaugaccuuaggcaugugcugcaucauaacugcuuccguuuugcugugguaugcgcagauucaaccccacuggaucgccgcaagcaucauucucgaguuuuuccugaucguccuucugauaccagaaccugagaaacagagaacgccccaggauaaucagcucaccuacguggugauugcuaucuugacagucguugccgccacuauggcaaacgaaaugggauuucuggagaagaccaagaaagacuuaggccuagggucaauuacaacccaagagccagaaaguaauauccuggacauagaucuccgcccugcuucugccuggacucuuuaugcgguggcuacaacguucguaacccccaugcugaggcauuccaucgagaacagcucagugaaugucaguuugacugccauugcaaaccaggccacagugcugaugggacucgguaagggcuggccgcugagcaaaauggacaucgggguuccacuucucgcuauuggauguuacucccaggugaauccuaucacccugaccgcagccuugcuguuacuagucgcgcacuacgcuauuaucggccccggucugcaggccaaggcaacacgggaagcccaaaaacgugcugccgcagggauaaugaagaacccaacuguagauggcauuacggugaucgaccucgagcccaucccuuaugauccgaaguuugaaaaacagcuuggacagguuaugcuguugauucugugcgugacccagguccucaugaugagaacaacuugggcucugugugaggcccuuaccuuagcgacaggccccauaucuacccugugggaggggaauccaggaagguucuggaacacuacgaucgccgugagcauggcaaauauuuuucgcggcuccuaccucgcuggugccggguugcuguucucaaucaugaagaacacaaccaauacucggcgaggaaccggcaacauuggugaaacacuaggcgagaaauggaagucuagacugaacgcacucgggaaaagugaauuucaaaucuauaagaaaucgggaauacaggaggucgacaggacucuugcuaaggagggcaucaagcgcggggaaaccgaucaucacgccgugagccggggauccgccaaacugagaugguucguugagcguaauauggugacaccugaaggcaagguaguggacuuggguugcgggaggggaggcuggucuuacuauugugguggccugaaaaacguccgggagguuaaggggcucacgaaaggaggccccgggcaugaagagccuauuccaaugucaaccuacggauggaaucuggugcgcuuacagagcggcgucgauguguucuuuacucccccugagaagugcgacacacuucugugugauaucggugaauccaguccaaaccccaccauugaggcggggcgaacucucagaguacuaaaucugguggaaaacugguugaauaacaauacacaauucugcaucaagguucugaacccguauaugccuucugugauagagaaaauggaaacccuccagaggaaguacggaggcgcucuuguccggaauccacugagccgcaacucaacgcacgagauguacuggguguccaaugcaaccggcaacauugucaguagcgugaauaugaucucuagaauguugaucaacagguuuacaaugaaacacaagaaagccacuuaugagcccgacguugaucugggguccggaacccgaaacauugguauagaaucagagaucccuaaucucgacauuaucggcaagcggauugaaaagaucaaacaggagcaugaaacaagcuggcacuacgaccaggaucauacuuauaagaccugggcuuaccacgggucguaugagacaaaacaaaccggaucugccaguuccaugguaaacggcgugguccguuuacugacuaagccaugggacgugguucccauggugacgcagauggcaaugacagauaccacuccguucggucagcagagagucuuuaaagagaagguggacacccgcacacaagaaccuaaggaggggacgaaaaagcuuaugaggauaaccgccgaauggcuguggaaagagcuaggaaagaaaaagacuccccggauguguacaagagaggaauucacccgcaaaguaaggagcaaugcugcgcucggcgccaucuuuacugaugagaacaaguggaagucagcacgagaagcuguggaggacggccgguucugggaacugguugauagagagaggaauuugcaccuggaggggaaaugcgaaacaugugucuacaacaugaugggaaagcgcgagaaaaagcucggugaauuuggcaaagccaaggggucccgugcaauuugguauauguggcuuggagcccgguuccuggaguuugaagcuuuaggcuuccugaaugaggaccauugguuuucuagagguaacagcuugagugggguggagggagaaggccuccacaggcugggcuacauccuacgcgauguggggaagaaagagggaggugccauguacgcggacgauaccgcaggcugggacacacgaauuacucuugaagaccugaagaaugaggaaauggucaccaaccauaugaaaggggagcacaagaaacucgccgaggcuaucuucaagcugacguaucagaauaagguugugcggguacagagaccaaccccuaggggaacagugauggauauuauaucccgcagagaccagcggggcagcggucaagucgggacuuacggauugaacaccuucacaaauauggaagcccagcugaucaggcagauggagggcgaaggcauuuuuaaaucuauccaacaucucacugugaccgaggagaucgcaguucagaacuggcuugcucguguggggcgagaacgccugucaagaauggccauuaguggagaugacugcgucgugaagcccauagaugaccgguucgcuuccgccuuaacggcacugaaugauauggguaaaguaaggaaggacauccagcagugggagccaagccgcggcuggaacgauuggacacaaguucccuuuugcucucaccacuuccaugaauuggugaugaaagacgggagaguccucguggugccuugucggaaccaggaugagcugauuggaagggcgcgaaucucgcagggcgccgguuggucacuaaaggaaaccgcuugccuugggaagagcuaugcccagauguggacucugauguacuuucaccguagagaccuccgccuggcagcuaaugccauuuguuccgcagucccaagucauuggguuccgacaucucggaccacuuggagcauccacgccaaacacgaguggaugaccacagaggauauguuggcgguguggaacaggguauggauacaagaaaaucccuggauggaggacaagacgccuguggaauccugggaggaagucccauauuuaggaaaaagagaggaccaguggugcggcucacugaucggccucaccagucgcgcuacuugggccaagaacauucagacagcaaucaaucaggugcggucucuuauugggaacgaggaauacaccgauuauaugcccagcaugaaaagguuccgaagagaggaagaggaagccggaguucugugguga

SEQ ID NO: 15040 - RNA, 9876 nt, Artificial Sequence
  derived and/or modified CDS sequence (opt3) from DENV-2__HQ332187__SS-prME
accgcaggcgugauaauuaugcugauacccacagcuauggcauuccaccucacuacgcguaacggggagccucauaugaucgucggaaggcaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguugcgcuggugccccaugucgguauggggcuugagaccagaacagaaacuuggaugaguagcgagggagcuuggaaacacgugcagaggaucgagaccuggauacugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguccucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaagaacaggacaaacgauuuaucugcaagcauucuaugguggauagaggcugggguaacggguguggacuauucggcaagggcgggauuguaaccugcgccauguuuacaugcaaaaagaauauggaaggaaaaguggugcagccugagaaccucgaauacaccauagucaucacuccacacagcggugaggagcaugcuguuggcaaugacacggggaagcacggaaaagaaauuaagaucacaccgcaguccucaauaaccgaggccgaacugacuggcuaugguaccgugacaauggaguguagucccaggaccgggcuugauuucaacgaaaugguacuguugcaaauggaggacaaagcauggcucgugcaccggcagugguuucuggauuuaccucugccauggcuccccggcgcugacacucagggaagcaauuggauucagaaggagacacuugucacguucaagaacccucaugccaaaaagcaagacgugguugugcugggcucucaggaaggggcgaugcacaccgccuugacuggagcaacagagauccagauguccucagguaaucuacuguuuaccggccaucucaaaugccgucugcgcauggauaaacuucaacugaaagggaugagcuacaguauguguacaggaaaguucaagaucgucaaagaaauugcugagacucagcacggcaccaucgugauuagaauacaguaugagggugacgggucuccaugcaagauccccuucgaaauuacggauuuggagaaaaggcauguacucggccggcugaucaccguuaacccgaucgugauugaaaaggacuccccugucaacauagaggccgaacccccauuuggagauagcuacaucauuaucggcguggagccugggcaguuaaaacugaauugguucaagaagggaucgucuauuggucaaauguuugagacaacuaugcgaggcgcuaaacgcauggccauccuaggggacaccgcaugggauuucggaucccucggcggugucuuuacaucaauagggaaggcccugcaccagguguucggcgcuaucuacggagcggcauuuaguggcguuagcuggacuaugaaaauucuuaucggggugguaauuaccuggaucggaaugaacuccagaucuacgagcuugucagucagucuggugcucguuggcguggucacacuguaucuuggugccauggugcaggcugacuccggguguguagugagcuggaagaauaaagaacugaagugcggaucuggcauauucauuaccgauaacguucacacuuggacagagcaguacaaguuucaacccgaaucaccaaguaaauuggccagcgcaauccagaaggcccaugaggaagguauuuguggcaucagguccgucacccggcucgagaaucugauguggaaacagauaacucccgaguuaaaccacauccugucugaaaaugaggugaagcuaaccauuaugacaggggacacgaaaggaaucaugcaggcuggcaagcgcucgcucagaccucaaccaaccgaacugaaauauagcuggaagacuugggggaaggccaaaaugcuuuccacagagucacauaaccagaccuucuugauugauggaccggaaacagcagagugccccaauacuaacagggcguggaauagucuggagguggaagacuacggcuuuggugucuucaccacgaacaucuggcucaagcugcgugagaaacaggacguauuuugugauucuaaguuaaugagcgcugccauaaaagacaaucgggcagugcacgccgauaugggguauuggauugaauccgcucugaacgacacauggaagauggagaaggccucauucaucgaggugaaaagcugccacuggccuaagucucauacccuuugguccaauggaguauuggaaagugagaugaucauucccaagaauuucgcaggccccgucagccagcacaacuaccgaccugguuaucauacucaaaccgcuggcccauggcaccucgggaagcuggaaauggauuuugacuucugugagggaacaacugugguugugaccgaagauugcggcaauagagggcccucucuaaggacaacgaccgccuccggaaaacugaucacugaguggugcugucgcucaugcacacucccgccucugcgguacagaggcgaggacgguuguugguacgggauggaaauuaggccacuuaaggagaaggaagagaacuuggucaauagucuggugaccgcgggacauggccagauagauaacuuuagcuuagguguucucggcauggcccuguuccuugaagagaugcugcgcacucgaguggggacaaaacacgcuaucuugcucguagcagucucguuugugacccugauuacgggaaauauguccuuccgggaccuaggccgugugauggucaugguuggggccacuaugaccgaugacaucggaaugggcgugacauaucuggcucuccuggccgcauuuaagguaagacccaccuucgcggccggucuuuugcugaggaaauuaacuucuaaggagcucaugauggcuacaauugggaucacccugcuuagccagucaacaauaccugaaacuauccuggagcuaaccgaugcccucgcacugggaaugaugauuuugaaaaucgugcgcaacauggaaaaguaccaacuggcugucacgauuauggccaucaguugcgugcccaaugcaguuauauuacggaacgccuggaagguguccuguacaauucucgcugcggucucugugagcccacugcuucugaccuccucacagcagaaagccgacuggaucccuuuggcacucacuaucaagggccugaaucccaccgcuauuuuucuaacaacucugagcagaaccaguaaaaagaggucuuggccacuuaacgaggccauaauggccguuggcaugguguccauccucgcuagcucgcuguugaaaaaugacauuccgaugacggggccucuggucgcaggagguuuacucacaguaugcuaugugcugaccggccgaucagccgaucuugaacuggagcgcgcggcugacguuaagugggaggaucaggccgaaaucucugggaguucccccauuuugagcaucacuauaucugaggacggaagcauguccaucaaaaacgaagaggaggaacaaacacucaccauucugauccggacuggccuacuggugauuucaggugucuucccagugaguauccccauaacagcagccgcuugguaccuuugggagguaaagaagcagagagcaggggugcucugggaugucccuagcccacccccuguuggaaaagccgaacuggaggacggcgcguauaggauuaagcagcguggcaucuugggguacucucagaucggagcugguguguauaaagaaggcaccuuucacacgauguggcaugugacucgcggggccgucuuaaugcaccggggaaagagaauugagccguccugggcagaugugaaaaaggaccugaucucauacggcgguggguggaagcucgagggagaauggaaagagggcgaagagguucaaguacuggcccuugaaccaggcaagaaucccagggcugugcagaccaaaccugggauauucaagacaaacaccggaacaauuggugccgucagucuggauuuuagcccaggcacuuccgggucucccaucguggaccgaaaaggaaagguugugggcuuguacgguaauggggucgugacccggucgggagcauauguaagcgcuauugcccagacggagaagucaaucgaggauaacccugaaauagaggacgauauuuuccgcaaaaagagacuaacaaucauggaccugcauccgggcgcgggcaaaacuaagagguaccuccccgucaucgugcgggaagccauuaaacgagggcugagaacccuuaucuuagcaccaacacgcguuguggcugccgagauggaagaggcucugaggggacucccuauucguuaucagacccccgcaauaaaggccgagcacacuggucgggaaaucgucgacuugaugugucaugccaccuucacaaugagacugcucuccccagugaggguuccuaacuacaaucugauuaucauggaugaggcucacuuuacggaccccgcgaguaucgcagcccgcggcuauauuucuacucgaguggaaaugggggaggcugccggaauauucaugaccgcaacaccaccgggcagcagagauccuuuuccccaauccaacgccccaaucauggacgaggaacgggagauucccgaaaggucauggaacucuggucacgagugggucaccgauuucaaggggaaaacugugugguuuguaccuagcaucaaggcuggaaacgacauugcggccugccuucgcaaaaauggcaagaaagugauccagcugagucguaagacauucgauuccgaauacguuaagaccagagcaaacgacugggauuuugucgugacgacugacauaagcgagaugggcgcuaauuucaaagccgagcgggugaucgauccaaggcgcuguaugaagcccgucauuuugacagacggggaagaacgaguaauccuagcaggaccuaugccggugacccauucuucagccgcucagagacgggguaggauuggccgcaaccccaaaaaugaaaacgaccaauauaucuacaugggggagccccuggaaaaugaugaggacugcgcccacuggaaggaggcgaaaaugcucuuagauaacauaaauaccccugaaggaauuauccccuccauguuugagccagaaagagagaagguugacgcaauugauggcgaauacaggcugcggggugaggcccguaaaacuuucguggaccuuaugcgccgaggggaucugccugucuggcucgcuuauaagguggccgcugagggcaucaacuacgcagacagaaagugguguuuugauggaaucaaaaauaaccagaucuuggaagagaacguugaaguggagauuuggacaaaggagggcgaaaggaaaaagcugaaaccccgguggcucgacgcccgcaucuauagugauccacuggcucuuaaggaguucaaggaguucgccgcagggagaaaaagccuaacccugaauuugauuacagagaugggaagguuaccuacuuuuaugacgcagaaggcgcggaacgcccuggacaaucucgcuguccugcauaccgccgaagcugguggacgagcauacaaccacgcccuuucggagcugccggagacacucgaaacuuugcugcuacugacccuccuugcaacagugaccgggggaaucuuccuguuuuuaaugucuggcaaagguauagggaagaugacuuugggcaugugcugcauuaucacggccuccguacugcucugguaugcucagauccaaccccacuggauugcggccagcaucauacuggaguucuuucuuauugugcugcucaucccagaaccugagaaacagagaaccccacaggauaaucaguugacauacguugucauugcaauccugacugugguggcugccaccauggccaacgaaaugggauucuuagagaagacaaagaaagaccuaggccuggggucaauaaccacucaagagagugaaucuaauauccucgacauugaucuucgcccagcauccgcuuggacacuguaugccgucgcgacgaccuuuguuacuccuauguugaggcauagcaucgagaacucaagugugaauguaagccugacagcuauugccaaccaggcaaccgugcucaugggacuggguaagggcuggccccuuuccaaaauggacaucggggucccgcuccuggccauuggauguuacucucaggugaauccaaucaccuugacagcugcacuguuacuacugguugcccacuacgcgauaauuggcccuggucuccaggcuaaggccacucgggaagcacaaaaacgugccgcugccgggaucaugaagaaccccacgguggauggcaucaccgucauugaccuugagccaauacccuaugauccuaaguucgaaaaacagcugggacagguaauguugcugauccucugcgugacacagguucugaugaugagaacuaccugggcacuuugugaggcuuuaacacuggccaccggcccgauuagcacucucugggaggggaaucccggaagguuuuggaacacgacaaucgcgguguccauggccaauauuuuccgcggcucauacuuggccggugcugggcugcuauuuucuaucaugaagaacaccacuaauacccggcgaggaacaggcaacauaggugaaacucugggcgagaaauggaagaguagacucaacgcccuugggaaaucggaguuccaaaucuauaagaaaagcgguauucaggaggucgacaggacccuggcaaaggagggcaucaagcgcggggaaacagaucaucacgcugugucccggggaucugccaaauugagaugguuugucgagcguaauauggugacgccagaaggcaagguuguggaccuggguugcgggaggggaggcuggucauacuauugugguggccucaaaaacguacgggaggugaaggggcugaccaaaggaggcccugggcaugaagaaccaauuccuaugagcacuuacggauggaauuuaguccgccuucaguccggcguugauguguucuucacaccacccgagaagugcgacacccugcucugugauaucggugaaaguucuccuaacccaacuauagaggccgggcgaacacuaagaguccugaauuugguggaaaacuggcugaauaacaauacccaauuuugcauuaagguacucaaccccuauaugccgagcgugaucgagaaaauggaaacgcuucagaggaaguacggaggcgcgcugguucggaauccuuugucacgcaacuccacccacgagauguacugggugaguaaugcuacaggcaacaucgucagcucugugaauaugauuuccagaaugcugauaaacagguucacuaugaaacacaagaaagcaaccuaugagccagacgucgaucucgggucaggaacacgaaacaucgguauugaaagcgagauccccaauuuagacauuaucggcaagcggauagaaaagaucaaacaggagcaugaaacuucguggcacuacgaccaggaucauccuuauaagaccugggccuaccacgggucuuaugagacaaaacaaaccggaagugcuuccagcauggugaacggcguuguacgucugcuuacuaagccaugggacgugguccccauggugacgcagauggccaugacagauaccacuccguuuggucagcagagaguuuucaaagagaagguggacacccgcacacaagaaccuaaggaggggacgaaaaagcugaugaggauuaccgcagaauggcuauggaaagagcucggaaagaaaaagacuccccggauguguacaagagaggaauuuacccgcaaagucaggucaaaugccgcucugggcgcgaucuucacugaugagaacaaguggaaguccgcccgagaagcaguggaggacggccgguuuggggaauugguagauaaagagagaaaucugcaccucgagggaaagugcgaaacauguguguacaacaugauggguaaaagggagaagaaacuuggcgaguucgggaaggcuaagggaucucgcgccauuugguauauguggcugggcgcaagauuuuuagaguucgaagcccugggauuuuugaaugaggaccauugguucagccgggggaacagucucuccggaguugagggcgaaggccugcacagacuaggguacauccuuagggaugucggcaaaaaggaggguggcgcuauguacgccgacgauaccgcggggugggacacacgcauuacucuggaagaccucaaaaaugaggaaauggugaccaaccauaugaagggagagcacaaaaagcuggcagaggccauauuuaaguugacguaucagaauaaagugguccgaguucagcggccaaccccuagaggcacagugauggauaucauuagcaggcgcgaccagagagguucugggcaaguaggaacuuacggccugaacaccuucacaaauauggaagcucagcucauccggcagauggagggcgaagggaucuucaagucaauucaacaucuuacugccaccgaggagauagcagugcagaacuggcuggcuagggucggacgugaacgauuaagucgcauggccaucuccggugaugacugcgugguuaaacccauugaugacagauuugcuagcgcccugacggcauugaaugauaugggcaaggugcggaaagacauccagcagugggagccaucuaggggguggaacgauuggacacaaguccccuucugcucgcaccacuuucaugaacucgugaugaaggacggacgcguacugguugugccuuguagaaaccaggaugagcuaauuggccgggcgaggaucucacagggugccggguggagccuuaaggaaaccgcuugccugggaaaauccuaugcccagauguggacucucauguacuuccaccgacgugaccugagauuggcagcuaaugccauauguagugcagucccaucucauugggugccgacaagccgcaccacuugguccauccacgccaagcacgaguggaugaccacagaggauauguuagcgguguggaaccgggucuggauucaagaaaaucccuggauggaggacaaaacgccuguugaaucaugggaggaagugccauaucugggcaagagggaggaccaguggugcggcagucucaucgggcuuaccucuagagcuacuugggccaaaaacauucagacagcaaucaaucagguacgcagccugauaggaaacgaggaauacaccgauuauaugcccuccaugaagcgguuuaggcgagaggaagaggaagccggugugcuaugguga

SEQ ID NO: 15041 - RNA, 9876 nt, Artificial Sequence
  derived and/or modified CDS sequence (opt3) from DENV-2__HQ332188__SS-prME
accgccggcgugaucgucaugcugauuccaacagcuauggcauuccaccucacuacgagaaacggggagccucauaugauaguugggaggcaggaaaaggguaaaagccuucuguuuaagaccgaggacggcgugaauaugugcacauugauggccaucgauuuaggggaacugugugaggacacuauuaccuacaaaugcccacuacuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaagaacaggacaaacgauuuaucugcaagcauucuauggucgauagaggcugggguaacggguguggacuauucggcaagggcgggaucgugaccugcgccauguuuacaugcaaaaagaauauggaaggaaaagugguccagccugagaaccucgaauacaccauuguuauaacuccacacagcggugaggagcaugcugugggcaaugacacggggaagcacggaaaagaaaucaagauuacaccgcaguccucaaucaccgaggccgaacugacuggcuaugguaccguaacaauggaguguagucccaggaccgggcuugauuucaacgaaauggugcuguugcaaauggaggacaaagcauggcucguccaccggcagugguuucuggauuuaccucugccauggcuccccggcgcugacacucagggaagcaauuggauacagaaggagacacuugugacguucaagaacccucaugccaaaaagcaagacguugugguccugggcucucaggaaggggcgaugcacaccgccuugacuggagcaacagagauucagauguccucagguaaucuacuguuuaccggccaucucaaaugccgucugcgcauggauaaacuucaacugaaagggaugagcuacaguauguguacaggaaaguucaagaucgugaaagaaaucgcugagacucagcacggcaccauuguaaucagaguucaguaugagggugacgggucuccaugcaagauucccuucgaaauaacggauuuggagaaaaggcaugugcucggccggcugaucaccgucaacccgauugugaucgaaaaggacuccccugucaacaucgaggccgaacccccauuuggagauagcuacauuauaaucggcguggagccugggcaguuaaaacugaauugguucaagaagggaucgucuauuggucaaauguuugagacaacuaugcgaggcgcuaaacgcauggccauccuaggggacaccgcaugggauuucggaucccucggcgguguuuuuacaucaauugggaaggcccugcaccagguguucggcgcuaucuacggagcggcauuuaguggcguaagcuggacuaugaaaauacuuaucggggucgugauuaccuggaucggaaugaacuccagaucuacgagcuugucaguuagucuggugcucgucggcgugguaacacuguaucuuggugccauggugcaggcugacuccggguguguugucagcuggaagaauaaagaacugaagugcggaucuggcauuuucaucaccgauaacgugcacacuuggacagagcaguacaaguuucaacccgaaucaccaaguaaauuggccagcgcaauacagaaggcccaugaggaagguauuuguggcaucagguccgugacccggcucgagaaucugauguggaaacagauuacucccgaguuaaaccacauccugucugaaaaugaggucaagcuaaccauaaugacaggggacacgaaaggaguuaugcaggcuggcaagcgcucgcucagaccucaaccaaccgaacugaaauauagcuggaagacuugggggaaggccaaaaugcuuuccacagagucacauaaccagaccuucuugaucgauggaccggaaacaacugagugccccaauaccaacagggcauggaauagucuggagguggaagacuacggcuuugguguguucacgacaaacauuuggcucaagcugcgugagaaacaggacguauuuugugauucuaaguuaaugagcgcggcuaucaaagacaaucgggccguccacgcagauaugggguauuggauugaauccgcccugaacgacaccuggaagauggagaaggcuucauucaucgaggugaaaagcugccacuggccuaagucucauacucuuugguccaauggaguuuuggaaagugagaugauaauucccaagaauuucgccggccccgugagccagcacaacuaccgaccugguuaucauacccaaaucgcaggcccauggcaccucgggaagcuggaaauggauuuugacuucugugagggaacaacugucgugguuaccgaagauugcggcaauagagggcccucucuaaggacaacgaccgcuuccggaaaacugaucacugaguggugcugucgcucaugcacacucccgccucugcgguacagaggcgaggacgguuguugguacgggauggaaauuaggccacuuaaggagaaggaagagaacuuggugaauagucugguaaccgccggacauggccagaucgauaacuuuagcuuagguguccucggcauggcgcuguuccuugaagagaugcugcgcacucgaguggggacaaaacacgccauuuugcucguggcugucucguuuguuacccugauaacgggaaauauguccuuccgggaccuaggccgugugaugguaauggugggggcaacuaugaccgaugacaucggaaugggcgccacauaucuggcucuccuggccgcauuuaaggucagacccaccuucgcggccggucuuuugcugaggaaauuaacuucuaaggagcucaugauggcuacaauugggaucacccugcuuagccagucaacaauuccugaaacuauccuggagcuaaccgaugcccucgcacugggaaugaugguguugaaaauaguucgcaacauggaaaaguaccaacuggcugugacgaucauggccauuaguugcguccccaaugcagugaucuuacggaacgccuggaagguuuccuguacaauucucgcugcggugucugucagcccacugcuucugaccuccucacagcagaaagccgacuggaucccuuuggcacucacuauaaagggccugaaucccaccgcuauuuuucuaacaacucugagcagaaccaguaaaaagaggucuuggccacuuaacgaggccaucauggccguaggcaugguguccauccucgcuagcucgcuguugaaaaaugacauuccgaugacggggccucugguugcaggagguuuacucacagugugcuauguccugaccggccgaucagccgaucuugaacuggagcgcgcggcugacgugaagugggaggaucaggccgaaauaucugggaguucccccaucuugagcauuacuaucucugaggacggaagcauguccauuaaaaacgaagaggaggaacaaacacucaccauccugauacggacuggccuacugguaaucucagguguguucccagucaguauucccaucacagcagccgcuugguaccuuugggagguuaagaagcagagagcaggggugcucugggaugugccuagcccacccccugucggaaaagccgaacuggaggacggcgcguauaggauuaagcagcguggcaucuugggguacucucagauaggagcugguguguauaaagaaggcaccuuucacacgauguggcauguuacucgcggggccguauuaaugcaccggggaaagagaauugagccguccugggcagaugugaaaaaggaccugaucucauacggcgguggguggaagcucgagggagaauggaaagagggcgaagagauccaaguccuggcccuugaaccaggcaagaaucccagggcugugcagaccaaaccugggauuuucaagacaaacaccggaacaaucggugccguuagucuggauuuuagcccaggcacuuccgggucucccauaguggaccgaaaaggaaaggucgugggcuuguacgguaaugggguagucacccggucgggagcauaugugagcgcuauugcccagacggagaagucaaucgaggauaacccugaaauugaggacgauaucuuccgcaaaaagagacuaacaauaauggaccugcauccgggcgcgggcaaaacuaagagguaccuccccgccauuguucgggaagcaaucaaacgagggcugagaacccuuaucuuagcuccaacacgcguggucgccgcugagauggaagaggcacugaggggacucccuauucguuaucagacccccgccaucaaggccgagcacacuggucgggaaauuguggacuugaugugucaugcuaccuucacaaugagacugcucuccccaguuagggugccuaacuacaaucugauaaucauggaugaggcgcacuuuacggaccccgcaaguauugccgcucgcggcuauaucucuacucgagucgaaaugggggaggccgcaggaaucuucaugaccgccacaccaccgggcagcagagauccuuuuccccaauccaacgcuccaauuauggacgaggaacgggagauacccgaaaggucauggaacucuggucacgagugggugaccgauuucaaggggaaaacuguaugguuugugccuagcaucaaggcgggaaacgacauugccgcaugccuucgcaaaaauggcaagaaaguuauccagcugagucguaagacauucgauuccgaauacgucaagaccagagcuaacgacugggauuuuguggugacgacugacauuagcgagaugggcgccaauuucaaagcagagcgggucaucgauccaaggcgcuguaugaagcccguaauauugacagacggggaagaacgagugauccuagccggaccuaugccgguuacccauucuucagcugcccagagacgggguaggauuggccgcaaccccaagaaugaaaacgaccaauauaucuacaugggggagccccuggaaaaugaugaggacugcgcgcacuggaaggaggcaaaaaugcucuuagauaacauuaauaccccugaaggaaucauacccuccauguuugagccagaaagagagaagguggacgccauugauggcgaauacaggcugcggggugaggcucguaaaacuuucgucgaccuuaugcgccgaggggaucugccuguguggcucgccuauaagguugcugcagagggcaucaacuacgccgacagaaagugguguuuugauggaauuaaaaauaaccagaucuuggaagagaacguggaagucgagauauggacaaaggagggcgaaaggaaaaagcugaaaccccgguggcucgacgcucgcaucuauagugauccacuggcccuuaaggaguucaaggaguucgcagcggggagaaaaagccuaacccugaauuugauuacagagaugggaagguuaccuacuuuuaugacgcagaaggcccggaacgcucuggacaaucucgccgugcugcauaccgcagaagcugguggccgagccuacaaccacgcacuuucggagcugccggagacacucgaaacuuugcugcuacugacccuccuugccacaguaaccgggggaaucuuccuguuuuuaaugucuggcaaagguauugggaagaugacuuugggcaugugcugcaucauaacggcuuccgugcugcucugguaugcgcagauucaaccccacuggaucgccgcaagcaucauucuggaguucuuucuuaucguucugcucauaccagaaccugagaaacagagaaccccacaggauaaucaguugacauacgucgugauugcuauccugacuguggucgccgccaccauggcaaacgaaaugggauucuuagagaagacaaagaaagaccuaggccuggggucaauuaccacucaagagccagaaaguaauauccucgacauagaucuucgcccugcuucugccuggacacuguaugcgguugcuacgaccuuugugacucccauguugaggcauuccaucgagaacagcucaguaaaugugagucugacagccauugcaaaccaggccaccguccucaugggacuggguaagggcuggccgcuuagcaaaauggacaucggggugccacuccuggcuauuggauguuacucccagguuaauccuaucaccuugacagcagcccuguuacuacugguggcgcacuacgcuauuaucggccccggucuccaggccaaggcaacucgggaagcccaaaaacgugcugccgcagggauaaugaagaacccaacggucgauggcauuaccguaaucgaccuugagcccaucccuuaugauccgaaguucgaaaaacagcugggacaggugauguugcugauucucugcguuacacaggugcugaugaugagaacuaccugggcucuuugugaggccuuaacacuggcgaccggccccauaucuacucucugggaggggaauccaggaagguuuuggaacacgacaaucgccgucagcauggcaaauauuuuccgcggcuccuacuuggcuggugccgggcugcuauuuucaaucaugaagaacaccacuaauacccggcgaggaacaggcaacauuggugaaacucugggcgagaaauggaagucuagacucaacgcacuugggaaaagugaguuccaaaucuauaagaaaucgggaauacaggagguggacaggacccuggcuaaggagggcaucaagcgcggggaaacagaucaucacgccgucagccggggauccgccaaauugagaugguuuguggagcguaauaugguuacgccugaaggcaaggugguagaccuggguugcgggaggggaggcuggucuuacuauugugguggccucaaaaacgugcgggaggucaaggggcugaccaaaggaggccccgggcaugaagaaccuauuccaaugucaacuuacggauggaauuuaguucgccuucagagcggcguggaugucuucuucacacccccugagaagugcgacacccugcucugugauaucggugaauccaguccaaaccccacuauugaggcggggcgaacacuaagagugcugaauuugguagaaaacuggcugaauaacaauacccaauuuugcaucaaggugcucaacccguauaugccuucuguuauagagaaaauggaaacgcuucagaggaaguacggaggcgcucuggugcggaauccauugagccgcaacucaacccacgagauguacugggucuccaaugcaacaggcaacauugugaguagcgucaauaugaucucuagaaugcugaucaacagguucacuaugaaacacaagaaagccaccuaugagcccgacguggaucucggguccggaacacgaaacauugguauagaaucagagaucccuaauuuagacauuaucggcaagcggauugaaaagaucaaacaggagcaugaaacuagcuggcacuacgaccaggaucauccauauaagaccugggcuuaccacgggucguaugagacaaaacaaaccggaucugccaguuccaugguuaacggcguagugcgucugcuuacuaagcccugggacgucgugccgaugguuacgcagauggcaaugacagauaccacuccuuuuggucagcagagaguguucaaagagaaggucgacacccgcacacaagaacccaaggaggggacgaaaaagcugaugaggauaaccgccgaauggcuauggaaagagcucggaaagaaaaagacuccacggauguguacaagagaggaauuuacccgcaaagugaggagcaaugcugcgcugggcgccaucuucacugaugagaacaaguggaagucagcacgagaagcuguagaggacggccgguuuugggaauugguggauagagagaggaaucugcaccucgaggggaaaugcgaaacauguguuuacaacaugaugggaaagcgcgagaagaaacuuggugaguucggcaaagccaaagggucccgugcaauuugguauauguggcugggagcccgguuuuuagaguucgaagcucugggcuuuuugaaugaggaccauugguucucuagagguaacagccucaguggggucgagggagaaggccugcacaggcuaggcuacauccuucgcgauguggggaagaaagagggaggugccauguacgcggacgauaccgcaggcugggacacacgaauuacucuggaagaccucaagaaugaggaaauggugaccaaccauaugaaaggggagcacaagaaacuggccgaggcuaucuuuaaguugacguaucagaauaaggucguucgggugcagagaccuacccccaggggaacaguaauggauauuauaucccgcagagaccagcggggcagcggucaaguggggacuuacggacugaacaccuucacaaauauggaagcccagcucaucaggcagauggagggcgaaggcauuuucaaaucuauccaacaucuuacugucaccgaggagaucgcagugcagaacuggcuggcucguguugggcgagaacgcuuaucaagaauggccauuaguggagaugacugcguggucaagccaauagaugaccgguuugcuuccgcccugacggcauugaaugauauggguaaagugaggaaggacauccagcagugggagcccagccgcggcuggaacgauuggacacaaguaccuuucugcucucaccacuuucaugaacucguuaugaaagacgggagagugcuggucgugccaugucggaaccaggaugagcuaauuggaagggcgcgaaucucgcagggcgccgguuggucacuuaaggaaaccgcuugccugggaaagagcuaugcccagauguggacucucauguacuuccaccguagagaccugcgcuuggcagcuaaugccauuuguuccgcagugccgagucauuggguccccacaucucggaccacuuggagcauccacgccaaacacgaguggaugaccacagaggauauguuagcgguuuggaacaggguguggauacaagaaaauccuuggauggaggacaagacgccaguagaauccugggaggaagugcccuaucugggaaaaagagaggaccaguggugcggcucacucaucggccuuaccagucgcgcuacuugggccaagaacauucagacagcaaucaaucagguccggucucugauugggaacgaggaauacaccgauuauaugccuagcaugaaaagguuucgaagagaggaagaggaagccggagugcuaugguga

SEQ ID NO: 15042 - RNA, 9876 nt, Artificial Sequence
  derived and/or modified CDS sequence (opt3) from DENV-2__HQ332189__SS-prME
accgccggagugaucgucaugcugauuccaacugcuauggcauuccaccucacuacgagaaacggggagccucauaugauaguuggaaggcaggaaaaggguaaaagccuucuguuuaagaccgaggacggcgugaauaugugcacauugauggccaucgauuuaggggaacugugugaggacacuauuaccuacaaaugcccacuacuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaacuggauccugcggcauccuggcuucaccauaauggccgcaaucuuggccuacacaauuggcaccacgcacuuucagcgcgcucucaucuucauucugcugacugcaguggccccauccaugacaaugagaugcaucgggauaucuaauagggauuuugucgaaggagugucggguggcucauggguagacauuguucucgagcacgggagcugugugaccacuauggcuaagaacaagcccacauuagauuucgaacugaucaaaaccgaggccaagcagccugcgacgcuucggaaauauugcauugaagcaaaguugaccaauacaacuaccgagagucgcuguccaacacaaggagagcccucccugaacgaggaacaggacaaacgauuuaucugcaagcauucuauggucgauagaggcugggguaauggguguggacuauucggcaagggcgggaucgugacuugcgccauguuuaccugcaaaaagaacauggaaggaaaagugguccagccugagaaucucgaauacacaauuguuauaaccccacacagcggugaggagcaugcugugggcaacgacacugggaagcacggaaaagaaaucaagauuacgccgcaguccucaaucacagaggccgaacugaccggcuaugguacuguaaccauggaguguagucccaggacagggcuugauuucaaugaaauggugcuguugcaaauggaggacaaagcauggcucguccaccggcagugguuucuggauuuaccucugccauggcuccccggcgcugacacccagggaagcaacuggauacagaaggagacucuugugacauucaagaauccucaugccaaaaagcaagacguugugguccugggcucucaggaaggggcgaugcacacggccuugaccggagcaacugagauucagauguccucagguaaccuacuguuuacaggccaucucaaaugccgucugcgcauggauaaacuucaacugaaagggaugagcuacaguauguguaccggaaaguucaagaucgugaaagaaaucgcugagacacagcacggcacuauuguaaucagaguucaguaugagggugacgggucuccaugcaagauucccuucgaaauaaccgauuuggagaaaaggcaugugcucggccggcugaucacggucaacccgauugugaucgaaaaggacuccccugucaauaucgaggccgaacccccauuuggagauagcuacgugauuauaggcguugagccugggcaguuaaaacugaacugguucaagaagggaucgucuaucggucaaauguuugagaccacaaugcgaggcgcuaaacgcauggccauucuaggggacacugcaugggauuucggaucccucggcgguguguuuaccucaaucgggaaggcccugcaccagguauucggcgcuauuuacggagcggcauuuaguggcgucagcuggacaaugaaaauccuuauaggggugguuaucacuuggauuggaaugaacuccagaucuaccagcuugucagugagucugguccucgugggcguagugacgcuguaucuuggugccaugguucaggcugacuccgggugugucgugagcuggaagaacaaagaacugaagugcggaucuggcaucuucauuacagauaaugugcacaccuggacugagcaguacaaguuucaacccgaaucaccaaguaaauuggccagcgcaauccagaaggcccaugaggaagguauauguggcauuagguccgucacacggcucgagaaccugauguggaaacagaucacccccgaguuaaaucacauucugucugaaaacgagguuaagcuaacuaucaugaccggggacacaaaaggaauaaugcaggcuggcaagcgcucgcucagaccucaaccaacggaacugaaauauagcuggaagaccugggggaaggccaaaaugcuuuccacugagucacauaaucagacauucuugaucgauggaccggaaaccgcagagugccccaacacaaauagggcguggaacagucuggagguggaagacuacggcuuugguguguucacuaccaauauuuggcucaagcugcgugagaaacaggacguauuuugugauucuaaguuaaugagcgcugccaucaaagacaaccgggcaguccacgccgauaugggguauuggauugaauccgcucugaaugacacguggaagauggagaaggccucauucaucgaggugaaaagcugccacuggccuaagucucauacacuuugguccaacggaguuuuggaaagugagaugauaauucccaagaauuucgcaggccccgugagccagcacaauuaccgaccugguuaucauacccaaacugcuggcccauggcaccucgggaagcuggaaauggauuuugacuucugugagggaaccacagucgugguuacugaagauugcggcaacagagggcccucucuaaggaccacaacggccuccggaaaacugaucaccgaguggugcugucgcucaugcacucucccgccucugcgguacagaggcgaggacgguuguugguacgggauggaaaucaggccacuuaaggagaaggaagagaauuuggugaacagucugguaacagcgggacauggccagauugauaauuuuagcuuagguguccucggcauggcccuguuccuugaagagaugcugcgcacccgaguggggacuaaacacgcuaucuugcucguggcagucucguuuguuacacugauuaccggaaacauguccuuccgggaccuaggccgugugaugguaauggugggggccacgaugacugaugacauaggaaugggcgucaccuaucuggcucuccuggccgcauuuaaggugagacccacauucgcggccggucuuuugcugaggaaauuaaccucuaaggagcucaugauggcuacuaucgggauuacacugcuuagccagucaaccaucccugaaacaauucuggagcuaacugaugcccucgcacugggaaugaugguuuugaaaaucgugcgcaauauggaaaaguaccaacuggcugucaccauaauggccaucaguugcgugcccaacgcaguuauuuuacggaaugccuggaagguguccuguacgauccucgcugcggucucuguaagcccacugcuucugacauccucacagcagaaagccgacuggauuccuuuggcacucaccaucaagggccugaaccccacugcuauauuucuaaccacacugagcagaacaaguaaaaagaggucuuggccacuuaaugaggccauuauggccgugggcaugguuuccauccucgcuagcucgcuguugaaaaacgacaucccgaugaccgggccucugguggcaggagguuuacucacggucugcuaugugcugacaggccgaucagccgaucuugaacuggagcgcgcggcugacguaaagugggaggaucaggccgaaauuucugggaguucccccauauugagcaucaccauuucugaggacggaagcauguccaucaaaaaugaagaggaggaacaaacucucacaauucugauccggaccggccuacuggugauaucaggugucuucccaguuaguauccccauuacugcagccgcuugguaccuuugggaggugaagaagcagagagcaggggugcucugggaugucccuagcccacccccugugggaaaagccgaacuggaggacggcgcguauaggaucaagcagcguggcauuuugggguacucucagaucggagcugguguuuauaaagaaggcacauuucacaccauguggcauguaacgcgcggggccguguuaaugcaccggggaaagagaauagagccguccugggcagaugucaaaaaggaccugauuucauacggcgguggguggaagcucgagggagaauggaaagagggcgaagaggugcaaguucuggcccuugaaccaggcaagaaccccagggcugugcagacuaaaccugggaucuucaagaccaauacaggaaccaucggugccgucagucuggauuuuagcccaggcacauccgggucucccauuguggaccgaaaaggaaagguagucggcuuguacgguaacggggugguuacucggucgggagcauaugugagcgcuaucgcccagaccgagaagucaauagaggauaacccugaaauugaggacgauaucuuccgcaaaaagagacuaacgauuauggaccugcauccgggcgcgggcaaaacaaagagguaccuccccgccaucguccgggaagcaauaaaacgagggcugagaacucuuauuuuagcuccaacccgcgugguugccgcugagauggaagaggcacugaggggacucccuauccguuaucagacacccgccaucaaggccgagcacaccggucgggaaauuguggacuugaugugucaugcuacuuucaccaugagacugcucuccccagucagggugccuaauuacaaccugaucauuauggaugaggcgcacuuuacagaccccgcaaguauagccgcucgcggcuauaucucuacgcgaguagaaaugggggaggccgcaggaauuuucaugacugccaccccaccgggcagcagagauccuuuuccccaauccaaugcuccaaucauggacgaggaacgggagauccccgaaaggucauggaacucuggucacgagugggugacagauuucaaggggaaaaccguuugguuugucccuagcauuaaggcgggaaaugacauagccgcaugccuucgcaaaaacggcaagaaagugauccagcugagucguaagacuuucgauuccgaauacgugaagacaagagcuaaugacugggauuuugucguaaccacggacauuagcgagaugggcgccaacuucaaagcagagcgggugaucgauccaaggcgcuguaugaagcccguuauuuugacugacggggaagaacgagugauccuagccggaccuaugccggucacacauucuucagcugcccagagacgggguaggauaggccgcaaucccaagaacgaaaaugaccaauauaucuacaugggggagccccuggaaaacgaugaggacugcgcgcacuggaaggaggcaaaaaugcucuuagauaauauuaacaccccugaaggaaucauucccuccauguuugagccagaaagagagaagguggacgccaucgauggcgaauacaggcugcggggugaggcucguaaaaccuucguugaccuuaugcgccgaggggaucugccuguguggcucgccuauaaggucgcugcagagggcauaaauuacgccgacagaaagugguguuuugauggaauuaaaaacaaccagaucuuggaagagaauguggaaguagagauuuggacuaaggagggcgaaaggaaaaagcugaaaccccgguggcucgacgcucgcaucuauagugauccacuggcccuuaaggaguucaaggaguucgcagcggggagaaaaagccuaacacugaacuugauaaccgagaugggaagguuaccuacauuuaugacucagaaggcccggaaugcucuggacaaccucgccgugcugcauacggcagaagcugguggccgagccuacaaucacgcacuuucggagcugccggagacccucgaaacauugcugcuacugacucuccuugccaccguuacagggggaaucuuccuguuuuuaaugucuggcaaagguauugggaagaugaccuugggcaugugcugcaucauuacugcuuccguccugcucugguaugcgcagauccaaccccacuggauagccgcaagcauuauccuggaguucuuucuuaucgugcugcucauuccagaaccugagaaacagagaacgccccaggauaaccaguugaccuacguggucaucgcuauacugacaguuguggccgccacuauggcaaaugaaaugggauucuuagagaagaccaagaaagaccuaggccuggggucaauuacaacccaagagagugaaucuaacauccucgacauugaucuucgcccagcuuccgccuggacucuguaugcgguagcuacaacguuugugaccccuauguugaggcauagcaucgaaaauucaagugucaacgugagccugacugccauagcaaaucaggccacaguucucaugggacuggguaagggcuggccccuuuccaaaauggacaucggggugccgcuccuggcuauuggauguuacucucaggucaacccaaucaccuugaccgcagcccuguuacuacugguagcgcacuacgcuauuaucggcccuggucuccaggccaaggcaacacgggaagcccaaaaacgugcugccgcagggauuaugaagaaucccacuguggauggcaucacgguuauagaccuugagccaauucccuaugauccuaaguucgaaaaacagcugggacaggugauguugcugauccucugcgucacccaggugcugaugaugagaacaacuugggcucuuugugaggccuuaacccuggcgacaggcccgaucagcacccucugggaggggaaccccggaagguuuuggaauacuacgauugccgucuccauggcaaacauauuccgcggcucauacuuggcuggugccgggcugcuauuuucuaucaugaagaauacaaccaacacucggcgaggaaccggcaacauuggugaaacacugggcgagaaauggaagaguagacucaaugcacuugggaaaucggaguuccaaaucuauaagaaaagcggcauucaggagguggacaggacucuggcuaaggagggcaucaagcgcggggaaaccgaucaucacgccguuucccggggaucugccaaauugagaugguuuguggagcguaacaugguaacaccagaaggcaagguggucgaccuggguugcgggaggggaggcuggucauacuauugugguggccucaaaaauguucgggaggugaaggggcugacgaaaggaggcccugggcaugaagaaccaauaccuaugagcaccuacggauggaacuuaguccgccuucaguccggcguggauguauucuucacuccacccgagaagugcgacacacugcucugugauaucggugaaaguucuccuagcccaaccauugaggcggggcgaacucuaagagugcugaauuugguugaagacuggcugaacaauaacacacaauuuugcaucaaggugcucaaucccuauaugccgucagucauugagaaaauggaaacccuucagaggaaguacggaggcgcucuggugcggaacccuuugucccgcaauaguacgcacgagauguacugggucagcaacgcaaccggcaauaucgugucuuccguuaacaugauaucaagaaugcugauuaauagguucacaaugaaacacaagaaagccacuuaugagccagauguagaccucgggagcggaacccgaaacaucgguaucgaaucggagauucccaacuuagacauaaucggcaagcggauugaaaagaucaaacaggagcaugaaacaucuuggcacuacgaucaggaccauacuuauaagaccugggcuuaccacgggaguuaugagacaaaacaaaccggauccgccagcucaauggugaauggcgucgugcgucugcuuacuaagccuugggauguugugccaauggucacgcagauggcaaugacagacaccacucccuuuggucagcagagaguguucaaagagaagguagauacccgcacacaagaaccgaaggaggggacgaaaaagcugaugaggauuaccgccgaauggcuauggaaagagcucggaaagaaaaagacuccucggauguguacaagagaggaauuuacccgcaaagugagguccaacgcugcgcugggcgccaucuucacugacgagaauaaguggaagucugcacgagaagcuguugaggauggccgguuuugggaauuggucgacagagagaggaaccugcaccucgaggggaaaugcgaaacauguguguacaauaugaugggaaagcgcgagaagaaacuuggugaguucggcaaagccaaagggagccgugcaauaugguauauguggcugggagcccgguuuuuagaguucgaagcucugggcuuuuugaacgaggaucauugguucaguagagguaauucccucagcgggguggagggagaaggccugcacaggcuaggcuacauccuucgcgacgucgggaagaaagagggaggugccauguacgcggaugacaccgcaggcugggacacacgaauuacucuggaagaucucaagaacgaggaaaugguuaccaaucauaugaaaggggagcacaagaaacuggccgaggcuaucuuuaaguugacguaucagaacaaggugguacgggugcagagacccaccccaaggggaacagucauggacauuaucucucgcagagaucagcggggcucaggucaaguggggacuuacggacugaauaccuucacaaacauggaagcccagcucauuaggcagauggagggcgaaggcauauucaaaaguauccaacaucuuacugcaaccgaggagauugcuguucagaauuggcuggcccguguggggcgagaacgcuuauccagaauggcuaucagcggagacgauugcgucgugaagccuaucgacgaucgguuugccucugcacugacggcguugaacgacauggguaaaguaaggaaggauauucagcagugggagcccucgcgcggcuggaaugacuggacacaaguuccauucugcucacaccacuuucaugaacucgugaugaaagaugggagaguccugguggugcccugucggaaccaggacgagcuaauaggaagggcccgaaucagccagggcgcugguuggucccuuaaggaaaccgccugccuggggaagaguuaugcacagauguggacucucauguacuuccaccguagagaucugcgcuuggcugccaacgcaauuuguucugccgucccuagccauuggguuccaacaucccggaccacuuggucaauccacgcgaaacacgaguggaugaccacagaggacauguuagcuguguggaauaggguauggauucaagaaaacccguggauggaggacaagacgcccguggaaaguugggaggaagucccuuaucugggaaaaagagaggaucaguggugcggcucucucaucggccuuaccagccgcgccacuugggcaaagaauauacagacagccaucaaccaggugcggucccugauugggaaugaggaauacaccgacuauaugccaucaaugaaaagguuucgaagagaggaagaggaagcuggaguucuaugguga

SEQ ID NO: 15043 - RNA, 9876 nt, Artificial Sequence
  derived and/or modified CDS sequence (opt3) from DENV-2__JN368476__SS-prME
agcgcaggaaugaucauuaugcugauccccaccgugauggcuuuccaccucaccacuagaaacggggagccucauaugaucgucggcauucaggaaaaggguaaaucccuucuguuuaagacggaggacggcguuaauaugugcaccuugauggcaauggauuuaggggaacugugugaggacacaaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcacuggugccccaugucgguauggggcuugagacucguaccgaaacauggaugagcuccgagggggcguggaaacacgcucagagaaucgagacuuggauacugaggcauccuggcuucaccaucauggccgcaauuuuggccuacacaaucggcaccacgcacuuucagcgggcucucauuuucauccugcugacugcaguggccccaucuaugacaaugcgcugcauagggauuucgaacagagauuuuguugaaggagugucagguggcagcugggucgacaucgugcucgagcacgggaguuguguaaccacuauggcuaagaauaagcccacauuagauuucgaacugauuaaaaccgaggccaagcagccugcgacgcuuaggaaauauugcaucgaagcaaaguugaccaacacaacuaccgagucccgguguccaacacaaggagagcccucucugaaagaggaacaggacaagcgcuuuguuugcaagcauagcaugguggaucgaggcugggguaauggguguggacuauucggcaaaggcgggaucgucacuugcgccauguuuaccugcaagaaaaacauggaaggaaagauugugcagccugagaaucucgaauacacaauaguggucaccccacacuccggugaggagcaugcuguuggcaacgacacugggaaacacggaaaggaaaucaaagugacgccgcagucaaguauuacagaggccgaacugaccggcuaugguacuguaaccauggaguguagccccagaacagggcuugauuucaaugaaauggugcuguugcaaauggagucuaaggcauggcucguccacaggcagugguuucuggacuuaccucugccauggcuccccggcgcugauaagcagggauccaacuggauccagaaagagacccuugugacuuucaagaauccucaugccaaaaagcaagacguugugguccugggcucacaggaaggggcgaugcacacagccuugacgggagcaaccgagauacagaugagcagugguaaccuacuguuuacuggccaucucaaaugccggcugcguauggacaaacuucaacugaaggggaugucuuacuccauguguacaggaaaauucaaggugguaaaagaaauugcugagacccagcacggcacaaucguuauccgcgugcaguaugagggugaugggagcccaugcaagauucccuucgaaaucauggacuuggagaaaagauacguccucggcaggcugauuacugugaauccgauagucaccgaaaaggauucgccugugaacaucgaggccgaacccccauuuggagacucuuacauuaucaucggcguugagccugggcaguuaaagcugaacugguucaaaaagggauccucaauuggucaaauguuugagacgaccaugcggggcgcuaaacgaauggccauacuaggggauacagcaugggacuucggaagucucggcgguguguuuacuagcaucgggaaggcccugcaucagguauucggcgcuauuuauggagcggcauuuuccggcgucucuuggaccaugaaaauccuuauuggggugaucauaacauggaucggaaugaauagccgcucaacaaguuuguccguuagccuggugcucgucggcauugugacccuguaccuugguguaauggugcaggccgauucuggguguguugucucauggaagaacaaggaacugaaaugcggaaguggcaucuucauuacggacaaugugcacacauggaccgagcaguauaaguuucaacccgaaagcccauccaaauuggcuucugccauccagaaggcacaggaggaagguauauguggcauuagaucggugacuaggcucgagaaccugauguggaaacagaucacacccgaguuaaaucacauucuggccgaaaacgaggucaagcuaaccaucaugacuggggauauaaaaggaaucaugcaagcuggcaagcggagccuccgcccucagccaaccgaacugaaguacuccuggaaaacaugggggaaggccaaaaugcuuucaacggagagucauaaucagaccuucuugauugacggaccggaaacugcagagugccccaacacaaauagagcguggaacucucuggagguugaagauuauggcuuugguguguucaccacaaauaucuggcucaagcugaaagagaagcaggacgcuuuuugugacagcaaguuaauguccgccgcaauuaaagauaacagggccgugcacgcugacaugggguacuggaucgaaucagcccugaaugauacuuggaagauagagaaagccagcuucauugagguaaagaacugccauuggccuaaaucucacacccuuugguccaauggagucuuggaaagugagaugaucaucccaaagaaccucgcuggccccgugagccaacacaacuaucguccugguuaccauacgcagacagccggcccauggcaccuggggaagcuagaaauggacuucgauuuuugugacggaaccacuguuauugugaccgaggauugcggcaaucgggggcccucucugcgaacaacuaccgcguccggaaaacucaucacagaauggugcuguagaucaugcacgcugccgccucuuagguaccgcggcgaggacgguuguugguaugggauggagauucggccauugaaggaaaaagaggaaaaccuggucaauaguuuagugaccgccggacauggccagguugauaacuucagccucggugugcugggcauggcucuuuuucuggaggaaauguugagaacuaggguagggacaaagcacgcaauacuccuggucgccgugucguucgugacccuaaucacuggaaauauguccuuuaaagaccugggccgcgucguugugaugguagggacaaccaugacggaugacauuggaaugggcgugacuuaccucgcucugcuugccgcauucaagguccgacccaccuuugcggccgguuugcuguuacggaagcucacaucuaaagagcugaugaugaccacuaucgggauugugcuucugagccaaucaacaaucccugagaccauacuagaacucacagaugcucuggccuugggaaugaugguucugaagaucgugcgugacauggagaaauaucaguuagcagucacuauuauggcuauccucugcgugcccaacgccguuauucugcagaaugcauggaaggugaguuguaccauccuugccgucguauccgugucuccacuguugcucacgagcucccagcaaaagacugacuggauaccucuggcucuaaccauuaagggccugaaccccacugcgaucuuccuuaccacacucucaagaacuaauaaaaagaggagcuggccacugaacgaagccaucauggcaguuggcauggugaguauuuuggcuucuucccuguuaaagaaugauauaccgaugaccgggccucucgucgccggaggucugcuuacggugugcuacguacugacaggccgcagcgccgacuuggagcucgaacgggcuaccgaugugaaaugggaggaccaggcagagaucucggggucaucucccauucugaguaucacuauuuccgaagauggaagcaugucuaucaagaacgaggaagaggagcagacacuaaccauacugaucagaacuggccuucucgucauuagcggucuguuuccaguuuccauccccauuacagccgcggcuugguauuugugggaagugaaaaagcagagggccgggguguuaugggacgucccuucaccacccccuaugggaaaagcagagcuggaagauggcgccuaccgaaucaagcaaaagggcauacucggguauagucagauuggagcugguguguacaaagagggcaccuuccauacgauguggcacguuacucgcggggcaguacugaugcacaagggaaaacggaucgaaccgagcugggccgacgugaagaaagaucuuaucucuuacggcgguggguggaagcuggagggagaguggaaggaaggcgaggaaguccagguguuggcgcuagagccaggcaaaaaucccagagcuguucagaccaagccugggcuguuuaaaacaaacaccggaacaauuggugccgugucccucgacuucucaccaggcacaagugggagccccaucauagauaagaaaggaaaggucgugggccuguaugguaaugggguagucaccagguccggagcauacgugucugccauugcucaaacggaaaagucgaucgaggacaacccugagauugaagaugacaucuuucguaaacgccggcuuacaauaauggacuuacauccgggcgccggcaagacuaaaagauaucugcccgcaauuguuagggaggcuaucaagcgagggcuccggaccuugauccuggccccaacacgcguggucgcggccgaaauggaggaagcacucagaggacugccuauuagguaccagacccccgcuauccgggccgagcacacuggucgagagauuguggaucuuaugugucaugcuaccuucacaaugagacuguugagcccaguucgcgugccuaacuauaaucuaauaaucauggacgaagcacacuucacggaucccgccucaauugccgcuaggggcuacaucuccacucgugucgagaugggggaagcggcaggaaucuuuaugaccgccacaccaccgggcagucgggacccuuucccccagucuaacgcuccaauuauagaugaggagagagaaauccccgagaggagcuggaauaccggucaugaaugggugacugacuuuaaagggaagacaguaugguucgugccuuccauuaaggccggaaacgauaucgcagccugccugcgcaaaaauggcaagaaaguuauucaacucucacgaaagaccuuugacucugaguaugucaaaacgagaacuaacgauugggacuucguggugacaaccgauaucagcgaaaugggcgcuaauuuuaaggcggagcgggucauagacccaaggcgcuguaugaaacccguaaucuuaaccgacggggaggaacgugugauucuggccggaccuaugccgguuacucacaguuccgcagcucagagacgggguaggaucggccgcaacccaaagaaugagaacgaucaguacauuuacaugggggaaccccuugagaaugacgaagauugcgcccacuggaaggaggcaaaaaugcugcucgacaacaucaauacaccugagggaauaauucccagcauguucgaaccagagcgagaaaagguggaugccaucgacggcgaguauagauugcggggugaagcuaggaaaaccuuugucgaucugaugcgcagaggggaccucccuguguggcuggccuacaagguugcggcagagggcauuaacuaugccgauaggcggugguguuucgacggaaucaaaaauaaccagauacuugaggaaaacguggaggucgaaaucuggacaaaggagggcgagcguaagaaacuaaagccccgcuggcuggaugcucgaauuuacucugacccauuggccuuaaaagaauuuaaggaguucgcugcagggagaaaaucacugacucucaaucugaucacggaaaugggaaggcuuccuaccuucaugacacaaaagacucgggaugcccuggacaaccucgcuguguugcauaccgccgaggcggguggacgcgcauauaaucacgcccuguccgaacuaccggagacacuggagacccuccuucuguuaacuuugcuggcuacgguaaccgggggaauuuuucucuuccugaugaguggcagagguaucgggaagaugacacuuggcaugugcugcauaauuacugccagcgugcugcucugguacgcacagauccagccccauuggaucgcugccucgauuaucuuggaauuuuuccugauaguuuuacuaauuccagagccugaaaaacagaggacaccccaagacaaccagcugacauaugucgugaucgcaauucucaccguggucgccgcuacuauggcgaaugagaugggauuucuugaaaagacuaaaaaggaucugggcuuggggucuaucgccacgcagcagccagaguccaacauacuggacaucgaucuccggccugcaagcgcuuggacccuguacgccguugccacuacauucgugacccccaugcuucgacacucaauugagaauaguucuguaaacgugucccucaccgcaaucgcuaaucaagccacaguccugaugggauuggguaaaggcuggccgcugagcaagauggacauuggggugccauuacuagcgaucggauguuacucacagguuaacccuauuacucugacggcugcccuccuucuguugguggcacacuaugccaucauaggccccggucugcaggcuaaggcaaccagagaagcccagaaacgcgcggcugccgggauuaugaagaauccaacagucgauggcaucacuguaaucgaccucgaucccauuccuuacgacccgaaauuugagaagcaacugggacaggugaugcuuuuaauacugugcguuacccaggugcucaugaugaggacaaccugggcauugugugaagcccugacucuagcuacgggccccaucaguacacugugggaggggaacccaggacgguucuggaauaccacuauugccgucagcauggcaaacaucuuucguggcuccuaucucgcuggugccgggcuucuguucucuauuaugaaaaauaccacaaacacuagaaggggaaccggcaauaucggugaaacauugggcgagaaguggaaaagccgccugaacgcgcucgggaaguccgaguuucaaacguacaagaaaucaggaauacaggaaguggaucggacccuggccaaggagggcaucaaacgaggggaaacugaccaucacgcagucucuagaggaagugcuaaguuaaggugguucguggagcgcaacaugguuacaccugagggcaaagugguagaucuugguugcgggcggggaggcuggucguauuacugugguggccugaagaaugugagagaagucaaggggcucaccaaaggaggccccgggcaugaggaaccuauuccaaugagcacuuauggauggaaccuaguucgucugcaguccggcguggacgucuuuuucauacccccugagaagugcgauacauugcugugugacauuggugaaucuucaccaaaucccaccguggaggccgggaggacgcuccggguacuuaaccugguggagaauugguugaacaauaacacccaguucugcaucaaaguucugaauccguacaugccuagcgugauagaaaagauggaggcacuccaacgcaaauacggaggcgcuuuaguccgaaacccacuguccagaaauaguacacacgaaauguauugggugucuaacgccagcggcaauauugucucauccgugaacaugaucaguaggaugcuuaucaaucgguuuacuaugcgccauaagaaggccaccuacgagcccgacguugaucuggggagcggaacaagaaacauugguauagaaucugagaucccuaaccuagacauuaucggcaaaaggauugagaagaucaaagaggaacacgaaacuuccuggcacuaugaucaggaccauccauacaagaccugggcguaucacgggucauacgagacaaaacagaccggaagcgcuucgucuaugguaaauggcgugguccgacuccugacuaagcccugggauguguugccgacgguuacacagauggcaaugaccgacacuaccccuuucggucaacagcggguguuuaaggaaaaagucgauacacguacgcaggagcccaaggaggggaccaaaaagcugaugaaaauaacugccgaauggcucuggaaggagcuuggcaaaaagaagacaccaagaauguguacccgcgaagaguucacuaggaaagugcggaguaacgcugcccugggcgcaaucuuuacagacgagaauaaguggaaauccgccagagaagcuguagaggauagccgcuucugggaauuaguggacaaggagaggaaccugcauuuggaaggcaaaugcgagaccuguguuuauaauaugauggggaagcgagagaagaaacucggagaauuugguaaggcgaaaggcucacgggccauuugguacauguggcugggggcaagauuccuagaguuugaagcucuuggauuccugaacgaggaucacugguuuuccagggaaaauucucucagcggcgucgagggugaggggcugcacaaguugggauacauccugcgcgacgugaguaaaaaggaaggcggcgccauguaugcagacgauacagccgggugggacacucguauuacccucgaggaucuuaagaacgaagagauggugacgaaucauauggaaggagagcacaaaaagcuggcugaggccaucuucaaauuaaccuaccagaacaaggucguucgggugcaaagaccuacacccagggguacuguaauggacauuauaucccgccgagaucagcggggcagcggacaggugggaaccuauggccugaauacauuuacuaacauggaagcgcaauugaucagacagauggagggugaaggggucuucaaaaauauucagcaucucaccgugacggaggaggcagccguucagaacuggcuggcuagggugggacgcgaaagacuaucucggauggccaucucaggcgacgauugcgucgugaagccacuugacgauagguucgcaaaugcucugacagcccucaacgacaugggcaagauccguaaagauauucaacagugggagcccaguaagggguggaacgacuggacccagguaccuuuuugcucccaccauuuccacgaacugauaaugaaagauggacgaguuuugguggucccaugucgcaaucaggacgaguuaaucgguagagcucggauuagccaaggcgccggguggucucugagggaaacugcaugccucggaaagucguacgcgcagauguggucacuuauguauuuucaccgcagagaccugcggcuagccgcuaacgccaucuguagcgcagugccgucccauugggugcccacaaguaggaccacuuggucuauucacgcuaaacaugaguggaugaccacagaggauaugcugacggucuggaaucgaguuuggauccgugaaaacccuuggauggaggacaagaccccaguggaaagcugggaggaaauacccuaccucggcaagagagaggaucaguggugcgguuccuugaucgggcugacuucacgcgccacaugggccaaaaauauucaggccgcgaucaaccaaguacggagucuuauuggaaaugaggaauauaccgacuacaugccuucuaugaagagguucagacgcgaggaagaggaagcuggcgugcugugguga

SEQ ID NO: 15044 - RNA, 9876 nt, Artificial Sequence
  derived and/or modified CDS sequence (opt3) from DENV-2__JF260983__SS-prME
accgccggcuuccugaucauggugauucccacagucauggcuuuucaccucacuacgagaaacggggagccucauaugauaguuagcaagaaugaaaaaggaaagggucuucuguucaaaaccgagaacggcaucaauaugugcacauugauggcaauggacuuaggggaacugugugaggauacugugaccuacaagugcccauuucuaaaacagaacgaaccggaggacauugauuguuggugcaauuccacaucuaccuggguaacuuauggaacauguucaaguaccggcgagcacaggcgggaaaagcgcagcguggcccucgucccccauguggguauggggcuggagacgcgaacugaaaccuggauguccucugagggagcguggaagcaagcucagcguaucgagacauggauucuuagacacccuggcuucacucugauggccgcaguuuuggccuacaccaucggcacaacccauuuucagagggcucucauauucauccugcugacggcaguggccccaucgaugacuaugcggugcauugggaucucaaaccgcgacuuugucgaaggagugagcgguggcaguuggguagauauuguucucgagcacggguccugugugacaaccauggcuaaaaauaagcccacuuuagacuucgaacugaucaaaacagaggccaagcagccugcgacccuuagaaaauuuugcauagaagcaaaguugacgaacaccacaacugagucuagguguccaacccaaggagagcccagccuggucgaagagcaggauaagcgguucgugugccgccacuccaugguggaccgaggcugggguaauggguguggacuauuuggcaaaggcgggauugucacaugcgccauguucacuugccucaagaaaauggaaggaaagguugugcagccugagaaccuggaauauaccaucguaauuacaccacauucaggugaggagcacgcugugggcaaugauaccgggaaacauggaaaggaagucaaaaucacuccgcagaguagcaucucugagacggaacuuacagacuacggcaccauuacuauggaguguucccccagaaccggucuggauuuuaacgaaaugguguugcuccaaauggagucaaaggccuggcugguucacaggcagugguucuuagaccugccucucccauggcuucccggggcagauacacagggcagcaauuggauacagaaggagaugcuggugaccuucaaaaacccucacgcuaagcggcaagacgucgugguauugggaagucaggaaggcgccaugcauacugcgcuaacaggggccacggagauccagaugucucugggaaauauucucuuuaugggucaccugaaaugccgucuucgcauggacaagcugcaauugaaaggcauguccuauagcauguguaccgggaaguucaagguugugaaagaaaucgcagagacucagcauggaacaauagucauuagagugcaguacgagggcgaugacucgccaugcaagauccccuuugaaaucauggaucucgagaaaaagcacguccuggguagguuaauuaccgugaacccgaucguuacagaaaaagacucuccuauuaacauagaggcugaacccccauucggggauuccuauaucgugauuggcguagagccuggacagcugaagcuaaauugguuuaagaaaggcucaaguaucgggcaaauguucgagacuaccaugcggggagccaagcgaauggcuauccucggugacacggccugggauuuuggcagcauugggggagucuucaccuccgugggcaaagcacugcaucagguuuuuggugccauauacggggcugcguucucuggcgugagcuggacaaugaagauccuuauuggagucgugaucacuuggauuggcaugaacucacgcaguaccuccuugagcguaacacuggugcucguugggaucgucacucuguaccuuggagugauggugcaggcagacucuggcugugucguuucauggaaaaauaaggaacugaagugcgguagugggauauuugugaccgauaacgugcacacguggacagagcaguauaaauuccaacccgacagcccauccaaguuggccucugcuauccagaaagcccacgaagagggaauuuguggcaucagaucgguaaccaggcucgaaaaucugauguggaagcagauuacucccgaguuaaaccauauccugagcgagaaugaagucaaacuaacaauaaugaccggugagauuaagggcaucaugcaggcagggcggcgcucccucaaaccucaaccaacugaacugagauacucauggaagaccuggggaaaggccaaagugcuuaguacagaguugcagaaccagacguuucugauugauggcccggaaaccacugagugccccaauucuaacagggcuuggaauagccucgagguugaagacuauggguucggaaucuucacaaccaacauauggcugaaguuacgugagaaacaggacaugaucugugauuccaagcugaugucagccgcagugaaagacgaucgggcgguccacgcugacaugggcuacuggauugaaagccgacuuaaugauacauggaagauggagaaggccucuuuuaucgaggugaaauccugcuauuggccuagaagucauacuuuguggagcaacgguguucucgaaucugagaugauuaucccaaagaaucuggcagggcccgugucccaacacaacuacaggccuggauauuacacccagacggccggcccauggcaccuagguaaacuggaaauggacuucgaguuuugugaaggcacaaccguagucgugacugaggauugcgggaaccgcggacccucacuccggaccacaacugcuaguggcaagcugauaaccgaguggugcuguagaagcugcacacuuccgccuuugagguaccgcggggaagacggauguugguauggcauggagauucgaccacugaaagaacgggaggaaaauuuagugaacucgcucgucacggccggucaugggcagaucgauaauuucucccugggaauccuuggcauggcacuguugcucgaggagaugcugcguaccagaguugguacuaagcacgcucuacugcucguggccauuucuuuuguaacacugaucaccggcaacaugagcuucaaggaccuugggagggugauuauaauggucggagcggccaugacugaugaaaugggcaugggggugacauacuuggcucuguuagcagccuuucgcguucggcccaccuucgcugugggacuccugcuuagaaaacugacgucaaaggagcuacucauggccacuaucggcgucgugcuguugagucaauccaauauuccugguaccguucuggaauuaacagacgcaaucgcgcucgggauuauggugcugaaaaucaugaggucuauggagaaguaucagcuugccgucaccguaauggcuaugcugugcauacccaacgugaugaucuugcagcaugccuggaaaguuggauguacuauucucgcagcugugagcgucuccccacugcuacugacaucaagccagcaaaagaccgauuggaucccucuugcccucacaauuaagggccugaaucccacugcaaucuuuuugaccacgcugagucgaccaucuaaaauacgcuccuggccguuaaacgaagccauuauggcugugggcaugguaagcauccucgcgucgucacugcuuaagaaugacaucccuaugacagggccccugguggccggagguuugcucaccgucugcuacguucugacuggccggucugcagaccuagagcuggagaaagcugccgaagugaagugggaggaucaggccgaaauuaguggguccagcccaauacuuucuaucaccauuagcgaggacggauccaugucaaucaaaaacgaggaagaggaacagacacucacuauucugaucagaaccggcuuguuagugauaaguggucuguuccccgucagcaucccuauuacggcugcagccugguaucucugggagacaaagaaacagagggcgggggugcugugggauguuccaucucccccuccgaugggaaaggcugaacuugaggacggcgccuaccguaucaagcaacgcggcauuuuuggguauucccagaucggagcagguguauacaaagagggcaccuuccacacuauguggcaugugacacggggggccguccuggugcacaagggaaaaagauuggaaccaucaugggcugauguuaagaaagaccuaauaaguuacggcgguggguggaagcuggagggagaauggaaggauggcgaggaagugcagguccucgcacuggagcccggcaaaaauccuagggccgugcagaccaagccagggcuuuuuaaaacuaacacaggaaccauuggugcgguaagcuuagacuucucccccggcacgucugggucgccuaucaucgaucgaaagggaaaagucgugggccuguaugguaaugggguugugacucggagcggaaccuacgucucauccauugcucaaacagagaagaguguggaagacaacccggagaucgaagaugacauauuccgcaagaaaagacucaccauuauggauuugcaccccggcgccggcaagacaaaaagguaucugccagcaaucguucgggaggccauucgaagagggcuccgcacucugauccuugcuccuaccaggguggucgccgcagaaauggaggaggcucugcguggauugcccauacgguaccagacgccagccauuaaggcggaacauacagguagagagaucguggaccuaaugugucacgccacuuuuaccaugaggcugcucucuccuauccgcguacccaauuauaacuuaauuaucauggacgaagcacauuucacagauccagcuagcauugccgcucgaggcuacauauccaccagaguggagaugggggaggcagccggaaucuuuaugacugccaccccgccuggcucacgggaccccuucccacagucuaacgcucccauuauggaugaagagagggaaaucccugagcgcagcuggaauaguggucacgaauggaucacaaacuuuaaagggaagacgguuugguucgucccauccauucgugcgggaaaugacauagcagccugccugagaaagaacggcaaacgggugauccaacuuagcaggaagacuuuugauaccgaguauacaaaaacccgcacuaaugacugggauuucguggucacaaccgacauuucugagaugggcgcuaacuuuaaggccgaacgaguaaucgaucccagacgguguaugaaaccugugauucugacggacggggaggaaaggguugugcucgcaggaccgaugccagucacucauucauccgccgcucagcgcagagguaggaucggccggaaucccaagaacgagaaugaucaguacauauacaugggggaaccuuuggagaacgacgaggacugcgcgcacuggaaggaagccaaaaugcugcucgauaauaucaacacacccgagggaauuaucccaaguauguucgaaccugagcgugaaaagguggacgcaauugauggcgaguaucgccugcgaggugaggcuagaaaaaccuuuguugaccuuaugaagaggggggaucuacccguguggcuggccuacaaagucgcaagcgaaggcaucaauuaugccgaccggaagugguguuucgauggaauacgcaacaaucagauuuuggaggaaaacaucgagguggagguauggaccaaagaaggcgagagaaagaaguuaaaaccaagguggcuggacgcucggacuuacucggauccucucgcccugaaggaauucaaagaguuugcggcagggcgaaagucucuuacacugucccucauuaccgaaaugggaagauugccgacauucaugacucaaaaaacgcgcgacgcccuggauaaccuagcugugcugcacagcgccgagauggguggcagggcuuauaaucaugcacucucagagcuucccgaaacccuggagacauuauugcugcucgggcugcuugccacuguuaccggaggcaucuuucuguuccucaugaguggucggggggucggcaagaugacauugggaaugugcugcauaaucaccgcuucuggccuguuaugguacgcccagauucagccacacuggaucgcagcguccauuauccuagaauuuuuccugauagugcuccuuauuccugagcccgaaaagcagcguacuccacaagacaaccagcugacguauguggucaucgccaucuugacccugguugcugccacaauggcaaaugagaugggguuucucgagaaaacuaagaaagaucugggacuugguggcuucaccaugcagcagccugaaauuaacauccucgacauagaccugagacccgcuagcgccuggacauuguacgcaguggccaccacuuuuguaacaccgaugcugaggcauucaauugagaauaguagcgugaacgucuccuuaacggcuaucgcgaaucaagccaccgugcuaauggggcugggaaagggcuggccacucucuaaaauggauauugguguuccucuucuggcaaucggguguuacagccaggugaaccccauaacuuugacagcugcccugcuccugcuugucgcccacuaugcaaucauuggcccaggauuacaggcuaaggccacccgcgaagcgcagaagcgggcugccgcaggcaucaugaaaaaucccaccguagacgggauuacagugaucgaucuggagccuauuccguacgaccccaaguucgaaaaacaacucggacagguuauguugcuggugcuaugcgucacucaggugcugaugaugcgaacgaccugggcccucugugaggcucuuacacuggcaacuggcccaaucuccaccuugugggaggguaacccugggaaguuuuggaauacaaccauagccgucucaauggcgaacauuuucagaggaucuuaucuggcuggcgccggucuccuguuuaguaucaugaggaauacuacgucggcacgccggggcacagggaccaucggagaaacuuuaggcgagaaauggaagagcagacuuaacgcccuggggcguuccgaauuccaaauuuacaagaaaucuggaauacaggagguggauaggacccucgcuaaggagggcaucaaacggggugaaacagaccaccaugccguuucacgcgggagcgcaaagcuacgaugguucguggagagaaauaugguagcucccgaaggaaaaguggucgaucugggcugcgguaggggcgggugguccuauuacuguggaggcuugaagaacguucgggaggugaaagggcugacuaagggaggcccuggucacgaagagccaauucccaugaguaccuauggguggaaucucguccgccuucagucuggaguggacguauuuuucacaccuccagagagaugcgauacgcuguugugugacaucggcgaaagcucacccaacccgaccguggaggccggcaggacucugcgaguucucaacuuaguggaaaauuggcugggguccaacacacaguuuugcauuaagguccuuaauccuuacaugccaagugugaucgagcggauggaaacccugcaacguaaauucggaggugcgcuagucagaaacccccucagccgcaauucuacucaugagauguacuggguguccaacgccucaggcaauauaguuagcucgguaaacaugaucucuaggaugcugauuaaucgguuuacaaugagacacaagaaagcaaccuaugagccugauguggacuuggggaguggaacgcgcaacaucggcauugaaugugagaccccaaauauggauaucauagguaagaggauugaaaaaaucaagcaggagcaugaagcuuccuggcacuacgaccaggaccaccccuauaagacaugggccuaccaugggagcuaugagacuaaacagaccggaucagcauccucuauggucaacggcgugguucgacugcucacaaagccgugggaugugaucccuauggucacucaaauggcuaugaccgacacaacccccuucggccagcagcggguguuuaaagagaagguagauacuagaacgcaggaaccaaaagaggggacaaagaagcuuaugaggauuaccgccgaauggcuguggggagaguuaggucgccguaaaaagccucggauaugcacuagagccgaguucuguaauaaagugaggagcaacgcggcucugggcgcaguuuuuaccgacgaaaauaaguggaaaagugcccgcgaggcugucgaagaugagcgauucugggaauugguggagaaggagcggaaccuccaccuggacgggaagugcgaaacaugcguguacaacaugaugggaaaaagagagaagaaacuaggcgaauuugguaaggccaaaggguccagggcaaucugguauauguggcuuggagcccgcuuccuggaguuugaagcucucggcuuccugaaugaggaucauugguucagcagagagaacucuuugucaggcgucgaaggggagggacugcacaagcucgguuacauucuucgggacaucaguaggaaagcgggcggggccauguacgcagaugacacggcuggaugggauacccguauuacuuccgaagaccugaagaaugaggaaaugaucacagaccaaauggagggccgacacaagaaauuagccgaggcaauauuucgccugaccuaucagaacaagguugugagaguacagcggcccacuccaagggguacagugauggauaucauuagccgcagagaccaacgggggucuggacaggucggcaccuacggcuugaauacauucacuaacauggaagcccagcucaucaggcagauggagggggaaggacuguuuaaaucgauucuacaucuuaccccccaagaggagacggcugugcacgccuggcugguucgagaaggucgugagagacucgcgcgcauggcaaucucaggcgaugacuguguggucaagccucuggaugaccgguucgccagggcuuugaccgccuuaaaugauauggggaaagugagaaaggacauucagcagugggaaccaagcaagggaugguccgauuggacacagguaccguuuugcagucaucacuuccaugagcugauaaugaaagacggccgcaagcucguugugcccugucggaaccaagaugaacuuaucgguagggcacgaauuucucagggggcuggauggagccugagagagacugccugccuaggcaaauccuaugcucagauguggucacugauguacuuucaccggagggaccuccgcuuggccgcaaaugcgaucuguagugccgucccuucucacugggugccaaccagccguacaacuugguccauccaugcuucacacgaguggaugaccacggaagauaugcuggccguguggaacagagucuggauucaggacaaucccuggauggaggacaagacaccuguugaaagcugggaggauauaccauaucuuggcaaacgagaagaccaauggugcgggucucugaucggacucaccuccagggcaacuugggcuaagaacauucagacagccaucaaucaggugcgggcauuaauuggugaggaggaauacauggauuauaugcccaguaugaagcgcuucagaagcgaggaagaggaaucgggcguacugugguga

SEQ ID NO: 15045 - RNA, 9876 nt, Artificial Sequence
  derived and/or modified CDS sequence (opt3) from DENV-2__AF119661__SS-prME
accgugggcgucaucauuaugcugauacccacagccauggcuuuccaccucacuacgagaaacggggagccucauaugaucguuggaaggcaggaaaaggguaaaagccuucuguuuaagaccgaggacggcgugaauaugugcacauugauggcaauugauuuaggggaacugugugaggacacuaucaccuacaaaugcccacuacuccggcaaaacgaaccggaggauauugacuguuggugcaauuccacaucuaccuggguaacuuauggaacauguaccacgacuggcgagcaccgccgagaaaagcguucaguggcccuggucccccauguggguauggggcuugagaccagaacagaaacuuggaugaguagcgagggagcguggaaacacgcucagaggaucgagaccuggauacugcggcauccuggcuucaucauuauggccgcaaucuuggccuacacaauuggcaccacgcacuuucagcgcgcucucaucuucauacugcugacugcaguugccccauccaugacaaugagaugcauuggggugucuaacagggauuuugucgaaggagugucggguggcucauggguagacaucguucucgagcacgggagcugugugaccacuauggcuaagaauaagcccacauuagauuucgaacugauuaaaaccgaggccaagcagccugucacgcuucggaaauauugcaucaaggcgaaauugaccaacacaacuaccgaaagucgcuguccaacacaaggagagcccucccugaaugaggaacaggacaagcgauuugugugcaagcauucuaugguggauagaggcugggguaacggguguggacuauucggcaaaggcgggaucgucacuugcgcaaccuuuacaugcaagaaaaauauggagggaaagauuguucagccugaaaaccucgaguacaccauagugaucacuccacacagcggugaagagcaugccguaggcaaugacacggggaaacacggaaaggagauuaaaaucacaccgcaguccucaauaaccgaagcugagcugacuggcuaugguaccgugacaauggaauguagucccaggaccgggcuugauuucaacgagaugguccuguugcaaauggaagacaaggccuggcucgugcaccggcagugguuucuggauuuaccucugccauggcuccccggcgcagacacucagggaagcaauuggauucagaaggagacacuuguuacguucaaaaacccucaugcuaagaaacaagacguggucgugcugggcucucaggagggggccaugcacaccgcguugacuggagccacagaaauccagauguccucagguaaucuacuguuuaccggccaucucaagugccgucugcgcauggauaaacuucaacugaaggggaugagcuacaguauguguacaggaaaguucaaaaucguaaaggagauugcagaaacucagcacggcaccaucguuauuagagugcaguaugagggugacgggucuccaugcaaaauacccuucgagaucauggauuuggaaaagaggcauguccucggccggcugauuacggugaacccgaucgucaccgagaaagacuccccugugaacaucgaagcugagcccccauuuggagauagcuacauuauaaucggcguugaaccugggcaguuaaagcugaauugggugaagaaaggaucgucuauuggucaaauguucgagacaacuaugcgaggcgccaagcgcauggcuauccuaggggacaccgccugggauuuuggaucccucggcgguguauucacaucaauugggaaagcacugcaccaggucuuuggcgccaucuacggagcugcguucaguggcgugagcuggacuaugaagauacuuaucgggguuauuaucaccuggauuggaaugaacuccagaucuacgagcuugucagugagucugguccucgugggcguaaucacacuguaucuuggugcaauggugcaggccgacuccggguguguugucagcuggaaaaauaaggagcugaagugcggaucuggcauauuuauuaccgauaacgugcacacuuggacagaacaguacaaauuccaacccgagucaccaaguaaguuggcuagcgccauccagaaagcacaugaagaggguauuuguggcaucagguccgugacccggcucgaaaaucugauguggaagcagauaacucccgaguuaaaccacauccugucugagaaugaagucaaacuaaccauuaugacaggggacaucaagggaauuaugcaggccggcaaacgcucgcucagaccucaaccaacggagcugaaguauagcuggaagaccugggggaaagcuaagaugcuuuccacugaaucacauaaccagacauuuuugaucgauggaccggagaccgccgaaugccccaauacaaacagggcauggaauagucuggagguugaggacuacggcuucgguguguuuacuaccaacauauggcucaaacugcgugaaaagcaggacguguucugugauucuaaauuaaugagcgcggcuauuaaggacaaucgggccguacacgcagauaugggguauuggaucgaguccgcccugaacgacacguggaagauggaaaaagcuucauuuaucgaggucaagagcugccacuggccuaaaucucauacacuuugguccaauggaguguuggagagugaaaugauuaucccaaagagcuucgccggccccguuucucagcacaacuaccgaccugguuauuacacccaaacugcaggcccauggcaucucgggaaacuggagauggauuucgacuuuugugaaggaaccacaguggucgugacugaggauugcggcaacagagggcccucccuaaggaccacaacggcuucaggaaagcugauuaccgaauggugcugucgcaguugcacucucccgccucugcgguacagaggcgaggacgguuguugguaugggauggagauaaggccacuuaaggaaaaagaggaaagcuugguugauucgcuggugacagccggacacggccagaucgacaauuucuccuuagguguacucggcauggcgcuguuucuugaggaaaugcugcgcacccgagucgggacuaagcaugccauuuugcucguggcugugucuuucgucacacugaucaccggaaacaugagccuacgggaucugggccguguuauggugaugguaggggcaacgaugacugacgauauuggaaugggcgugaccuaccucgcccugcuugcugccuuuaaagucagacccacauucgcagcggguuugcuguuaaggaagcucaccucaaaagagcugaugauggccacuaucgggauagcucuucugagucaguccacaaucccugagaccauucuagaacucacagacgcccuggcauugggaaugauggugcugaagaucguucgcaauauggagaaguaucaauuagcugugacuauuauggccaucucuugcguccccaacgcagugauacuccagaaugccuggaaaguuagcuguaccauucuggcugcgguguccgucucaccacuucuguugacgagcagucagcagaaggccgacuggaucccucucgcacugacaaucaaaggccuaaaccccaccgcuauuuuucugacuacccuugcccggacaucuaagaaaagauccuggccacucaaugaagccauaauggcuguaggcauggugagcauccuggcaucgucauugcugaagaacgauauuccgaugacugggccuuuaguugccggaggucuccugaccgugugcuacguccuuacgggcaggucugcggaccuggaguuggaacgagcuacagaugugaaaugggaggaccaagccgagaucaguggguccagccccauucucucuaucaccauaagcgaagauggauccaugucaaucaagaaugaggaagaggagcagacucugacaauucuaauccgcaccggccugcuuguaauuaguggucucuucccagugagcauccccauaacugcagccgcuugguaucugugggaagucaagaaacagcgggcagggguuuugugggacgugccuucuccacccccuguggagaaggccgaauuagaggauggagcguacagaauuaaacagaagggcauccugggcuauucccaaaucgggacaggagucuacaaagaagguaccuuucacacgauguggcacgugacuaggggcgcuguucucaugcaucgugggaagcgcauugagccgucaugggccgacguaaagaaagaucugaucaguuacggaggcgguuggaagcuugagggggaauggaaagagggagaagaggugcagguccuggcauuggaaccaggcaagaacccccgggccgugcagaccaaaccuggccuauucaagacaaauaccgggacaauaggagcuguuagccuggacuuuuccccagguacuucuggcucgcccauuguggauagaaaggggaaagucgugggacucuauggcaacgguguagucaccaggagcggggccuacgugucagcaaucgcucagacggagaaguccauugaggacaauccugaaaucgaggaugacauauuccgaaaaaagcggcugacaauuauggaccuucacccgggagccggcaaaacuaagcgcuauuuacccgcgaucguuagagaagccaucaagaggggccugcggacccucauuuuggcaccaacacgaguggucgcugccgagauggaagaggcucugagagggcucccuauccgcuaccaaacccccgcaauuagggccgagcauacuggacgugaaauaguggaucugaugugucacgccaccuuuacaaugcggcuucugaguccaguuagagugccuaacuauaauuugaucauuauggacgaggcucauuucacggaucccgcgaacaucgcagccagggguuacaucucuacucgcgucgaaaugggcgaggcugccgggauuuucaugaccgcaacaccaccgggaagccgagacccuuuuccccaguccaacgccccaauaauggaugaggaaagagagauccccgaacggucauggaauucuggccacgagugggugaccgacuucaaagguaagacuguaugguuugugccuagcauuaaagcugggaacgauaucgcggccugccuaaggaagaauggaaaaaagguuauucagcugagucgcaagacauucgacuccgaauaugucaaaacccguacgaacgauugggacuuuguggugacuacagauaucagcgagaugggcgcaaauuucaaggcugagagagucauagacccacggagguguaugaaacccguaauccucaccgacggcgaagagcgcgugauuuuagccgggccuaugccgguuacccacucuucagcagcccaacgaagaggacggaucgguaggaacccaaagaaugaaaacgaucaguacauuuacaugggcgagccccuggaaaaugacgaggauugcgcucauuggaaagaggccaagaugcuucuggacaacaucaauacuccugaagggauaauucccuccauguuugagccagaacgcgagaaaguggaugcgaucgacggagaauauagacucaggggcgaggcacggaagacauucgucgauuugaugcgucgcggugaccugccuguguggcucgccuaccgaguugcugccgaggggauuaacuaugcugauagaaggugguguuuugacggcgugaagaauaaccagauccuggaagagaaugucgaaguggagauauggaccaaagagggagaacggaagaaacuuaagccccgcuggcuagaugcaagaaucuacagugacccacuggccuugaaagaguucaaggaauuugcugccggcaggaagagcuuaacacugaaccucauuacugagauggggcggcugccuacguucaugacccagaaagcacgagaugcgcuugacaaccuggccguacuccacacagcugaagccggagguagagcauauaaucaugcuuugucggagcugccggagacucuagaaacccugcuccuucugacauuauuggccaccgugacuggcgggaucuuccuguuucucaugucuggaaagggcguugguaaaaugacgcuggggaugugcugcauuaucaccgcauccauacuucugugguacgcccaaauucagccccacuggaucgcugcgagcaucauucucgaguucuuuuugaugguccuguuaaucccagaaccugagaagcagcgcacaccccaggacaaccaacuaacuuauguggugauagccauucugaccgucguugcagcuacaauggccaaugaaaugggcuuccucgagaaaaccaagaaggaucuuggacugggcucaaucgccacucaggagccagaaaguaacauuuuggacaucgaucugaggccugcaucugcuuggacacucuacgccguggcgacgaccuuuguaacucccaugcugcggcacuccauagagaauagcucagugaacgucagucuuacagcuaucgccaaucaggcaaccgugcucauggggcugggaaaagguuggccguugagcaagauggacauuggcguuccacuguuagccaucggguguuacucccaggugaacccuauuacccuaacagcugcacugcuccuucuggucgcccauuaugcgaucauuggacccggcuugcaagcuaaagccacucgugaagcacagaagagagccgcugccgguaucaugaaaaauccaacgguagaugggauaaccgugauugaccuggaucccaucccuuacgacccgaaguucgagaagcagcucggccagguuaugcugcuuaucuuaugcgugacacaaguccugaugaugaggacuaccugggcacucugugaagcuuugacacuggccaccggacccauuucuacucuaugggagggcaacccagggcgcuuuuggaauacgacaauagcggugagcauggccaacaucuuccggggauccuaucuggcaggcgcuggucuccuuuuuuucauuaugaaaaauaccacuaacacccgaagagggacaggaaauaucggcgagacucugggugaaaaguggaaaucaagguugaacgcccugggcaagucugaguuucagauuuacaaaaagagugggauccaggaagucgaucgcacccucgcaaaagagggaauaaagcggggcgagacagaccaccaugcugugucgagagggagcgccaagcugcguugguucguugaaaggaauauggugacgccugagggaaaaguaguggauuuaggcugcggucgggggggaugguccuauuacuguggcggucuuaagaacguccgcgaaguuaaaggccugaccaaggggggacccggccacgaggaaccuaucccaaugucuacuuauggguggaaccucgugcgacuacaaucaggagucgacguguuuuucacacccccugagaaaugcgauacccuguugugugacauuggcgagagcuccccaaaucccacuaucgaagccgguagaacacugaggguacucagucuuguggagaacuggcugaauaacgacacccaguucugcauuaagguuuugaauccguacaugccuucugugaucgaaaagauggagacgcugcagcggaaauacgggggagcgcucguccgcaacccauuaagcagaaauucaacccaugaaauguauuggguguccaacgcuacaggcaauauagucaguagcgugaacaugauuucuaggaugcugaucaaucgauuuacuaugaagcacaaaaaggcaaccuacgagcccgauguugaccuuggcuccgggacacggaacaucggaauugagucagaaauaccuaaucuggauaucauugguaaacguaucgagaagauuaagcaggaacacgagacuagcuggcauuaugaccaagaucacccauacaaaaccugggccuaucauggcucguacgaaacaaagcagaccgggucugcuaguuccaugguaaacggaguggucagacuacucacuaaacccugggacgugguuccgauggugacgcagauggccaugacagauaccacuccuuucggccagcaacgcgucuuuaaggagaaaguggacaccaggacacaggagcccaaggaagguacgaagaaacugaugaagaucaccgcagagugguuguggaaagaacuggggaagaaaaagacuccacggauguguacaagagaggaguucacccgcaaaguaaggagcaaugccgcucucggagcgauauuuacugaugaaaacaaguggaagucagcccgagaggcaguggaagacaaccgguucugggagcuuguugauaaagaaagaaaucugcacuuagagggcaagugcgagacaugugucuauaacaugaugggcaaaagggaaaagaaacugggggaguuuggaaaggcuaaggguucccgcgccaucugguacaugugguugggcgcacguuuccucgaauuugaggcccugggguuccuaaaugaagaccacugguuuucucgggagaacagccuuaguggaguggagggcgaaggucugcauaaacucggguacauucugagagacguguccaagaaagagggaggcgcuauguaugccgaugacaccgcgggcugggauacaaggaucacuuuggaagaccugaagaaugaggaaauggucaccaaccacauggagggggagcauaaaaagcucgcagaagccauuuucaagcuuacguaccagaauaaagcuguucgcgugcagcgaccuaccccccggggaacaguaauggauaucauuagcagaagggaccaacgcgguucuggccagguggggacuuauggacugaacaccuuuacaaauauggaggcccaguuaauaagacaaauggaaggcgaggguaucuucaagucaauucagcaccugacugucaccgaggaaaucgcagugcagaacugguuggcucggguugggagggagcgucucagucgaauggccaucuccggagaugacugcguggucaaaccacuggaugaccgcuucgcuagcgcccuaacggcacuuaaugauaugggcaaggugagaaaagacauucagcaaugggaacccucucggggcuggaacgauuggacacagguaccuuuuugcucgcaucacuuccacgagcugauaaugaaggacgggaggguucucguggucccaugucgcaaucaggacgaacugaucggaagagcgcggauuucacagggugccggcuggagcuugaaggagaccgcuugcuuagggaaauccuacgcccaaauguggagucugauguauuuucauaggcgagaucuccgucuugcagcuaacgccaucuguucugcagugccgagccacugggugcccacuuccagaacaaccuggucaauucaugccaagcacgaguggaugacuaccgaagacaugcugacagucuggaaucgcguuuggauccaggagaacccuuggauggaagauaaaacgccaguggagaguugggaagagguacccuaccuaggaaagcgggaggaccaguggugcggcucucugauaggucucaccagcagggcgacuugggcuaaaaacauccagacagccauuaaucaagugagauccuugaucgggaacgaagaguauaccgauuacaugccuucaaugaagcgcuuccggagggaagaggaagaggcaggaguccugugguga

SEQ ID NO: 15046 - RNA, 9876 nt, Artificial Sequence
  derived and/or modified CDS sequence (opt3) from DENV-2__EU056810__SS-prME
acagccggaaucauuauaaugcugauccccacagugauggcuuuccaccucacuacgagaaauggggagccucauaugauuguaagcaggcaggaaaagggaaaaucccuucuguuuaagaccgaggacgguguuaauaugugcacauugauggcaauggauuuaggcgaacugugugaggacacuaucaccuacaauugcccacuacuccggcaaaaugaaccggaggauauugacuguuggugcaacucuacaucaaccugggugacuuaugggacauguaccgccacgggagagcaccgccgagaaaaacguaguguugcgcuggugccccaugucggcaugggucuugagacuagaaccgaaacauggaugagcuccgagggggcuuggaagcacgcccagaggaucgagacuuggauacugcggcauccuggauucaccaucauggcagccauuuuggcuuacacaaucggcaccacguauuuucagcgcgugcucauuuucauccugcugacugcaguugccccaucuaugacaaugagaugcauaggcauuucgaauagggauuuuguggaaggggucucaggagguagcuggguggacaucguacucgagcacggcaguuguguuaccacuauggcuaaaaacaagcccacauuagauuucgaacugauuaagaccgaggccaaacagccugcgacgcuucggaaguacugcaucgaagcaaaauugaccaauacaacuaccgccucccgcuguccaacacaaggggagcccucucugaacgaggaacaggacaagcgauuugugugcaaacacagcauggucgauagaggauggggcaaugguugugggcuauucggaaagggcggcaucgugacuugcgcuauguuuaccugcaagaaaaacauggaggggaaggugguccagccugaaaaucucgaguauacaauuguuauaaccccacauuccggagaagagaacgccguggguaaugacacuggcaaacacgggaaggagaucaaaauuacgccgcagucaaguaucacagaagcagagcugaccggauacggcacuguaaccauggaauguagccccaggacaggucuugauuucaacgagauggugcuguugcaaauggaaaauaaggcuuggcucguccaucggcagugguuucuggacuuaccucugccauggcuccccggggccgauacccagggcucuaacuggauacagaaagagacucuugugacauucaagaacccucacgcgaagaaacaagacguugugguccugggaucccaggagggcgccaugcacacggcauugaccggggcuacugaaauucagaugucaagcggaaaucuacuguuuacaggucaucucaagugccgucugcgcauggacaaacuucaacugaagggcaugaguuauucuauguguaccgggaaauucaaggugguaaaggagaucgccgaaacacagcacggaacuaucguugugagaguccaguacgagggcgaugguuccccaugcaaaauucccuucgagaucauggacuuggaaaagaggcaugugcucgggcggcugauuaccgucaacccgauagugacggagaaagauagcccuguuaauaucgaagcugagcccccauuuggcgacucguacauuaucaucggaguggaaccuggccaguuaaagcugaacugguucaaaaaggggucuuccauuggacaaauguuugagaccacaaugcgaggugccaagcgcauggcaauacuaggcgauacugccugggacuucgggucacucggaggcguauuuaccaguaucgguaaagcucugcaccaggucuucggggcgauuuauggcgcagccuuuagcggaguguccuggacaaugaagauccuuauuggcguugugaucacuuggauagggaugaacucuagaagcaccucauugagugucucccuggugcucguaggagugguuacgcuguaccuuggcgucauggugcaggcugauagcgguuguguggucucuuggaaaaacaaggagcugaaaugcgggucaggaaucuucguuacagacaaugugcauaccuggacugaacaguauaaguuucaacccgagaguccaagcaaguuggccuccgcaauucagaaagcccacgaagagggcaucugugguauuaggucugugacacggcucgaaaaccugauguggaagcagaucacccccgaguuaaaucacauacugucggagaacgaaguaaaacuaacuauuaugaccggcgauaucaaggggauuaugcaggcuggaaaacgcagccucagaccucaaccaacagagcugaaguacuccuggaaaacguggggcaaggccaagaugcuuucaaccgaauugcauaaucagacuuuccugaucgacgggccggagacagcagaaugccccaacaccaauagggcguggaacagucucgaggucgaggauuauggauuuggcguguucacaacuaauauauggcugaaauuaaaggaacgucaggacguauuuugugacucuaaacugaugagcgcugccaucaaggauaaccgggcagugcacgccgacauggguuacuggauugaguccgcucuuaacgauaccuggaaaaucgaaaaggccucauucauugaggucaagagcugccauuggccuaaaucucacacguugugguccaauggggugcucgagagugaaaugaucauaccaaagaacuucgcaggacccguuagccagcacaauuaucgaccuggcuaccauacacaaaccgcugguccauggcaccugggcaaacuagagguggacuuuaacuucugugaagggacuaccguagucgugacaggagauugcggcaauagagggcccucucugaggacuaccacagccuccggaaagcucauuacggaguggugcugucgcucaugcacccugccgccucuucgguacagaggcgaagacgguuguugguaugggauggagaucaggccauugaaagagaaggaagagaaccuggugaauaguuuagucacugcgggacauggccagaucgauaacuuuagccucgguguucugggcauggcccuuuuccuggaagagauguugcgcacacgaguggggaccaagcacgcuauucuccugguagcagugucguuugucacucuaaucacaggaaauauguccuuccgggaccugggccgugugaugguuauggugggggccaccaugacggaugacauuggaaugggcgucacuuaccucgcucugcuugccgcauuuaaagugagacccaccuucgcggccgguuugcuguuaaggaagcucacaucuaaagaacugaugaugaccacuauagggaucguucuucugagccagucaacaauuccugagaccgugcuagagcucacagaugcucuggccuugggaaugaugguccugaagaucguacgcaacauggaaaaauaucaauuagcagugacuauuauggcuauccucugcguucccaaugccgugauacugcagaacgcauggaaggucaguuguaccauccuugccgugguauccgugucuccacuguugcucacgagcucccagcagaaggcugacuggauuccucuggcgcuaacaaucaaaggccugaaucccaccgccauuuuucuuacuacccucucacggacaagcaagaaaagaaguuggccacugaacgaggcaaucauggcugucggcaugguuucuauauuggccuccagccuguuaaagaaugauauuccgaugacugggccucucguggccggaggucugcuuaccgugugcuacguccugacgggcaggucggcugacuuggaacucgagcgagcagccgacgugcgcugggaagaucaagcggagaucucagggucuagucccauccuguccauuacaauaagcgaggacggaucuaugagcaucaaaaacgaagaggaagaacagacccuaacuauucugauccggacaggccuucucguuauuuccggucuguucccaguaucaauccccauaaccgcugccgcaugguauuugugggaggugaagaaacagagagccggggucuuaugggaugugccuaguccacccccuguuggaaaggcugaacuggaggacggcgcauacaggaucaagcagaaaggcauucucggguauagccaaaucggagccgguguguacaaggaaggcacuuuucauacaauguggcacgucacccguggggcggugcugaugcacaaaggaaagcgcauugagccgucuugggcugaugucaagaaggaccuuaucuccuacggcgguggguggaagcuggaaggagaguggaaagagggcgaagagguccagguguuggcccuagaaccaggcaagaacccccgggcaguucagacgaaaccugggcuguucaagacuaauaccggaacaauaggugccgugucacucgauuuuaguccaggcaccagcgggucccccauugucgacaaaaagggaaaggugguuggccuguaugguaacgggguggucacaagaucuggaacuuacgugucggcuaucgcccagaccgagaaaagcaucgaagauaauccugagauugaggacgauaucuucaggaagaaacgacuuacgauaauggacuuacauccgggcgcaggcaagacaaaacgguaucugcccgcuauuguacgcgaagccaucaagagagggcucaggacuuugauucuggcgccaacccgggugguugccgcagagauggaagaggcucuccgaggacugccuaucagauaccaaacacccgccauacgcgcugaacacaccgguagggagauugucgaucuuaugugucaugcaacuuucaccaugcgucuguugucaccagugcgggugccuaacuauaaucuaaucaucauggacgaggcccacuuuacagaccccgccuccauugcugcgagaggcuacaucaguacgagggucgaaaugggggaggcagccggaauuuucaugacugcuaccccaccgggcucucgcgauccuuuuccccagagcaacgccccaauaauggacgaggaacgagagauccccgaaagauccuggaacucaggucaugaguggguaacagauuucaaggggaaaaccgugugguuuguuccuucuauuaaggcaggaaacgacaucgccgcuugccugcggaaaaauggcaagaaagugauccagcucagcaggaagacuuucgauagugaauauauuaagacacgcaccaacgacugggauuuugucgugacgacugacauauccgagaugggcgcgaauuucaaagccgaacguguuaucgauccaagacgguguaugaagcccgugauuuuaacagacggggaggagagggucauccuggcaggaccuaugccggugacccacagcucugcugcccaacgccgagguagaauuggccggaaccccaaaaaugaaaacgaucaguacaucuacaugggggagccccuugaaaaugacgaggacugcgcacacuggaaggaagccaaaaugcugcucgauaacauaaacaccccugagggaaucauucccucaauguuugagccagaaagggagaagguagacgcuaucgauggcgaauaucgcuugagaggugaggccaggaaaacuuucguggaccugaugcggcguggggaucucccuguuuggcuggcguaccgcgucgcagccgaaggcauuaauuaugcugaccgaagaugguguuuugauggaaucaagaacaaucagauacuugaggagaacguggaaguggagauuuggacaaaggaaggcgagaggaaaaagcuaaaaccccgguggcuggacgcccgcaucuacuccgauccauuggcuuuaaaggaguucaaagaguucgcagccgggagaaagagucugacccucaaucugauuacagagaugggaaggcuuccuacuuuuaugacgcagaaggcucggaacgcccuggacaaucucgcagucuugcauaccgcggaagccgguggccgagcuuauaaccacgcccugagcgagcuaccggaaacacuggagacucuccuucuguuaaccuugcuggcaacaguuaccgggggaaucuuccucuuucugaugucgggcaaagguauagggaagaugacucuuggcaugugcugcaucauuacggcuucuauccugcucugguacgcccaaauucagccccauuggaucgcagccuccauaauuuuggaguucuuucugaucguguuacuaaucccagaaccugagaaacagagaacaccacaggauaaucaacugacauauguagugauugcuauccucacugucguggcggccaccauggcaaacgaaaugggauuccuugagaagaccaaaaaggacuuuggccuggggagcauagcuacccagcagccagaaucaaauauuuuggauaucgaccugcgcccugccagugccuggacucucuacgcaguugcuacaacguucauuacccccaugcugaggcacucuaucgagaacuccagcgugaaugucucacuuacugccauagcgaaccaggcuacaguacucaugggacuggguaagggcuggccguugaguaaaauggacaucggggugccacuguuagccauuggauguuacagccaaguuaauccuaucacccuaaccgcagcccugcuccuucugguggcucacuaugcaauuaucggccccgguuugcaggccaaggcgacacgggaggcucagaaacgugccgcagccgggauuaugaagaacccaacugucgauggcaucacggugauagaccuggaucccauuccuuacgacccgaaauuugaaaagcagcucggacaagucaugcugcuuguguuaugcguuacccaggugcugaugaugagaacaacuugggcucucugugaggccuugacccuggcaacaggccccaucuccacccuaugggaagggaauccaggaagguucuggaacacuacgaucgcuguaucuauggccaacauuuuucgcggcagcuaucuggcgggugccgggcuccuuuucuccauaaugaagaauacagcaaacacccggcgaggaacuggcaauaccggugagacacugggcgaaaaauggaagaacagauugaaugcucuggggaaaucagaguuucagaucuacaagaaaucuggcauucaagagguggauaggacucucgccaaggaaggcaucaaacgcggggagaccgaccaucacgcagucagucggggaucggcuaagcugagaugguucguugaacguaacuuagugacaccugagggcaaggucguggaucuugguugcgggaggggaggcuggagcuauuacugugguggccugaaaaauguacgggaggugaaggggcucacgaaaggaggccccgggcaugaggaaccuauuccaauguccaccuauggauggaaccuaguucgccugcagucuggcguggacgucuucuuuacucccccugaaaagugcgauacauugcugugugacaucggugagucaagcccaaaucccaccauagaagccgggcgaacucucagagugcuuaaccuggucgagaauugguugaacaauaacacacaguucugcaucaaagugcugaauccguacaugccuuccguuauugagaagauggaagcccuccagaggaaguacggaggcgcguuaguacggaacccacugagucgcaacucuacccacgagauguauugggugagcaaugcuucaggcaacaucgucuccagugugaauaugauuagcagaaugcuuaucaacagguuuacgaugcgacauaaaaaggcaaccuacgaacccgauguugaccuggggucuggaacacggaauauagguauugaguccgaaacuccuaaccuagauaucaucggcaaacguauugagaagauaaaacaagagcacgaaaccucauggcacuaugaccaggaccauccauacaagacaugggccuaucacgggagcuacgagacuaagcagaccggaucggcuucuaguauggugaauggcgucgugagacuccugacaaaacccugggauguaaucccgaccgugacucagauggccaugacggacacaaccccuuucggucaacagcgcguuuuuaaggaaaaagucgauacuaggacccaggagcccaaggaagggaccaaaaaguugaugaagauuacggcagaguggcuguggaaagagcucggaaagaaaaagaccccacggauguguacuagagaagaguucacacgcaaagugagguccaacgccgcucuuggcgcgaucuuuaccgacgaaaauaaguggaaaagcgcccgagaggcaguggaggauucacgguucugggaacuggucgacaaggagagaaacuuacaucuggaaggcaagugcgagacuuguguuuauaauaugauggggaaaagggaaaagaaauugggagaguuugguaaggcuaaaggcucccgcgccauuugguacauguggcucggggcacguuuccuggaguuugaagcccuaggauuccuuaacgaggaucacugguuuucucgggaaaauagccugaguggcguggagggugaagggcuccacaagcugggauacaucuugagagacguauccaagaaagagggcggcgcuauguaugccgaugacacagcggggugggauaccaggauaacacuggaggaccucaagaacgaagagauggugacuaaucauauggaaggagagcacaagaaacuugcagaagccaucuucaaacugaccuaccagaacaaagucgugcgcguucaacgaccuacgccccgggguaccgugauggacauuaucagcagaagggaucagcgcggcucugggcaggucggaacauauggcuuaaacacuuucaccaauauggaggcucaacugauuagacagauggagggugaagggguguuuaagucaauccagcauuugacaguaacugaggaaauuaccguuaaaaacuggcucgcccgggugggaagggagcgucugagucgaauggcaauauccggcgacgauugcgucgugaagccacuagacgaucgcuucgcuagcgcccuuacggcucugaaugacaugggcaaagugagaaaggauauccagcaaugggagcccucucggggguggaacgacuggacacaggucccuuuuugcucgcaccauuuccacgaacucauuaugaaagauggaaggguucuggugguaccaugucgcaaucaggacgaguugaucgguagagcccggaucucacagggcgcaggguggagcuuaagggaaaccgcgugccugggaaaguccuacgcccaaauguggagucucauguauuuucaccgacgugaucuuagacuggcugccaacgcaauuuguucugcugugccgagccauuggguccccacuucccgcacaaccuggucaauacacgcccggcaugaguggaugacuaccgaagacaugcuaacaguguggaauaggguuuggauccaggagaacccuuggauggaggauaagacgccaguggaaaguugggaggaaauucccuaccugggcaaaagagaggaccaguggugcgguucucucaucggguugaccagccgcgcaacuugggccaagaauauucagacagcgaucaaccaaguccggucccugauaggaaaugaagaguauaccgacuacaugccuucaaugaaaagguuccgaagagaggaagaggaagcuggcgugcuuugguga

SEQ ID NO: 15047 - RNA, 9876 nt, Artificial Sequence
  derived and/or modified CDS sequence (opt3) from DENV-2__EU056811__SS-prME
accgccggcaugaucauuaugcugauacccacagugauggcuuuccaccucacuacgagaaacggggagccucauaugaucgucagcaggcaggaaaagggaaaaucccuucuguuuaagaccaaagacgguacaaauaugugcacuuugauggcaauggauuuaggcgagcugugugaagacaccauuacauacaagugcccauuccuaaaacaaaacgagccggaagauaucgacuguuggugcaauucuaccucaacuuggguuacauaugggaccuguacgacuaccggagagcaccggcgcgagaagcgaaguguggcccucguaccccaugugggcaugggucuggaaacacguacugagaccuggaugagcuccgaaggggcguggaagcacgcucagagaauugagacauggauccuuaggcauccuggauuuaccauaauggccgcaauccuggccuacacgauuggcacuacacacuuccagcgggucuugaucuuuauucuccugaccgcuaucgcaccaucuaugacuaugcgcugcauaggcauuucgaacagagauuucguggaggggguuucaggagguagcuggguggacaucguccuggaacacggcaguugugugacaaccauggccaaaaauaagcccacgcucgauuuugaguuaauuaaaaccgaagcuaagcagccugccacacugaggaaauauugcaucgaggcgaagcuuacuaacaccacaacugacucccgguguccaacccaaggggaacccacauugaaugaggagcaggauaagcgcuucguaugcaaacauucuaugguugaccgaggauggggcaacgguugugggcuguuuggaaagggcggcaucgugaccugcgcaauguucacuugcaaaaagaauauggaagggaaaauuguccagccugagaaccuagaauacacgguggugauaacaccacacagcggagaggaacaugccgucgguaaugauaccggcaagcacgggaaagagguuaagaucacuccgcaguccucaauuaccgaggcugaacucacaggauauggcaccgugacuauggaguguagucccagaacaggucuggacuuuaacgaaaugguacuucugcaaauggaggauaaggccugguuggugcacaggcagugguuccucgaccugccuuuaccauggcugcccggggcagacacgcagggcagcaauuggauccagaaagaaacccucgucacuuuuaagaacccucaugcuaaaaagcaagaugugguugugcuuggaucucaggagggcgccaugcacacagcgcugaccggggccacagagauacagauguccucaggaaauuugcuauucacuggucaucugaaaugccggcuccguauggacaagcugcaacuuaagggcaugagcuacaguauguguaccgggaaauucaagauugucaaagaaaucgcagagacgcagcacggaaccaucgugauucgcguacaguaugaaggcgaugguucuccaugcaagauccccuuugagauuauggaccuggagaaaagacauguuuuggggaggcucauaacagugaacccgaucgucacugaaaaggauuccccugugaacauugaggcugaacccccauucggcgacagcuacaucaucauuggagucgagccuggccagcugaaguuagauugguuuaaaaaggggucgucuauaggacaaauguucgaaaccacaaugcggggugccaaacgaauggcuauccugggcgacacugccugggauuuugggucccuaggaggcguguucaccucaauugguaaggcacuccaccagguuuuuggggccaucuacggcgcugcguucaguggagugagcuggacgaugaaaauucugaucggcguaauaaucacauggauugggaugaauucccgcucuaccagccuuucagucaguuuggugcugguuggaaucgugacucucuaucugggcgucauggugcaggcagacuccgguuguguagugagcuggaagaacaaggagcuuaaaugcgggucuggaauuuuuguuacagauaauguccacaccuggacugagcaguacaaguuccaacccgaaucaccaaguaaacuggccagcgcuauccagaaggcccaugaggaaggcauaugugguauuagauccgugaccagguuggagaaccucauguggaaacagaucacaucugaacugaaucacauuuuaucggagaacgaggugaagcugacgaucaugaccggcgacauaaaagggaucaugcaggucggaaagcggagccuacgcccccaaccuacugaacucagauauuccuggaagacauggggcaaagcaaagaugcugucaaccgagcuucauaaucagacauuuuugauugacgggccagaaacugccgagugcccgaacaccaauagggcuuggaacagucuggaaguugaggauuacggauucggcguguuuacgacaaauaucuggcuccgucugcgggagaaacaggacgccuucugugauucuaaguuaaugagcgcagcgauuaaagacaaccgagcugugcacgccgauauggguuauuggaucgaauccgcacugaaugacaccuggaagauagagaaggccucauucauugaaguaaaaagcugccacuggcccaagucucauacucuuugguccaacggggucuuggagagugagauggugaucccuaaaaauaucgcuggaccaguuagccagcacaacaacagacccggcuaccauacccaaacagccgguccuuggcaccucggcaagcuggaaauggauuuugacuucugugaggggacuaccguggucgugacagaagagugcggaaauaggggcccaucucuacgcacgaccacugcauccgggaaacugauuacagaauggugcugucggucaugcacccuccccccgcugagauauaggggagaggauggcuguugguacgguauggagauccgcccucuuaaggaaaaggaggaaaacuugguuaguagccuggugacugcugggcauggacagauugacaauuuuucguuaggcauacucgguauggcccuguuccuugaggaaaugcugcgaacacggguaggcaccaaacacgcgaucuugcucgucgccguguccuuucugacgcuaauuacugggaacaugucuuuccgugaucugggaagagugauggucaugguuggcgcuaccaugacagacgauaucgggaugggagugaccuaccucgcacugcuugccgcuuuuaagguaaggccaacuuucgccgcaggcuugcuguuacgcaaacucacaagcaaggagcugaugaugaccacaauugguaucgugcuucugucacagaguuccauacccgagacuauccuagaacucaccgacgcgcuggccuuggggaugaugguccugaaaauggugcggaauauggagaaguaucaauuagcuguuacgauuauggccauccucugcgugccuaacgcagucauucugcagaaugcuuggaaggugucuuguacaacccuugccguugugagcgucuccccccuguugcucacuucaagccagcagaaagcagacuggaucccacuggcccuaaccauaaagggacugaacccuacagcuauuuuucuuacuacccucacgagaacaaguaaaaagaggucuuggccccugaaugaagcgaucauggccguaggcaugguguccaucuuggcaagcucgcuguuaaaaaacgauauuccaaugaccggcccgcucguugcugggggacugcuuacugugugcuacguccugacaggucgaucagccgacuuggagcucgaacgcgccaccgaugugaagugggacgaucaagcugagauaucuggcaguuccccuauccugagcauuacuaucucugaggacgggagcauguccauuaaaaaugaagaggaagagcagacacuaaccauccugauacggacgggacuucucguaaucucaggccuguuccccgugaguauuccaaucacugcagccgcgugguauuugugggaggucaagaagcagagagcugguguuuuaugggaugugcccagcccuccacccguggggagggccgaacuggaggacggagcauaccguauuaaacagaagggcauccucggcuauucucaaauaggggccggagucuacaaagaagguaccuuucacacaauguggcaugugacccgcggcgcuguucugaugcacaaggggaaacggauugagccuuccugggcagauguaaagaaggaccuuaucucauauggaggcgguuggaaacuggaaggggaguggaaggagggagaagaggugcaggucuuggcccuagaaccgggcaaaaacccaagagcggugcagacaaagcccggccuguucaggacuaauaccgggacgaucggagcuguuagucucgauuuuagcccugguacauccggcucuccaauuguggacaaaaaggggaaggucgugggacuguacggcaacgguguagucacucgagggggagccuacgugucggcaaucgcccagaccgagaaaggcauagaagauaaucccgagauugaggacgacaucuuccggaagcgcagacuuacaauuauggauuuacauccuggcgcugggaaaaccaagagguaucugccggccaucguucgggaagcaauaaaacgaggacucagaacuuugauucuggcucccacccgcguggucgccgcggagauggaagaggcccucaggggucugccaauccguuaccaaacaccugcaauccgggcugaacacacgggcagagagauuguggaccuuaugugucaugccacuuucaccaugaggcuguugagccccauccgcguuccaaacuauaaccuaauuauaauggaugaggcucacuuuacagacccugcaucaaucgccgcccgaggguacauuuccaccagaguggaaaugggagaggcugcgggcaucuucaugacugcaacacccccagguagucgggauccguuuccucagucuaaugcccccaucauggacgaagagagggagauuccagaacgcagcuggaacuccgggcacgagugggucaccgauuucaagggaaagacggugugguuuguacccucaauaaaaacuggcaaugacaucgcugccugccugcguaagaacggcaaaagagugauucagcucucucggaagacauucgauagcgaauauguuaaaaccaggaccaaugacugggauuuugucgugacuacagacaucagugagaugggggcaaacuucaaggccgaacgcgugauugacccucgaagauguaugaagccagucaucuuaaccgauggagaggagcggguaauacuggcuggucccaugccugugacacauuccagcgcggcccaaaggcgcggcagaaucgggaggaauccgcggaacgaaaaugaccaguacauuuauaugggagagccacuugaaaacgaugaggacugcgcacacuggaaagaagcuaagaugcugcucgauaauaucaacacucccgagggcauuaucccuucuauguuugagcccgaacgugagaaaguugacgccauagauggugaauaccgcuugcgaggggaggcaagaaagacguucguggaccugaugaggcggggcgaucucccagucuggcuggccuacaaaguggcugccgaaggaauuaauuaugcggaccgcagaugguguuuugauggcaccaggaacaaucagauccuugaggagaacguugaaguggagauuuggacaaaggaaggggagcggaaaaagcuaaagccucgauggcuggacgcaagaaucuacucagaucccuuggccuuaaaagaguucaaggaauucgcugccggacgcaaaucccugacucucaaccugauaaccgagauggguaggcuuccaacauuuaugacccagaaggcucgggacgcacuggacaaucucgccgucuugcauacugcugaagccggcgggaaagcauauaaccacgcgcugagugagcuaccugaaacgcuggagacccuccuucuguuaacauugcuggccacugugaccggaggcaucuuccucuuucugaugagcggucgugggauuggcaagaugacacuuggaaugugcugcaucauuaccgcuucgauccugcucugguacgcccaaauacagccgcacuggauugcagcuucuaucaucuuggaguucuuucugauuguauuacuaauccccgaaccagagaagcagagaacuccucaggauaaucaacugacauaugugauaauugccauccucacgguugucgcagccaccauggcuaacgaaaugggcuuccuugagaaaacuaagaaagaccugggguugggacauauugcgacacagcagcccgaauccaauauccuggauauagaccucaggccagccagcgcauggacccuguacgcuguggccaccacauuuaucacuccuaugcuucgccacucaauugagaacaguucugugaaugucucccucacggccaucgcaaaccaggcuaccguucugauggguuugggcaagggguggccccugagcaaaauggauauuggagugccguuacuagccaucggcuguuauucacaaguaaauccaauuacacugacugcggcucuccuuaugcugguggcccauuacgcaaucauagguccuggguugcaggccaaggcuacccgggaggcacagaagcgagccgcggcuggcauuaugaaaaaccccacagucgacggaaucaccgugaucgaucuggacccaauucccuacgauccuaaguucgaaaaacagcucggccaaguuaugcugcuuguguuaugcgucacucagguacugaugaugagaacgacaugggcccucugugaggcauugacccuggccacugggccggugaguacccuaugggaaggaaaucccggcagguuuuggaacacaacuauagcuguuagcauggccaauaucuuccgcgguuccuaucuggcaggggcuggacuccuuuuuucuauuaugaagaacaccacaagcacgcggagaggcaccgguaauaugggcgagacucugggggaaaaauggaagaaccguuugaaugcccugggaaaguccgaguuccagaucuacaaaaagucaggcauucaagagguggacaggacacucgcgaaagaagggaucaagcggggagagaccgaucaccaugccgucucucgcggcagugcaaaacugcgaugguuuguggaaagaaacuuagucacuccagaggguaaggugguugaccuugggugcggaaggggcgguuggucguauuacuguggcgggcugaaaaacgugcgggagguaaagggacucacaaagggcgggccuggacacgaagagcccauaccuaugagcaccuauggcuggaaucuagugcgccugcaguccggugucgauguuuucuucgugccacccgaaaaaugcgacacguugcugugugacaucggggagucuucaccuaacccaaccgucgaagcuggaagaacacucagggugcuuaaucugguagagaacugguugaauaacaauacucaguuuugcgugaagguucugaaccccuacaugccgagcgugauugagcgaauggaaacccuccagcggaaauauggcggcgccuuaguccguaauccucuguccagaaacaguacacacgagauguacugggugucuaaugcaagcgggaacaucgucucauccgugaauaugauuagucgcaugcuuaucaacagguucacuaugcggcauaagaaagcuaccuacgaaccagauguugaccugggaagcgguacaagaaauauaggcauugagucugaaacccccaaccuagauaucaucgggaagcgcauugagaagauaaaacaagagcacgaaacuuccuggcauuaugaccaggaucacccuuacaagacgugggccuaucacggaucauacgagacaaaacagaccggcagcgccucgucuaugguaaacgguguggucaggcuccugacuaagccaugggacgugauccccaugguuacccagauggcgaugacagauacgaccccguuugggcaacagcgaguguucaaagaaaaggucgacacucggacacaggagccuaaggaaggaaccaaaaaguugaugaaaauuacugcugaguggcuguggaaggagcucggcaaaaagaagacacccagaauguguaccagggaagaguuuacaaaaaaggugcgcaguaaugcagcccuuggcgcuaucuucacugaugaaaacaaauggaaguccgcccgugaggcaguagaggacaaucgguuuugggaacugguggauaaagagagaaacuuacaucuggaagggaagugcgagaccuguguuuauaauaugaugggaaaaagggaaaagaaguugggugaguucggcaaagccaaggggagccgcgcuauuugguacauguggcucggagcgcgauuucuggaguucgaagcccuaggcuuucuuaacgaggaccacugguucucacgggaaaauucccugucuggugucgagggggaaggacuccauaaacugggcuauaucuugagagaggugagcaagaaagagggcggggcaauguacgcugacgauacggccggaugggacaccaggauaacaaucgaagaucugaagaacgaggaaaugauuacuaaucacauggcaggugagcauaagaaacucgccgaagcuaucuuuaagcuuaccuaccagaacaaagugguccgcguucaaagaccaacaccucggggcacugugauggacauuaucaguaggcgugaucagcgaggguccggacagguagugaccuauggccugaauacguucacaaacauggaggcccaauuaauucgccagauggagggugaaggggucuucaagagcauacagcaccugaccgcgucugaggaaaucgcagugcaggacugguugguuagagugggacgggagaggcucucacgcauggccauuaguggcgaugacugcgucgugaaaccccuggaugacagauuugcuaaggcccuaacugcacuuaaugauaugggcaagguacggaaagacauccaacagugggagccauccaggggguggaacgauuggacacagguucccuucugcagccaccauuuucacgaacugaucaugaaggacggacgaacccucguggucccuugucguaaucaggacgagcugauugguagagcucgcauaucucaaggcgccggguggucguugcgggaaacugcuugcuuaggaaaaucauacgcccagauguggagccugauguauuuccauaggagagaucuccgccuugcagcgaacgccaucuguuccgcugugccaagucacugggugccgaccucucggacaacguggagcauucacgccucccaugaguggaugaccacugaagacaugcugacagucuggaacaggguuuggauccuagagaaucccuggauggaggauaagaccccuguggaaucaugggaggaaauuccauaccugggcaaacgagaggaccaguggugcgguagucucaucggguugacuucuagagcaacaugggcuaagaacauacagaccgccaucaaucaaguacggagccugauuggaaacgaagaguauacggauuacaugcccuccaugaagagguuucgccgugaggaagaggaagcaggcgugcuuugguga

SEQ ID NO: 15048 - RNA, 9876 nt, Artificial Sequence
  derived and/or modified CDS sequence (opt3) from DENV-2__DQ645545__SS-prME
accgcaggcgugaucauuaugaugauacccaccguaguugcuuuccaccugacuacgcggaauggggagccucauaugaucgugagcaggcaggaaaagggaaagucccuccuuuuuaagaccgagaaugguguaaauaugugcacacugauggcaauggacuugggcgaauuaugugaggauacuauuaccuacaauugcccacugcugcggcaaaacgaaccggaggacaucgauuguuggugcaauucuacaucaaccugggugacuuaugggacauguaccgccacgggagagcaccgccgagaaaaacguagugucgcgcucgugccccauguuggcaugggucuggagacuagaaccgaaacauggaugagcucccagggggcuuggaagcacgcccagaggauugagacuugggugcuucggcauccuggauucaccaucauggcagccauacuggcuuacacaaucggcaccacguauuuucagcgcgucuugauuuucauccuccugacugcaguggccccaucuaugacaaugagaugcauuggcaucucgaacagggacuuuguagaggggguuucaggagguagcuggguggauauaguccuggaacacggcaguugugugaccacuauggcuaaaaauaagcccacacucgacuucgaguuaauuaagaccgaagccaaacacccugcgacgcugcggaaguacugcaucgaggcaaaacuuaccaacacaacuaccgccucccgcuguccaacacaaggggaacccucuuugaaugaggagcaggauaagcgauuugugugcaaacauagcauggucgacagaggauggggcaacgguugugggcuguucggaaagggcggcauuguuacuugcgcuauguuuaccugcaagaaaaauauggaagggaaggugguacagccugagaaccuagaauauacaaucgugaucaccccacacuccggagaggaaaaugccgucgguaacgauacuggcaaacaugggaaggagauuaaagugacgccgcagucaaguauaacagaggcagaacucaccggauacggcacuguuaccauggaguguagccccaggacaggucuggacuucaaugaaauggugcuucugcaaauggaggauaaggcuugguugguccaccggcagugguuucucgaccugccuuuaccauggcugcccggggccgauacccagggcucuaacuggauccagaaagaaacucucgugacauucaagaacccucacgcgaagaaacaagacguaguugugcuuggaucccaggagggcgccaugcauacggcacugaccggggcuacugagauucagaugucaagcggaaauuugcuauuuacaggucaccugaagugccgucuccgcauggacaaacugcaacuuaagggcaugaguuauucuauguguaccgggaaauucaaggucgugaaggaaaucgccgagacacagcauggaacuauagucauuagagugcaguacgaaggcgaugguuccccaugcaaaauccccuucgagaucauggaccuggagaagaggcacguuuuggggcggcucauuaccgugaacccgaucguaacgggcaaagauagcccugucaauauugaagcugagcccccauuuggagacucguacauaaucauuggcguggaaccugggcagcugaaguuaucuugguucaaaaagggauccucaaucggucaaauguuugagaccacaaugcgaggcgccaagcgcauggcaauccugggggauacugccugggacuucggaagucuaggcgguguuuuuaccagcauugggaaagcucuccaucagguguucggcgcgauauauggagcagccuuuuccggcgucucuuggacaaugaagauccugauuggggugguaaucacuuggauuggaaugaacagcagaucaaccagucuuuccgugagcuugguucuggucggcguggugacgcucuaccugggugucaugguucaggcugauucuggguguguggugucauggaaaaauaaggaacuuaaaugcggaaguggcaucuucauaacagacaacguacacaccuggacugagcaguauaaguuucaacccgagagcccauccaagcuggccucugcaauccagaaagcccacgaagaggguauuuguggcaucaggucggucacacgguuggaaaaucucauguggaagcagauuacccccgagcugaaccauaucuuaagcgaaaaugaggugaaacugacuauaaugaccggggauauuaagggaaucaugcaggcuggcaaacgcucccuaagaccucaaccaacagagcucaaguacucauggaaagccugggggaaggcaaagaugcugaguacggaacuucacaaccauaccuucuugauugacggaccggagacugcggaaugccccaauacaaacagggcuuggaacucucuggagguugaagauuauggcuuugguguguucaccacaaacaucuggcucaaacugaaggagcgucaggacgucuuuugugacagcaaauuaauguccgccgcaauaaaggauaaucgggccgugcacgcugacaugggguacuggaucgagucagcccugaacgauacuuggaaaauugaaaaggccagcuucaucgagguuaagucuugccacuggccuaaaucccauacccuuuggaguaacggaguguuggaaagcgagaugauuaucccaaagaauuucgcuggccccguaucucagcacaacuaucgaccugguuaccauacgcagacagccggcccauggcaccucgggaaacuggagauggacuuugauuucugugaaggaaccacugucguggugaccgaggacugcggcaauagagggcccucccuaaggacaacuaccgcgucaggaaagcugauaacagaauggugcugucgcaguugcacgcucccgccucugcgguacagaggcgaggaugguuguugguaugggauggaaauuaggccacuuaaagagaaggaggaaaacuuggucaauagccugguuaccgccggacauggccaaaucgacaacuuuucguuaggugugcucggcauggcucuguuccuugaggaaaugcugcgcacucgaguagggacaaagcacgcaaucuugcucguggccgucuccuuugugacccugauuacuggaaauaugucuuuccgggaucuaggccguguuauggugauggucggggcuacaaugaccgacgauaucggaaugggcgugacguaccuggcccuccuggcagcguuuaaaguuagacccacuuucgccgcuggucuuuugcugaggaaguuaaccagcaaagagcucaugaugacaaccauugggauagugcugcuuucacagaguacuaucccugaaacaauucuggagcuaaccgacgcccucgcacugggaaugauggucuugaagaucguacgcaacauggagaaauaucagcuggcugugacaauuauggccaucuuaugcguucccaaugcagugauacuccaaaacgccuggaaggucuccuguacuauccuggcugugguaucugugagcccacuucuguugaccuccucacagcagaaggcggauuggauuccucucgcccugacgaucaaaggccuaaaucccacagcaauuuuucugaccacucuuagccggaccaguaagaaaagaucuuggccacucaacgaagcuaucauggccgucggcaugguuuccauacuggccagcucguugcugaagaaugacauuccgaugacagggccuuuaguggcuggaggucuccugacugugugcuacguccuuaccggcaggucagcagaccuggaguuggaacgagccgcggaugugcgcugggaggaacaggcugagaucucugggaguucccccauccucagcauuacgauaucugaggacggaagcauguccaucaaaaacgaagaggaggaacaaacacugaccauucuaauccggacuggccugcuuguuauuucaggucucuucccaguaaguauccccauaacagccgcagccugguaucugugggaggugaagaaacagagagcuggggucuugugggaugugccuagcccacccccuguuggaaaggcagaauuagaggacggcgccuacaggaucaagcagaaaggcauucugggguauucucagaucggagcggguguguacaaggaaggcaccuuucacacuauguggcaugucacacguggggcugugcucaugcacaaaggaaagcgcauugagccguccugggccgaugucaagaaggaccugaucucauacggcgguggguggaaacuugaaggagaguggaaagagggcgaagagguccaagugcuggcauuggaaccaggcaagaauccccgggccguucagaccaaaccugggcuauucaagacgaacacuggaaccauaggugcugugagucuggauuuuagcccaggcacauccgggucucccauugucgacaaaaagggaaaggugguuggccucuaugguaacgggguggucaccagaucgggaacauacgugagcgccaucgcacagacugagaaaucaaucgaagauaauccugagauugaggacgauaucuucaggaagaaacgacugaccauaauggaccuucauccgggcgcuggcaagacgaaacgguauuuacccgccauuguacgcgaagcgaucaagagagggcugaggacacucauuuuggccccaacucgggugguugcagcugagauggaagaggcccugcgaggacucccuaucagauaccagacccccgcuauacgcgcagaacacacagguagggagauugucgaucugaugugucaugccaccuucacuaugcgucuucuguccccaauccgggugccuaacuauaauuugaucauuauggacgaggcccacuuuaccgaccccgcuaguaucgcggcaagaggcuacauuucuacaaggguggaaaugggggaggccgcuggaauauucaugacggccacuccaccgggcagccgcgauccuuuuccccaauccaacgcaccaaucauggacgaagaacgagagauucccgaaagaucauggaacucuggucacgagugggucaccgauuucaaggggaaaacaguaugguuugugccuagcaucaaggccggaaacgacaucgcugcgugccuacggaaaaauggcaagaaaguuauucagcugaguaggaagaccuucgauuccgaauaugugaagacucgcacaaacgacugggauuuugucgugaccacggacauaagcgagaugggcgccaauuucaaagcagaacguguuaucgauccaagacgguguaugaagcccgugauucucacugacggggaggagagggucaucuuagcuggaccuaugccggugacacauucuucagccgcacagcgccgagguagaguaggccggaaccccaagaaugaaaacgaucaauacauuuacaugggggagccccuggaaaaugacgaggacugcgcccacuggaaggaagcuaaaaugcuucuggauaacaucaauaccccugagggaauaauccccuccauguuugagccagaaagggagaagguggacgccauugauggcgaauaucgccucagaggugaggcgaggaaaaccuucguugacuugaugcggcguggggaucugccugucuggcucgcauaccgcguggccgcugaaggcaucaacuaugccgaccgaagaugguguuuugauggagugaagaacaaucagauucuggaggagaacgucgaaguugagaucuggacuaaggaaggcgagaggaagaaacuuaaaccccgguggcuagacgcucgcauauacagugauccacuggcauugaaagaguucaaagaguucgccgcugggagaaagagcuuaacacugaaucucauuaccgagaugggaaggcugccuacauuuaugacucagaaggcccggaacgcacuugacaaucuggcggugcuccauacggccgaagcugguggccgagccuauaaccacgcauugucggagcugccggaaacccuagagacacugcuccuucugacuuuauuggcuaccguaacagggggaaucuuccuguuucucaugucuggcaaagguauugggaagaugacccugggcaugugcugcaucauaacugccuccgugcuucugugguacgcacagauccaaccccacuggauugccgcuagcaucauucucgaguucuuuuugaucguccuguuaauaccagaaccugagaaacagagaacgccccaggauaaucagcuaaccuaugugguuauugcgauccugacaguggucgccgcaacuauggcuaacgaaaugggauuccucgagaagaccaaaaaggacuuuggccuugggggaaucgccacacaacagccagaaucaaauauucuggauaucgacuugcgcccugccagugcauggacccuguacgcuguagccacuacauucauaacgcccaugcucaggcauucuauugagaacuccagcgugaauguuucacugaccgcgaucgcuaaccaggccacugugcuuaugggucucggcaagggguggccgcugaguaaaauggacauuggagucccauugcuggcaaucggcuguuacagccaggugaauccuauaacauuaaccgccgcucuacugcuccuugucgcacacuaugccaucauuggucccgggcugcaagcgaaggcuacccgggaggcccagaaacgugcagccgcuggcaucaugaagaacccaacaguggauggaauuacuguuaucgacuuggaucccauuccuuacgacccgaaauuugaaaagcagcugggccaggugaugcuccugguacuuugcgugacgcaagucuuaaugaugagaaccacaugggcccugugugaggcacucacuuuggcuaccgggcccaucuccacacugugggaaggaaauccaggcagguucuggaacaccacuauagccguuucuauggcgaauauuuuucgcgguagcuaucuagccggggcaggacuacucuucuccaucaugaagaacacggcuaacacacggcgaggcaccgguaauacuggcgagacccuuggggaaaaauggaagaacagacugaaugccuugggaaaaucagaguuucagaucuacaagaaaucuggcauucaggagguggauaggacacuggcaaaggaagggauaaaacgcggagagacugaccaucacgcugucagucggggcucggccaagcucagaugguucguggaacguaaccugguaaccccugaggguaaggugauggauuuagggugcggaaggggcgguuggagcuauuacuguggcgggcuuaaaaauguuaaggaggugaaaggacugacaaagggcgggcccggacaugaggaaccuaucccaauguccacguauggcuggaaccucguccggcuacaaucugguguggacgucuucuuuacaccaccugaaaaaugcgauacucuguugugugacauuggggagucaagcccaaaucccacaguggaagccggacgcacccugcgaguucucaaccuuguagagaauuggcugaacaauaacacucaguucugcaucaagguguugaauccguacaugccuuccgucauugagaagauggaagcgcugcagagaaaauacggcggcgcucucgugaggaacccauuaaguagaaauucuacacacgagauguauuggguuagcaacgcaucagggaacaucguguccagugucaauaugauaagccgcaugcugaucaacagauuuaccaugaggcacaagaaagccacguacgaacccgauguggaccuuggaucugguacccgaaauauuggcaucgaguccgaaacaccuaaccuggauauuaucgggaagcggauagagaaaauuaagcaggagcaugaaacuucauggcacuaugaccaagaccauccauacaagaccugggcuuaucacggaagcuacgagacaaaacagacuggcucggccucuaguaugguaaauggugugguucgucuacucaccaagcccugggaugucaucccgauggugacacagauggcaaugaccgacacuacgccuuucgggcagcaaagaguguuuaaagaaaaggucgauacacgcacccaggagcccaaagaaggaacuaagaagcugaugaaaaucaccgccgagugguuguggaaggagcugggcaaaaagaaaacaccaaggauguguacgcgggaagaguucaccagaaagguucgcuccaacgcugcgcucggcgccauuuuuacugacgaaaauaaauggaaaagcgcaagggaggcuguggaggauucaggguucugggaacuuguagacaaggagcgaaaccugcacuuagaaggaaaaugcgagacauguguguauaauaugauggguaagcgggagaagaagcugggcgaguuugggaaagccaagggauccagagcaauaugguacaugugguugggcgccagguuccucgaguuugaagcucuggguuuccuaaacgaggaucauugguuuucucgcgaaaauagccuuaguggggucgagggagaaggccugcacaagcucggcuacauccugcgugacguguccaaaaaggaagggggagccauguaugcggaugacaccgcagguugggauacucggauuacauuggaggaccugaaaaacgaagagaugguuaccaaucauauggaaggcgagcacaagaaacucgccgaagcuaucuucaaacuuacauaccagaacaagguggucagagugcagaggccuacuccccgcgggaccguaauggacauuaucagccgacgggaucaaagaggaucuggccagguugugacguauggucugaauaccuucacaaacauggaggcccaguuaauaaggcaaauggagggggaaggagucuuuaaaucaauccagcagcugacugcaaccgaggaaauugcugugaagaacugguuggcccgcgugggcagagagcggcucaguaggauggcuaucuccggcgacgauugcgucguuaaaccacuggacgaucguuucgccagcgcacuaacagcgcuuaaugacauggggaaggugcgaaaagauauucagcaaugggagcccucucgcggauggaacgacuggacucagguaccuuuuugcucgcaucacuuccacgaacugaucaugaaggaugguagagugcucgucgugccaugucggaaucaggacgagcugauuggcagggcccgcauaucacagggggcuggauggagcuugagagaaaccgccugcuuaggcaaguccuacgcacaaauguggagucugauguauuuucaucggagggaucuccgacuugcugccaacgcaaucuguucugccguuccgagccacugggugcccacgucccguacaaccuggucaauucaugcgacucacgaguggaugacaaccgaagacaugcugacugucuggaauagaguguggauccaggagaacccuuggaucgaggauaaaaccccaguagaaaguugggaggaaauucccuaccuagguaagcgcgaggaccaguggugcgggucucugauaggacucacaagccgggcuacgugggccaaaaauauccagaccgcaauuaaccaaguuagguccuugaucggcaaugaagaguauacugacuacaugccuucaaugaagagauuccgccgggaggaagaggaagccggcgugcugugguga

SEQ ID NO: 15049 - RNA, 9876 nt, Artificial Sequence
  derived and/or modified CDS sequence (opt3) from DENV-2__DQ645546__SS-prME
accgcaggagugaucauuaugaugauacccaccguaguugcuuuccaccugacuacgcggaauggggagccucauaugaucgugagcaggcaggaaaagggaaagucccuccuuuuuaagaccgagaaugguguaaauaugugcacacugauggcaauggacuugggagaauuaugugaggauacuauuaccuacaauugcccacugcugcggcaaaacgaaccggaggacaucgauuguuggugcaauucuacaucaaccugggugacuuaugggacauguaccgccacgggagagcaccgccgagaaaaacguagugucgcgcucgugccccauguuggcaugggucuggagacuagaaccgaaacauggaugagcuccgagggggcuuggaagcacgcccagaggauugagacuugggugcuucggcauccuggauucaccaucauggcagccauacuggcuuacacaaucggcaccacguauuuucagcgcgucuugauuuucauccuccugacugcaguggccccaucuaugacaaugagaugcauuggcaucucgaacagggacuuuguagaagggguuucaggagguagcuggguggauauaguccuggagcacggcaguugugugaccacuauggcuaaaaauaagcccacacucgacuucgaauuaauuaagaccgaggccaaacacccugcgacgcugcggaaguacugcaucgaagcaaaacuuaccaacacaacuaccgccucccgcuguccaacacagggggagcccucuuugaaugaggaacaagauaagcgauuugugugcaaacauagcauggucgacagaggauggggcaacgguugugggcuguucggaaagggcggcauuguuacuugcgcuauguuuaccugcaagaaaaauauggaggggaaggugguacagccugaaaaccuagaguauacaaucgugaucaccccacacuccggagaagagaaugccgucgguaacgauacuggcaaacaugggaaggagauuaaagugacgccgcagucaaguauaacagaagcagagcucaccggauacggcacuguuaccauggaauguagccccaggacaggucuggacuucaaugagauggugcuucugcagauggaagauaaggcuugguugguccaccggcaaugguuucucgaccugccuuuaccauggcugcccggggccgauacccagggcucuaacuggauccagaaagagacucucgugacauucaagaacccucacgcgaagaaacaggacguaguugugcuuggaucccaagagggcgccaugcauacggcacugaccggggcuacugaaauucagaugucaagcggaaauuugcuauuuacaggucaccugaagugccgucuccgcauggacaaacugcagcuuaagggcaugaguuauucuauguguaccgggaaauucaaggucgugaaggagaucgccgaaacacaacauggaacuauagucauuagagugcaguacgagggcgaugguuccccaugcaaaauccccuucgagaucauggaccuggaaaagaggcacguuuuggggcggcucauuaccgugaacccgaucguaacggagaaagauagcccugucaauauugaagcugagcccccauuuggcgacucguacauaaucauuggaguggaaccuggccagcugaaguuaucuugguucaaaaagggguccucaaucggacagauguuugagaccacaaugcgaggugccaagcgcauggcaauccugggcgauacugccugggacuucgggagucuaggaggcguuuuuaccagcauugguaaagcucuccaucaaguguucggggcgauauauggcgcagccuuuuccggagucucuuggacaaugaagauccugauuggcgugguaaucacuuggauugggaugaacagcagaucaaccagucuuuccgugagcuugguucuggucggaguggugacgcucuaccugggcgucaugguucaggcugauucugguuguguggugucauggaaaaauaaggagcuuaaaugcgggaguggaaucuucauaacagacaacguacacaccuggacugaacaguauaaguuucagcccgagagcccauccaagcuggccucugcaauccaaaaagcccacgaagagggcauuugugguaucaggucggucacacgguuggaaaaucucauguggaagcagauuacccccgagcugaaccauaucuuaagcgagaaugaagugaaacugacuauaaugaccggcgauauuaaggggaucaugcaggcuggaaaacgcucccuaagaccucagccaacagagcucaaguacucauggaaagccuggggcaaggcaaagaugcugaguacggaacuucacaaccauaccuucuugauugacgggccggagacugcggaaugccccaauacaaacagggcuuggaacucucuggagguugaggauuauggauuuggcguguucaccacaaacaucuggcucaaacugaaggaacgucaagacgucuuuugugacagcaaauuaauguccgccgcaauaaaggauaaucgggccgugcacgcugacauggguuacuggaucgagucagcccugaacgauacuuggaaaauugaaaaggccagcuucaucgagguuaagucuugccacuggccuaaaucccauacccuuuggaguaacgggguguuggagagcgaaaugauuaucccaaagaauuucgcuggacccguaucucagcacaacuaucgaccuggcuaccauacgcagacagccgguccauggcaccucggcaaacuggagauggacuuugauuucugugaagggaccacugucguggugaccgaggacugcggaaauagaggccccucccuaaggacaacuaccgcgucagggaagcugauaacagaauggugcugucgcaguugcacgcucccgccucugcgguacagaggagaggauggcuguugguaugguauggagauuaggccacuuaaagaaaaggaggaaaacuuggucaauagccugguuaccgccgggcauggacagaucgacaacuuuucguuaggcgugcucgguauggcucuguuccuugaggaaaugcugcgcacucgaguaggcacaaagcacgcaaucuugcucguggccgucuccuuugugacccugauuacugggaauaugucuuuccgggaucuaggacguguuauggugauggucggcgcuacaaugaccgacgauaucgggaugggagugacguaccuggcccuccuggcagcguuuaaaguuagacccacuuucgccgcuggccuuuugcugaggaaguuaaccagcaaagagcucaugaugacaaccauugguauagugcugcuuucacaaaguacuaucccugagacaauucuggaacuaaccgacgcccucgcacuggggaugauggucuugaagaucguacgcaacauggagaaauaucagcuggcugugacaauuauggccaucuuaugcguucccaaugcagugauacuccagaacgccuggaaggucuccuguacuauccuggcugugguaucugugagcccacuucuguugaccuccucacaacagaaggcggauuggauuccucucgcccugacgaucaaaggacuaaaucccacagcaauuuuucugaccacucuuagccggaccaguaagaaaagaucuuggccacucaacgaagcuaucauggccgucggcaugguuuccauacuggccagcucguugcugaagaaugacauuccgaugacaggcccuuuaguggcugggggacuccugacugugugcuacguccuuaccgguaggucagcagaccuggaguuggaacgagccgcggaugugcgcugggaggagcaggcugaaaucucuggcaguucccccauccucagcauuacgauaucugaggacgggagcauguccaucaaaaacgaagaggaggaacagacacugaccauucuaauccggacuggacugcuuguuauuucaggccucuucccaguaaguauccccauaacagccgcagccugguaucugugggaggugaagaaacaaagagcuggugucuugugggaugugccuagcccacccccuguugggaaggcagaauuagaggacggagccuacaggaucaagcagaaaggcauucugggcuauucucagaucggggcgggaguguacaaggaagguaccuuucacacuauguggcaugucacacguggcgcugugcucaugcacaaagggaagcgcauugagccguccugggccgaugucaagaaggaccugaucucauacggaggcgguuggaaacuugagggggaauggaaagagggagaagagguccaggugcuggcauuggaaccaggcaagaauccccgggccguucaaaccaaaccuggccuauucaagacgaacacugggaccauaggagcugugagucuggauuuuagcccagguacauccggcucucccauugucgacaaaaaggggaaggugguuggacucuauggcaacgguguggucaccagaucggggacauacgugagcgccaucgcacagacugagaaaucaaucgaggauaauccugaaauugaggacgauaucuucaggaagaaacgacugaccauaauggaccuucauccgggagcuggcaagacgaaacgguauuuacccgccauuguacgcgaagcgaucaagagaggccugaggacacucauuuuggccccaacucgggugguugcagcugagauggaagaggcccugcgagggcucccuaucagauaccagacccccgcuauacgcgcagagcacacaggaagggaaauugucgaucugaugugucaugccaccuucacuaugcgucuucuguccccaauccgggugccuaacuauaauuugaucauuauggacgaggcccacuuuaccgaccccgcuaguaucgcggcaagagguuacauuucuacaaggguggaaaugggcgaggccgcugggauauucaugacggccacuccaccgggaagccgcgauccuuuuccccaguccaacgcaccaaucauggacgaggaacgagagauucccgaaagaucauggaacucuggccacgagugggucaccgauuucaaggguaaaacaguaugguuugugccuagcaucaaggccgggaacgacaucgcugcgugccuacggaaaaauggaaagaaaguuauucaacugaguaggaagaccuucgauuccgaauaugugaagacucgcacaaacgacugggauuuugucgugaccacggacauaagcgagaugggcgccaauuucaaagcagagcguguuaucgauccaagacgguguaugaagcccgugauucucacugacggcgaagagagggucaucuuagcugggccuaugccggugacacauucuucagccgcacagcgccgaggaagaguaggucggaaccccaagaaugaaaacgaucaguacauuuacaugggcgagccccuggaaaaugacgaggacugcgcccacuggaaggaggcuaaaaugcuucuggauaacaucaauaccccugaagggauaauccccuccauguuugagccagaaagggagaagguggacgccauugauggagaauaucgccucagaggcgaggcgaggaaaaccuucguugacuugaugcggcguggugaucugccugucuggcucgcauaccgcguggccgcugaggggaucaacuaugccgaccgaagaugguguuuugauggcgugaagaacaaucaaauucuggaagagaacgucgaaguugagaucuggacuaaggagggagaaaggaagaaacuuaaaccccgguggcuagacgcucgcauauacagugauccacuggcauugaaagaguucaaagaguucgccgcuggcagaaagagcuuaacacugaaucucauuaccgagauggggaggcugccuacauuuaugacucagaaggcccggaacgcacuugacaaucuggcggugcuccauacggccgaagcuggaggucgagccuauaaccacgcauugucggagcugccggagacccuagaaacacugcuccuucugacuuuauuggcuaccguaacaggcgggaucuuccuguuucucaugucuggaaaaggcauugguaagaugacccuggggaugugcugcaucauaacugccuccgugcuucugugguacgcacagauccagccccacuggauugccgcuagcaucauucucgaguucuuuuugaucguccuguuaauaccagaaccugagaaacaaagaacgccccaggauaaucagcuaaccuaugugguuauugcgauccugacaguggucgccgcaacuauggcuaacgaaaugggcuuccucgagaagaccaaaaaggacuuuggacuuggcgggaucgccacacagcaaccagagucaaauauucuggauaucgacuugcgcccugccagugcauggacccuguacgcuguagccacuacauucauaacgcccaugcucaggcauucuauugaaaacuccagcgugaauguuucacugaccgcgaucgcuaaccaggccacugugcuuaugggacucgguaagggcuggccgcugaguaaaauggacauuggggucccauugcuggcaaucggauguuacagccaggugaauccuauaacauuaaccgccgcucuacugcuccuugucgcacacuaugccaucauuggccccggucugcaggcgaaggcuacccgggaggcccaaaaacgugcagccgcugggaucaugaagaacccaacaguggauggcauuacuguuaucgacuuggaucccauuccuuacgacccgaaauuugaaaagcagcugggacaggugaugcuccugguacuuugcgugacgcaggucuuaaugaugagaaccacaugggcccugugugaggcacucacuuuggcuaccggccccaucuccacacugugggaagggaauccaggaagguucuggaacaccacuauagccguuucuauggcgaauauuuuucgcggcagcuaucuagccggugcagggcuacucuucuccaucaugaagaacacggcuaacacacggcgaggaaccggcaauacuggugagacccuuggcgagaaauggaagaacagacugaaugccuuggggaaaucagaauuucaaaucuacaagaaaucuggcauucaggagguggauaggacacuggcaaaggaaggcauaaaacgcggggagacugaccaucacgcugucagucggggaucggccaagcucagaugguucguggagcguaaccugguaaccccugaaggcaaggugauggauuuagguugcgggaggggaggcuggagcuauuacugugguggccuuaaaaauguuaaggaggugaaagggcugacaaagggaggccccgggcaugaagaaccuaucccaauguccacguauggauggaaccucguccggcuacagucuggcguggacgucuucuuuacaccaccugaaaaaugcgauacucuguugugugacauuggugagucaagcccaaaucccacaguggaggccgggcgcacccugcgaguucucaaccuuguagaaaauuggcugaacaauaacacucaauucugcaucaagguguugaauccguacaugccuuccgucauugagaagauggaagcgcugcagagaaaauacggaggcgcucucgugaggaacccauuaaguagaaauucuacacacgagauguauuggguuagcaacgcaucaggcaacaucguguccagugucaauaugauaagccgcaugcugaucaacagauuuaccaugaggcacaagaaagccacguacgaacccgauguggaccuugggucuggaacccgaaauauugguaucgaguccgagacaccuaaccuggauauuaucggcaagcggauagagaaaauuaagcaggaacaugaaacuucauggcacuaugaccaggaccauccauacaagaccugggcuuaucacgggagcuacgagacaaaacaaacuggaucggccucuaguaugguaaauggcgugguucgucuacucaccaagcccugggaugucaucccgauggugacacagauggcaaugaccgacacuacgccuuucggucagcagagaguguuuaaagaaaaggucgauacacgcacccaagagcccaaagaggggacuaagaagcugaugaaaaucaccgccgaaugguuguggaaggagcugggcaagaagaaaacaccaaggauguguacgcgggaagaguucaccagaaagguucgcuccaacgcugcgcucggcgccauuuuuacugacgagaauaaauggaaaagcgcaagggaagcuguggaggauucaggcuucugggaacuuguagacaaggagcgaaaccugcacuuagaagggaaaugcgagacauguguguauaauaugaugggaaagcgggagaaaaagcugggugaauuuggcaaagccaagggguccagagcaauaugguacaugugguugggagccagguuccucgaguuugaagcucugggcuuccuaaacgaggaucauugguuuucucgcgaaaauagccuuaguggugucgagggggagggacugcacaagcucggcuacauccugcgugacguguccaaaaaggaaggcggggccauguaugcggaugacaccgcaggaugggauacucggauuacauuggaggaccugaaaaacgaagagaugguuaccaaucauauggaaggugagcacaagaaacucgccgaggcuaucuucaaacuuacauaccagaacaagguggucagagugcagaggccuacuccccgcggcaccguaauggacauuaucagccgacgggaucagagagggucuggacaaguugugacguauggccugaauaccuucacaaacauggaagcccaguuaauaaggcagauggagggugaaggggucuuuaaaucaauccaacagcugacugcaaccgaggagauugcugugaagaacugguuggcccgcgugggaagagaacggcucaguaggauggcuaucuccggcgacgauugcgucguuaaaccacuggacgaucguuucgccagcgcacuaacagcgcuuaaugacaugggcaaggugcgaaaagauauucagcagugggagcccucucgcggguggaacgacuggacucaaguaccuuuuugcucgcaucacuuccacgaacugaucaugaaggauggaagagugcucgucgugccaugucggaaucaggacgagcugauugguagggcccgcauaucacagggcgcuggguggagcuugagagaaaccgccugcuuaggaaaguccuacgcacagauguggagucugauguauuuucaucggagggaucuccgacuugcugccaacgcaaucuguucugccguuccgagccacugggugcccacgucccguacaaccuggucaauucaugcgacucacgaguggaugacaaccgaggacaugcugacugucuggaauagaguguggauccaagaaaacccuuggaucgaggauaaaaccccaguagaaaguugggaggaaauucccuaccuaggcaagcgcgaggaccaguggugcgguucucugauagggcucacaagccgggcuacgugggccaaaaauauccagaccgcaauuaaccagguuagguccuugaucggaaaugaggaauauacugacuacaugccuucaaugaagagauuccgccgggaggaagaggaagccggcgugcugugguga

SEQ ID NO: 15050 - RNA, 9876 nt, Artificial Sequence
  derived and/or modified CDS sequence (opt3) from DENV-2__DQ645547__SS-prME
accgcaggagugaucauuaugaugauacccaccguaguugcuuuccaccugacuacgcggaauggggagccucauaugaucgugagcaggcaggaaaagggaaagucccuccuuuuuaagaccgagaaugguguaaauaugugcacacugauggcaauggacuugggagaauuaugugaggauacuauuaccuacaauugcccacugcugcggcaaaacgaaccggaggacaucgauuguuggugcaauucuacaucaaccugggugacuuaugggacauguaccgccacgggagagcaccgccgagaaaaacguagugucgcgcucgugccccauguuggcaugggucuggagacuagaaccgaaacauggaugagcuccgagggggcuuggaagcacgcccagaggauugagacuugggugcuucggcauccuggauucaccaucauggcagccauacuggcuuacacaaucggcaccacguauuuucagcgcgucuugauuuucauccuccugacugcaguggccccaucuaugacaaugagaugcauuggcaucucgaacagggacuuuguagaagggguuucaggagguagcuggguggauauaguccuggagcacggcaguugugugaccacuauggcuaaaaauaagcccacacucgacuucgaauuaauuaagaccgaggccaaacacccugcgacgcugcggaaguacugcaucgaagcaaaacuuaccaacacaacuaccgccucccgcuguccaacacagggggagcccucuuugaaugaggaacaagauaagcgauuugugugcaaacauagcauggucgacagaggauggggcaacgguugugggcuguucggaaagggcggcauuguuacuugcgcuauguuuaccugcaagaaaaauauggaggggaaggugguacagccugaaaaccuagaguauacaaucgugaucaccccacacuccggagaagagaaugccgucgguaacgauacuggcaaacaugggaaggagauuaaagugacgccgcagucaaguauaacagaagcagagcucaccggauacggcacuguuaccauggaauguagccccaggacaggucuggacuucaaugagauggugcuucugcagauggaagauaaggcuugguugguccaccggcaaugguuucucgaccugccuuuaccauggcugcccggggccgauacccagggcucuaacuggauccagaaagagacucucgugacauucaagaacccucacgcgaagaaacaggacguaguugugcuuggaucccaagagggcgccaugcauacggcacugaccggggcuacugaaauucagaugucaagcggaaauuugcuauuuacaggucaccugaagugccgucuccgcauggacaaacugcagcuuaagggcaugaguuauucuauguguaccgggaaauucaaggucgugaaggagaucgccgaaacacaacauggaacuauagucauuagagugcaguacgagggcgaugguuccccaugcaaaauccccuucgagaucauggaccuggaaaagaggcacguuuuggggcggcucauuaccgugaacccgaucguaacggagaaagauagcccugucaauauugaagcugagcccccauuuggcgacucguacauaaucauuggaguggaaccuggccagcugaaguuaucuugguucaaaaagggguccucaaucggacagauguuugagaccacaaugcgaggugccaagcgcauggcaauccugggcgauacugccugggacuucgggagucuaggaggcguuuuuaccagcauugguaaagcucuccaucaaguguucggggcgauauauggcgcagccuuuuccggagucucuuggacaaugaagauccugauuggcgugguaaucacuuggauugggaugaacagcagaucaaccagucuuuccgugagcuugguucuggucggaguggugacgcucuaccugggcgucaugguucaggcugauucugguuguguggugucauggaaaaauaaggagcuuaaaugcgggaguggaaucuucauaacagacaacguacacaccuggacugaacaguauaaguuucagcccgagagcccauccaagcuggccucugcaauccaaaaagcccacgaagagggcauuugugguaucaggucggucacacgguuggaaaaucucauguggaagcagauuacccccgagcugaaccauaucuuaagcgagaaugaagugaaacugacuauaaugaccggcgauauuaaggggaucaugcaggcuggaaaacgcucccuaagaccucagccaacagagcucaaguacucauggaaagccuggggcaaggcaaagaugcugaguacggaacuucacaaccauaccuucuugauugacgggccggagacugcggaaugccccaauacaaacagggcuuggaacucucuggagguugaggauuauggauuuggcguguucaccacaaacaucuggcucaaacugaaggaacgucaagacgucuuuugugacagcaaauuaauguccgccgcaauaaaggauaaucgggccgugcacgcugacauggguuacuggaucgagucagcccugaacgauacuuggaaaauugaaaaggccagcuucaucgagguuaagucuugccacuggccuaaaucccauacccuuuggaguaacgggguguuggagagcgaaaugauuaucccaaagaauuucgcuggacccguaucucagcacaacuaucgaccuggcuaccauacgcagacagccgguccauggcaccucggcaaacuggagauggacuuugauuucugugaagggaccacugucguggugaccgaggacugcggaaauagaggccccucccuaaggacaacuaccgcgucagggaagcugauaacagaauggugcugucgcaguugcacgcucccgccucugcgguacagaggagaggauggcuguugguaugguauggagauuaggccacuuaaagaaaaggaggaaaacuuggucaauagccugguuaccgccgggcauggacagaucgacaacuuuucguuaggcgugcucgguauggcucuguuccuugaggaaaugcugcgcacucgaguaggcacaaaguacgcaaucuugcucguggccgucuccuuugugacccugauuacugggaauaugucuuuccgggaucuaggacguguuauggugauggucggcgcuacaaugaccgacgauaucgggaugggagugacguaucuggcccuccuggcagcguuuaaaguuagacccacuuucgccgcuggccuuuugcugaggaaguuaaccagcaaagagcucaugaugacaaccauugguauagugcugcuuucacaaaguacuaucccugagacaauucuggaacuaaccgacgcccucgcacuggggaugauggucuugaagaucguacgcaacauggagaaauaccagcuggcugugacaauuauggccaucuuaugcguucccaaugcagugauacuccagaacgccuggaaggucuccuguacuauccuggcugugguaucugugagcccacuucuguugaccuccucacaacagaaggcggauuggauuccucucgcccugacgaucaaaggacuaaaucccacagcaauuuuucugaccacucuuagccggaccaguaagaaaagaucuuggccacucaacgaagcuaucauggccgucggcaugguuuccauacuggccagcucguugcugaagaaugacauuccgaugacaggcccuuuaguggcugggggacuccugacugugugcuauguccuuaccgguaggucagcagaccuggaguuggaacgagccgcggaugugcgcugggaggagcaggcugaaaucucuggcaguucccccauccucagcauuacgauaucugaggacgggagcauguccaucaaaaacgaagaggaggaacagacacugaccauucuaauccggacuggacugcuuguuauuucaggccucuucccaguaaguauccccauaacagccgcagccugguaccugugggaggugaagaaacaaagagcuggugucuugugggaugugccuagcccacccccuguugggaaggcagaauuagaggacggagccuauaggaucaagcagaaaggcauucugggcuacucucagaucggggcgggaguguacaaggaagguaccuuucacacuauguggcacgucacacguggcgcugugcucaugcauaaagggaagcgcauugagccguccugggccgaugucaagaaggaccugaucucauauggaggcgguuggaaacuugagggggaauggaaagagggagaagagguccaggugcuggcauuggaaccaggcaagaauccccgggccguucaaaccaaaccuggccuauucaagacgaacacugggaccauaggagcugugagucuggauuuuagcccagguacauccggcucucccauugucgacaaaaaggggaaggugguuggacucuacggcaacgguguggucaccagaucggggacauaugugagcgccaucgcacagacugagaaaucaaucgaggauaauccugaaauugaggacgauaucuucaggaagaaacgacugaccauaauggaccuucacccgggagcuggcaagacgaaacgguacuuacccgccauuguacgcgaagcgaucaagagaggccugaggacacucauuuuggccccaacucgggugguugcagcugagauggaagaggcccugcgagggcucccuaucagauaucagacccccgcuauacgcgcagagcauacaggaagggaaauugucgaucugaugugucacgccaccuucacuaugcgucuucuguccccaauccgggugccuaacuacaauuugaucauuauggacgaggcccauuuuaccgaccccgcuaguaucgcggcaagagguuauauuucuacaaggguggaaaugggcgaggccgcugggauauucaugacggccacuccaccgggaagccgcgauccuuuuccccaguccaacgcaccaaucauggacgaggaacgagagauucccgaaagaucauggaacucuggccacgagugggucaccgauuucaaggguaaaacaguaugguuugugccuagcaucaaggccgggaacgacaucgcugcgugccuacggaaaaauggaaagaaaguuauucaacugaguaggaagaccuucgauuccgaauacgugaagacucgcacaaacgacugggauuuugucgugaccacggacauaagcgagaugggcgccaauuucaaagcagagcguguuaucgauccaagacgguguaugaagcccgugauucucacugacggcgaagagagggucaucuuagcugggccuaugccggugacacacucuucagccgcacagcgccgaggaagaguaggucggaaccccaagaaugaaaacgaucaguacauuuauaugggcgagccccuggaaaaugacgaggacugcgcccauuggaaggaggcuaaaaugcuucuggauaacaucaauaccccugaagggauaauccccuccauguuugagccagaaagggagaagguggacgccauugauggagaauaccgccucagaggcgaggcgaggaaaaccuucguugacuugaugcggcguggugaucugccugucuggcucgcauaucgcguggccgcugaggggaucaacuacgccgaccgaagaugguguuuugauggcgugaagaacaaucaaauucuggaagagaacgucgaaguugagaucuggacuaaggagggagaaaggaagaaacuuaaaccccgguggcuagacgcucgcauauauagugauccacuggcauugaaagaguucaaagaguucgccgcuggcagaaagagcuuaacacugaaucucauuaccgagauggggaggcugccuacauuuaugacucagaaggcccggaacgcacuugacaaucuggcggugcuccacacggccgaagcuggaggucgagccuacaaccaugcauugucggagcugccggagacccuagaaacacugcuccuucugacuuuauuggcuaccguaacaggcgggaucuuccuguuucucaugucuggaaaaggcauugguaagaugacccuggggaugugcugcaucauaacugccuccgugcuucugugguaugcacagauccagccccacuggauugccgcuagcaucauucucgaguucuuuuugaucguccuguuaauaccagaaccugagaaacaaagaacgccccaggauaaucagcuaaccuacgugguuauugcgauccugacaguggucgccgcaacuauggcuaacgaaaugggcuuccucgagaagaccaaaaaggacuuuggacuuggcgggaucgccacacagcaaccagagucaaauauucuggauaucgacuugcgcccugccagugcauggacccuguacgcuguagccacuacauucauaacgcccaugcucaggcacucuauugaaaacuccagcgugaauguuucacugaccgcgaucgcuaaccaggccacugugcuuaugggacucgguaagggcuggccgcugaguaaaauggacauuggggucccauugcuggcaaucggauguuauagccaggugaauccuauaacauuaaccgccgcucuacugcuccuugucgcacauuacgccaucauuggccccggucugcaggcgaaggcuacccgggaggcccaaaaacgugcagccgcugggaucaugaagaacccaacaguggauggcauuacuguuaucgacuuggaucccauuccuuaugacccgaaauuugaaaagcagcugggacaggugaugcuccugguacuuugcgugacgcaggucuuaaugaugagaaccacaugggcccugugugaggcacucacuuuggcuaccggccccaucuccacacugugggaagggaauccaggaagguucuggaacaccacuauagccguuucuauggcgaauauuuuucgcggcagcuaccuagccggugcagggcuacucuucuccaucaugaagaacacggcuaacacacggcgaggaaccggcaauacuggugagacccuuggcgagaaauggaagaacagacugaaugccuuggggaaaucagaauuucaaaucuauaagaaaucuggcauucaggagguggauaggacacuggcaaaggaaggcauaaaacgcggggagacugaccaccaugcugucagucggggaucggccaagcucagaugguucguggagcguaaccugguaaccccugaaggcaaggugauggauuuagguugcgggaggggaggcuggagcuacuauugugguggccuuaaaaauguuaaggaggugaaagggcugacaaagggaggccccgggcacgaagaaccuaucccaauguccacguacggauggaaccucguccggcuacagucuggcguggacgucuucuuuacaccaccugaaaaaugcgauacucuguugugugacauuggugagucaagcccaaaucccacaguggaggccgggcgcacccugcgaguucucaaccuuguagaaaauuggcugaacaauaacacucaauucugcaucaagguguugaauccguacaugccuuccgucauugagaagauggaagcgcugcagagaaaauauggaggcgcucucgugaggaacccauuaaguagaaauucuacacaugagauguacuggguuagcaacgcaucaggcaacaucguguccagugucaauaugauaagccgcaugcugaucaacagauuuaccaugaggcacaagaaagccacguaugaacccgauguggaccuugggucuggaacccgaaauauugguaucgaguccgagacaccuaaccuggauauuaucggcaagcggauagagaaaauuaagcaggaacacgaaacuucauggcauuacgaccaggaccacccauauaagaccugggcuuaccaugggagcuaugagacaaaacaaacuggaucggccucuaguaugguaaauggcgugguucgucuacucaccaagcccugggaugucaucccgauggugacacagauggcaaugaccgacacuacgccuuucggucagcagagaguguuuaaagaaaaggucgauacacgcacccaagagcccaaagaggggacuaagaagcugaugaaaaucaccgccgaaugguuguggaaggagcugggcaagaagaaaacaccaaggauguguacgcgggaagaguucaccagaaagguucgcuccaacgcugcgcucggcgccauuuuuacugacgagaauaaauggaaaagcgcaagggaagcuguggaggauucaggcuucugggaacuuguagacaaggagcgaaaccugcacuuagaagggaaaugcgagacauguguguacaauaugaugggaaagcgggagaaaaagcugggugaauuuggcaaagccaagggguccagagcaauaugguacaugugguugggagccagguuccucgaguuugaagcucugggcuuccuaaacgaggaucacugguuuucucgcgaaaauagccuuaguggugucgagggggagggacugcauaagcucggcuauauccugcgugacguguccaaaaaggaaggcggggccauguacgcggaugacaccgcaggaugggauacucggauuacauuggaggaccugaaaaacgaagagaugguuaccaaucacauggaaggugagcauaagaaacucgccgaggcuaucuucaaacuuacauaucagaacaagguggucagagugcagaggccuacuccccgcggcaccguaauggacauuaucagccgacgggaucagagagggucuggacaaguugugacguacggccugaauaccuucacaaacauggaagcccaguuaauaaggcagauggagggugaaggggucuuuaaaucaauccaacagcugacugcaaccgaggagauugcugugaagaacugguuggcccgcgugggaagagaacggcucaguaggauggcuaucuccggcgacgauugcgucguuaaaccacuggacgaucguuucgccagcgcacuaacagcgcuuaaugacaugggcaaggugcgaaaagauauucagcagugggagcccucucgcggguggaacgacuggacucaaguaccuuuuugcucgcaccauuuccacgaacugaucaugaaggauggaagagugcucgucgugccaugucggaaucaggacgagcugauugguagggcccgcauaucacagggcgcuggguggagcuugagagaaaccgccugcuuaggaaaguccuaugcacagauguggagucugauguacuuucaccggagggaucuccgacuugcugccaacgcaaucuguucugccguuccgagccauugggugcccacgucccguacaaccuggucaauucacgcgacucaugaguggaugacaaccgaggacaugcugacugucuggaauagaguguggauccaagaaaacccuuggaucgaggauaaaaccccaguagaaaguugggaggaaauucccuaucuaggcaagcgcgaggaccaguggugcgguucucugauagggcucacaagccgggcuacgugggccaaaaauauccagaccgcaauuaaccagguuagguccuugaucggaaaugaggaauacacugacuacaugccuucaaugaagagauuccgccgggaggaagaggaagccggcgugcugugguga

SEQ ID NO: 15051 - RNA, 9876 nt, Artificial Sequence
  derived and/or modified CDS sequence (opt3) from DENV-2__DQ645549__SS-prME
accgcaggagugaucauuaugaugauacccaccguaguugcuuuccaccugacuacgcggaauggggaaccucauaugaucgugagcaggcaggaaaagggaaagucccuccuuuuuaagaccgagaaugguguaaauaugugcacacugauggcaauggacuugggagaauuaugugaggauacuauuaccuacaauugcccacugcugcggcaaaacgaaccggaggacaucgauuguuggugcaauucuacaucaaccugggugacuuaugggacauguaccgccacgggagagcaccgccgagaaaaacguagugucgcgcucgugccccauguuggcaugggucuggagacuagaaccgaaacauggaugagcuccgagggggcuuggaagcacgcccagaggauugagacuugggugcuucggcauccuggauucaccaucauggcagccauacuggcuuacacaaucggcaccacguauuuucagcgcgucuugauuuucauccuccugacugcaguggccccaucuaugacaaugagaugcauuggcaucucgaacagggacuuuguagaagggguuucaggagguagcuggguggauauaguccuggagcacggcaguugugugaccacuauggcuaaaaauaagcccacacucgacuucgaauuaauuaagaccgaggccaaacacccugcgacgcugcggaaguacugcaucgaagcaaaacuuaccaacacaacuaccgccucccgcuguccaacacagggggagcccucuuugaaugaggaacaagauaagcgauuugugugcaaacauagcauggucgacagaggauggggcaacgguugugggcuguucggaaagggcggcauuguuacuugcgcuauguuuaccugcaagaaaaauauggaggggaaggugguacagccugaaaaccuagaguauacaaucgugaucaccccacacuccggagaagagaaugccgucgguaacgauacuggcaaacaugggaaggagauuaaagugacgccgcagucaaguauaacagaagcagagcucaccggauacggcacuguuaccauggaauguagccccaggacaggucuggacuucaaugagauggugcuucugcagauggaagauaaggcuugguugguccaccggcaaugguuucucgaccugccuuuaccauggcugcccggggccgauacccagggcucuaacuggauccagaaagagacucucgugacauucaagaacccucacgcgaagaaacaggacguaguugugcuuggaucccaagagggcgccaugcauacggcacugaccggggcuacugaaauucagaugucaagcggaaauuugcuauuuacaggucaccugaagugccgucuccgcauggacaaacugcagcuuaagggcaugaguuauucuauguguaccgggaaauucaaggucgugaaggagaucgccgaaacacaacauggaacuauagucauuagagugcaguacgagggcgaugguuccccaugcaaaauccccuucgagaucauggaccuggaaaagaggcacguuuuggggcggcucauuaccgugaacccgaucguaacggagaaagauagcccugucaauauugaagcugagcccccauuuggcgacucguacauaaucauuggaguggaaccuggccagcugaaguuaucuugguucaaaaagggguccucaaucggacagauguuugagaccacaaugcgaggugccaagcgcauggcaauccugggcgauacugccugggacuucgggagucuaggaggcguuuuuaccagcauugguaaagcucuccaucaaguguucggggcgauauauggcgcagccuuuuccggagucucuuggacaaugaagauccugauuggcgugguaaucacuuggauugggaugaacagcagaucaaccagucuuuccgugagcuugguucuggucggaguggugacgcucuaccugggcgucaugguucaggcugauucugguuguguggugucauggaaaaauaaggagcuuaaaugcgggaguggaaucuucauaacagacaacguacacaccuggacugaacaguauaaguuucagcccgagagcccauccaagcuggccucugcaauccaaaaagcccacgaagagggcauuugugguaucaggucggucacacgguuggaaaaucucauguggaagcagauuacccccgagcugaaccauaucuuaagcgagaaugaagugaaacugacuauaaugaccggcgauauuaaggggaucaugcaggcuggaaaacgcucccuaagaccucagccaacagagcucaaguacucauggaaagccuggggcaaggcaaagaugcugaguacggaacuucacaaccauaccuucuugauugacgggccggagacugcggaaugccccaauacaaacagggcuuggaacucucuggagguugaggauuauggauuuggcguguucaccacaaacaucuggcucaaacugaaggaacgucaagacgucuuuugugacagcaaauuaauguccgccgcaauaaaggauaaucgggccgugcacgcugacauggguuacuggaucgagucagcccugaacgauacuuggaaaauugaaaaggccagcuucaucgagguuaagucuugccacuggccuaaaucccauacccuuuggaguaacgggguguuggagagcgaaaugauuaucccaaagaauuucgcuggacccguaucucagcacaacuaucgaccuggcuaccauacgcagacagccgguccauggcaccucggcaaacuggagauggacuuugauuucugugaagggaccacugucguggugaccgaggacugcggaaauagaggccccucccuaaggacaacuaccgcgucagggaagcugauaacagaauggugcugucgcaguugcacgcucccgccucugcgguacagaggagaggauggcuguugguaugguauggagauuaggccacuuaaagaaaaggaggaaaacuuggucaauagccugguuaccgccgggcauggacagaucgacaacuuuucguuaggcgugcucgguauggcucuguuccuugaggaaaugcugcgcacucgaguaggcacaaagcacgcaaucuugcucguggccgucuccuuugugacccugauuacugggaauaugucuuuccgggaucuaggacguguuauggugauggucggcgcuacaaugaccgacgauaucgggaugggagugacguaccuggcccuccuggcagcguuuaaaguuagacccacuuucgccgcuggccuuuugcugaggaaguuaaccagcaaagagcucaugaugacaaccauugguauagugcugcuuucacaaaguacuaucccugagacaauucuggaacuaaccgacgcccucgcacuggggaugauggucuugaagaucguacgcaacauggagaaauaucagcuggcugugacaauuauggccaucuuaugcguucccaaugcagugauacuccagaacgccuggaaggucuccuguacuauccuggcugugguaucugugagcccacuucuguugaccuccucacaacagaaggcggauuggauuccucucgcccugacgaucaaaggacuaaaucccacagcaauuuuucugaccacucuuagccggaccaguaagaaaagaucuuggccacucaacgaagcuaucauggccgucggcaugguuuccauacuggccagcucguugcugaagaaugacauuccgaugacaggcccuuuaguggcugggggacuccugacugugugcuacguccuuaccgguaggucagcagaccuggaguuggaacgagccgcggaugugcgcugggaggagcaggcugaaaucucuggcaguucccccauccucagcauuacgauaucugaggacgggagcauguccaucaaaaacgaagaggaggaacagacacugaccauucuaauccggacuggacugcuuguuauuucaggccucuucccaguaaguauccccauaacagccgcagccugguaucugugggaggugaagaaacaaagagcuggugucuugugggaugugccuagcccacccccuguugggaaggcagaauuagaggacggagccuacaggaucaagcagaaaggcauucugggcuauucucagaucggggcgggaguguacaaggaagguaccuuucacacuauguggcaugucacacguggcgcugugcucaugcacaaagggaagcgcauugagccguccugggccgaugucaagaaggaccugaucucauacggaggcgguuggaaacuugagggggaauggaaagagggagaagagguccaggugcuggcauuggaaccaggcaagaauccccgggccguucaaaccaaaccuggccuauucaagacgaacacugggaccauaggagcugugagucuggauuuuagcccagguacauccggcucucccauugucgacaaaaaggggaaggugguuggacucuauggcaacgguguggucaccagaucggggacauacgugagcgccaucgcacagacugagaaaucaaucgaggauaauccugaaauugaggacgauaucuucaggaagaaacgacugaccauaauggaccuucauccgggagcuggcaagacgaaacgguauuuacccgccauuguacgcgaagcgaucaagagaggccugaggacacucauuuuggccccaacucgggugguugcagcugagauggaagaggcccugcgagggcucccuaucagauaccagacccccgcuauacgcgcagagcacacaggaagggaaauugucgaucugaugugucaugccaccuucacuaugcgucuucuguccccaauccgggugccuaacuauaauuugaucauuauggacgaggcccacuuuaccgaccccgcuaguaucgcggcaagagguuacauuucuacaaggguggaaaugggcgaggccgcugggauauucaugacggccacuccaccgggaagccgcgauccuuuuccccaguccaacgcaccaaucauggacgaggaacgagagauucccgaaagaucauggaacucuggccacgagugggucaccgauuucaaggguaaaacaguaugguuugugccuagcaucaaggccgggaacgacaucgcugcgugccuacggaaaaauggaaagaaaguuauucaacugaguaggaagaccuucgauuccgaauaugugaagacucgcacaaacgacugggauuuugucgugaccacggacauaagcgagaugggcgccaauuucaaagcagagcguguuaucgauccaagacgguguaugaagcccgugauucucacugacggcgaagagagggucaucuuagcugggccuaugccggugacacauucuucagccgcacagcgccgaggaagaguaggucggaaccccaagaaugaaaacgaucaguacauuuacaugggcgagccccuggaaaaugacgaggacugcgcccacuggaaggaggcuaaaaugcuucuggauaacaucaauaccccugaagggauaauccccuccauguuugagccagaaagggagaagguggacgccauugauggagaauaucgccucagaggcgaggcgaggaaaaccuucguugacuugaugcggcguggugaucugccugucuggcucgcauaccgcguggccgcugaggggaucaacuaugccgaccgaagaugguguuuugauggcgugaagaacaaucaaauucuggaagagaacgucgaaguugagaucuggacuaaggagggagaaaggaagaaacuuaaaccccgguggcuagacgcucgcauauacagugauccacuggcauugaaagaguucaaagaguucgccgcuggcagaaagagcuuaacacugaaucucauuaccgagauggggaggcugccuacauuuaugacucagaaggcccggaacgcacuugacaaucuggcggugcuccauacggccgaagcuggaggucgagccuauaaccacgcauugucggagcugccggagacccuagaaacacugcuccuucugacuuuauuggcuaccguaacaggcgggaucuuccuguuucucaugucuggaaaaggcauugguaagaugacccuggggaugugcugcaucauaacugccuccgugcuucugugguacgcacagauccagccccacuggauugccgcuagcaucauucucgaguucuuuuugaucguccuguuaauaccagaaccugagaaacaaagaacgccccaggauaaucagcuaaccuaugugguuauugcgauccugacaguggucgccgcaacuauggcuaacgaaaugggcuuccucgagaagaccaaaaaggacuuuggacuuggcgggaucgccacacagcaaccagagucaaauauucuggauaucgacuugcgcccugccagugcauggacccuguacgcuguagccacuacauucauaacgcccaugcucaggcauucuauugaaaacuccagcgugaauguuucacugaccgcgaucgcuaaccaggccacugugcuuaugggacucgguaagggcuggccgcugaguaaaauggacauuggggucccauugcuggcaaucggauguuacagccaggugaauccuauaacauuaaccgccgcucuacugcuccuugucgcacacuaugccaucauuggccccggucugcaggcgaaggcuacccgggaggcccaaaaacgugcagccgcugggaucaugaagaacccaacaguggauggcauuacuguuaucgacuuggaucccauuccuuacgacccgaaauuugaaaagcagcugggacaggugaugcuccugguacuuugcgugacgcaggucuuaaugaugagaaccacaugggcccugugugaggcacucacuuuggcuaccggccccaucuccacacugugggaagggaauccaggaagguucuggaacaccacuauagccguuucuauggcgaauauuuuucgcggcagcuaucuagccggugcagggcuacucuucuccaucaugaagaacacggcuaacacacggcgaggaaccggcaauacuggugagacccuuggcgagaaauggaagaacagacugaaugccuuggggaaaucagaauuucaaaucuacaagaaaucuggcauucaggagguggauaggacacuggcaaaggaaggcauaaaacgcggggagacugaccaucacgcugucagucggggaucggccaagcucagaugguucguggagcguaaccugguaaccccugaaggcaaggugauggauuuagguugcgggaggggaggcuggagcuauuacugugguggccuuaaaaauguuaaggaggugaaagggcugacaaagggaggccccgggcaugaagaaccuaucccaauguccacguauggauggaaccucguccggcuacagucuggcguggacgucuucuuuacaccaccugaaaaaugcgauacucuguugugugacauuggugagucaagcccaaaucccacaguggaggccgggcgcacccugcgaguucucaaccuuguagaaaauuggcugaacaauaacacucaauucugcaucaagguguugaauccguacaugccuuccgucauugagaagauggaagcgcugcagagaaaauacggaggcgcucucgugaggaacccauuaaguagaaauucuacacacgagauguauuggguuagcaacgcaucaggcaacaucguguccagugucaauaugauaagccgcaugcugaucaacagauuuaccaugaggcacaagaaagccacguacgaacccgauguggaccuugggucuggaacccgaaauauugguaucgaguccgagacaccuaaccuggauauuaucggcaagcggauagagaaaauuaagcaggaacaugaaacuucauggcacuaugaccaggaccauccauacaagaccugggcuuaucacgggagcuacgagacaaaacaaacuggaucggccucuaguaugguaaauggcgugguucgucuacucaccaagcccugggaugucaucccgauggugacacagauggcaaugaccgacacuacgccuuucggucagcagagaguguuuaaagucaagguugauacacgcacccaagaacccaaagaggggacuaagaagcugaugaaaaucaccgccgagugguuguggaaggaacugggcaagaagaaaacaccaaggauguguacgcgggaggaguucaccagaaaggugcgcuccaacgcugcgcucggcgccauuuuuacugacgagaauaaauggaaaagcgcaagggaggcuguagaagauucaggcuucugggagcuuguggacaaggaacgaaaccugcacuuagaggggaaaugcgaaacaugugucuauaauaugaugggaaagcgggagaaaaagcugggugaguuuggcaaagccaagggguccagagcaauaugguacaugugguugggagccagguuccucgaauuugaggcucugggcuuccuaaacgaagaucauugguuuucucgcgagaauagccuuagugguguggaaggggagggacugcacaagcucggcuacauccugcgugacguuuccaaaaaggagggcggggccauguaugcggaugacaccgcaggaugggauacucggauuacauuggaagaccugaaaaacgaggaaauggugaccaaucauauggagggugaacacaagaaacucgccgaggcuaucuucaaacuuacauaccagaacaaggucgugagaguacagaggccuacuccccgcggcaccguuauggacauuaucagccgacgggaucagagagggucuggacaaguggucacguauggccugaauaccuucacaaacauggaggcccaguuaauaaggcagauggaaggugaggggguguuuaaaucaauccaacagcugacugcaaccgaagagauugcugugaagaacugguuggcccgcgucggaagagagcggcucaguaggauggcuaucuccggcgacgauugcguugugaaaccacuggacgaucguuucgccagcgcacuaacagcgcuuaaugacaugggcaagguacgaaaagauauucagcagugggaacccucucgcggguggaacgacuggacucaagugccuuuuugcucgcaucacuuccacgagcugaucaugaaggauggaagaguccucgugguuccaugucggaaucaggacgaacugauugguagggcccgcauaucacagggcgcuggguggagcuugagagagaccgccugcuuaggaaaguccuacgcacagauguggagucugauguauuuucaucggagggaucuccgacuugcugccaacgcaaucuguucugccgugccgagccacuggguccccacgucccguacaaccuggucaauucaugcgacucacgaauggaugacaaccgaggacaugcugacuguguggaauagaguauggauccaagagaacccuuggaucgaagauaaaaccccaguugagaguugggaagagauucccuaccuaggcaagcgcgaagaccaguggugcgguucucugauagggcucacaagccgggcuacgugggccaaaaauauccagaccgcaauuaaccaggugagguccuugaucggaaaugaggaguauacugacuacaugccuucaaugaagagauuccgccgggaagaggaagaggccggcguccugugguga

SEQ ID NO: 15052 - RNA, 9876 nt, Artificial Sequence
  derived and/or modified CDS sequence (opt3) from DENV-2__DQ645550__SS-prME
accgcaggagugaucauuaugaugauacccaccguaguugcuuuccaccugacuacgcggaauggggaaccucauaugaucgugagcaggcaggaaaagggaaaaucccuccuuuuuaagaccgaaaaugguguaaauaugugcacacugauggcaauggacuugggagaauuaugugaggauacuauuaccuacaauugcccacugcuucggcaaaacgaaccggaggacaucgauuguuggugcaauucuacaucaaccugggugacuuaugggacauguaccgccacgggagagcaccgccgagaaaaacguagugucgcgcucgugccccauguuggcaugggucuggagacuagaaccgaaacauggaugagcuccgagggggcuuggaagcacgcccagaggauugagacuugggugcuucggcauccuggauucaccaucauggcagccauacuggcuuacacaaucggcaccacguauuuucagcgcgucuugauuuucauccuccugacugcaguggccccaucuaugacaaugagaugcauuggcaucucgaacagggacuuuguagaagggguuucaggagguagcuggguggauauaguccuggagcacggcaguugugugaccacuauggcuaaaaauaagcccacacucgacuucgaauuaauuaagaccgaggccaaacacccugcgacgcugcggaaguacugcaucgaagcaaaacuuaccaacacaacuaccgccucccgcuguccaacacagggggagcccucuuugaaugaggaacaagauaagcgauuugugugcaaacauagcauggucgacagaggauggggcaacgguugugggcuguucggaaagggcggcauuguuacuugcgcuauguuuaccugcaagaaaaauauggaggggaaggugguacagccugaaaaccuagaguauacaaucgugaucaccccacacuccggagaagagaaugccgucgguaacgauacuggcaaacaugggaaggagauuaaagugacgccgcagucaaguauaacagaagcagagcucaccggauacggcacuguuaccauggaauguagccccaggacaggucuggacuucaaugagauggugcuucugcagauggaagauaaggcuugguugguccaccggcaaugguuucucgaccugccuuuaccauggcugcccggggccgauacccagggcucuaacuggauccagaaagagacucucgugacauucaagaacccucacgcgaagaaacaggacguaguugugcuuggaucccaagagggcgccaugcauacggcacugaccggggcuacugaaauucagaugucaagcggaaauuugcuauuuacaggucaccugaagugccgucuccgcauggacaaacugcagcuuaagggcaugaguuauucuauguguaccgggaaauucaaggucgugaaggagaucgccgaaacacaacauggaacuauagucauuagagugcaguacgagggcgaugguuccccaugcaaaauccccuucgagaucauggaccuggaaaagaggcacguuuuggggcggcucauuaccgugaacccgaucguaacggagaaagauagcccugucaauauugaagcugagcccccauuuggcgacucguacauaaucauuggaguggaaccuggccagcugaaguuaucuugguucaaaaagggguccucaaucggacagauguuugagaccacaaugcgaggugccaagcgcauggcaauccugggcgauacugccugggacuucgggagucuaggaggcguuuuuaccagcauugguaaagcucuccaucaaguguucggggcgauauauggcgcagccuuuuccggagucucuuggacaaugaagauccugauuggcgugguaaucacuuggauugggaugaacagcagaucaaccagucuuuccgugagcuugguucuggucggaguggugacgcucuaccugggcgucaugguucaggcugauucugguuguguggugucauggaaaaauaaggagcuuaaaugcgggaguggaaucuucauaacagacaacguacacaccuggacugaacaguauaaguuucagcccgagagcccauccaagcuggccucugcaauccaaaaagcccacgaagagggcauuugugguaucaggucggucacacgguuggaaaaucucauguggaagcagauuacccccgagcugaaccauaucuuaagcgagaaugaagugaaacugacuauaaugaccggcgauauuaaggggaucaugcaggcuggaaaacgcucccuaagaccucagccaacagagcucaaguacucauggaaagccuggggcaaggcaaagaugcugaguacggaacuucacaaccauaccuucuugauugacgggccggagacugcggaaugccccaauacaaacagggcuuggaacucucuggagguugaggauuauggauuuggcguguucaccacaaacaucuggcucaaacugaaggaacgucaagacgucuuuugugacagcaaauuaauguccgccgcaauaaaggauaaucgggccgugcacgcugacauggguuacuggaucgagucagcccugaacgauacuuggaaaauugaaaaggccagcuucaucgagguuaagucuugccacuggccuaaaucccauacccuuuggaguaacgggguguuggagagcgaaaugauuaucccaaagaauuucgcuggacccguaucucagcacaacuaucgaccuggcuaccauacgcagacagccgguccauggcaccucggcaaacuggagauggacuuugauuucugugaagggaccacugucguggugaccgaggacugcggaaauagaggccccucccuaaggacaacuaccgcgucagggaagcugauaacagaauggugcugucgcaguugcacgcucccgccucugcgguacagaggagaggauggcuguugguaugguauggagauuaggccacuuaaagaaaaggaggaaaacuuggucaauagccugguuaccgccgggcauggacagaucgacaacuuuucguuaggcgugcucgguauggcucuguuccuugaggaaaugcugcgcacucgaguaggcacaaagcacgcaaucuugcucguggccgucuccuuugugacccugauuacugggaauaugucuuuccgggaucuaggacguguuauggugauggucggcgcuacaaugaccgacgauaucgggaugggagugacguaccuggcccuccuggcagcguuuaaaguuagacccacuuucgccgcuggccuuuugcugaggaaguuaaccagcaaagagcucaugaugacaaccauugguauagugcugcuuucacaaaguacuaucccugagacaauucuggaacuaaccgacgcccucgcacuggggaugauggucuugaagaucguacgcaacauggagaaauaucagcuggcugugacaauuauggccaucuuaugcguucccaaugcagugauacuccagaacgccuggaaggucuccuguacuauccuggcugugguaucugugagcccacuucuguugaccuccucacaacagaaggcggauuggauuccucucgcccugacgaucaaaggacuaaaucccacagcaauuuuucugaccacucuuagccggaccaguaagaaaagaucuuggccacucaacgaagcuaucauggccgucggcaugguuuccauacuggccagcucguugcugaagaaugacauuccgaugacaggcccuuuaguggcugggggacuccugacugugugcuacguccuuaccgguaggucagcagaccuggaguuggaacgagccgcggaugugcgcugggaggagcaggcugaaaucucuggcaguucccccauccucagcauuacgauaucugaggacgggagcauguccaucaaaaacgaagaggaggaacagacacugaccauucuaauccggacuggacugcuuguuauuucaggccucuucccaguaaguauccccauaacagccgcagccugguaucugugggaggugaagaaacaaagagcuggugucuugugggaugugccuagcccacccccuguugggaaggcagaauuagaggacggagccuacaggaucaagcagaaaggcauucugggcuauucucagaucggggcgggaguguacaaggaagguaccuuucacacuauguggcaugucacacguggcgcugugcucaugcacaaagggaagcgcauugagccguccugggccgaugucaagaaggaccugaucucauacggaggcgguuggaaacuugagggggaauggaaagagggagaagagguccaggugcuggcauuggaaccaggcaagaauccccgggccguucaaaccaaaccuggccuauucaagacgaacacugggaccauaggagcugugagucuggauuuuagcccagguacauccggcucucccauugucgacaaaaaggggaaggugguuggacucuauggcaacgguguggucaccagaucggggacauacgugagcgccaucgcacagacugagaaaucaaucgaggauaauccugaaauugaggacgauaucuucaggaagaaacgacugaccauaauggaccuucauccgggagcuggcaagacgaaacgguauuuacccgccauuguacgcgaagcgaucaagagaggccugaggacacucauuuuggccccaacucgggugguugcagcugagauggaagaggcccugcgagggcucccuaucagauaccagacccccgcuauacgcgcagagcacacaggaagggaaauugucgaucugaugugucaugccaccuucacuaugcgucuucuguccccaauccgggugccuaacuauaauuugaucauuauggacgaggcccacuuuaccgaccccgcuaguaucgcggcaagagguuacauuucuacaaggguggaaaugggcgaggccgcugggauauucaugacggccacuccaccgggaagccgcgauccuuuuccccaguccaacgcaccaaucauggacgaggaacgagagauucccgaaagaucauggaacucuggccacgagugggucaccgauuucaaggguaaaacaguaugguuugugccuagcaucaaggccgggaacgacaucgcugcgugccuacggaaaaauggaaagaaaguuauucaacugaguaggaagaccuucgauuccgaauaugugaagacucgcacaaacgacugggauuuugucgugaccacggacauaagcgagaugggcgccaauuucaaagcagagcguguuaucgauccaagacgguguaugaagcccgugauucucacugacggcgaagagagggucaucuuagcugggccuaugccggugacacauucuucagccgcacagcgccgaggaagaguaggucggaaccccaagaaugaaaacgaucaguacauuuacaugggcgagccccuggaaaaugacgaggacugcgcccacuggaaggaggcuaaaaugcuucuggauaacaucaauaccccugaagggauaauccccuccauguuugagccagaaagggagaagguggacgccauugauggagaauaucgccucagaggcgaggcgaggaaaaccuucguugacuugaugcggcguggugaucugccugucuggcucgcauaccgcguggccgcugaggggaucaacuaugccgaccgaagaugguguuuugauggcgugaagaacaaucaaauucuggaagagaacgucgaaguugagaucuggacuaaggagggagaaaggaagaaacuuaaaccccgguggcuagacgcucgcauauacagugauccacuggcauugaaagaguucaaagaguucgccgcuggcagaaagagcuuaacacugaaucucauuaccgagauggggaggcugccuacauuuaugacucagaaggcccggaacgcacuugacaaucuggcggugcuccauacggccgaagcuggaggucgagccuauaaccacgcauugucggagcugccggagacccuagaaacacugcuccuucugacuuuauuggcuaccguaacaggcgggaucuuccuguuucucaugucuggaaaaggcauugguaagaugacccuggggaugugcugcaucauaacugccuccgugcuucugugguacgcacagauccagccccacuggauugccgcuagcaucauucucgaguucuuuuugaucguccuguuaauaccagaaccugagaaacaaagaacgccccaggauaaucagcuaaccuaugugguuauugcgauccugacaguggucgccgcaacuauggcuaacgaaaugggcuuccucgagaagaccaaaaaggacuuuggacuuggcgggaucgccacacagcaaccagagucaaauauucuggauaucgacuugcgcccugccagugcauggacccuguacgcuguagccacuacauucauaacgcccaugcucaggcauucuauugaaaacuccagcgugaauguuucacugaccgcgaucgcuaaccaggccacugugcuuaugggacucgguaagggcuggccgcugaguaaaauggacauuggggucccauugcuggcaaucggauguuacagccaggugaauccuauaacauuaaccgccgcucuacugcuccuugucgcacacuaugccaucauuggccccggucugcaggcgaaggcuacccgggaggcccaaaaacgugcagccgcugggaucaugaagaacccaacaguggauggcauuacuguuaucgacuuggaucccauuccuuacgacccgaaauuugaaaagcagcugggacaggugaugcuccugguacuuugcgugacgcaggucuuaaugaugagaaccacaugggcccugugugaggcacucacuuuggcuaccggccccaucuccacacugugggaagggaauccaggaaggcuauggaacaccacuauagccguuucuauggcgaauauuuuccgcggcagcuaucuggccggugcagggcuccuauuuuccaucaugaagaacacggcuaacacacggcgaggaaccggcaauacuggugagacccugggcgagaaauggaagaacagauugaaugcccuggggaaaucagaguuccaaaucuacaagaaaucuggcauucaggagguggauaggacacucgcaaaggaaggcauaaaacgcggggagacugaccaucacgcugucagucggggaucggccaagcugagaugguuuguggagcguaacuuaguaaccccugaaggcaaggugauggaucuugguugcgggaggggaggcuggagcuauuacugugguggccugaaaaauguuaaggaggugaaagggcucacaaagggaggccccgggcaugaagaaccuaucccaauguccacguauggauggaaccuaguccggcugcagucuggcguggacgucuucuucacaccaccugaaaaaugcgauacuuugcugugugacauuggugagucaagcccaaaucccacaguggaggccgggcgcacccuccgaguucuuaaccugguagaaaauugguugaacaauaacacucaauuuugcaucaaggugcugaauccguacaugccuuccgucauugagaagauggaagcgcuccagagaaaauacggaggcgcuuuagugaggaacccacugaguagaaauucuacacacgagauguauuggguuagcaacgcaucaggcaacaucguguccagugucaauaugauaagccgcaugcuuaucaacagauucaccaugaggcacaagaaagccacguacgaacccgauguggaccuggggucuggaacccgaaauauugguaucgaguccgagacaccuaaccuagauauuaucggcaagcggauagagaaaauuaagcaggaacaugaaacuucauggcacuaugaccaggaccauccauacaagaccugggcuuaucacgggagcuacgagacaaaacaaacuggaucggccucuaguaugguaaauggcgugguucgucuccugaccaagcccugggaugucaucccgauggugacacagauggcaaugaccgacacuacgccuuuuggucagcagagaguguucaaagucaagguugauacacgcacccaagaacccaaagaggggacuaagaaguugaugaaaaucaccgccgaguggcuguggaaggaacucggcaagaagaaaacaccaaggauguguacgcgggaggaauuuaccagaaaggugcgcuccaacgcugcgcuuggcgccauuuucacugacgagaauaaauggaaaagcgcaagggaggcuguagaagauucaggcuuuugggagcugguggacaaggaacgaaacuuacaccuggaggggaaaugcgaaacaugugucuauaauaugaugggaaagcgggagaaaaaguugggugaguucggcaaagccaagggguccagagcaauaugguacauguggcucggagccagguuucuggaguucgaggcucuaggcuuucuuaacgaagaucauugguucucucgcgagaauagccugagugguguggaaggggagggacuccacaagcugggcuacaucuugcgugacguuuccaaaaaggagggcggggccauguaugcggaugacaccgcaggaugggauacucggauuacacuggaagaccucaaaaacgaggaaauggugaccaaucauauggagggugaacacaagaaacuugccgaggcuaucuuuaagcugacauaccagaacaaggucgugagaguacagaggccuacuccccgcggcaccguuauggacauuaucagccgacgggaucagagagggucuggacaaguggucacguauggcuuaaauaccuucacaaacauggaggcccagcugauaaggcagauggaaggugaggggguguucaaaucaauccaacaguugacugcaaccgaagagauugcugugaagaacuggcucgcccgcgucggaagagagcggcugaguaggauggcuaucuccggcgacgauugcguugugaaaccacuagacgaucguuuugccagcgcacuuacagcgcugaaugacaugggcaagguacgaaaagauauucagcagugggaacccucucgcggguggaacgacuggacucaagugccuuucugcucgcaucacuuucacgagcucaucaugaaggauggaagaguccuggugguuccaugucggaaucaggacgaauugauugguagggcccgcauaucacagggcgcuggguggagcuuaagagagaccgccugccugggaaaguccuacgcacagauguggagucucauguauuuccaucggagggaucuucgacuggcugccaacgcaaucuguucugccgugccgagccacuggguccccacgucccguacaaccuggucaauucaugcgacucacgaauggaugacaaccgaggacaugcuaacuguguggaauagaguauggauccaagagaacccuuggaucgaagauaaaaccccaguugagaguugggaagagauucccuaccugggcaagcgcgaagaccaguggugcgguucucucauaggguugacaagccgggcuacgugggccaaaaauauccagaccgcaauuaaccaggugaggucccugaucggaaaugaggaguauacugacuacaugccuucaaugaagagauuucgccgggaagaggaagaggccggcguccuuugguga

SEQ ID NO: 15053 - RNA, 9876 nt, Artificial Sequence
  derived and/or modified CDS sequence (opt3) from DENV-2__DQ645551__SS-prME
accgcaggagugaucauuaugaugauacccaccguaguugcuuuccaccugacuacgcggaauggggagccucauaugaucgugagcaggcaggaaaagggaaaaucccuccuuuuuaagaccgagaaugguguaaauaugugcacacugauggcaauggacuugggagaauuaugugaggauacuauuaccuacaauugcccacugcugcggcaaaacgaaccggaggacaucgauuguuggugcaauucuacaucaaccugggugacuuaugggacauguaccgccacgggagagcaccgccgagaaaaacguagugucgcgcucgugccccauguuggcaugggucuggagacuagaaccgaaacauggaugagcuccgagggggcuuggaagcacgcccagaggauugagacuugggugcuucggcauccuggauucaccaucauggcagccauacuggcuuacacaaucggcaccacguauuuucagcgcgucuugauuuucauccuccugacugcaguggccccaucuaugacaaugagaugcauuggcaucucgaacagggacuuuguagaagggguuucaggagguagcuggguggauauaguccuggagcacggcaguugugugaccacuauggcuaaaaauaagcccacacucgacuucgaauuaauuaagaccgaggccaaacacccugcgacgcugcggaaguacugcaucgaagcaaaacuuaccaacacaacuaccgccucccgcuguccaacacagggggagcccucuuugaaugaggaacaagauaagcgauuugugugcaaacauagcauggucgacagaggauggggcaacgguugugggcuguucggaaagggcggcauuguuacuugcgcuauguuuaccugcaagaaaaauauggaggggaaggugguacagccugaaaaccuagaguauacaaucgugaucaccccacacuccggagaagagaaugccgucgguaacgauacuggcaaacaugggaaggagauuaaagugacgccgcagucaaguauaacagaagcagagcucaccggauacggcacuguuaccauggaauguagccccaggacaggucuggacuucaaugagauggugcuucugcagauggaagauaaggcuugguugguccaccggcaaugguuucucgaccugccuuuaccauggcugcccggggccgauacccagggcucuaacuggauccagaaagagacucucgugacauucaagaacccucacgcgaagaaacaggacguaguugugcuuggaucccaagagggcgccaugcauacggcacugaccggggcuacugaaauucagaugucaagcggaaauuugcuauuuacaggucaccugaagugccgucuccgcauggacaaacugcagcuuaagggcaugaguuauucuauguguaccgggaaauucaaggucgugaaggagaucgccgaaacacaacauggaacuauagucauuagagugcaguacgagggcgaugguuccccaugcaaaauccccuucgagaucauggaccuggaaaagaggcacguuuuggggcggcucauuaccgugaacccgaucguaacggagaaagauagcccugucaauauugaagcugagcccccauuuggcgacucguacauaaucauuggaguggaaccuggccagcugaaguuaucuugguucaaaaagggguccucaaucggacagauguuugagaccacaaugcgaggugccaagcgcauggcaauccugggcgauacugccugggacuucgggagucuaggaggcguuuuuaccagcauugguaaagcucuccaucaaguguucggggcgauauauggcgcagccuuuuccggagucucuuggacaaugaagauccugauuggcgugguaaucacuuggauugggaugaacagcagaucaaccagucuuuccgugagcuugguucuggucggaguggugacgcucuaccugggcgucaugguucaggcugauucugguuguguggugucauggaaaaauaaggagcuuaaaugcgggaguggaaucuucauaacagacaacguacacaccuggacugaacaguauaaguuucagcccgagagcccauccaagcuggccucugcaauccaaaaagcccacgaagagggcauuugugguaucaggucggucacacgguuggaaaaucucauguggaagcagauuacccccgagcugaaccauaucuuaagcgagaaugaagugaaacugacuauaaugaccggcgauauuaaggggaucaugcaggcuggaaaacgcucccuaagaccucagccaacagagcucaaguacucauggaaagccuggggcaaggcaaagaugcugaguacggaacuucacaaccauaccuucuugauugacgggccggagacugcggaaugccccaauacaaacagggcuuggaacucucuggagguugaggauuauggauuuggcguguucaccacaaacaucuggcucaaacugaaggaacgucaagacgucuuuugugacagcaaauuaauguccgccgcaauaaaggauaaucgggccgugcacgcugacauggguuacuggaucgagucagcccugaacgauacuuggaaaauugaaaaggccagcuucaucgagguuaagucuugccacuggccuaaaucccauacccuuuggaguaacgggguguuggagagcgaaaugauuaucccaaagaauuucgcuggacccguaucucagcacaacuaucgaccuggcuaccauacgcagacagccgguccauggcaccucggcaaacuggagauggacuuugauuucugugaagggaccacugucguggugaccgaggacugcggaaauagaggccccucccuaaggacaacuaccgcgucagggaagcugauaacagaauggugcugucgcaguugcacgcucccgccucugcgguacagaggagaggauggcuguugguaugguauggagauuaggccacuuaaagaaaaggaggaaaacuuggucaauagccugguuaccgccgggcauggacagaucgacaacuuuucguuaggcgugcucgguauggcucuguuccuugaggaaaugcugcgcacucgaguaggcacaaagcacgcaaucuugcucguggccgucuccuuugugacccugauuacugggaauaugucuuuccgggaucuaggacguguuauggugauggucggcgcuacaaugaccgacgauaucgggaugggagugacguaccuggcccuccuggcagcguuuaaaguuagacccacuuucgccgcuggccuuuugcugaggaaguuaaccagcaaagagcucaugaugacaaccauugguauagugcugcuuucacaaaguacuaucccugagacaauucuggaacuaaccgacgcccucgcacuggggaugauggucuugaagaucguacgcaacauggagaaauaucagcuggcugugacaauuauggccaucuuaugcguucccaaugcagugauacuccagaacgccuggaaggucuccuguacuauccuggcugugguaucugugagcccacuucuguugaccuccucacaacagaaggcggauuggauuccucucgcccugacgaucaaaggacuaaaucccacagcaauuuuucugaccacucuuagccggaccaguaagaaaagaucuuggccacucaacgaagcuaucauggccgucggcaugguuuccauacuggccagcucguugcugaagaaugacauuccgaugacaggcccuuuaguggcugggggacuccugacugugugcuacguccuuaccgguaggucagcagaccuggaguuggaacgagccgcggaugugcgcugggaggagcaggcugaaaucucuggcaguucccccauccucagcauuacgauaucugaggacgggagcauguccaucaaaaacgaagaggaggaacagacacugaccauucuaauccggacuggacugcuuguuauuucaggccucuucccaguaaguauccccauaacagccgcagccugguaucugugggaggugaagaaacaaagagcuggugucuugugggaugugccuagcccacccccuguugggaaggcagaauuagaggacggagccuacaggaucaagcagaaaggcauucugggcuauucucagaucggggcgggaguguacaaggaagguaccuuucacacuauguggcaugucacacguggcgcugugcucaugcacaaagggaagcgcauugagccguccugggccgaugucaagaaggaccugaucucauacggaggcgguuggaaacuugagggggaauggaaagagggagaagagguccaggugcuggcauuggaaccaggcaagaauccccgggccguucaaaccaaaccuggccuauucaagacgaacacugggaccauaggagcugugagucuggauuuuagcccagguacauccggcucucccauugucgacaaaaaggggaaggugguuggacucuauggcaacgguguggucaccagaucggggacauacgugagcgccaucgcacagacugagaaaucaaucgaggauaauccugaaauugaggacgauaucuucaggaagaaacgacugaccauaauggaccuucauccgggagcuggcaagacgaaacgguauuuacccgccauuguacgcgaagcgaucaagagaggccugaggacacucauuuuggccccaacucgggugguugcagcugagauggaagaggcccugcgagggcucccuaucagauaccagacccccgcuauacgcgcagagcacacaggaagggaaauugucgaucugaugugucaugccaccuucacuaugcgucuucuguccccaauccgggugccuaacuauaauuugaucauuauggacgaggcccacuuuaccgaccccgcuaguaucgcggcaagagguuacauuucuacaaggguggaaaugggcgaggccgcugggauauucaugacggccacuccaccgggaagccgcgauccuuuuccccaguccaacgcaccaaucauggacgaggaacgagagauucccgaaagaucauggaacucuggccacgagugggucaccgauuucaaggguaaaacaguaugguuugugccuagcaucaaggccgggaacgacaucgcugcgugccuacggaaaaauggaaagaaaguuauucaacugaguaggaagaccuucgauuccgaauaugugaagacucgcacaaacgacugggauuuugucgugaccacggacauaagcgagaugggcgccaauuucaaagcagagcguguuaucgauccaagacgguguaugaagcccgugauucucacugacggcgaagagagggucaucuuagcugggccuaugccggugacacauucuucagccgcacagcgccgaggaagaguaggucggaaccccaagaaugaaaacgaucaguacauuuacaugggcgagccccuggaaaaugacgaggacugcgcccacuggaaggaggcuaaaaugcuucuggauaacaucaauaccccugaagggauaauccccuccauguuugagccagaaagggagaagguggacgccauugauggagaauaucgccucagaggcgaggcgaggaaaaccuucguugacuugaugcggcguggugaucugccugucuggcucgcauaccgcguggccgcugaggggaucaacuauacugaccgaagaugguguuuugauggcgugaagaacaaucaaauucuggaagagaacgucgaaguugagaucuggacaaaggagggagaaaggaagaaacuuaaaccccgguggcuagacgcccgcauauacagugauccacuggcuuugaaagaguucaaagaguucgcagccggcagaaagagcuuaacccugaaucucauuacagagauggggaggcugccuacuuuuaugacgcagaaggcucggaacgcccuugacaaucuggcagugcuccauaccgcggaagccggaggucgagcuuauaaccacgccuugucggagcugccggagacacuagaaacucugcuccuucugaccuuauuggcaacaguaaccggcgggaucuuccuguuucucaugucuggaaaaggcauugguaagaugacucuggggaugugcugcaucauaacggcuuccgugcuucugugguacgcccagauccagccccacuggauugcagccagcaucauucucgaguucuuuuugaucguccuguuaauaccagaaccugagaaacaaagaacaccacaggauaaucagcuaacauaugugguuauugcuauccugacuguggucgcggccaccauggcaaacgaaaugggcuuccucgagaagaccaagaaggacuuuggacuuggcgggaucgcuacccagcaaccagagucaaauauucuggauaucgacuugcgcccugccagugccuggacucuguacgcaguagcuacaacguucauaacccccaugcucaggcauucuauugaaaacuccagcgugaauguuucacugacugccaucgcgaaccaggcuacagugcuuaugggacucgguaagggcuggccgcugaguaaaauggacauuggggucccauugcuggccaucggauguuacagccaggugaauccuauaaccuuaaccgcagcccuacugcuccuugucgcucacuaugcaaucauuggccccggucugcaggccaaggcgacacgggaggcucaaaaacgugccgcagccgggaucaugaagaacccaacuguggauggcauuacgguuaucgacuuggaucccauuccuuacgacccgaaauuugaaaagcagcugggacaggugaugcuccugguacuuugcgugacccaggucuuaaugaugagaacaacuugggcucugugugaggcccucaccuuggcaacaggccccaucuccacccugugggaagggaauccaggaagguucuggaacacuacgauagcuguuucuauggccaauauuuuucgcggcagcuaucuagcgggugccgggcuacucuucuccaucaugaagaacacagcaaacacccggcgaggaacuggcaauaccggugagacacuuggcgagaaauggaagaacagacugaaugcuuuggggaaaucagaauuucaaaucuacaagaaaucuggcauucaggagguggauaggacucuggccaaggaaggcauaaaacgcggggagaccgaccaucacgcagucagucggggaucggcuaagcucagaugguucguggagcguaaccugguaacaccugaaggcaaggugauggauuuagguugcgggaggggaggcuggagcuauuacugugguggccuuaaaaauguuaaggaggugaaagggcugacgaagggaggccccgggcaugaagaaccuaucccaauguccaccuauggauggaaccucguccggcuacagucuggcguggacgucuucuuuacucccccugaaaaaugcgauacacuguugugugacauuggugagucaagcccaaaucccaccguggaggccgggcgcacucugcgaguucucaaccuuguagaaaauuggcugaacaauaacacacaauucugcaucaagguguugaauccguacaugccuuccgucauugagaagauggaagcccugcagagaaaauacggaggcgcgcucgugaggaacccauuaaguagaaauucuacccacgagauguauuggguuagcaacgcuucaggcaacaucguguccagugucaauaugauaagccgcaugcugaucaacagauuuacgaugaggcacaagaaagcaaccuacgaacccgauguggaccuugggucuggaacacgaaauauugguaucgaguccgagacuccuaaccuggauauuaucggcaagcggauagagaaaauuaagcaggaacaugaaaccucauggcacuaugaccaggaccauccauacaagacaugggccuaucacgggagcuacgagacuaaacaaaccggaucggcuucuaguaugguaaauggcgugguucgucuacucacaaagcccugggaugucaucccgauggugacccagauggccaugacugacacgacaccuuucggucagcagagaguguuuaaagaaaaggucgauacccgcacucaagagcccaaagaggggaccaagaagcugaugaaaaucacagcagaaugguuguggaaggagcugggcaagaagaaaacgccaaggauguguacccgggaagaguucacuagaaagguucgcuccaacgccgcucucggcgcgauuuuuacagacgagaauaaauggaaaagcgccagggaagcaguggaggauucaggcuucugggaacuuguagacaaggagcgaaaccugcacuuagaagggaaaugcgagaccuguguguauaauaugaugggaaagcgggagaaaaagcugggugaauuuggcaaagcuaagggguccagagccauaugguacaugugguugggagcaagguuccucgaguuugaagcccugggcuuccuaaacgaggaucauugguuuucucgcgaaaauagccuuaguggugucgagggggagggacugcacaagcucggcuacauccugcgugacguguccaaaaaggaaggcggggcuauguaugccgaugacacugcgggaugggauacacggauuaccuuggaggaccugaaaaacgaagagaugguuacaaaucauauggaaggugagcacaagaaacucgcagaggccaucuucaaacuuacuuaccagaacaagguggucagagugcagaggccuacaccccgcggcacgguaauggacauuaucagccgacgggaucagagagggucuggacaaguugugaccuauggccugaauacauucacuaacauggaagcucaguuaauaaggcagauggagggugaaggggucuuuaaaucaauccaacagcugaccgccacagaggagauugcagugaagaacugguuggcucgcgugggaagagaacggcucaguaggauggccaucuccggcgacgauugcgucguuaaaccacuggacgaucguuucgcuagcgcccuaacugcacuuaaugacaugggcaaggugcgaaaagauauucagcagugggagcccucucgcggguggaacgacuggacccaaguaccuuuuugcucgcaucacuuccacgaacugaucaugaaggauggaagagugcucgucgugccaugucggaaucaggacgagcugauugguagggcgcgcauaucacagggcgccggguggagcuugagagaaacggcuugcuuaggaaaguccuacgcccagauguggagucugauguauuuucaucggagggaucuccgacuugcagcuaacgccaucuguucugcaguuccgagccacugggugcccacaucccguaccacuuggucaauucaugccacacacgaguggaugaccacugaggacaugcugaccgucuggaauagaguguggauccaagaaaacccuuggaucgaggauaaaacaccaguagaaaguugggaggaaauucccuaccuaggcaagcgcgaggaccaguggugcgguucucugauagggcucacgagccgggcgaccugggcuaaaaauauccagacugccauuaaccagguuagguccuugaucggaaaugaggaauauacagacuacaugccuucaaugaagagauuccgccgggaggaagaggaagcaggcgugcugugguga

SEQ ID NO: 15054 - RNA, 9876 nt, Artificial Sequence
  derived and/or modified CDS sequence (opt3) from DENV-2__DQ645552__SS-prME
accgcaggagugaucauuaugaugauacccaccguaguugcuuuccaccugacuacgcggaauggggagccucauaugaucgugagcaggcaggaaaagggaaagucccuccuuuuuaagaccgagaaugguguaaauaugugcacacugauggcaauggacuugggagaauuaugugaggauacuauuaccuacaauugcccacugcugcggcaaaacgaaccggaggacaucgauuguuggugcaauucuacaucaaccugggugacuuaugggacauguaccgccacgggagagcaccgccgagaaaaacguagugucgcgcucgugccccauguuggcaugggucuggagacuagaaccgaaacauggaugagcuccgagggggcuuggaagcacgcccagaggauugagacuugggugcuucggcauccuggauucaccaucauggcagccauacuggcuuacacaaucggcaccacguauuuucagcgcgucuugauuuucauccuccugacugcaguggccccaucuaugacaaugagaugcauuggcaucucgaacagggacuuuguagaagggguuucaggagguagcuggguggauauaguccuggagcacggcaguugugugaccacuauggcuaaaaauaagcccacacucgacuucgaauuaauuaagaccgaggccaaacacccugcgacgcugcggaaguacugcaucgaagcaaaacuuaccaacacaacuaccgccucccgcuguccaacacagggggagcccucuuugaaugaggaacaagauaagcgauuugugugcaaacauagcauggucgacagaggauggggcaacgguugugggcuguucggaaagggcggcauuguuacuugcgcuauguuuaccugcaagaaaaauauggaggggaaggugguacagccugaaaaccuagaguauacaaucgugaucaccccacacuccggagaagagaaugccgucgguaacgauacuggcaaacaugggaaggagauuaaagugacgccgcagucaaguauaacagaagcagagcucaccggauacggcacuguuaccauggaauguagccccaggacaggucuggacuucaaugagauggugcuucugcagauggaagauaaggcuugguugguccaccggcaaugguuucucgaccugccuuuaccauggcugcccggggccgauacccagggcucuaacuggauccagaaagagacucucgugacauucaagaacccucacgcgaagaaacaggacguaguugugcuuggaucccaagagggcgccaugcauacggcacugaccggggcuacugaaauucagaugucaagcggaaauuugcuauuuacaggucaccugaagugccgucuccgcauggacaaacugcagcuuaagggcaugaguuauucuauguguaccgggaaauucaaggucgugaaggagaucgccgaaacacaacauggaacuauagucauuagagugcaguacgagggcgaugguuccccaugcaaaauccccuucgagaucauggaccuggaaaagaggcacguuuuggggcggcucauuaccgugaacccgaucguaacggagaaagauagcccugucaauauugaagcugagcccccauuuggcgacucguacauaaucauuggaguggaaccuggccagcugaaguuaucuugguucaaaaagggguccucaaucggacagauguuugagaccacaaugcgaggugccaagcgcauggcaauccugggcgauacugccugggacuucgggagucuaggaggcguuuuuaccagcauugguaaagcucuccaucaaguguucggggcgauauauggcgcagccuuuuccggagucucuuggacaaugaagauccugauuggcgugguaaucacuuggauugggaugaacagcagaucaaccagucuuuccgugagcuugguucuggucggaguggugacgcucuaccugggcgucaugguucaggcugauucugguuguguggugucauggaaaaauaaggagcuuaaaugcgggaguggaaucuucauaacagacaacguacacaccuggacugaacaguauaaguuucagcccgagagcccauccaagcuggccucugcaauccaaaaagcccacgaagagggcauuugugguaucaggucggucacacgguuggaaaaucucauguggaagcagauuacccccgagcugaaccauaucuuaagcgagaaugaagugaaacugacuauaaugaccggcgauauuaaggggaucaugcaggcuggaaaacgcucccuaagaccucagccaacagagcucaaguacucauggaaagccuggggcaaggcaaagaugcugaguacggaacuucacaaccauaccuucuugauugacgggccggagacugcggaaugccccaauacaaacagggcuuggaacucucuggagguugaggauuauggauuuggcguguucaccacaaacaucuggcucaaacugaaggaacgucaagacgucuuuugugacagcaaauuaauguccgccgcaauaaaggauaaucgggccgugcacgcugacauggguuacuggaucgagucagcccugaacgauacuuggaaaauugaaaaggccagcuucaucgagguuaagucuugccacuggccuaaaucccauacccuuuggaguaacgggguguuggagagcgaaaugauuaucccaaagaauuucgcuggacccguaucucagcacaacuaucgaccuggcuaccauacgcagacagccgguccauggcaccucggcaaacuggagauggacuuugauuucugugaagggaccacugucguggugaccgaggacugcggaaauagaggccccucccuaaggacaacuaccgcgucagggaagcugauaacagaauggugcugucgcaguugcacgcucccgccucugcgguacagaggagaggauggcuguugguaugguauggagauuaggccacuuaaagaaaaggaggaaaacuuggucaauagccugguuaccgccgggcauggacagaucgacaacuuuucguuaggcgugcucgguauggcucuguuccuugaggaaaugcugcgcacucgaguaggcacaaagcacgcaaucuugcucguggccgucuccuuugugacccugauuacugggaauaugucuuuccgggaucuaggacguguuauggugauggucggcgcuacaaugaccgacgauaucgggaugggagugacguaccuggcccuccuggcagcguuuaaaguuagacccacuuucgccgcuggccuuuugcugaggaaguuaaccagcaaagagcucaugaugacaaccauugguauagugcugcuuucacaaaguacuaucccugagacaauucuggaacuaaccgacgcccucgcacuggggaugauggucuugaagaucguacgcaacauggagaaauaucagcuggcugugacaauuauggccaucuuaugcguucccaaugcagugauacuccagaacgccuggaaggucuccuguacuauccuggcugugguaucugugagcccacuucuguugaccuccucacaacagaaggcggauuggauuccucucgcccugacgaucaaaggacuaaaucccacagcaauuuuucugaccacucuuagccggaccaguaagaaaagaucuuggccacucaacgaagcuaucauggccgucggcaugguuuccauacuggccagcucguugcugaagaaugacauuccgaugacaggcccuuuaguggcugggggacuccugacugugugcuacguccuuaccgguaggucagcagaccuggaguuggaacgagccgcggaugugcgcugggaggagcaggcugaaaucucuggcaguucccccauccucagcauuacgauaucugaggacgggagcauguccaucaaaaacgaagaggaggaacagacacugaccauucuaauccggacuggacugcuuguuauuucaggccucuucccaguaaguauccccauaacagccgcagccugguaucugugggaggugaagaaacaaagagcuggugucuugugggaugugccuagcccacccccuguugggaaggcagaauuagaggacggagccuacaggaucaagcagaaaggcauucugggcuauucucagaucggggcgggaguguacaaggaagguaccuuucacacuauguggcaugucacacguggcgcugugcucaugcacaaagggaagcgcauugagccguccugggccgaugucaagaaggaccugaucucauacggaggcgguuggaaacuugagggggaauggaaagagggagaagagguccaggugcuggcauuggaaccaggcaagaauccccgggccguucaaaccaaaccuggccuauucaagacgaacacugggaccauaggagcugugagucuggauuuuagcccagguacauccggcucucccauugucgacaaaaaggggaaggugguuggacucuauggcaacgguguggucaccagaucggggacauacgugagcgccaucgcacagacugagaaaucaaucgaggauaauccugaaauugaggacgauaucuucaggaagaaacgacugaccauaauggaccuucauccgggagcuggcaagacgaaacgguauuuacccgccauuguacgcgaagcgaucaagagaggccugaggacacucauuuuggccccaacucgggugguugcagcugagauggaagaggcccugcgagggcucccuaucagauaccagacccccgcuauacgcgcagagcacacaggaagggaaauugucgaucugaugugucaugccaccuucacuaugcgucuucuguccccaauccgggugccuaacuauaauuugaucauuauggacgaggcccacuuuaccgaccccgcuaguaucgcggcaagagguuacauuucuacaaggguggaaaugggcgaggccgcugggauauucaugacggccacuccaccgggaagccgcgauccuuuuccccaguccaacgcaccaaucauggacgaggaacgagagauucccgaaagaucauggaacucuggccacgagugggucaccgauuucaaggguaaaacaguaugguuugugccuagcaucaaggccgggaacgacaucgcugcgugccuacggaaaaauggaaagaaaguuauucaacugaguaggaagaccuucgauuccgaauaugugaagacucgcacaaacgacugggauuuugucgugaccacggacauaagcgagaugggcgccaauuucaaagcagagcguguuaucgauccaagacgguguaugaagcccgugauucucacugacggcgaagagagggucaucuuagcugggccuaugccggugacacauucuucagccgcacagcgccgaggaagaguaggucggaaccccaagaaugaaaacgaucaguacauuuacaugggcgagccccuggaaaaugacgaggacugcgcccacuggaaggaggcuaaaaugcuucuggauaacaucaauaccccugaagggauaauccccuccauguuugagccagaaagggagaagguggacgccauugauggagaauaucgccucagaggcgaggcgaggaaaaccuucguugacuugaugcggcguggugaucugccugucuggcucgcauaccgcguggccgcugaggggaucaacuaugccgaccgaagaugguguuuugauggcgugaagaacaaucaaauucuggaagagaacgucgaaguugagaucuggacuaaggagggagaaaggaagaaacuuaaaccccgguggcuagacgcucgcauauacagugauccacuggcauugaaagaguucaaagaguucgccgcuggcagaaagagcuuaacacugaaucucauuaccgagauggggaggcugccuacauuuaugacucagaaggcccggaacgcacuugacaaucuggcggugcuccauacggccgaagcuggaggucgagccuauaaccacgcauugucggagcugccggagacccuagaaacacugcuccuucugacuuuauuggcuaccguaacaggcgggaucuuccuguuucucaugucuggaaaaggcauugguaagaugacccuggggaugugcugcaucauaacugccuccgugcuucugugguacgcacagauccagccccacuggauugccgcuagcaucauucucgaguucuuuuugaucguccuguuaauaccagaaccugagaaacaaagaacgccccaggauaaucagcuaaccuaugugguuauugcgauccugacaguggucgccgcaacuauggcuaacgaaaugggcuuccucgagaagaccaaaaaggacuuuggacuuggcgggaucgccacacagcaaccagagucaaauauucuggauaucgacuugcgcccugccagugcauggacccuguacgcuguagccacuacauucauaacgcccaugcucaggcauucuauugaaaacuccagcgugaauguuucacugaccgcgaucgcuaaccaggccacugugcuuaugggacucgguaagggcuggccgcugaguaaaauggacauuggggucccauugcuggcaaucggauguuacagccaggugaauccuauaacauuaaccgccgcucuacugcuccuugucgcacacuaugccaucauuggccccggucugcaggcgaaggcuacccgggaggcccaaaaacgugcagccgcugggaucaugaagaacccaacaguggauggcauuacuguuaucgacuuggaucccauuccuuacgacccgaaauuugaaaagcagcugggacaggugaugcuccugguacuuugcgugacgcaggucuuaaugaugagaaccacaugggcccugugugaggcacucacuuuggcuaccggccccaucuccacacugugggaagggaauccaggaagguucuggaacaccacuauagccguuucuauggcgaauauuuuucgcggcagcuaucuagccggugcagggcuacucuucuccaucaugaagaacacggcuaacacacggcgaggaaccggcaauacuggugagacccuuggcgagaaauggaagaacagacugaaugccuuggggaaaucagaauuucaaaucuacaagaaaucuggcauucaggagguggauaggacacuggcaaaggaaggcauaaaacgcggggagacugaccaucacgcugucagucggggaucggccaagcucagaugguucguggagcguaaccugguaaccccugaaggcaaggugauggauuuagguugcgggaggggaggcuggagcuauuacugugguggccuuaaaaauguuaaggaggugaaagggcugacaaagggaggccccgggcaugaagaaccuaucccaauguccacguauggauggaaccucguccggcuacagucuggcguggacgucuucuuuacaccaccugaaaaaugcgauacucuguugugugacauuggugagucaagcccaaaucccacaguggaggccgggcgcacccugcgaguucucaaccuuguagaaaauuggcugaacaauaacacucaauucugcaucaagguguugaauccguacaugccuuccgucauugagaagauggaagcgcugcagagaaaauacggaggcgcucucgugaggaacccauuaaguagaaauucuacacacgagauguauuggguuagcaacgcaucaggcaacaucguguccagugucaauaugauaagccgcaugcugaucaacagauuuaccaugaggcacaagaaagccacguacgaacccgauguggaccuugggucuggaacccgaaauauugguaucgaguccgagacaccuaaccuggauauuaucggcaagcggauagagaaaauuaagcaggaacaugaaacuucauggcacuaugaccaggaccauccauacaagaccugggcuuaucacgggagcuacgagacaaaacaaacuggaucggccucuaguaugguaaauggcgugguucgucuacucaccaagcccugggaugucaucccgauggugacacagauggcaaugaccgacacuacgccuuucggucagcagagaguguuuaaagaaaaggucgauacacgcacccaagagcccaaagaggggacuaagaagcugaugaaaaucaccgccgaaugguuguggaaggagcugggcaagaagaaaacaccaaggauguguacgcgggaagaguucaccagaaagguucgcuccaacgcugcgcucggcgccauuuuuacugacgagaauaaauggaaaagcgcaagggaagcuguggaggauucaggcuucugggaacuuguagacaaggagcgaaaccugcacuuagaagggaaaugcgagacauguguguauaauaugaugggaaagcgggagaaaaagcugggugaauuuggcaaagccaagggguccagagcaauaugguacaugugguugggagccagguuccucgaguuugaagcucugggcuuccuaaacgaggaucauugguuuucucgcgaaaauagccuuaguggugucgagggggagggacugcacaagcucggcuacauccugcgugacguguccaaaaaggaaggcggggccauguaugcggaugacaccgcaggaugggauacucggauuacauuggaggaccugaaaaacgaagagaugguuaccaaucauauggaaggugagcacaagaaacucgccgaggcuaucuucaaacuuacauaccagaacaagguggucagagugcagaggccuacuagccgcggcaccguaauggacauuaucucucgacgggaucagagagggucaggacaaguugugacguauggccugaauaccuucacaaacauggaagcccaguuaauaaggcagauggagggugaaggggucuuuaaaaguauccaacagcugacugcaaccgaggagauugcugugaagaacugguuggcccgcgugggaagagaacggcucuccaggauggcuaucagcggcgacgauugcgucguuaaaccccuggacgaucguuucgccucugcacuaacagcgcuuaaugacaugggcaaggugcgaaaagauauucagcagugggagccaucgcgcggguggaacgacuggacucaaguacccuuuugcucacaucacuuccacgaacugaucaugaaggauggaagagugcucgucgugccuugucggaaucaggacgagcugauugguagggcccgcauaagccagggcgcugggugguccuugagagaaaccgccugcuuaggaaagaguuacgcacagauguggucucugauguauuuucaucggagggaucuccgacuugcugccaacgcaaucuguagcgccguuccaucccacugggugccgacgucacguacaaccuggaguauucaugcgacucacgaguggaugacaaccgaggacaugcugacugucuggaauagaguguggauccaagaaaaccccuggaucgaggauaaaaccccuguagaaucuugggaggaaauuccauaccuaggcaagcgcgaggaccaguggugcgguagccugauagggcucacaucccgggcuacgugggccaaaaauauccagaccgcaauuaaccagguuaggucauugaucggaaaugaggaauauacugacuacaugcccagcaugaagagauuccgccgggaggaagaggaagccggcgugcugugguga

SEQ ID NO: 15055 - RNA, 9876 nt, Artificial Sequence
  derived and/or modified CDS sequence (opt3) from DENV-2__DQ645553__SS-prME
accgcaggagugaucauuaugaugauacccacaguaguugcuuuccaccugacuacgcggaauggggagccucauaugaucgugagcaggcaggaaaagggaaaaucccuccuuuuuaagaccgagaaugguguaaauaugugcacacugauggcaauggacuugggagaauuaugugaggauacuauuaccuacaauugcccacuguuacggcaaaacgaaccggaggacaucgauuguuggugcaauucuacaucaaccugggugacuuaugggacauguaccgcaacgggagagcaccgccgagaaaaacguagcgucgcgcucgugccccauguuggcaugggucuggagacuagaaccgaaacauggaugagcuccgagggggcuuggaagcacgcccagaggauugagacuugggugcuucggcauccuggauucaccaucauggcagccauacuggcuuacacaaucggcaccacguauuuucagcgcgucuugauuuucauccuccugacugcaguggccccaucuaugacaaugagaugcauuggcaucucgaacagggacuuuguagaagggguuucaggagguagcuggguggauauaguccuggagcacggcaguugugugaccacuauggcuaaaaauaagcccacacucgacuucgaauuaauuaagaccgaggccaaacacccugcgacgcugcggaaguacugcaucgaagcaaaacuuaccaacacaacuaccgccucccgcuguccaacacagggggagcccucuuugaaugaggaacaagauaagcgauuugugugcaaacauagcauggucgacagaggauggggcaacgguugugggcuguucggaaagggcggcauuguuacuugcgcuauguuuaccugcaagaaaaauauggaggggaaggugguacagccugaaaaccuagaguauacaaucgugaucaccccacacuccggagaagagaaugccgucgguaacgauacuggcaaacaugggaaggagauuaaagugacgccgcagucaaguauaacagaagcagagcucaccggauacggcacuguuaccauggaauguagccccaggacaggucuggacuucaaugagauggugcuucugcagauggaagauaaggcuugguugguccaccggcaaugguuucucgaccugccuuuaccauggcugcccggggccgauacccagggcucuaacuggauccagaaagagacucucgugacauucaagaacccucacgcgaagaaacaggacguaguugugcuuggaucccaagagggcgccaugcauacggcacugaccggggcuacugaaauucagaugucaagcggaaauuugcuauuuacaggucaccugaagugccgucuccgcauggacaaacugcagcuuaagggcaugaguuauucuauguguaccgggaaauucaaggucgugaaggagaucgccgaaacacaacauggaacuauagucauuagagugcaguacgagggcgaugguuccccaugcaaaauccccuucgagaucauggaccuggaaaagaggcacguuuuggggcggcucauuaccgugaacccgaucguaacggagaaagauagcccugucaauauugaagcugagcccccauuuggcgacucguacauaaucauuggaguggaaccuggccagcugaaguuaucuugguucaaaaagggguccucaaucggacagauguuugagaccacaaugcgaggugccaagcgcauggcaauccugggcgauacugccugggacuucgggagucccggaggcguuuuuaccagcauugguaaagcucuacaucaaguguucggggcgauauauggcgcagccuuuuccggagucucuuggacaaugaagauccucauuggcgugguaaucacuuggauugggaugaacagcagaucaaccagucuguccgugagccuuguuuuggucggaguggugacgcuguaccucggcgucaugguucaggcugauucugguuguguggugucauggaaaaauaaggagcugaaaugcgggaguggaaucuucauaacagacaacguacacaccuggacugaacaguauaaguuucagccagagagccccuccaaacuugccucugcaauccaaaaagcccacgaagagggcauuugugguaucaggucggucacacggcuggaaaauuugauguggaagcagauuaccccugagcucaaccauauccugagcgagaaugaagugaaauuaacuauaaugaccggcgauauuaaggggaucaugcaggcuggaaaacgcucccugagaccacagccgacagagcuaaaguacucauggaaagccuggggcaaggcaaagaugcucaguacggaacugcacaaccauaccuuccuuauugacgggcccgagacugcggaaugcccuaauacaaacagggcuuggaacucuuuggagguugaggauuauggauuuggcguguucaccacaaacaucuggcugaaacucaaggaacgucaagacgucuuuugugacagcaaacugauguccgccgcaauaaaggauaaucgggccgugcacgcugacauggguuacuggaucgagucagccuuaaacgauacuuggaaaauugaaaaggccagcuucaucgagguuaagucuugccacuggccaaaaucccauacccuguggaguaacggggugcuugagagcgaaaugauuauccccaagaauuucgcuggaccuguaucucagcacaacuaucgaccaggcuaccauacgcagacagccggucccuggcacuugggcaaacucgagauggacuuugauuucugugaagggaccacugucguggugaccgaggacugcggaaauagaggcccgucccugaggacaacuaccgcgucagggaagcuaauaacagaauggugcugucgcaguugcacgcugccuccacuccgguacagaggagaggauggcuguugguaugguauggagauuaggccccugaaagaaaaggaggaaaaccuugucaauagcuugguuaccgccgggcauggacagaucgacaacuuuucgcugggcguguuagguauggcucucuuccuggaggaaaugcuucgcacucgaguaggcacaaagcacgcaauccuguugguggccgucuccuuugugacccucauuacugggaauaugucuuuccgggaucugggacguguuauggugauggucggcgcuacaaugaccgacgauaucgggaugggagugacguaccuagcccugcucgcagcguuuaaaguuagaccuacuuucgccgcuggccugcuuuugaggaagcugaccagcaaagaguuaaugaugacaaccauugguauagugcuccugucacaaaguacuauccccgagacaauucuugaacugaccgacgcccuagcacucgggaugaugguccugaagaucguacgcaacauggagaaauaucaguuggcugugacaauuauggccauccugugcguuccaaaugcagugauauuacagaacgccuggaaggucuccuguacuauccucgcugugguaucugugagcccucugcuucugaccuccucacaacagaaggcggauuggauucccuuggcccucacgaucaaaggacugaauccaacagcaauuuuucuaaccacucugagccggaccaguaagaaaagaucuuggccgcuuaacgaagcuaucauggccgucggcaugguuuccauacucgccagcucgcuguugaagaaugacauuccuaugacaggcccccugguggcugggggauuacucacugugugcuacguccugaccgguaggucagcagaccuugagcuggaacgagccgcggaugugcgcugggaggagcaggcugaaaucucuggcaguuccccaaucuugagcauuacgauaucugaggacgggagcauguccaucaaaaacgaagaggaggaacagacacucaccauucugauccggacuggacuacugguuauuucaggccuuuuccccguaaguaucccuauaacagccgcagccugguaucucugggaggugaagaaacaaagagcugguguccugugggaugugccaagucccccuccgguugggaaggcagaauuggaggacggagccuacaggaucaagcagaaaggcauuuuaggcuauucucagaucggggcgggaguguacaaggaagguaccuuucacacuauguggcaugucacacguggcgcugugcugaugcacaaagggaagcgcauugagccauccugggccgaugucaagaaggaccucaucucauacggaggcgguuggaagcuggagggggaauggaaagagggagaagagguccaggugcuugcacuggaacccggcaagaauccucgggccguucaaaccaaaccaggcuuguucaagacgaacacugggaccauaggagcugugagucuagauuuuagccccgguacauccggcucuccuauugucgacaaaaaggggaaggugguuggacuguauggcaacgguguggucaccagaucggggacauacgugagcgccaucgcacagacugagaaaucaaucgaggauaauccggaaauugaggacgauaucuucaggaagaaacgacucaccauaauggaccugcaucccggagcuggcaagacgaaacgguaucuuccagccauuguacgcgaagcgaucaagagaggcuuaaggacacugauucucgccccuacucgggugguugcagcugagauggaagaggccuugcgagggcugcccaucagauaccagaccccagcuauacgcgcagagcacacaggaagggaaauugucgaucucaugugucaugccaccuucacuaugcgucugcuuuccccuauccgggugcccaacuauaaucugaucauuauggacgaggcccacuuuaccgacccagcuaguaucgcggcaagagguuacauuucuacaaggguggaaaugggcgaggccgcugggauauucaugacggccacuccgccuggaagccgcgaucccuuuccacaguccaacgcacccaucauggacgaggaacgagagauuccugaaagaucauggaacucuggccacgagugggucaccgauuucaaggguaaaacaguaugguuugugccaagcaucaaggccgggaacgacaucgcugcgugcuugcggaaaaauggaaagaaaguuauucaacuaaguaggaagaccuucgauuccgaauaugugaagacucgcacaaacgacugggauuuugucgugaccacggacauaagcgagaugggcgccaauuucaaagcagagcguguuaucgaucccagacgguguaugaagccugugauucugacugacggcgaagagagggucauccucgcugggccgaugccagugacacauucuucagccgcacagcgccgaggaagaguaggucggaaccccaaaaaugaaaacgaucaguacauuuacaugggcgagccuuuagaaaaugacgaggacugcgcccacuggaaggaggcuaaaaugcugcuugauaacaucaauacccccgaagggauaaucccauccauguuugagccugaaagggagaagguggacgccauugauggagaauaucgccugagaggcgaggcgaggaaaaccuucguugaccucaugcggcguggugauuugcccgucuggcuggcauaccgcguggccgcugaggggaucaacuaugccgaccgaagaugguguuuugauggcgugaagaacaaucaaauucucgaagagaacgucgaaguugagaucuggacuaaggagggagaaaggaaaaagcugaaaccacgguggcuugacgcucgcauauacagugauccucuagcacugaaggaguucaaagaguucgccgcuggcagaaagagcuugacauuaaaucugauuaccgagauggggaggcucccgacauuuaugacucagaaggcccggaacgcacuggacaaucuugcggugcugcauacggccgaagcuggaggucgagccuauaaccacgcacucucggaguugcccgagacccuggaaacacuacugcuccuuacucuguuagcuaccguaacaggcgggaucuucuuguuucugaugucuggaaaaggcauugguaagaugacccucgggaugugcugcaucauaacugccuccgugcugcuuugguacgcacagauccagccacacuggauugccgcuagcaucauucuggaguucuuucucaucgucuugcugauaccugaacccgagaaacaaagaacgccacaggauaaucaguuaaccuaugugguuauugcgauccuaacaguggucgccgcaacuauggcuaacgaaaugggcuuccuggagaagaccaaaaaggacuuuggacucggcgggaucgccacacagcaaccugagucaaauauucuugauaucgaccugcgccccgccagugcauggaccuuguacgcuguagccacuacauucauaacgccgaugcugaggcauucuauugaaaacuccagcgugaauguuucacucaccgcgaucgcuaaccaggccacugugcugaugggacuugguaagggcuggccacucaguaaaauggacauuggggucccucuguuggcaaucggauguuacagccaggugaaucccauaacacugaccgccgcuuuacuacugcucgucgcacacuaugccaucauuggcccaggucuucaggcgaaggcuacccgggaggcccaaaaacgugcagccgcugggaucaugaagaaccccacaguggauggcauuacuguuaucgaccuggauccuauuccguacgaccccaaauuugaaaagcaguugggacaggugaugcugcucguacugugcgugacgcagguccuuaugaugagaaccacaugggccuuaugugaggcacugacucucgcuaccggcccaaucuccacauugugggaagggaauccuggaagguucuggaacaccacuauagccguuucuauggcgaauauuuuucgcggcagcuaucuggccggugcagggcuacuguucuccaucaugaagaacacggcuaacacacggcgaggaaccggcaauacuggugagacccucggcgagaaauggaagaacagacuuaaugcccuggggaaaucagaauuucaaaucuacaagaaaucuggcauucaggagguggauaggacauuggcaaaggaaggcauaaaacgcggggagacugaccaucacgcugucagucggggaucggccaagcugagaugguucguggagcguaaccucguaacccccgaaggcaaggugauggaucuggguugcgggaggggaggcuggagcuauuacugugguggccuaaagaauguuaaggaggugaaagggcuuacaaagggaggcccugggcaugaagaaccaauccccauguccacguauggauggaaccugguccggcuccagucuggcguggacgucuucuuuaccccuccagaaaaaugcgauacucuacugugugacauuggugagucaagccccaauccgacaguggaggccgggcgcaccuugcgaguucugaaccucguagaaaauuggcuuaacaauaacacucaauucugcaucaaggugcugaauccuuacaugccauccgucauugagaagauggaagcguugcagagaaaauacggaggcgcucuggugaggaacccccucaguagaaauucuacacacgagauguauuggguuagcaacgcaucaggcaacaucguguccagugucaauaugauaagccgcauguuaaucaacagauuuaccaugaggcacaagaaagccacguacgaaccugauguggaccuggggucuggaacccgaaauauugguaucgaguccgagacaccaaaccuugauauuaucggcaagcggauagagaaaauuaagcaggaacaugaaacuucauggcacuaugaccaggaccaucccuacaagaccugggcuuaucacgggagcuacgagacaaaacaaacuggaucggccucuaguaugguaaauggcgugguucgucugcuaaccaagccgugggaugucaucccuauggugacacagauggcaaugaccgacacuacgcccuucggucagcagagaguguuuaaagaaaaggucgauacacgcacccaagagccaaaagaggggacuaagaagcucaugaaaaucaccgccgaauggcuguggaaggaguugggcaaaaagaaaacaccuaggauguguacgcgggaagaguucaccagaaagguucgcuccaacgcugcgcugggcgccauuuuuacugacgagaauaaauggaaaagcgcaagggaagcuguggaggauucaggcuucugggaacucguagacaaggagcgaaaccuucaccuggaagggaaaugcgagacauguguguauaauaugaugggaaagcgggagaaaaaguuaggugaauuuggcaaagccaagggguccagagcaauaugguacauguggcugggagccagguucuuggaguuugaagcucucggcuuccugaacgaggaucauugguuuucucgcgaaaauagccuaaguggugucgagggggagggacuucacaagcugggcuacauccuccgugacguguccaaaaaggaaggcggggccauguaugcggaugacaccgcaggaugggauacucggauuacacuggaggacuugaaaaacgaagagaugguuaccaaucauauggaaggugagcacaagaaacuggccgaggcuaucuucaagcucacauaccagaacaagguggucagagugcagaggcccacuccacgcggcaccguaauggacauuaucagccgacgggaucagagagggucuggacaaguugugacguauggccuuaauaccuucacaaacauggaagcccagcugauaaggcagauggagggugaaggggucuuuaaaucaauccaacaguuaacugcaaccgaggagauugcugugaagaacuggcuggcccgcgugggaagagaacgguugaguaggauggcuaucuccggcgacgauugcgucguuaaaccccucgacgaucguuucgccagcgcacugacagcgcuaaaugacaugggcaaggugcgaaaagauauucagcagugggagccuucucgcggguggaacgacuggacucaaguaccauuuugcucgcaucacuuccacgaacuuaucaugaaggauggaagagugcuggucgugccgugucggaaucaggacgagcucauugguagggcccgcauaucacagggcgcuggguggagccugagagaaaccgccugcuugggaaaguccuacgcacagauguggaguuuaauguauuuucaucggagggaucugcgacucgcugccaacgcaaucuguucugccguucccagccacugggugccuacgucccguacaaccuggucaauucaugcgacucacgaguggaugacaaccgaggacaugcuugcugucuggaauagaguguggauccaagaaaacccauggaucgaggauaaaacucccguagaaaguugggaggaaauuccuuaccugggcaagcgcgaggaccaguggugcgguucucuaauagggcugaccagccgggccacaugggccaaaaauauccagacggccauuaaccagguuaggucccucaucggaaaugaggaauauaccgacuacaugccaucaaugaagagauuccgccgggaggaagaggaagcuggcguguugugguga

SEQ ID NO: 15056 - RNA, 9876 nt, Artificial Sequence
  derived and/or modified CDS sequence (opt3) from DENV-2__DQ645554__SS-prME
accgcaggagugaucauuaugaugauacccaccguaguugcuuuccaccugacuacgcggaauggggagccucauaugaucgugagcaggcaggaaaagggaaagucccuccuuuuuaagaccgagaaugguguaaauaugugcacacugauggcaauggacuugggagaauuaugugaggauacuauuaccuacaauugcccacugcugcggcaaaacgaaccggaggacaucgauuguuggugcaauucuacaucaaccugggugacuuaugggacauguaccgccacgggagagcaccgccgagaaaaacguagugucgcgcucgugccccauguuggcaugggucuggagacuagaaccgaaacauggaugagcuccgagggggcuuggaagcacgcccagaggauugagacuugggugcuucggcauccuggauucaccaucauggcagccauacuggcuuacacaaucggcaccacguauuuucagcgcgucuugauuuucauccuccugacugcaguggccccaucuaugacaaugagaugcauuggcaucucgaacagggacuuuguagaagggguuucaggagguagcuggguggauauaguccuggagcacggcaguugugugaccacuauggcuaaaaauaagcccacacucgacuucgaauuaauuaagaccgaggccaaacacccugcgacgcugcggaaguacugcaucgaagcaaaacuuaccaacacaacuaccgccucccgcuguccaacacagggggagcccucuuugaaugaggaacaagauaagcgauuugugugcaaacauagcauggucgacagaggauggggcaacgguugugggcuguucggaaagggcggcauuguuacuugcgcuauguuuaccugcaagaaaaauauggaggggaaggugguacagccugaaaaccuagaguauacaaucgugaucaccccacacuccggagaagagaaugccgucgguaacgauacuggcaaacaugggaaggagauuaaagugacgccgcagucaaguauaacagaagcagagcucaccggauacggcacuguuaccauggaauguagccccaggacaggucuggacuucaaugagauggugcuucugcagauggaagauaaggcuugguugguccaccggcaaugguuucucgaccugccuuuaccauggcugcccggggccgauacccagggcucuaacuggauccagaaagagacucucgugacauucaagaacccucacgcgaagaaacaggacguaguugugcuuggaucccaagagggcgccaugcauacggcacugaccggggcuacugaaauucagaugucaagcggaaauuugcuauuuacaggucaccugaagugccgucuccgcauggacaaacugcagcuuaagggcaugaguuauucuauguguaccgggaaauucaaggucgugaaggagaucgccgaaacacaacauggaacuauagucauuagagugcaguacgagggcgaugguuccccaugcaaaauccccuucgagaucauggaccuggaaaagaggcacguuuuggggcggcucauuaccgugaacccgaucguaacggagaaagauagcccugucaauauugaagcugagcccccauuuggcgacucguacauaaucauuggaguggaaccuggccagcugaaguuaucuugguucaaaaagggguccucaaucggacagauguuugagaccacaaugcgaggugccaagcgcauggcaauccugggcgauacugccugggacuucgggagucuaggaggcguuuuuaccagcauugguaaagcucuccaucaaguguucggggcgauauauggcgcagccuuuuccggagucucuuggacaaugaagauccugauuggcgugguaaucacuuggauugggaugaacagcagaucaaccagucuuuccgugagcuugguucuggucggaguggugacgcucuaccugggcgucaugguucaggcugauucugguuguguggugucauggaaaaauaaggagcuuaaaugcgggaguggaaucuucauaacagacaacguacacaccuggacugaacaguauaaguuucagcccgagagcccauccaagcuggccucugcaauccaaaaagcccacgaagagggcauuugugguaucaggucggucacacgguuggaaaaucucauguggaagcagauuacccccgagcugaaccauaucuuaagcgagaaugaagugaaacugacuauaaugaccggcgauauuaaggggaucaugcaggcuggaaaacgcucccuaagaccucagccaacagagcucaaguacucauggaaagccuggggcaaggcaaagaugcugaguacggaacuucacaaccauaccuucuugauugacgggccggagacugcggaaugccccaauacaaacagggcuuggaacucucuggagguugaggauuauggauuuggcguguucaccacaaacaucuggcucaaacugaaggaacgucaagacgucuuuugugacagcaaauuaauguccgccgcaauaaaggauaaucgggccgugcacgcugacauggguuacuggaucgagucagcccugaacgauacuuggaaaauugaaaaggccagcuucaucgagguuaagucuugccacuggccuaaaucccauacccuuuggaguaacgggguguuggagagcgaaaugauuaucccaaagaauuucgcuggacccguaucucagcacaacuaucgaccuggcuaccauacgcagacagccgguccauggcaccucggcaaacuggagauggacuuugauuucugugaagggaccacugucguggugaccgaggacugcggaaauagaggccccucccuaaggacaacuaccgcgucagggaagcugauaacagaauggugcugucgcaguugcacgcucccgccucugcgguacagaggagaggauggcuguugguaugguauggagauuaggccacuuaaagaaaaggaggaaaacuuggucaauagccugguuaccgccgggcauggacagaucgacaacuuuucguuaggcgugcucgguauggcucuguuccuugaggaaaugcugcgcacucgaguaggcacaaagcacgcaaucuugcucguggccgucuccuuugugacccugauuacugggaauaugucuuuccgggaucuaggacguguuauggugauggucggcgcuacaaugaccgacgauaucgggaugggagugacguaccuggcccuccuggcagcguuuaaaguuagacccacuuucgccgcuggccuuuugcugaggaaguuaaccagcaaagagcucaugaugacaaccauugguauagugcugcuuucacaaaguacuaucccugagacaauucuggaacuaaccgacgcccucgcacuggggaugauggucuugaagaucguacgcaacauggagaaauaucagcuggcugugacaauuauggccaucuuaugcguucccaaugcagugauacuccagaacgccuggaaggucuccuguacuauccuggcugugguaucugugagcccacuucuguugaccuccucacaacagaaggcggauuggauuccucucgcccugacgaucaaaggacuaaaucccacagcaauuuuucugaccacucuuagccggaccaguaagaaaagaucuuggccacucaacgaagcuaucauggccgucggcaugguuuccauacuggccagcucguugcugaagaaugacauuccgaugacaggcccuuuaguggcugggggacuccugacugugugcuacguccuuaccgguaggucagcagaccuggaguuggaacgagccgcggaugugcgcugggaggagcaggcugaaaucucuggcaguucccccauccucagcauuacgauaucugaggacgggagcauguccaucaaaaacgaagaggaggaacagacacugaccauucuaauccggacuggacugcuuguuauuucaggccucuucccaguaaguauccccauaacagccgcagccugguaucugugggaggugaagaaacaaagagcuggugucuugugggaugugccuagcccacccccuguugggaaggcagaauuagaggacggagccuacaggaucaagcagaaaggcauucugggcuauucucagaucggggcgggaguguacaaggaagguaccuuucacacuauguggcaugucacacguggcgcugugcucaugcacaaagggaagcgcauugagccguccugggccgaugucaagaaggaccugaucucauacggaggcgguuggaaacuugagggggaauggaaagagggagaagagguccaggugcuggcauuggaaccaggcaagaauccccgggccguucaaaccaaaccuggccuauucaagacgaacacugggaccauaggagcugugagucuggauuuuagcccagguacauccggcucucccauugucgacaaaaaggggaaggugguuggacucuauggcaacgguguggucaccagaucggggacauacgugagcgccaucgcacagacugagaaaucaaucgaggauaauccugaaauugaggacgauaucuucaggaagaaacgacugaccauaauggaccuucauccgggagcuggcaagacgaaacgguauuuacccgccauuguacgcgaagcgaucaagagaggccugaggacacucauuuuggccccaacucgggugguugcagcugagauggaagaggcccugcgagggcucccuaucagauaccagacccccgcuauacgcgcagagcacacaggaagggaaauugucgaucugaugugucaugccaccuucacuaugcgucuucuguccccaauccgggugccuaacuauaauuugaucauuauggacgaggcccacuuuaccgaccccgcuaguaucgcggcaagagguuacauuucuacaaggguggaaaugggcgaggccgcugggauauucaugacggccacuccaccgggaagccgcgauccuuuuccccaguccaacgcaccaaucauggacgaggaacgagagauucccgaaagaucauggaacucuggccacgagugggucaccgauuucaaggguaaaacaguaugguuugugccuagcaucaaggccgggaacgacaucgcugcgugccuacggaaaaauggaaagaaaguuauucaacugaguaggaagaccuucgauuccgaauaugugaagacucgcacaaacgacugggauuuugucgugaccacggacauaagcgagaugggcgccaauuucaaagcagagcguguuaucgauccaagacgguguaugaagcccgugauucucacugacggcgaagagagggucaucuuagcugggccuaugccggugacacauucuucagccgcacagcgccgaggaagaguaggucggaaccccaagaaugaaaacgaucaguacauuuacaugggcgagccccuggaaaaugacgaggacugcgcccacuggaaggaggcuaaaaugcuucuggauaacaucaauaccccugaagggauaauccccuccauguuugagccagaaagggagaagguggacgccauugauggagaauaucgccucagaggcgaggcgaggaaaaccuucguugacuugaugcggcguggugaucugccugucuggcucgcauaccgcguggccgcugaggggaucaacuaugccgaccgaagaugguguuuugauggcgugaagaacaaucaaauucuggaagagaacgucgaaguugagaucuggacuaaggagggagaaaggaagaaacuuaaaccccgguggcuagacgcucgcauauacagugauccacuggcauugaaagaguucaaagaguucgccgcuggcagaaagagcuuaacacugaaucucauuaccgagauggggaggcugccuacauuuaugacucagaaggcccggaacgcacuugacaaucuggcggugcuccauacggccgaagcuggaggucgagccuauaaccacgcauugucggagcugccggagacccuagaaacacugcuccuucugacuuuauuggcuaccguaacaggcgggaucuuccuguuucucaugucuggaaaaggcauugguaagaugacccuggggaugugcugcaucauaacugccuccgugcuucugugguacgcacagauccagccccacuggauugccgcuagcaucauucucgaguucuuuuugaucguccuguuaauaccagaaccugagaaacaaagaacgccccaggauaaucagcuaaccuaugugguuauugcgauccugacaguggucgccgcaacuauggcuaacgaaaugggcuuccucgagaagaccaaaaaggacuuuggacuuggcgggaucgccacacagcaaccagagucaaauauucuggauaucgacuugcgcccugccagugcauggacccuguacgcuguagccacuacauucauaacgcccaugcucaggcauucuauugaaaacuccagcgugaauguuucacugaccgcgaucgcuaaccaggccacugugcuuaugggacucgguaagggcuggccgcugaguaaaauggacauuggggucccauugcuggcaaucggauguuacagccaggugaauccuauaacauuaaccgccgcucuacugcuccuugucgcacacuaugccaucauuggccccggucugcaggcgaaggcuacccgggaggcccaaaaacgugcagccgcugggaucaugaagaacccaacaguggauggcauuacuguuaucgacuuggaucccauuccuuacgacccgaaauuugaaaagcagcugggacaggugaugcuccugguacuuugcgugacgcaggucuuaaugaugagaaccacaugggcccugugugaggcacucacuuuggcuaccggccccaucuccacacugugggaagggaauccaggaagguucuggaacaccacuauagccguuucuauggcgaauauuuuucgcggcagcuaucuagccggugcagggcuacucuucuccaucaugaagaacacggcuaacacacggcgaggaaccggcaauacuggugagacccuuggcgagaaauggaagaacagacugaaugccuuggggaaaucagaauuucaaaucuacaagaaaucuggcauucaggagguggauaggacacuggcaaaggaaggcauaaaacgcggggagacugaccaucacgcugucagucggggaucggccaagcucagaugguucguggagcguaaccugguaaccccugaaggcaaggugauggauuuagguugcgggaggggaggcuggagcuauuacugugguggccuuaaaaauguuaaggaggugaaagggcugacaaagggaggccccgggcaugaagaaccuaucccaauguccacguauggauggaaccucguccggcuacagucuggcguggacgucuucuuuacaccaccugaaaaaugcgauacucuguugugugacauuggugagucaagcccaaaucccacaguggaggccgggcgcacccugcgaguucucaaccuuguagaaaauuggcugaacaauaacacucaauucugcaucaagguguugaauccguacaugccuuccgucauugagaagauggaagcgcugcagagaaaauacggaggcgcucucgugaggaacccauuaaguagaaauucuacacacgagauguauuggguuagcaacgcaucaggcaacaucguguccagugucaauaugauaagccgcaugcugaucaacagauuuaccaugaggcacaagaaagccacguacgaacccgauguggaccuugggucuggaacccgaaauauugguaucgaguccgagacaccuaaccuggauauuaucggcaagcggauagagaaaauuaagcaggaacaugaaacuucauggcacuaugaccaggaccauccauacaagaccugggcuuaucacgggagcuacgagacaaaacaaacuggaucggccucuaguaugguaaauggcgugguucgucuacucaccaagcccugggaugucaucccgauggugacacagauggcaaugaccgacacuacgccuuucggucagcagagaguguuuaaagaaaaggucgauacacgcacccaagagcccaaagaggggacuaagaagcugaugaaaaucaccgccgaaugguuguggaaggagcugggcaagaagaaaacaccaaggauguguacgcgggaagaguucaccagaaagguucgcuccaacgcugcgcucggcgccauuuuuacugacgagaauaaauggaaaagcgcaagggaagcuguggaggauucaggcuucugggaacuuguagacaaggagcgaaaccugcacuuagaagggaaaugcgagacauguguguauaauaugaugggaaagcgggagaaaaagcugggugaauuuggcaaagccaagggguccagagcaauaugguacaugugguugggagccagguuccucgaguuugaagcucugggcuuccuaaacgaggaucauugguuuucucgcgaaaauagccuuaguggugucgagggggagggacugcacaagcucggcuacauccugcgugacguguccaaaaaggaaggcggggccauguaugcggaugacaccgcaggaugggauacucggauuacauuggaggaccugaaaaacgaagagaugguuaccaaucauauggaaggugagcacaagaaacucgccgaggcuaucuucaaacuuacauaccagaacaagguggucagagugcagaggccuacuccccgcggcaccguaauggacauuaucagccgacgggaucagagagggucuggacaaguugugacguauggccugaauaccuucacaaacauggaagcccaguuaauaaggcagauggagggugaaggggucuuuaaaucaauccaacagcugacugcaaccgaggagauugcugugaagaacugguuggcccgcgugggaagagaacggcucaguaggauggcuaucuccggcgacgauugcgucguuaaaccacuggacgaucguuucgccagcgcacuaacagcgcuuaaugacaugggcaagauucgaaaagauauccagcagugggagcccucucgcggguggaacgacuggacucaagugccuuuuugcucgcaucacuuccacgaacugauuaugaaggauggaagaguacucguggucccaugucggaaucaggacgagcugauagguagggcccgcaucucacagggcgcuggguggagcuugagagaaaccgccugcuuaggaaaguccuacgcacagauguggagucugauguauuuucaucggagggaucuccgacuugcugccaacgcaauuuguucugccgugccgagccacuggguucccacgucccguacaaccuggucaauccaugcgacucacgaguggaugacaaccgaggacaugcugacuguguggaauagagucuggauccaagaaaacccuuggauugaggauaaaaccccaguggaaaguugggaggaaauacccuaccuaggcaagcgcgaggaccaguggugcgguucucugaucgggcucacaagccgggcuacgugggccaaaaauauucagaccgcaaucaaccagguaagguccuugauuggaaaugaggaauauacugacuacaugccuucaaugaagagauuccgccgggaggaagaggaagccggcguucugugguga

SEQ ID NO: 15057 - RNA, 9876 nt, Artificial Sequence
  derived and/or modified CDS sequence (opt3) from DENV-2__DQ645555__SS-prME
accgcaggagugaucauuaugaugauacccaccguaguugcuuuccaccugacuacgcggaauggggaaccucauaugaucgugagcaggcaggaaaagggaaagucccuccuuuuuaagaccgaaaaugguguaaauaugugcacacugauggcaauggacuugggagaauuaugugaggauacuauuaccuacaauugcccacugcugcggcaaaacgaaccggaggacaucgauuguuggugcaauucuacaucaaccugggugacuuaugggacauguaccgccacgggagagcaccgccgagaaaaacguagugucgcgcucgugccccauguuggcaugggucuggagacuagaaccgaaacauggaugagcucccagggggcuuggaagcacgcccagaggauugagacuugggugcuucggcauccuggauucaccaucauggcagccauacuggcuuacacaaucggcaccacguauuuucagcgcgucuugauuuucauccuccugacugcaguggccccaucuaugacaaugagaugcauuggcaucucgaacagggacuuuguagaggggguuucaggagguagcuggguggauauaguccuggaacacggcaguugugugaccacuauggcuaaaaauaagcccacacucgacuucgaguuaauuaagaccgaagccaaacacccugcgacgcugcggaaguacugcaucgaggcaaaacuuaccaacacaacuaccgccucccgcuguccaacacaaggggaacccucuuugaaugaggagcaggauaagcgauuugugugcaaacauagcauggucgacagaggauggggcaacgguugugggcuguucggaaagggcggcauuguuacuugcgcuauguuuaccugcaagaaaaauauggaagggaaggugguacagccugagaaccuagaauauacaaucgugaucaccccacacuccggagaggaaaaugccgucgguaacgauacuggcaaacaugggaaggagauuaaagugacgccgcagucaaguauaacagaggcagaacucaccggauacggcacuguuaccauggaguguagccccaggacaggucuggacuucaaugaaauggugcuucugcaaauggaggauaaggcuugguugguccaccggcagugguuucucgaccugccuuuaccauggcugcccggggccgauacccagggcucuaacuggauccagaaagaaacucucgugacauucaagaacccucacgcgaagaaacaagacguaguugugcuuggaucccaggagggcgccaugcauacggcacugaccggggcuacugagauucagaugucaagcggaaauuugcuauuuacaggucaccugaagugccgucuccgcauggacaaacugcaacuuaagggcaugaguuauucuauguguaccgggaaauucaaggucgugaaggaaaucgccgagacacagcauggaacuauagucauuagagugcaguacgaaggcgaugguuccccaugcaaaauccccuucgagaucauggaccuggagaagaggcacguuuuggggcggcucauuaccgugaacccgaucguaacggaaaaagauagcccugucaauauugaggcugaacccccauuuggcgacucguacauaaucauuggaguggagccuggccagcugaaguuaucuugguucaaaaagggguccucaaucggacaaauguuugaaaccacaaugcgaggugccaagcgcauggcaauccugggcgauacugccugggacuucgggagucuaggaggcguuuuuaccagcauugguaaagcucuccaucagguguucggggcgauauauggcgcagccuuuuccggagucucuuggacaaugaagauccugauuggcgugguaaucacuuggauugggaugaacagcagaucaaccagucuuuccgugagcuugguucuggucggaguggugacgcucuaccugggcgucaugguucaggcugauucugguuguguggugucauggaaaaauaaggagcuuaaaugcgggaguggaaucuucauaacagacaacguacacaccuggacugagcaguauaaguuucaacccgaaagcccauccaagcuggccucugcaauccagaaagcccacgaggaaggcauuugugguaucaggucggucacacgguuggagaaucucauguggaagcagauuacccccgaacugaaccauaucuuaagcgagaaugaggugaaacugacuauaaugaccggcgauauuaaggggaucaugcaggcuggaaaacgcucccuaagaccucaaccaacagaacucaaguacucauggaaagccuggggcaaggcaaagaugcugaguacggagcuucacaaccauaccuucuugauugacgggccggaaacugcggagugccccaauacaaacagggcuuggaacucucuggaaguugaggauuauggauuuggcguguucaccacaaacaucuggcucaaacugaaggagcgucaggacgucuuuugugacagcaaauuaauguccgccgcaauaaaggauaaucgggccgugcacgcugacauggguuacuggaucgaaucagcccugaacgauacuuggaaaauugagaaggccagcuucaucgaaguuaagucuugccacuggccuaaaucccauacccuuuggaguaacgggguguuggagagcgagaugauuaucccaaagaauuucgcuggacccguaucucagcacaacuaucgaccuggcuaccauacgcagacagccgguccauggcaccucggcaaacuggaaauggacuuugauuucugugaggggaccacugucguggugaccgaagacugcggaaauagaggccccucccuaaggacaacuaccgcgucagggaagcugauaacagaguggugcugucgcaguugcacgcucccgccucugcgguacagaggagaagauggcuguugguaugguauggagauuaggccacuuaaagagaaggaagagaacuuggucaauagccugguuaccgccgggcauggacaaaucgacaacuuuucguuaggcgugcucgguauggcucuguuccuugaagagaugcugcgcacucgaguaggcacaaagcacgcaaucuugcucguggccgucuccuuugugacccugauuacugggaauaugucuuuccgggaucuaggacguguuauggugauggucggcgcuacaaugaccgacgauaucgggaugggagugacguaccuggcccuccuggcagcguuuaaaguuagacccacuuucgccgcuggccuuuugcugaggaaguuaaccagcaaagaacucaugaugacaaccauugguauagugcugcuuucacagaguacuaucccugagacaauucuggagcuaaccgacgcccucgcacuggggaugauggucuugaagaucguacgcaacauggaaaaauaucagcuggcugugacaauuauggccaucuuaugcguucccaaugcagugauacuccaaaacgccuggaaggucuccuguacuauccuggcugugguaucugugagcccacuucuguugaccuccucacagcagaaggcggauuggauuccucucgcccugacgaucaaaggacuaaaucccacagcaauuuuucugaccacucuuagccggaccaguaagaaaagaucuuggccacucaacgaggcuaucauggccgucggcaugguuuccauacuggccagcucguugcugaagaaugacauuccgaugacaggcccuuuaguggcugggggacuccugacugugugcuacguccuuaccgguaggucagcagaccuggaauuggagcgagccgcggaugugcgcugggaagaacaggcugagaucucuggcaguucccccauccucagcauuacgauaucugaagacgggagcauguccaucaaaaacgaggaagaggagcaaacacugaccauucuaauccggacuggacugcuuguuauuucaggccucuucccaguaaguauccccauaacagccgcagccugguaucugugggaagugaagaaacagagagcuggugucuugugggaugugccuagcccacccccuguugggaaggcagaguuagaagacggagccuacaggaucaagcagaaaggcauucugggcuauucucagaucggggcgggaguguacaaggaggguaccuuucacacuauguggcaugucacacguggcgcugugcucaugcacaaagggaagcgcauugaaccguccugggccgaugucaagaaggaccugaucucauacggaggcgguuggaaacuugagggggaguggaaagaaggagaggaaguccaagugcuggcauuggagccaggcaagaauccccgggccguucagaccaaaccuggccuauucaagacgaacacugggaccauaggagcugugagucuggauuuuagcccagguacauccggcucucccauugucgacaaaaaggggaaggugguuggacucuauggcaacgguguggucaccagaucggggacauacgugagcgccaucgcacagacugaaaaaucaaucgaggauaauccugagauugaagacgauaucuucaggaagaaacgacugaccauaauggaccuucauccgggagcuggcaagacgaaacgguauuuacccgccauuguacgcgaggcgaucaagagaggccugaggacacucauuuuggccccaacucgggugguugcagcugaaauggaggaagcccugcgagggcucccuaucagauaccagacccccgcuauacgcgcagagcacacaggaagggagauugucgaucugaugugucaugccaccuucacuaugcgucuucuguccccaauccgggugccuaacuauaauuugaucauuauggacgaagcccacuuuaccgaccccgcuaguaucgcggcaagagguuacauuucuacaaggguggagaugggcgaagccgcugggauauucaugacggccacuccaccgggaagccgcgauccuuuuccccaauccaacgcaccaaucauggacgaggagcgagaaauucccgagagaucauggaacucuggccacgaaugggucaccgauuucaaggguaaaacaguaugguuugugccuagcaucaaggccgggaacgacaucgcugcgugccuacggaaaaauggaaagaaaguuauucagcugaguaggaagaccuucgauuccgaguaugugaagacucgcacaaacgacugggauuuugucgugaccacggacauaagcgaaaugggcgccaauuucaaagcagagcguguuaucgauccaagacgguguaugaagcccgugauucucacugacggcgaggaaagggucaucuuagcugggccuaugccggugacacauucuucagccgcacagcgccgaggaagaguaggucggaaccccaagaaugagaacgaucaauacauuuacaugggcgaaccccuggagaaugacgaagacugcgcccacuggaaggaggcuaaaaugcuucuggauaacaucaauaccccugaggggauaauccccuccauguuugaaccagagagggaaaagguggacgccauugauggagaguaucgccucagaggcgaagcgaggaaaaccuucguugacuugaugcggcguggugaucugccugucuggcucgcauaccgcguggccgcugaggggaucaacuaugccgaccgaagaugguguuuugauggcgugaagaacaaucagauucuggaggaaaacgucgagguugaaaucuggacuaaggagggagagaggaagaaacuuaaaccccgguggcuagacgcucgcauauacagugauccacuggcauugaaagaguucaaagaguucgccgcuggcagaaagagcuuaacacugaaucucauuaccgaaauggggaggcugccuacauuuaugacucagaaggcccggaacgcacuugacaaucuggcggugcuccauacggccgaggcuggaggucgagccuauaaccacgcauugucggaacugccggagacccuagagacacugcuccuucugacuuuauuggcuaccguaacaggcgggaucuuccuguuucucaugucuggaaaaggcauugguaagaugacccuggggaugugcugcaucauaacugccuccgugcuucugugguacgcacagauccaaccccacuggauugccgcuagcaucauucucgaguucuuuuugaucguccuguuaauaccagagccugaaaaacagagaacgccccaggauaaucagcuaaccuaugugguuauugcgauccugacaguggucgccgcaacuauggcuaacgagaugggcuuccucgaaaagaccaaaaaggacuuuggacuuggcgggaucgccacacaacagccagagucaaauauucuggauaucgacuugcgcccugccagugcauggacccuguacgcuguagccacuacauucauaacgcccaugcucaggcauucuauugagaacuccagcgugaauguuucacugaccgcgaucgcuaaccaggccacugugcuuaugggacucgguaagggcuggccgcugaguaaaauggacauuggggucccauugcuggcaaucggauguuacagccaggugaauccuauaacauuaaccgccgcucuacugcuccuugucgcacacuaugccaucauuggccccggucugcaagcgaaggcuacccgggaagcccagaaacgugcagccgcugggaucaugaagaacccaacaguggauggcauuacuguuaucgacuuggaucccauuccuuacgacccgaaauuugagaagcagcugggacaggugaugcuccugguacuuugcgugacgcaagucuuaaugaugagaaccacaugggcccugugugaagcacucacuuuggcuaccggccccaucuccacacugugggaggggaauccaggaagguucuggaacaccacuauagccguuucuauggcgaauauuuuucgcggcagcuaucuagccggugcagggcuacucuucuccaucaugaagaacacggcuaacacacggcgaggaaccggcaauacuggugaaacccuuggcgagaaauggaagaacagacugaaugccuuggggaaaucagaguuucagaucuacaagaaaucuggcauucaggaaguggauaggacacuggcaaaggagggcauaaaacgcggggaaacugaccaucacgcugucagucggggaucggccaagcucagaugguucguggagcguaaccugguaaccccugagggcaaggugauggauuuagguugcgggaggggaggcuggagcuauuacugugguggccuuaaaaauguuaaggaagugaaagggcugacaaagggaggccccgggcaugaggaaccuaucccaauguccacguauggauggaaccucguccggcuacaaucuggcguggacgucuucuuuacaccaccugagaaaugcgauacucuguugugugacauuggugaaucaagcccaaaucccacaguggaggccgggcgcacccugcgaguucucaaccuuguagagaauuggcugaacaauaacacucaguucugcaucaagguguugaauccguacaugccuuccgucauugaaaagauggaggcgcugcagagaaaauacggaggcgcucucgugaggaacccauuaaguagaaauucuacacacgaaauguauuggguuagcaacgcaucaggcaacaucguguccagugucaauaugauaagccgcaugcugaucaacagauuuaccaugaggcacaagaaagccacguacgagcccgauguggaccuugggucuggaacccgaaauauugguaucgaauccgagacaccuaaccuggauauuaucggcaagcggauagagaaaauuaagcaggaacaugagacuucauggcacuaugaccaagaccauccauacaagaccugggcuuaucacgggagcuacgaaacaaaacagacuggaucggccucuaguaugguaaauggcgugguucgucuacucaccaagcccugggaugucaucccgauggugacacagauggcaaugaccgacacuacgccuuucggucagcaaagaguguuuaaagagaaggucgauacacgcacccaggaacccaaagaggggacuaagaagcugaugaaaaucaccgccgagugguuguggaaggaacugggcaagaagaaaacaccaaggauguguacgcgggaggaguucaccagaaagguucgcuccaacgcugcgcucggcgccauuuuuacugacgagaauaaauggaaaagcgcaagggaggcuguggaagauucaggcuucugggagcuuguagacaaggaacgaaaccugcacuuagaggggaaaugcgaaacauguguguauaauaugaugggaaagcgggagaaaaagcugggugaguuuggcaaagccaagggguccagagcaauaugguacaugugguugggagccagguuccucgaauuugaggcucugggcuuccuaaacgaagaucauugguuuucucgcgagaauagccuuaguggugucgaaggggagggacugcacaagcucggcuacauccugcgugacguguccaaaaaggagggcggggccauguaugcggaugacaccgcaggaugggauacucggauuacauuggaagaccugaaaaacgaggaaaugguuaccaaucauauggagggugaacacaagaaacucgccgaggcuaucuucaaacuuacauaccagaacaagguggucagagugcagaggccuacuccccgcggcaccguaauggacauuaucagccgacgggaucaaagagggucuggacagguugugacguauggccugaauaccuucacaaacauggaggcccaguuaauaaggcaaauggaaggugagggggucuuuaaaucaauccagcagcugacugcaaccgaagagauugcugugaagaacugguuggcccgcgugggaagagagcggcucaguaggauggcuaucuccggcgacgauugcgucguuaaaccacuggacgaucguuucgccagcgcacuaacagcgcuuaaugacaugggcaaggugcgaaaagauauucagcaaugggaacccucucgcggguggaacgacuggacucagguaccuuuuugcucgcaucacuuccacgagcugaucaugaaggauggaagagugcucgucgugccaugucggaaucaggacgaacugauugguagggcccgcauaucacagggcgcuggguggagcuugagagagaccgccugcuuaggaaaguccuacgcacaaauguggagucugauguauuuucaucggagggaucuccgacuugcugccaacgcaaucuguucugccguuccgagccacugggugcccacgucccguacaaccuggucaauucaugcgacucacgaauggaugacaaccgaggacaugcugacugucuggaauagaguguggauccaggagaacccuuggaucgaagauaaaaccccaguagagaguugggaagagauucccuaccuaggcaagcgcgaagaccaguggugcgguucucugauagggcucacaagccgggcuacgugggccaaaaauauccagaccgcaauuaaccaaguuagguccuugaucggaaaugaggaguauacugacuacaugccuucaaugaagagauuccgccgggaagaggaagaggccggcgugcugugguga

SEQ ID NO: 15058 - RNA, 9876 nt, Artificial Sequence
  derived and/or modified CDS sequence (opt3) from DENV-2__DQ645556__SS-prME
accgcaggagugaucauuaugaugauacccaccguaguugcuuuccaccugacuacgcggaauggggagccucauaugaucgugagcaggcaggaaaagggaaagucccuccuuuuuaagaccgagaaugguguaaauaugugcacacugauggcaauggacuugggagaauuaugugaggauacuauuaccuacaauugcccacugcugcggcaaaacgaaccggaggacaucgauuguuggugcaauucuacaucaaccugggugacuuaugggacauguaccgccacgggagagcaccgccgagaaaaacguagugucgcgcucgugccccauguuggcaugggucuggagacuagaaccgaaacauggaugagcuccgagggggcuuggaagcacgcccagaggauugagacuugggugcuucggcauccuggauucaccaucauggcagccauacuggcuuacacaaucggcaccacguauuuucagcgcgucuugauuuucauccuccugacugcaguggccccaucuaugacaaugagaugcauuggcaucucgaacagggacuuuguagaagggguuucaggagguagcuggguggauauaguccuggagcacggcaguugugugaccacuauggcuaaaaauaagcccacacucgacuucgaauuaauuaagaccgaggccaaacacccugcgacgcugcggaaguacugcaucgaagcaaaacuuaccaacacaacuaccgccucccgcuguccaacacagggggagcccucuuugaaugaggaacaagauaagcgauuugugugcaaacauagcauggucgacagaggauggggcaacgguugugggcuguucggaaagggcggcauuguuacuugcgcuauguuuaccugcaagaaaaauauggaggggaaggugguacagccugaaaaccuagaguauacaaucgugaucaccccacacuccggagaagagaaugccgucgguaacgauacuggcaaacaugggaaggagauuaaagugacgccgcagucaaguauaacagaagcagagcucaccggauacggcacuguuaccauggaauguagccccaggacaggucuggacuucaaugagauggugcuucugcagauggaagauaaggcuugguugguccaccggcaaugguuucucgaccugccuuuaccauggcugcccggggccgauacccagggcucuaacuggauccagaaagagacucucgugacauucaagaacccucacgcgaagaaacaggacguaguugugcuuggaucccaagagggcgccaugcauacggcacugaccggggcuacugaaauucagaugucaagcggaaauuugcuauuuacaggucaccugaagugccgucuccgcauggacaaacugcagcuuaagggcaugaguuauucuauguguaccgggaaauucaaggucgugaaggagaucgccgaaacacaacauggaacuauagucauuagagugcaguacgagggcgaugguuccccaugcaaaauccccuucgagaucauggaccuggaaaagaggcacguuuuggggcggcucauuaccgugaacccgaucguaacggagaaagauagcccugucaauauugaagcugagcccccauuuggcgacucguacauaaucauuggaguggaaccuggccagcugaaguuaucuugguucaaaaagggguccucaaucggacagauguuugagaccacaaugcgaggugccaagcgcauggcaauccugggcgauacugccugggacuucgggagucuaggaggcguuuuuaccagcauugguaaagcucuccaucaaguguucggggcgauauauggcgcagccuuuuccggagucucuuggacaaugaagauccugauuggcgugguaaucacuuggauugggaugaacagcagaucaaccagucuuuccgugagcuugguucuggucggaguggugacgcucuaccugggcgucaugguucaggcugauucugguuguguggugucauggaaaaauaaggagcuuaaaugcgggaguggaaucuucauaacagacaacguacacaccuggacugaacaguauaaguuucagcccgagagcccauccaagcuggccucugcaauccaaaaagcccacgaagagggcauuugugguaucaggucggucacacgguuggaaaaucucauguggaagcagauuacccccgagcugaaccauaucuuaagcgagaaugaagugaaacugacuauaaugaccggcgauauuaaggggaucaugcaggcuggaaaacgcucccuaagaccucagccaacagagcucaaguacucauggaaagccuggggcaaggcaaagaugcugaguacggaacuucacaaccauaccuucuugauugacgggccggagacugcggaaugccccaauacaaacagggcuuggaacucucuggagguugaggauuauggauuuggcguguucaccacaaacaucuggcucaaacugaaggaacgucaagacgucuuuugugacagcaaauuaauguccgccgcaauaaaggauaaucgggccgugcacgcugacauggguuacuggaucgagucagcccugaacgauacuuggaaaauugaaaaggccagcuucaucgagguuaagucuugccacuggccuaaaucccauacccuuuggaguaacgggguguuggagagcgaaaugauuaucccaaagaauuucgcuggacccguaucucagcacaacuaucgaccuggcuaccauacgcagacagccgguccauggcaccucggcaaacuggagauggacuuugauuucugugaagggaccacugucguggugaccgaggacugcggaaauagaggccccucccuaaggacaacuaccgcgucagggaagcugauaacagaauggugcugucgcaguugcacgcucccgccucugcgguacagaggagaggauggcuguugguaugguauggagauuaggccacuuaaagaaaaggaggaaaacuuggucaauagccugguuaccgccgggcauggacagaucgacaacuuuucguuaggcgugcucgguauggcucuguuccuugaggaaaugcugcgcacucgaguaggcacaaagcacgcaaucuugcucguggccgucuccuuugugacccugauuacugggaauaugucuuuccgggaucuaggacguguuauggugauggucggcgcuacaaugaccgacgauaucgggaugggagugacguaccuggcccuccuggcagcguuuaaaguuagacccacuuucgccgcuggccuuuugcugaggaaguuaaccagcaaagagcucaugaugacaaccauugguauagugcugcuuucacaaaguacuaucccugagacaauucuggaacuaaccgacgcccucgcacuggggaugauggucuugaagaucguacgcaacauggagaaauaucagcuggcugugacaauuauggccaucuuaugcguucccaaugcagugauacuccagaacgccuggaaggucuccuguacuauccuggcugugguaucugugagcccacuucuguugaccuccucacaacagaaggcggauuggauuccucucgcccugacgaucaaaggacuaaaucccacagcaauuuuucugaccacucuuagccggaccaguaagaaaagaucuuggccacucaacgaagcuaucauggccgucggcaugguuuccauacuggccagcucguugcugaagaaugacauuccgaugacaggcccuuuaguggcugggggacuccugacugugugcuacguccuuaccgguaggucagcagaccuggaguuggaacgagccgcggaugugcgcugggaggagcaggcugaaaucucuggcaguucccccauccucagcauuacgauaucugaggacgggagcauguccaucaaaaacgaagaggaggaacagacacugaccauucuaauccggacuggacugcuuguuauuucaggccucuucccaguaaguauccccauaacagccgcagccugguaucugugggaggugaagaaacaaagagcuggugucuugugggaugugccuagcccacccccuguugggaaggcagaauuagaggacggagccuacaggaucaagcagaaaggcauucugggcuauucucagaucggggcgggaguguacaaggaagguaccuuucacacuauguggcaugucacacguggcgcugugcucaugcacaaagggaagcgcauugagccguccugggccgaugucaagaaggaccugaucucauacggaggcgguuggaaacuugagggggaauggaaagagggagaagagguccaggugcuggcauuggaaccaggcaagaauccccgggccguucaaaccaaaccuggccuauucaagacgaacacugggaccauaggagcugugagucuggauuuuagcccagguacauccggcucucccauugucgacaaaaaggggaaggugguuggacucuauggcaacgguguggucaccagaucggggacauacgugagcgccaucgcacagacugagaaaucaaucgaggauaauccugaaauugaggacgauaucuucaggaagaaacgacugaccauaauggaccuucauccgggagcuggcaagacgaaacgguauuuacccgccauuguacgcgaagcgaucaagagaggccugaggacacucauuuuggccccaacucgggugguugcagcugagauggaagaggcccugcgagggcucccuaucagauaccagacccccgcuauacgcgcagagcacacaggaagggaaauugucgaucugaugugucaugccaccuucacuaugcgucuucuguccccaauccgggugccuaacuauaauuugaucauuauggacgaggcccacuuuaccgaccccgcuaguaucgcggcaagagguuacauuucuacaaggguggaaaugggcgaggccgcugggauauucaugacggccacuccaccgggaagccgcgauccuuuuccccaguccaacgcaccaaucauggacgaggaacgagagauucccgaaagaucauggaacucuggccacgagugggucaccgauuucaaggguaaaacaguaugguuugugccuagcaucaaggccgggaacgacaucgcugcgugccuacggaaaaauggaaagaaaguuauucaacugaguaggaagaccuucgauuccgaauaugugaagacucgcacaaacgacugggauuuugucgugaccacggacauaagcgagaugggcgccaauuucaaagcagagcguguuaucgauccaagacgguguaugaagcccgugauucucacugacggcgaagagagggucaucuuagcugggccuaugccggugacacauucuucagccgcacagcgccgaggaagaguaggucggaaccccaagaaugaaaacgaucaguacauuuacaugggcgagccccuggaaaaugacgaggacugcgcccacuggaaggaggcuaaaaugcuucuggauaacaucaauaccccugaagggauaauccccuccauguuugagccagaaagggagaagguggacgccauugauggagaauaucgccucagaggcgaggcgaggaaaaccuucguugacuugaugcggcguggugaucugccugucuggcucgcauaccgcguggccgcugaggggaucaacuaugccgaccgaagaugguguuuugauggcgugaagaacaaucaaauucuggaagagaacgucgaaguugagaucuggacuaaggagggagaaaggaagaaacuuaaaccccgguggcuagacgcucgcauauacagugauccacuggcauugaaagaguucaaagaguucgccgcuggcagaaagagcuuaacacugaaucucauuaccgagauggggaggcugccuacauuuaugacucagaaggcccggaacgcacuugacaaucuggcggugcuccauacggccgaagcuggaggucgagccuauaaccacgcauugucggagcugccggagacccuagaaacacugcuccuucugacuuuauuggcuaccguaacaggcgggaucuuccuguuucucaugucuggaaaaggcauugguaagaugacccuggggaugugcugcaucauaacugccuccgugcuucugugguacgcacagauccagccccacuggauugccgcuagcaucauucucgaguucuuuuugaucguccuguuaauaccagaaccugagaaacaaagaacgccccaggauaaucagcuaaccuaugugguuauugcgauccugacaguggucgccgcaacuauggcuaacgaaaugggcuuccucgagaagaccaaaaaggacuuuggacuuggcgggaucgccacacagcaaccagagucaaauauucuggauaucgacuugcgcccugccagugcauggacccuguacgcuguagccacuacauucauaacgcccaugcucaggcauucuauugaaaacuccagcgugaauguuucacugaccgcgaucgcuaaccaggccacugugcuuaugggacucgguaagggcuggccgcugaguaaaauggacauuggggucccauugcuggcaaucggauguuacagccaggugaauccuauaacauuaaccgccgcucuacugcuccuugucgcacacuaugccaucauuggccccggucugcaggcgaaggcuacccgggaggcccaaaaacgugcagccgcugggaucaugaagaacccaacaguggauggcauuacuguuaucgacuuggaucccauuccuuacgacccgaaauuugaaaagcagcugggacaggugaugcuccugguacuuugcgugacgcaggucuuaaugaugagaaccacaugggcccugugugaggcacucacuuuggcuaccggccccaucuccacacugugggaagggaauccaggaagguucuggaacaccacuauagccguuucuauggcgaauauuuuucgcggcagcuaucuagccggugcagggcuacucuucuccaucaugaagaacacggcuaacacacggcgaggaaccggcaauacuggugagacccuuggcgagaaauggaagaacagacugaaugccuuggggaaaucagaauuucaaaucuacaagaaaucuggcauucaggagguggauaggacacuggcaaaggaaggcauaaaacgcggggagacugaccaucacgcugucagucggggaucggccaagcucagaugguucguggagcguaaccugguaaccccugaaggcaaggugauggauuuagguugcgggaggggaggcuggagcuauuacugugguggccuuaaaaauguuaaggaggugaaagggcugacaaagggaggccccgggcaugaagaaccuaucccaauguccacguauggauggaaccucguccggcuacagucuggcguggacgucuucuuuacaccaccugaaaaaugcgauacucuguugugugacauuggugagucaagcccaaaucccacaguggaggccgggcgcacccugcgaguucucaaccuuguagaaaauuggcugaacaauaacacucaauucugcaucaagguguugaauccguacaugccuuccgucauugagaagauggaagcgcugcagagaaaauacggaggcgcucucgugaggaacccauuaaguagaaauucuacacacgagauguauuggguuagcaacgcaucaggcaacaucguguccagugucaauaugauaagccgcaugcugaucaacagauuuaccaugaggcacaagaaagccacguacgaacccgauguggaccuugggucuggaacccgaaauauugguaucgaguccgagacaccuaaccuggauauuaucggcaagcggauagagaaaauuaagcaggaacaugaaacuucauggcacuaugaccaggaccauccauacaagaccugggcuuaucacgggagcuacgagacaaaacaaacuggaucggccucuaguaugguaaauggcgugguucgucuacucaccaagcccugggaugucaucccgauggugacacagauggcaaugaccgacacuacgccuuucggucagcagagaguguuuaaagaaaaggucgauacacgcacccaagagcccaaagaggggacuaagaagcugaugaaaaucaccgccgaaugguuguggaaggagcugggcaagaagaaaacaccaaggauguguacgcgggaagaguucaccagaaagguucgcuccaacgcugcgcucggcgccauuuuuacugacgagaauaaauggaaaagcgcaagggaagcuguggaggauucaggcuucugggaacuuguagacaaggagcgaaaccugcacuuagaagggaaaugcgagacauguguguauaauaugaugggaaagcgggagaaaaagcugggugaauuuggcaaagccaagggguccagagcaauaugguacaugugguugggagccagguuccucgaguuugaagcucugggcuuccuaaacgaggaucauugguuuucucgcgaaaauagccuuaguggugucgagggggagggacugcacaagcucggcuacauccugcgugacguguccaaaaaggaaggcggggccauguaugcggaugacaccgcaggaugggauacucggauuacauuggaggaccugaaaaacgaagagaugguuaccaaucauauggaaggugagcacaagaaacucgccgaggcuaucuucaaacuuacauaccagaacaagguggucagagugcagaggccuacuccccgcggcaccguaauggacauuaucagccgacgggaucagagagggucuggacaaguugugacguauggccugaauaccuucacaaacauggaagcccaguuaauaaggcagauggagggugaaggggucuuuaaaaacauccaacagcugacugcaaccgaggagauugcugugaagaauugguuggcccgcgugggaagagaacggcucucaaggauggcuaucaguggcgacgauugcgucguuaaaccacuggacgaucguuucgccuccgcacuaacagcgcuuaacgacaugggcaaggugcgaaaagauguacagcagugggagcccagccgcggguggaaugacuggacucaagugccuuuuugcucucaucacuuccacgaacugauuaugaaggauggaagaguccucgugguuccaugucggaaccaggacgagcugaucgguagggcccgcauuucgcagggcgcuggguggucauugagagaaaccgccugcuuaggaaagagcuacgcacagauguggucccugauguauuuucaucggagggaucuccgacuugcugccaaugcaauauguagugccgugccgucucacuggguccccacgagccguacaaccugguccauccaugcgacucacgaguggaugacaaccgaggacaugcugacuguguggaacagaguauggauucaagaaaauccuuggaucgaggauaaaaccccaguugaaucaugggaggaaauccccuaccuaggcaagcgcgaggaccaguggugcgguagucugauugggcucacaucucgggcuacgugggccaaaaacauacagaccgcaaucaaucaggugaggagcuugauuggaaacgaggaauauacugacuacaugccuuccaugaagagauuccgccgggaggaagaggaagccggcguccugugguga

SEQ ID NO: 15059 - RNA, 9876 nt, Artificial Sequence
  derived and/or modified CDS sequence (opt3) from DENV-2__AF204178__SS-prME
accgccggcaugaucauuaugcugauacccacagugauggcuuuccaccucacuacgagaaacggggagccucauaugaucgucagcaggcaggaaaagggaaaaucccuucuguuuaagaccggugacggcguuaauaugugcacauugauggcaauggauccaggggaguuaugugaagacacuauuaccuacaaaugcccgcugcuaaagcaaaacgagcccgaagauaucgacuggugguguaauucuacaucaaccugggugacuuauggaacaugcaccacgacuggcgagcaccggcgcgagaaacgaaguguagcccucgugccucaugucgguauggggcuggaaacccguacagagacuuggaugagcuccgaaggagcguggaagcacgcucagagaauugagaccuggauccuuaggcauccaggcuucacaaugauggccgcaauacuggccuacaccaucggcacgacucacuuucagcgggcuuugauuuucauccuccugacagcaguggcccccucuaugaccaugcgcuguauugggaucucgaacagagauuuuguugagggagugucagguggcagcugggucgacauagugcuggaacacgggaguugcguaacuacaauggcuaagaauaaaccuacccucgauuucgaguuaauuaagacggaagccaaacagccagcgacccugaggaaguauuguaucgaggcaaaacuuacaaacacuaccacagacucccggugccccacucaaggagaaccuucuuugaaugaggagcaggauaagcgcuuuguuuguaagcauagcaugguggaccgaggcugggguaacgggugcggacuguucggcaaaggcgggauugucaccuuugccauguucacauguaagaaaaauaugaagggaaaaguggugcagccagaaaaccuagaguacaccaucgucaucacuccgcacuccggugaagagcaugcuguuggcaaugauacggggaagcacggaaaagaaauuaagauaacaccccagucaaguaucaccgaggccgagcucacuggcuaugguaccgugacaaugaagugcagcccuagaaccgggcuggacuuuaacgaaaugguacuucugcaaauggagaauaaagcaugguuggugcacaggcagugguuccucgaucugccauuacccuggcugccuggcgcugacacucagggaucuaacuggauucagaaggaaacacucgucacguuuaaaaauccacaugccaagaaacaagacgugguugugcuuggcucccaggagggggcgaugcacaccgcccugacuggagcaacagaaauccagaugucaagcgguaacuugcuauucaccggccaucugaagugccggcuccguauggauaagcugcaacuuaaagggaugaguuacucuauguguacaggaaaguucaaagucgugaaggagauagcugagacucagcacggcaccauuguaauccgcguucaguaugaaggugacgggucccccugcaaaaucccguuugagauuauggaucuggaaaagagacauguguugggcaggcucaucacggucaacccuauugugaccgagaaggacagccccgucaauauagaggccgaaccaccuuucggagauucguacaucauuaucggcguggagcccgggcagcugaaauuaaacugguuuaagaaaggaucuuccaucggucaaauguucgaaacaacuaugcggggcgcuaagcgaauggccauucugggggacaccgcaugggauuuuggaucacuaggcgguguuuucacaaguauagggaaagcccuccaccagguguuuggcgcuaucuacggagcggcauucagcggcguauccuggacuaugaagauucugaucggggucauuaucaccuggauaggaaugaauucucgcagcacgucacuuaguguguccuugguucuggugggcgucgugacacucuaucuggguguaauggugcaggccgacagcggguguguugucucuuggaagaacaaagagcuuaagugcggaucaggcaucuuuauuaccgaugacgugcacacuuggacagaacaguacaaauuccaaccagagagucccagcaagcuggcuuccgccauccagaaagcacaugaggaagguauuuguggcaucagaucugugaccagguuggagaaucucauguggaagcagauaacuccugaacugaaccacauuuuaucggagaaugaagucaaacugaccaucaugacaggggauauuaagggaaucaugcaggccggcaagcggagccuacgcccacaaccgacggagcucaaauauuccuggaagaccugggggaaagcuaagaugcugucaacugagagucauaaccagacauuucuuauagacggacccgaaaccgccgagugcccuaauacaaacagagcauggaauucuuuggaaguugaggacuacggcuucgguguguuuacuaccaacaucuggcugaaacucagggaaaagcaggauguguucugugacagcaagcugauguccgcgguaauuaaagauaaucgugcugcccacgcagacaugggguauuggaucgagucagccuuaaacgauacguggaagauugagaaagcuagcuucaucgaagucaagucuugccacuggccaaaaucccauacacuguggaguaauggagugcuugagagcgaaaugauaauucccaagaacuuugccggcccuguuucucagcacaacuaccggccagguuaucauacccaaacugcaggccccuggcacuuggggaagcucgagauggacuucgauuuuugugagggaaccacaguggucgugacugaagacugcggcaaucgagggccgucccugagaaccacaacggcuucaggaaaacuaaucaccgagugguguugcaggaguugcacucugccuccacuccgcuaccggggcgaagaugguuguugguacgggauggagaucagaccccugaaggaaaaagaggagaaccuuguuaauagcuuggugacagccggacauggccagauugacaacuucucgcuggguguauuaggcauggcgcucuuucuggaagagaugcuuaggacccgcgucgggacuaagcacgccauccuguugguggcuguguccuucgucacacucauuaccggaaauaugucuuuucgagaucugggccggguuauggugaugguaggggcaacgaugacugacgauauaggaaugggcgugaccuaucuagcccugcucgcugccuucaaaguccguccuacauuugcagcgggucugcuuuugagaaagcugaccagcaaggaauuaaugaugacuacaaucgggauugugcuccugucacagaguaccauccccgagacaauucuugaacugacugacgcccuagcucucggaaugaugguucugaaaauggugaggaagauggagaaauaccaauuggccgucaccaucauggcaauacugugcgugccaaacgcuguuaucuuacagaaugccuggaagguguccuguacgauucucgcagucguaucugugagcccucuguucaucacauccucacagcagaaagccgacuggauuccccuugcucugaccaucaagggcuugaacccaacugcgauauuucucaccacacugagccgcacuaauaaaaagcggaguuggccgcuaaacgaggccauuauggcaguuggcauggugucuauccuggcuuccagccuucucaagaaugauaucccuaugaccgggccccuggucgccggagguuugcugacggugugcuauguauuaacaggcagaucggccgaccucgaacuggagagggcugcagaugugaaaugggaagaccaagccgagauuucagggucuaguccaauacuuuccaucaccauuagcgaagauggaucuaugagcaucaagaacgaggaggaagagcagauucugacuaucuugauacgaacaggccuccuggucaucuccggucuauuccccguuucaauuccuaucaccgcggcugccugguaccugugggaagugaaaaagcagcgcgcaggggugcuuugggacgucccaagucccccuccggugggaaaagccgagcucgaggauggcgcuuaucggauuaagcagaagggcauccugggguacagccaaauaggagcagguguuuauaaagaaggcacuuuucacacaauguggcauguaaccagaggggccguguugaugcacaagggaaaaaggauugagccaucuugggcggacgucaagaaagauuuaaucuccuacggcgguggguggaagcuggaaggagaguggaaggaaggcgaggaggugcagguucucgcucuggaacccggcaaaaauccucgugccgugcagacgaagccagggcuuuucaaaacuaacgcaggaaccaucggugccgucucacuggacuucagucccggcacaagcggguccccuauuaucgauaagaaaggaaaggugguaggcuuguacgguaauggggucgugacccgcucuggagcuuauguuucggccauagcacagacagagaagagcauugaagacaacccggagaucgaagaugacauuuuucggaaaagaaagcuaacuaucauggaccugcaucccggcgcuggcaaaaccaagagguaccucccagccauagugcgagaggcgauuaaacgggggcugcgcacgcuuaucuuagccccuacaagagucguggcagcugagauggaagaggcccugaggggacuccccauccgguaucaaacuccagcuauucgagcagaacacaccgguagagagaucguugauuugaugugucaugccacauucaccaugcgccugcucucaccugugaggguccccaacuacaaucugauuauaauggacgaagcccacuuuacugauccagcuuccaucgcggcacguggcuauauuaguacccggguggagaugggggaggccgcuggaaucuucaugacagccacgccgccuggcucuagagaccccuuuccacagagcaacgcacccaucauggaugaagagagggaaauuccugagcgcuccuggucaucuggucacgaguggguaacugacuucaaggggaagaccgugugguuuguuccaagcauaaaagccggaaaugauaucgcugcgugccuucgaaagaacggcaaaaaggucauucagcugaguagaaaaacauucgacuccgaauacgugaagacccggacuaaugauugggacuuuguggucacaaccgauaucagcgagaugggcgccaacuucaaagcagaaaggguaauugacccccgccguuguaugaagccugugaucuugacggacggggaggaaagaguuauacuagcuggaccgaugccagugacucauucuucagccgcacaacggaggggucgcaucggccgaaaucccaagaacgagaaugaucaguauauuuacaugggggagccucuggaaaacgacgaggauugcgcccacuggaaagaagcuaagaugcucuuagacaauaucaacacacccgagggaauuaucccauccauguuugaaccugagagagagaaagucgaugccauagacggcgaauaccggcugaggggugaggcgcgcaagaccuucguggaucuuaugagaaggggggaccugcccguuuggcucgcauaucggguggccgcugaaggcauuaauuacgccgaucgucgcugguguuucgacggaaucaaaaacaaucagauuuuggaggaaaacgucgagguggagaucuggaccaaggaaggcgagcgaaagaaacugaagccaagauggcucgaugcuaaaauauauagugacccucuggcacuuaaggaauuuaaagaguucgccgcugggaggaagagccuaacucugaacuugaucacagagaugggacgguuaccgaccuuuaugacacagaaggcccgcgaugcacuggacaaucucgcgguacugcauacugccgaagcugguggcagagccuacaaccacgcacuuucggagcugcccgaaacgcucgagaccuugcugcuacugacacuccuugcuacugugaccgggggaauuuuccuguuuuuaaugucuggcagggguaucgggaaaaugacauugggcaugugcuguauuaucaccgccuccauacugcucugguaugcacaaauucagccacacuggaucgccgcuagcaucauucuggaauucuuucuuaucguucugcucauaccugagcccgagaagcagcggacuccacaggacaaucaauugacguacgucgugauugcgauccugaccguggucgccgcaacaauggcuaacgaaaugggauucuuagagaaaacuaagaaagaucuaggccuggggucaauuaccacacagcagccugaaaguaauauccucgacauagaucuucgacccgccucugccuggacccuguaugcaguugcuacuacauuugugacgccgauguugagacauuccaucgagaacagcucaguaaaugugagucugaccgccauugcgaaccaggcuacuguccucaugggacuggguaagggcuggccacuuagcaagauggacaucggggugccucuccuggccauuggaugcuacucccaaguuaaucccaucacauugaccgcagcccuguucuuacuaguggcucacuacgcaauuaucggcccaggucugcaggccaaagcgacccgcgaagcucagaagagggccgcagccgggauaaugaaaaaccccacagucgauggcauuacuguaaucgaccucgauccuaucccguaugaccccaaguuugagaaacagcuuggacaagugaugcuguugguucugugcgugacgcagguccucaugaugcggaccacaugggcucugugugaggcccuuacuuuagcaaccggcccaauuucuacacugugggaagggaauccuggacguuucuggaacaccacuauagcugugagcauggccaauaucuuuagaggcuccuaccucgcgggugccggguugcuguucucaauuaugaagaacacgacaaauaccaggcgcggaacuggcaacaucggugagacccuaggcgaaaaauggaagauucggcugaaugcacucgggaagucugaguuccagaucuauaaaaagaguggaauacaagaagucgaucgaacacuugcuaaagagggcaucaagagaggggagacugaccaucacgccgugucgaggggaagcgcaaaacugcgcugguuuguugaacggaacauggugacccccgagggcaagguaguggauuuggguugcgggagaggaggcugguccuacuauugugguggccugaagaacguccgugaaguuaaagggcucacaaagggaggcccugggcaugaggagccaauucccaugucuacguacggauggaaucuggugagguuacagucaggcgucgacguguucuuuaccccuccagaaaaaugcgauacucuucugugugacaucggugagagcucccccaacccgacaguagaagcugggcggacccuccgcgugcuaaaucugguugagaacugguugaauaacaauacucaguucugcauuaaggugcugaacccuuauaugccaagugucaucgaaaaaauggagacacuccagcgaaaguacggaggcgcccuugugggcaauccccugucuagaaacagcacccacgagauguacugggucucaaaugccuccgggaacauagugaguagcguuaauaugauuucuaggauguugaucaaccgguuuacgaugcgccacaagaaagcgaccuaugaaccugacguagaucugggauccgguacaagaaauaucggcauugagucagaaauaccaaaccucgacaucauugggaagaggaucgagaaaauuaagcaagaacaugagacuagcuggcacuacgaucaggaccaucccuauaaaaccugggcuuaccacggaucguaugagacaaagcagacuggcucugcaaguuccauggugaacggugucgugcgauuacugaccaagccgugggauguugugccuauggucacacagauggccaugaccgacacuacgcccuucgggcaacagcggguguuuaaagaaaagguagauacacguacccaggagccaaaagaaggaacuaagaaacuuaugaagaucaccgcugaguggcuguggaaagaacuaggcaagaagaaaacaccuagaauguguacgcgcgaggaguucaccaggaaggugcggagcaaugccgcacucggcgccauauuuacugacgaaaacaaauggaagucagcuagagaggcgguugaagauucccgcuucugggagcuggucgacaaagagaggaauuugcaccuggaagggaagugcgagacauguguguacaacaugaugggaaagcgagaaaaaaagcucggugaguuuggcaaagccaaggggucucgggcaaucugguauauguggcuuggagcuagauuccuggaauuugaggccuuaggcuuccugaaugaggaucauugguucagcagggaaaacaguuuguccgguguggagggggaaggacucuacaaacugggcuacauucuacgcgacgucagcaagaaggagggcggggcaauguaugccgacgauaccgcuggaugggacacucguaucacacuugaagaucugaaaaaugaggagaugguuaccaaccacauggaaggugagcauaagaaacucgccgaagcgauuuuuaagcugacauaccagaauaaagugguacgggugcaaagacccacuccaaggggcaccgucauggacaucauuucucgccgagaucagcgggggucaggacaggugggcacguaugguuugaacaccuucacaaauauggaggcacaacugauaagacagauggaaggggagggaguuuuuaagaguauccagcaccucacugugaccgaggaaauugccguccagaacuggcuugcuagggugcgcagagagcggcuguccaggauggccaucagcggcgacgauugcguaguuaagcccuuagacgaucguuucgcaucugcucugacagccuugaaugacaugggcaaagugcgaaaggauauccaacagugggaaccuucgcgcggguggaacgacuggacucaggucccauuuuguucacaucacuuccacgagcucauuaugaaagauggaagagugcugguggucccgugccggaaucaggacgagcuaauagguagggcucgcaucagccaaggcgccggguggucccuuagagaaaccgcaugccugggaaagaguuacgcgcagauguggucucucauguauuuucaucggagggaccugcgauuggccgcuaacgccauuuguagcgcaguucccucccacugggugccuacgucacguacaaccuggaguauccaugcuaaacacgaguggaugacuacagaagauauguuaaccguauggaacagaguguggauucaggagaauccauggauggaagacaagacucccgucgagucuugggaggaaaucccuuaccugggcaagcgcgaggaucaguggugcgguagccucauagggcuuaccucccgggccacaugggcaaaaaacauccaaacggccauuaaucaggugaggucacugaucggaaacgaagaguauaccgacuacaugccaagcaugaagagauuccgccgggaagaggaggaagcgggcguucuaugguga

SEQ ID NO: 15060 - RNA, 9876 nt, Artificial Sequence
  derived and/or modified CDS sequence (opt3) from DENV-2__AF204177__SS-prME
accgccggcaugaucauuaugcugauacccaccgugauggcuuuccaccucacuacgcgaaacggggaaccucauaugaucgucagcaggcaggaaaagggaaaaucccuucuguuuaagaccggugacggcguuaauaugugcacauugauggcaauggauuuaggggaacugugugaagacacuauuaccuacaaaugcccauuacuccggcaaaacgaaccggaagauaucgacuguuggugcaauucuacaucaaccugggugacuuauggaacauguaccacgacuggcgagcaccgccgagagaagcguagugucgcccuggugccccaugucgguauggggcuugaaaccagaacagagacuuggaugagcuccgaaggagcguggaaacacgcucagaggauugagaccuggauccugcggcauccuggcuucacaauaauggccgcaaucuuggccuacaccauuggcacgacucacuuucagcgcgcucucaucuucauucugcugacagcaguggccccaucuaugaccaugagaugcaucgggauaucgaacagggauuuuguugagggagugucagguggcagcugggucgacauugugcucgaacacgggaguugugugacuacaauggcuaagaauaagcccaccuuagaucuggagcuuaucaaaacggaagccaagcaguccgcgaccuugcggaaauauugcauugaggcaaagcugacaaacacuaccacagaaucucgcuguccuacucaaggagagccaagccugaaugaggaacaggacaaacgauucguuugcaagcauuccaugguggauagaggcugggguaacggguguggacucuuuggcaagggcgggaucguaaccugcgccauguucacaugcaaaaagaauaugaaaggaaagguggugcagcccgagaaccuggaauacaccaucgucauuacuccucacucaggugaggaacaugcuguuggcaaugacacggggaaacacggaaaggagauaaaaaucacaccacagaguagcauuaccgaggccgaacuuacuggcuaugguaccgugacaauggaguguucuccgaggaccgggcuggauuuuaacgaaaugguauugcuccaaauggagaauaaggcauggcuggugcaccggcagugguucuuagaccugccccucccuuggcuuccaggcgcugauacucagggauccaacuggauccagaaggaaacacuggucacguuuaaaaauccccaugccaagaaacaagacgugguuguguugggcucacaggagggggcgaugcacaccgcccugacuggagcaacagagauacagaugagcagugguaaccuacucuucaccggccaucugaagugccgucuucgcauggacaaacugcaauugaaggggaugucuuacuccauguguacaggaaaguuuaaagucgugaaggaaauugcugagacucagcacggcaccaucguaaucagaguucaguaugaaggugaugggagcccuugcaaaauuccauucgagaucauggaccucgagaagaggcaugugcugggccgguuaauuacggucaaccccauagugaccgaaaaagauucgccggucaauaucgaggccgaaccucccuucggagacucuuacauuaucaucggcguggagccagggcagcugaagcuaaacugguuuaagaaaggauccucaauuggucaaauguucgaaacaacuaugcgaggcgcuaagcgcauggccauacucggggauaccgcaugggacuuuggaagucugggcgguguuuucacaagcaucgggaaagcccuucaccagguguuuggcgcuauuuacggagcggcauucuccggcguaucuuggacuaugaagaucuugauuggggucaucauaaccuggaucggaaugaauagcagaucaacgagucuguccgugagccucguucuggugggcgucgugacacuuuaucuggguguaauggugcaggccgauucuggguguguugucucauggaaaaacaaggaguugaagugcggaaguggcauuuuuaucaccgacaaugugcacacuuggacagagcaguacaaauuccaaccugaaagccccuccaagcucgcuucugccauucagaaagcacaugaggaagguaucuguggcauaaggucggugacccggcuggagaacuuaauguggaagcagauuacuccagaacugaaucacauccuaagcgagaacgaggucaaacucaccauuaugacaggggauaucaagggaauaaugcaggccggcaaacgcucccugagaccccaaccuacggaacuuaaguauucauggaagaccugggggaaagcuaagauguugaguacugagucucauaaucagacauuucugaucgacggaccagaaaccgccgagugcccgaacacaaauagggcauggaacagccucgaaguugaggauuacggcuucgguguguuuacuaccaauauuuggcugaaauuacgugagaagcaggacguguucugugacuccaaacugaugucagcggcuaucaaggauaaccgggccguacacgcagacaugggguauuggauugaaagcgcccuuaaugauacguggaagaucgagaaggcuucuuuuauagaagucaaguccugccacuggcccaaaagucauacauuguggagcaacgaggugcucgagucugaaaugauuaucccuaagaacuucgccggaccaguuucccagcacaauuaccgacccggcuaucauacccaaacugcagguccuuggcaccugggcaaacuagagauggacuucgauuuuugugaagggaccacaguggucgugacugaggacugcggaaacagaggcccaucacugaggaccacaacggcuagugggaagcucaucaccgaaugcuguugccgcagcuguacucugcccccgcuucgguacagaggagaggauggcugcugguacgguauggagauuaggccuuugaaggaaaaagaggaaaaucugguuaacucguuagugacagccgggcauggacagaucgacaauuucucccucggcguacuggguauggcgcuuuuucuggaggaaauguugcgcacccgagucggcacuaagcacgccauucuccugguggcugugucuuucgucacacuaauaaccgggaacaugagcuuucgggaucugggacguguuauggugaugguaggcgcaacgaugacugacgauaucgggaugggagugaccuaucucgcccugcuugcugccuucaaagucagaccaacauuugcagcgggcuugcuguuaaggaagcucaccucaaaagagcugaugaugacuacaauugguaucgugcuucugagucaguccaccauucccgagacaauccuagaacucacugacgcccuggcuuuggggaugaugguucugaagauggugcgcaagauggagaaauaccaauuagccgucaccauaauggcaauccucugugugccuaaugcuguuauucugcagaacgccuggaaggugucuugcacgauccuugcagucguaagcgugagcccccuguucuugacaucaagccagcagaaagccgauuggauuccacucgcucugaccaucaagggacuaaauccuacugcgauauuucugaccacacuuaguaaaacuaacaagaaacggucuuggccccucaaugaagccauuauggcaguuggcaugguguccauccuggcuagcucguugcugaagaacgacaucccaaugaccggcccguuagucgccgggggacuccugacgguguguuauguacuuacagguagaucagccgaccuggaguuggaaagggcugcagaugugaagugggaggaccaagccgagauuucuggcaguuccccuauacucagcaucaccauuucugaagaugggagcauguccaucaaaaaugaggaagaggagcagauucugacuauccuaauacgaacaggacugcuugucaucucaggccucuuccccguuaguauuccaaucaccgcggcugccugguaccugugggaagugaagaaacagcgcgccgguguauugugggacguccccagcccuccacccguggggaaggcagaguuagaagauggagcuuaucggauuaaacagaagggcauccugggcuacucucaaauaggggcaggaguuuauaaggaggguacuuuucacacaauguggcauguaaccagaggcgccgugcucaugcacaaagggaagaggauugaaccuuccugggcggacgucaaaaaggaucugaucucauacgcuggaggcuggaaacuugagggugaguggaaggaaggggaggaagugcagguucuggccuuggagccgggaaagaacccacgugcagugcagacgaaacccggccuauucaagacuaaugccggcaccaucggggcugucagucuggacuuuagcccuggaacauccgguucuccaauuaucgauaaaaagggcaaagugguagggcucuacggaaacggcgucgugacccgcucgggugccuauguuagcgcaauagcucagacagaaaagucaauugaggacaaccccgagaucgaagaugacauuuuccggaagagaaaacugacuaucauggaucuucauccuggggccggaaagaccaaaagguacuuaccggcgauagugcgagaggccauuaagcggggccugcgcacgcucaucuuggcacccacaagagucguggcugccgaaauggaggaagcucugaggggccucccaauccgguaucaaacuccugcaauucgagccgagcacaccgggagagagaucguugaccugaugugccaugccacauucaccaugcgccuucugucccccgugagggucccaaauuacaacuugauuauaauggacgaagcucacuuuacugauccugcgaguaucgcagcccguggauauauuucuacccggguggagaugggugaagcugccggcaucuucaugacagcaacgcccccagggagcagagacccguuuccucaguccaaugcccccaucauggaugaggagagggaaauuccagagcgcucauggucuagcggacacgaauggguaacugacuucaaaggcaagaccgugugguuuguucccaguauaaaggcugguaacgauaucgcggccugucuaagaaagaaugggaagaaagucauucagcuguccagaaagacauucgacagcgaguacgugaaaacccggacuaacgauugggacuuuguggucacaaccgauaucucugaaaugggagcaaauuucaaggcugagaggguaauugacccucgccguugcaugaaaccagugauccucacggauggcgaggaaagaguuauauuagccggccccaugccugugacucauucauccgcagcccaacggagggggcgcaucggacgaaacccgaagaaugagaacgaccaguauauuuacaugggugaaccacuggagaaugacgaagauugugcucacuggaaggaggccaaaaugcuucuggacaacaucaauacacccgagggcauuaucccuaguauguuugaacccgagagagaaaaggucgaugcgauagacggggaguaccggcucaggggagaagcacgcaaaaccuucguggauuugaugagaaggggcgaccugccaguuuggcucgccuaucggguggcugccgaggguauuaacuacgcugaucgucgcuggugcuuugacgggaucaagaauaaccagauucuggaggaaaacgucgagguggaaaucuggaccaaagagggcgagcgaaagaaacuuaaaccuagauggcuagaugcaaggauauauagcgacccccuggccuugaaggaguucaaagaguucgcugccggacggaagucguuaacucugaaucucaucacagaaaugggccgccugccaaccuuuaugacacagaaagcaagagaugcgcuugacaaccuggccguacuccauacugcugaggccgggggaagggcauacaaucacgcuuugucugaacugccugagacgcuagagacccugcuccuucugacauuauuggccacugugaccgguggcauuuuccuguuucucauguccgggcggggaaucggcaagaugacacuggguaugugcuguauuaucaccgcaagcauacuucugugguaugcccaaauucagccgcacuggaucgcugcgucaaucauucucgaguucuuuuugaucguucuguuaauacccgagccagaaaagcagcgaacuccucaggauaaccaacuaacguacgucgugauugccauccugaccguggucgcagcuacaauggccaaugagaugggguuccucgagaaaacuaagaaagaccuuggccugggaaguauuaccacacagcagcccgagucuaacaucuuggacauagaucugagaccagccuccgcauggacccucuaugcuguugccacuacauuugugacgccuaugcugcgccauagcaucgaaaauucaaguguaaacgugagccuuaccgcgauugcuaaucaggccacuguccucaugggccuggggaagggauggcccuuguccaaaauggacaucggugugccgcuguuagcaauuggcugcuacucucaaguuaacccaaucacacuaaccgccgcucuguuccuccuuguggcacacuacgccauuaucgggccuggacugcaggcgaaggcuaccagggaagcccagaagcgggcagccgcuggcauaaugaaaaaucccacagucgaugguauuacuguaaucgacuuggauccaauccccuaugacccuaaguuugagaaacagcuggggcaagugaugcuccugguucuuugugugacgcaggucuuaaugaugcguaccacaugggcccugugcgaagcacucacuuuggcuaccggcccgauuagcacacugugggagggaaaccccggcagauucuggaauaccacuauagccguguccauggcgaacaucuuuagggggucauaccuagccggagcaggccuacucuucucuauuaugaagaauacgacaaacacccgccgggguacugggaauaucggagaaacccuuggcgagaaauggaagagucgacugaacgcuuuggguaaaucggaguuucagauuuauaagaaguccggcauccaagaagucgauagaacacuggccaaagaggggauaaagaggggagaaacugaccaucacgcagugucccgcggcucugcuaaacuccggugguucguugagagaaacauggugaccccagaggggaagguaguggaucugggauguggccgugguggguggucauacuauugcggaggccuuaaaaaugucagggaaguuaagggucuaacaaagcggggcccugggcaugaggaacccaucccuaugagcacguacggauggaaccuggugcgccuccaguccggcgucgacguguucuuuaccccacccgagaaaugugauacucuacugugcgacauuggggaaaguucuccuaauccaacaguagaggccggacgaaccuugagagugcugaaccucguugagaauuggcuuaacaauaacacucaguucuguaucaaggugcugaaucccuauaugccgagcgucauugagaaaauggaggccuugcagaggaaguacggcggugcgcuggugcggaacccucucucacgcaauuccacacacgaaauguacugggucaguaacgcuagcgggaauaucgugucuuccguuaacaugauaucaagaauguuaauuaauagguuuaccaugcgacacaaaaaggcaacguaugagccagauguagaccugggaagcggcacccggaacaucggcaucgaaucggagauucccaaccuugacauaaucgggaagcguauugagaaaaucaagcaagaacaugagacacuguggcacuacgaucaggaccauccuuauaaaacuugggccuaccacggaucuuaugaaaccaagcagacagguagugcuuccagcauggugaauggcgucgugagacuacucacuaaaccaugggauguugugcccauggucacccagauggccaugacagacaccacuccguucgggcaacagcgcguguuuaaggagaagguagauacgaggacacaggaaccuaaagagggaaccaagaaacugaugaagauuacugcagagugguuguggaaagaacugggcaagaaaaagacaccccggaugugcacaagagaggaguucacgcgcaaggugaggucaaacgccgcucucggugcgaucuuuaccgacgagaauaaacgaaaguccgcccgggaggcaguugaagauucuagauucugggagcuugucgacaaagaaaggaaccugcacuuagaggggaagugugaaacuugcguguacaauaugaugggaaaacgcgagaagaagcugggcgaguuuggcaaagcuaaggggagccgugccauaugguauaugugguugggagcacgguuccucgaauuugaggcccuggguuuccuaaacgaagaucauugguuuaguagagaaaauucccuuagcggcguggaaggggagggacugcacaaacucggcuacauccugagggacgucucuaagaaagaggguggggcuauguacgccgaugacacagcgggaugggacacccgcauuacuuuggaagaucugaagaacgaggaaaugguuacaaaucauauggagggcgaacacaagaaacucgcagaggccaucuucaaacuuaccuaucagaacaaagugguacgagugcaacggccaacaccuagaggcacugucauggacauuaucucaaggcgcgaucagagagggaguggacagguggguaccuacggccugaauacguucaccaacauggaggcucaauuaauucggcagauggaaggggagggaguuuuuaaguccauacagcaucugacagugacugaagagaucgccguccagaauugguuggcaagggugggccgugagcgacucagccgcauggcuauuucuggugacgauugcguaguuaaaccccuggacgauagauucgccucggcucuaaccgcccuuaacgacauggggaaggugcggaaggauauccaacagugggaaccaucaaggggauggaaugacuggacacagguccccuuuuguagccaccacuuccaugagcugaucaugaaagauggccgcgugcucguggucccuugcagaaaccagaacgaacugauuggccgggcaaggauaucccaaggggcgggauggaguuugcgagagacugccuguuuagguaagucuuaugcucagauguggagccugauguacuuucaccguagagaccuccgccuugccgcaaaugcuaucugcuccgccguuccaucacauugggugccgaccagucggacgacauggucuauucacgcaaaacacgaauggaugaccacugaggauaugcugacaguauggaacaggguguggauccaggagaaucccuggauggaagacaagaccagcgucgaguccugggaagagauuccuuaucuaggcaaaagagaagaccaguggugugggucacugaucggacucacuagccgcgccaccugggcgaagaacauacaaacagcuaucaaucaggugcggucuuugauuggcaacgaggaguacacggauuauaugccauccaugaagagguuccgaagagaagaggaagaggccgguguucugugguga

SEQ ID NO: 15061 - RNA, 9876 nt, Artificial Sequence
  derived and/or modified CDS sequence (opt3) from DENV-2__DQ645540__SS-prME
accgcaggagugauaauuaugaugauacccacaguaguugcuuuccaccugacuacgcggaauggggaaccucauaugaucgugagcaggcaggaaaagggaaaaucccuccuuuuuaagaccgagaaugguguaaacaugugcacacugauggcaauggacuugggcgaauuaugugaggauacuauuaccuacaauugcccacugcugcggcaaaacgaaccggaggacaucgauuguuggugcaauucuacaucaaccugggugacuuaugggacauguaccgccacgggagagcaccgccgagaaaaacguagugucgcgcucgugccccauguuggcaugggucuggagacuagaaccgaaacauggaugagcuccgagggggcuuggaagcacgcccagaggauugagacuugggugcuucggcauccuggauucaccaucauggcagccauacuggcuuacacaaucggcaccacguauuuucagcgcgucuugauuuucauccuccugacugcaguggccccaucuaugacaaugagaugcauuggcaucucgaacagggacuuuguagaagggguuucaggagguagcuggguggauauaguccuggagcacggcaguugugugaccacuauggcuaaaaauaagcccacacucgacuucgaauuaaccaagacggaggccaaacacccugcgacccugcggaaguacugcauugaagcaaaacuuacaaacacuaccacagccucccgcuguccaacucagggggagcccucuuugaaugaggaacaagauaagcgauuugugugcaaacauagcauggucgacagaggauggggcaacgguugugggcuguucggaaagggcggcaucguuaccugcgcuauguuuacaugcaagaaaaauauggaggggaaggugguacagccugaaaaccuagaguauaccauugugaucacuccacacuccggagaagagaaugccgucgguaacgauacgggcaaacaugggaaggagaucaaagugacaccgcagucaaguauuaccgaagcagagcucacuggauacggcaccguuacaauggaauguagccccaggaccggucuggacuucaaugagauggugcuucugcagauggaagauaaggcuugguugguccaccggcaaugguuucucgaccugccuuuaccauggcugcccggggccgauacucagggcucuaacuggauacagaaagagacacucgugacguucaagaacccucacgcgaagaaacaggacguaguugugcuuggaucccaagagggcgccaugcauaccgcacugacuggggcuacagaaauccagaugucaagcggaaauuugcuauuuaccggucaccugaagugccgucuccgcauggacaaacugcagcuuaagggcaugaguuauucuauguguacagggaaauucaaggucgugaaggagauugccgaaacucaacauggaaccaucgucauaagagugcaguacgagggcgaugguuccccaugcaaaauucccuucgagaucauggaccuggaaaagaggcacguuuuggggcggcucaucacggugaacccgauuguaaccgagaaagauagcccugucaauaucgaagcugagcccccauuuggcgacucguacauuauaaucggaguggaaccuggccagcugaaguuaucuugguucaaaaagggguccucaauuggacagauguuugagacaacuaugcgaggugccaagcgcauggcaauccugggcgauaccgccugggacuucgggagucuaggaggcguuuuuacaagcaucgguaaagcucuccaucaaguguucggggcgauuuauggcgcagccuuuuccggagucucuuggacuaugaagauacugaucggcgugguaauuaccuggaucgggaugaacagcagaucaacgagucuuuccgugagcuugguucuggucggaguggugacacucuaccugggcgucaugguucaggcugauucugguuguguggugucauggaaaaauaaggagcuuaaaugcgggaguggaauuuucaucaccgacaacguacacacuuggacagaacaguauaaguuucagcccgagagcccauccaagcuggccucugcaauacaaaaagcccacgaagagggcaucugugguauuaggucggucacccgguuggaaaaucucauguggaagcagaucacucccgagcugaaccauauuuuaagcgagaaugaagugaaacugaccaucaugacaggcgauauaaaggggauuaugcaggcuggaaaacgcucccuaagaccucagccaacggagcucaaguacucauggaaagccuggggcaaggcaaagaugcugaguaccgaacuucacaaccauacuuucuugaucgacgggccggagacagcggaaugccccaauaccaacagggcuuggaacucucuggagguugaggauuauggauuuggcguguucacaacuaacauuuggcucaaacugaaggaacgucaagacgucuuuugugacagcaaauuaauguccgccgcaaucaaggauaaucgggccgugcacgcugacauggguuacuggauagagucagcccugaacgauaccuggaaaaucgaaaaggccagcuucauugagguuaagucuugccacuggccuaaaucccauacgcuuuggaguaacgggguguuggagagcgaaaugaucauuccaaagaauuucgcuggacccguaucucagcacaacuaucgaccuggcuaccauacacagaccgccgguccauggcaccucggcaaacuggagauggacuuugauuucugugaagggacuaccgucguggugacagaggacugcggaaauagaggccccucccuaaggacuaccacagcgucagggaagcugaucacggaauggugcugucgcaguugcacccucccgccucugcgguacagaggagaggauggcuguugguaugguauggagauaaggccacuuaaagaaaaggaggaaaacuuggucaauagccugguuacugccgggcauggacagauugacaacuuuucguuaggcgugcucgguauggcucuguuccuugaggaaaugcugcgcacacgaguaggcaccaagcacgcaaucuugcucguggccgucuccuuugugacucugaucacagggaauaugucuuuccgggaucuaggacguguuauggugauggucggcgcuaccaugacggacgauauugggaugggagugacuuaccuggcccuccuggcagcguuuaaaguuagacccaccuucgccgcuggccuuuugcugaggaaguuaacaagcaaagagcucaugaugaccacuaucgguauugugcugcuuucacaaaguacaauaccugagaccauccuggaacuaacagacgcccucgcacuggggaugauggucuugaagauuguacgcaacauggagaaauaucagcuggcugugacuaucauggccauuuuaugcguucccaaugcagugauccuccagaacgccuggaaggucuccuguaccauacuggcugugguaucugugagcccacuucuguugacguccucacaacagaaggcggauuggaucccucucgcccugacaauuaaaggacuaaaucccaccgcaaucuuucugacuacccuuagccggacaaguaagaaaagaucuuggccacucaacgaagcuauuauggccgucggcaugguuuccauccuggccagcucguugcugaagaaugacauaccgaugacuggcccuuuaguggcugggggacuccugaccgugugcuacguccuuacggguaggucagcagaccuggaguuggaacgagccgcggaugugcgcugggaggagcaggcugaaauuucuggcaguucccccauccucagcaucacaauuucugaggacgggagcauguccaucaagaaugaagaggaggaacagacccugacuauccuaauucggacaggacugcuuguuaucucaggccucuucccaguaaguauucccaucaccgccgcagccugguaucugugggaggugaagaaacaaagagcuggugucuugugggaugugccuagcccacccccuguugggaaggcagaauuagaggacggagccuacaggauaaagcagaaaggcauccugggcuauucucagauuggggcgggaguguacaaggaagguacuuuucacacaauguggcaugucacccguggcgcugugcucaugcacaaagggaagcgcaucgagccguccugggccgaugucaagaaggaccugauuucauacggaggcgguuggaaacuugagggggaauggaaagagggagaagagguccaggugcuggcauuggaaccaggcaagaauccccgggccguucaaacgaaaccuggccuauucaagacuaacaccgggacaaucggagcugugagucuggauuuuagcccagguaccuccggcucucccauagucgacaaaaaggggaaggugguuggacucuauggcaacgguguggucacaagaucggggacuuacgugagcgccauugcacagaccgagaaaucaaucgaggauaauccugaaaucgaggacgauauuuucaggaagaaacgacugacgaucauggaccuucauccgggagcuggcaagacaaaacgguauuuacccgccauaguacgcgaagcgauuaagagaggccugaggacucucaucuuggccccaacccgggugguugcagcugagauggaagaggcccugcgagggcucccuauuagauaccagacacccgcuauccgcgcagagcacaccggaagggaaauagucgaucugaugugucaugccacuuucaccaugcgucuucuguccccaauucgggugccuaacuauaauuugaucaucauggacgaggcccacuuuacagaccccgcuaguauugcggcaagagguuacaucucuacgaggguggaaaugggcgaggccgcugggauuuucaugacugccaccccaccgggaagccgcgauccuuuuccccaguccaacgcaccaauaauggacgaggaacgagagauccccgaaagaucauggaacucuggccacgagugggucacagauuucaaggguaaaaccguaugguuugugccuagcauuaaggccgggaacgacaucgcugcgugccuacggaaaaauggaaagaaaguuauccaacugaguaggaagacuuucgauuccgaauaugugaagacacgcaccaacgacugggauuuugucgugacgacugacauuagcgagaugggcgccaauuucaaagcagagcguguuauagauccaagacgguguaugaagcccgugauccucacagacggcgaagagagggucauuuuagcugggccuaugccggugacccauucuucagccgcacagcgccgaggaagaguaggucggaaccccaagaaugaaaacgaucaguacaucuacaugggcgagccccuggaaaaugacgaggacugcgcccacuggaaggaggcuaaaaugcuucuggauaacauuaauaccccugaagggaucauacccuccauguuugagccagaaagggagaagguggacgccaucgauggagaauaucgccucagaggcgaggcgaggaaaacuuucguugacuugaugcggcguggugaucugccugucuggcucgcauaccgcguggccgcugaggggauuaacuaugccgaccgaagaugguguuuugauggcgugaagaacaaucaaauccuggaagagaacgucgaaguugagauuuggacaaaggagggagaaaggaagaaacuuaaaccccgguggcuagacgcucgcaucuacagugauccacuggcauugaaagaguucaaagaguucgccgcuggcagaaagagcuuaacccugaaucucauaacagagauggggaggcugccuacuuuuaugacgcagaaggcccggaacgcacuugacaaucuggcggugcuccauaccgccgaagcuggaggucgagccuauaaccacgcauugucggagcugccggagacacuagaaacucugcuccuucugaccuuauuggcuacaguaaccggcgggauuuuccuguuucucaugucuggaaaaggcaucgguaagaugacucuggggaugugcugcauuaucacggccuccgugcuucugugguacgcacagauacagccccacuggaucgccgcuagcauuauccucgaguucuuuuugauuguccuguuaaucccagaaccugagaaacaaagaacaccacaggauaaucagcuaacauaugugguuauagcgauucugacuguggucgccgcaaccauggcuaacgaaaugggcuuccucgagaagaccaagaaggacuuuggacuuggcgggaucgccacccagcaaccagagucaaauauccuggauauugacuugcgcccugccagugcauggacucuguacgcuguagccacaacguucaucacccccaugcucaggcauucuauagaaaacuccagcgugaauguuucacugacugcgauugcuaaccaggccacagugcuuaugggacucgguaagggcuggccgcugaguaaaauggacaucggggucccauugcuggcaauuggauguuacagccaggugaauccuaucaccuuaaccgccgcucuacugcuccuugucgcacacuaugccauaaucggccccggucugcaggcgaaggcuacacgggaggcccaaaaacgugcagccgcugggauuaugaagaacccaacuguggauggcaucacgguuauugacuuggaucccaucccuuacgacccgaaauuugaaaagcagcugggacaggugaugcuccugguacuuugcgugacccaggucuuaaugaugagaacaacuugggcccugugugaggcacucaccuuggcuacaggccccauuuccacccugugggaagggaauccaggaagguucuggaacacuacgaucgccguuucuauggcgaauauauuucgcggcagcuaucuagccggugcagggcuacucuucuccauuaugaagaacacagcuaacacccggcgaggaacuggcaauaccggugagacacuuggcgagaaauggaagaacagacugaaugccuuggggaaaucagaauuucaaaucuacaagaaaucuggaauccaggagguggauaggacucuggcaaaggaaggcauuaaacgcggggagaccgaccaucacgcugucagucggggaucggccaagcucagaugguucguggagcguaaccugguaacaccugaaggcaaggugauggauuuagguugcgggaggggaggcuggagcuauuacugugguggccuuaaaaauguuaaggaggugaaagggcugacgaagggaggccccgggcaugaagaaccuauaccaauguccaccuauggauggaaccucguccggcuacagucuggcguggacgucuucuuuacucccccugaaaaaugcgauacacuguugugugacaucggugagucaagcccaaaucccaccguggaggccgggcgcacucugcgaguucucaaccuuguagaaaauuggcugaacaauaacacacaauucugcauuaagguguugaauccguacaugccuuccgucaucgagaagauggaagcgcugcagagaaaauacggaggcgcucucgugaggaacccauuaaguagaaauucuacccacgagauguauuggguuagcaacgcaucaggcaacauuguguccagugucaauaugaucagccgcaugcugauaaacagauuuacgaugaggcacaagaaagccaccuacgaacccgauguggaccuugggucuggaacacgaaauaucgguauugaguccgagaucccuaaccuggauauuaucggcaagcggauagagaaaauuaagcaggaacaugaaacuucauggcacuaugaccaggaccauccauacaagaccugggcuuaucacgggagcuacgagacaaaacaaacuggaucggccucuaguaugguaaauggcgugguucgucuacucaccaagcccugggaugucaucccgauggugacacagauggcaaugaccgacacuacgccuuucggucagcagagaguguuuaaagucaagguugauacacgcacccaagaacccaaagaggggacuaagaagcugaugaaaaucaccgccgagugguuguggaaggaacugggcaaaaagaaaacaccaaggauguguacgcgggaggaguucaccagaaaggugcgcuccaacgcugcgcucggcgccauuuuuacugacgagaauaaauggaaaagcgcaagggaggcuguagaagauucaggcuucugggagcuuguggacaaggaacgaaaccugcacuuagaggggaaaugcgaaacaugugucuauaauaugaugggaaagcgggagaaaaagcugggugaguuuggcaaagccaagggguccagagcaauaugguacaugugguugggagccagguuccucgaauuugaggcucugggcuuccuaaacgaagaucauugguuuucucgcgagaauagccuuagugguguggaaggggagggacugcacaagcucggcuacauccugcgugacguuuccaaaaaggagggcggggccauguaugcggaugacaccgcaggaugggauacucggauuacauuggaagaccugaaaaacgaggaaauggugaccaaucauauggagggugaacacaagaaacucgccgaggcuaucuucaaacuuacauaccagaacaaggucgugagaguacagaggccuacuccccgcggcaccguuauggacauuaucagccgacgggaucagagagggucuggacaaguggucacguauggccugaauaccuucacaaacauggaggcccaguuaauaaggcagauggaaggugaggggguguuuaaaucaauccaacagcugacugcaaccgaagagauugcugugaagaacugguuggcccgcgucggaagagagcggcucaguaggauggcuaucuccggcgacgauugcguugugaaaccacuggacgaucguuucgccagcgcacuaacagcgcuuaaugacaugggcaagguacgaaaagauauucagcagugggaacccucucgcggguggaacgacuggacucaagugccuuuuugcucgcaucacuuccacgagcugaucaugaaggauggaagaguccucgugguuccaugucggaaucaggacgaacugauugguagggcccgcauaucacagggcgcuggguggagcuugagagagaccgccugcuuaggaaaguccuacgcacagauguggagucugauguauuuucaucggagggaucuccgacuugcugccaacgcaaucuguucugccgugccgagccacuggguccccacgucccguacaaccuggucaauucaugcgacucacgaauggaugacaaccgaggacaugcugacuguguggaauagaguauggauccaagagaacccuuggaucgaagauaaaaccccaguugagaguugggaagagauucccuaccuaggcaagcgcgaagaccaguggugcgguucucugauagggcucacaagccgggcuacgugggccaaaaauauccagaccgcaauuaaccaggugagguccuugaucggaaaugaggaguauacugacuacaugccuucaaugaagagauuccgccgggaagaggaagaggccggcguccugugguga

SEQ ID NO: 15062 - RNA, 9876 nt, Artificial Sequence
  derived and/or modified CDS sequence (opt3) from DENV-2__DQ645541__SS-prME
accgcaggagugauaauuaugaugauacccaccguaguugcuuuccaccugacuacgcggaauggggagccucauaugaucgugagcaggcaggaaaagggaaaaucccuccuuuuuaagaccgagaaugguguaaacaugugcacacugauggcaauggacuugggcgaauuaugugaggauacuauuaccuacaauugcccacugcugcggcaaaacgaaccggaggacaucgauuguuggugcaauucuacaucaaccugggugacuuaugggacauguaccgccacgggagagcaccgccgagaaaaacguagugucgcgcucgugccccauguuggcaugggucuggagacuagaaccgaaacauggaugagcuccgagggggcuuggaagcacgcccagaggauugagacuugggugcuucggcauccuggauucaccaucauggcagccauacuggcuuacacaaucggcaccacguauuuucagcgcgucuugauuuucauccuccugacugcaguggccccaucuaugacaaugagaugcauuggcaucucgaacagggacuuuguagaagggguuucaggagguagcuggguggauauaguccuggagcacggcaguugugugaccacuauggcuaaaaauaagcccacacucgacuucgaauuaaccaagacggaggccaaacacccugcgacccugcggaaguacugcauugaagcaaaacuuacaaacacuaccacagccucccgcuguccaacucagggggagcccucuuugaaugaggaacaagauaagcgauuugugugcaaacauagcauggucgacagaggauggggcaacgguugugggcuguucggaaagggcggcaucguuaccugcgcuauguuuacaugcaagaaaaauauggaggggaaggugguacagccugaaaaccuagaguauaccauugugaucacuccacacuccggagaagagaaugccgucgguaacgauacgggcaaacaugggaaggagaucaaagugacaccgcagucaaguauuaccgaagcagagcucacuggauacggcaccguuacaauggaauguagccccaggaccggucuggacuucaaugagauggugcuucugcagauggaagauaaggcuugguugguccaccggcaaugguuucucgaccugccuuuaccauggcugcccggggccgauacucagggcucuaacuggauacagaaagagacacucgugacguucaagaacccucacgcgaagaaacaggacguaguugugcuuggaucccaagagggcgccaugcauaccgcacugacuggggcuacagaaauccagaugucaagcggaaauuugcuauuuaccggucaccugaagugccgucuccgcauggacaaacugcagcuuaagggcaugaguuauucuauguguacagggaaauucaaggucgugaaggagauugccgaaacucaacauggaaccaucgucauaagagugcaguacgagggcgaugguuccccaugcaaaauucccuucgagaucauggaccuggaaaagaggcacguuuuggggcggcucaucacggugaacccgauuguaaccgagaaagauagcccugucaauaucgaagcugagcccccauuuggcgacucguacauuauaaucggaguggaaccuggccagcugaaguuaucuugguucaaaaagggguccucaauuggacagauguuugagacaacuaugcgaggugccaagcgcauggcaauccugggcgauaccgccugggacuucgggagucuaggaggcguuuuuacaagcaucgguaaagcucuccaucaaguguucggggcgauuuauggcgcagccuuuuccggagucucuuggacuaugaagauacugaucggcgugguaauuaccuggaucgggaugaacagcagaucaacgagucuuuccgugagcuugguucuggucggaguggugacacucuaccugggcgucaugguucaggcugauucugguuguguggugucauggaaaaauaaggagcuuaaaugcgggaguggaauuuucaucaccgacaacguacacacuuggacagaacaguauaaguuucagcccgagagcccauccaagcuggccucugcaauacaaaaagcccacgaagagggcaucugugguauuaggucggucacccgguuggaaaaucucauguggaagcagaucacucccgagcugaaccauauuuuaagcgagaaugaagugaaacugaccaucaugacaggcgauauaaaggggauuaugcaggcuggaaaacgcucccuaagaccucagccaacggagcucaaguacucauggaaagccuggggcaaggcaaagaugcugaguaccgaacuucacaaccauacuuucuugaucgacgggccggagacagcggaaugccccaauaccaacagggcuuggaacucucuggagguugaggauuauggauuuggcguguucacaacuaacauuuggcucaaacugaaggaacgucaagacgucuuuugugacagcaaauuaauguccgccgcaaucaaggauaaucgggccgugcacgcugacauggguuacuggauagagucagcccugaacgauaccuggaaaaucgaaaaggccagcuucauugagguuaagucuugccacuggccuaaaucccauacgcuuuggaguaacgggguguuggagagcgaaaugaucauuccaaagaauuucgcuggacccguaucucagcacaacuaucgaccuggcuaccauacacagaccgccgguccauggcaccucggcaaacuggagauggacuuugauuucugugaagggacuaccgucguggugacagaggacugcggaaauagaggccccucccuaaggacuaccacagcgucagggaagcugaucacggaauggugcugucgcaguugcacccucccgccucugcgguacagaggagaggauggcuguugguaugguauggagauaaggccacuuaaagaaaaggaggaaaacuuggucaauagccugguuacugccgggcauggacagauugacaacuuuucguuaggcgugcucgguauggcucuguuccuugaggaaaugcugcgcacacgaguaggcaccaagcacgcaaucuugcucguggccgucuccuuugugacucugaucacagggaauaugucuuuccgggaucuaggacguguuauggugauggucggcgcuaccaugacggacgauauugggaugggagugacuuaccuggcccuccuggcagcguuuaaaguuagacccaccuucgccgcuggccuuuugcugaggaaguuaacaagcaaagagcucaugaugaccacuaucgguauugugcugcuuucacaaaguacaauaccugagaccauccuggaacuaacagacgcccucgcacuggggaugauggucuugaagauuguacgcaacauggagaaauaucagcuggcugugacuaucauggccauuuuaugcguucccaaugcagugauccuccagaacgccuggaaggucuccuguaccauacuggcugugguaucugugagcccacuucuguugacguccucacaacagaaggcggauuggaucccucucgcccugacaauuaaaggacuaaaucccaccgcaaucuuucugacuacccuuagccggacaaguaagaaaagaucuuggccacucaacgaagcuauuauggccgucggcaugguuuccauccuggccagcucguugcugaagaaugacauaccgaugacuggcccuuuaguggcugggggacuccugaccgugugcuacguccuuacggguaggucagcagaccuggaguuggaacgagccgcggaugugcgcugggaggagcaggcugaaauuucuggcaguucccccauccucagcaucacaauuucugaggacgggagcauguccaucaagaaugaagaggaggaacagacccugacuauccuaauucggacaggacugcuuguuaucucaggccucuucccaguaaguauucccaucaccgccgcagccugguaucugugggaggugaagaaacaaagagcuggugucuugugggaugugccuagcccacccccuguugggaaggcagaauuagaggacggagccuacaggauaaagcagaaaggcauccugggcuauucucagauuggggcgggaguguacaaggaagguacuuuucacacaauguggcaugucacccguggcgcugugcucaugcacaaagggaagcgcaucgagccguccugggccgaugucaagaaggaccugauuucauacggaggcgguuggaaacuugagggggaauggaaagagggagaagagguccaggugcuggcauuggaaccaggcaagaauccccgggccguucaaacgaaaccuggccuauucaagacuaacaccgggacaaucggagcugugagucuggauuuuagcccagguaccuccggcucucccauagucgacaaaaaggggaaggugguuggacucuauggcaacgguguggucacaagaucggggacuuacgugagcgccauugcacagaccgagaaaucaaucgaggauaauccugaaaucgaggacgauauuuucaggaagaaacgacugacgaucauggaccuucauccgggagcuggcaagacaaaacgguauuuacccgccauaguacgcgaagcgauuaagagaggccugaggacucucaucuuggccccaacccgggugguugcagcugagauggaagaggcccugcgagggcucccuauuagauaccagacacccgcuauccgcgcagagcacaccggaagggaaauagucgaucugaugugucaugccacuuucaccaugcgucuucuguccccaauucgggugccuaacuauaauuugaucaucauggacgaggcccacuuuacagaccccgcuaguauugcggcaagagguuacaucucuacgaggguggaaaugggcgaggccgcugggauuuucaugacugccaccccaccgggaagccgcgauccuuuuccccaguccaacgcaccaauaauggacgaggaacgagagauccccgaaagaucauggaacucuggccacgagugggucacagauuucaaggguaaaaccguaugguuugugccuagcauuaaggccgggaacgacaucgcugcgugccuacggaaaaauggaaagaaaguuauccaacugaguaggaagacuuucgauuccgaauaugugaagacacgcaccaacgacugggauuuugucgugacgacugacauuagcgagaugggcgccaauuucaaagcagagcguguuauagauccaagacgguguaugaagcccgugauccucacagacggcgaagagagggucauuuuagcugggccuaugccggugacccauucuucagccgcacagcgccgaggaagaguaggucggaaccccaagaaugaaaacgaucaguacaucuacaugggcgagccccuggaaaaugacgaggacugcgcccacuggaaggaggcuaaaaugcuucuggauaacauuaauaccccugaagggaucauacccuccauguuugagccagaaagggagaagguggacgccaucgauggagaauaucgccucagaggcgaggcgaggaaaacuuucguugacuugaugcggcguggugaucugccugucuggcucgcauaccgcguggccgcugaggggauuaacuaugccgaccgaagaugguguuuugauggcgugaagaacaaucaaauccuggaagagaacgucgaaguugagauuuggacaaaggagggagaaaggaagaaacuuaaaccccgguggcuagacgcucgcaucuacagugauccacuggcauugaaagaguucaaagaguucgccgcuggcagaaagagcuuaacccugaaucucauaacagagauggggaggcugccuacuuuuaugacgcagaaggcccggaacgcacuugacaaucuggcggugcuccauaccgccgaagcuggaggucgagccuauaaccacgcauugucggagcugccggagacacuagaaacucugcuccuucugaccuuauuggcuacaguaaccggcgggauuuuccuguuucucaugucuggaaaaggcaucgguaagaugacucuggggaugugcugcauuaucacggccuccgugcuucugugguacgcacagauacagccccacuggaucgccgcuagcauuauccucgaguucuuuuugauuguccuguuaaucccagaaccugagaaacaaagaacaccacaggauaaucagcuaacauaugugguuauagcgauucugacuguggucgccgcaaccauggcuaacgaaaugggcuuccucgagaagaccaagaaggacuuuggacuuggcgggaucgccacccagcaaccagagucaaauauccuggauauugacuugcgcccugccagugcauggacucuguacgcuguagccacaacguucaucacccccaugcucaggcauucuauagaaaacuccagcgugaauguuucacugacugcgauugcuaaccaggccacagugcuuaugggacucgguaagggcuggccgcugaguaaaauggacaucggggucccauugcuggcaauuggauguuacagccaggugaauccuaucaccuuaaccgccgcucuacugcuccuugucgcacacuaugccauaaucggccccggucugcaggcgaaggcuacacgggaggcccaaaaacgugcagccgcugggauuaugaagaacccaacuguggauggcaucacgguuauugacuuggaucccaucccuuacgacccgaaauuugaaaagcagcugggacaggugaugcuccugguacuuugcgugacccaggucuuaaugaugagaacaacuugggcccugugugaggcacucaccuuggcuacaggccccauuuccacccugugggaagggaauccaggaagguucuggaacacuacgaucgccguuucuauggcgaauauauuucgcggcagcuaucuagccggugcagggcuacucuucuccauuaugaagaacacagcuaacacccggcgaggaacuggcaauaccggugagacacuuggcgagaaauggaagaacagacugaaugccuuggggaaaucagaauuucaaaucuacaagaaaucuggaauccaggagguggauaggacucuggcaaaggaaggcauuaaacgcggggagaccgaccaucacgcugucagucggggaucggccaagcucagaugguucguggagcguaaccugguaacaccugaaggcaaggugauggauuuagguugcgggaggggaggcuggagcuauuacugugguggccuuaaaaauguuaaggaggugaaagggcugacgaagggaggccccgggcaugaagaaccuauaccaauguccaccuauggauggaaccucguccggcuacagucuggcguggacgucuucuuuacucccccugaaaaaugcgauacacuguugugugacaucggugagucaagcccaaaucccaccguggaggccgggcgcacucugcgaguucucaaccuuguagaaaauuggcugaacaauaacacacaauucugcauuaagguguugaauccguacaugccuuccgucaucgagaagauggaagcgcugcagagaaaauacggaggcgcucucgugaggaacccauuaaguagaaauucuacccacgagauguauuggguuagcaacgcaucaggcaacauuguguccagugucaauaugaucagccgcaugcugauaaacagauuuacgaugaggcacaagaaagccaccuacgaacccgauguggaccuugggucuggaacacgaaauaucgguauugaguccgagacuccuaaccuggauaucauuggcaagcggaucgagaaaauaaagcaggaacaugaaaccucauggcacuaugaccaggaccauccauacaagacaugggcuuaucacgggagcuacgagacuaaacaaaccggaucggccucuaguaugguaaauggcgugguucgucuacucacaaagcccugggaugucauuccgauggugacccagauggcaaugacugacacgacaccuuucggucagcagagaguguuuaaagaaaaggucgauacccgcacucaagagcccaaagaggggaccaagaagcugaugaaaaucacagccgaaugguuguggaaggagcugggcaaaaagaaaacgccaaggauguguacccgggaagaguucacuagaaagguucgcuccaacgcugcgcucggcgccaucuuuacagacgagaauaaauggaaaagcgcaagggaagcuguggaggauucaggcuucugggaacuuguagacaaggagcgaaaccugcacuuagaagggaaaugcgagaccuguguguauaauaugaugggaaagcgggagaaaaagcugggugaauuuggcaaagccaagggguccagagcaauuugguacaugugguugggagccagguuccucgaguuugaagcucugggcuuccuaaacgaggaucauugguuuucucgcgaaaauagccuuaguggugucgagggggagggacugcacaagcucggcuacauacugcgugacguguccaaaaaggaaggcggggccauguaugcggaugacacugcaggaugggauacacggaucaccuuggaggaccugaaaaacgaagagaugguuacaaaucauauggaaggugagcacaagaaacucgccgaggcuauuuucaaacuuacuuaccagaacaagguggucagagugcagaggccuacaccccgcggcacgguaauggacaucauuagccgacgggaucagagagggucuggacaaguugugaccuauggccugaauacauucacuaacauggaagcccaguuaaucaggcagauggagggugaaggggucuuuaaaucaauacaacagcugaccgcaacagaggagaucgcugugaagaacugguuggcccgcgugggaagagaacggcucaguaggauggcuauuuccggcgacgauugcgucguuaaaccacuggacgaucguuucgccagcgcacuaacugcgcuuaaugacaugggcaaggugcgaaaagauauccagcagugggagcccucucgcggguggaacgacuggacccaaguaccuuuuugcucgcaucacuuccacgaacugauuaugaaggauggaagagugcucgucgugccaugucggaaucaggacgagcugaucgguagggcccgcauuucacagggcgcuggguggagcuugagagaaacggccugcuuaggaaaguccuacgcacagauguggagucugauguauuuucaucggagggaucuccgacuugcugccaacgcaauauguucugccguuccgagccacugggugcccacaucccguaccacuuggucaauccaugcgacacacgaguggaugaccacugaggacaugcugaccgucuggaauagaguguggauucaagaaaacccuuggaucgaggauaaaacaccaguagaaaguugggaggaaauccccuaccuaggcaagcgcgaggaccaguggugcgguucucugauugggcucacgagccgggcuaccugggccaaaaauauacagacugcaaucaaccagguuagguccuugauuggaaaugaggaauauacagacuacaugccuucaaugaagagauuccgccgggaggaagaggaagccggcgugcugugguga

SEQ ID NO: 15063 - RNA, 9876 nt, Artificial Sequence
  derived and/or modified CDS sequence (opt3) from DENV-2__DQ645542__SS-prME
accgcaggagugauaauuaugaugauacccacaguaguugcuuuccaccugacuacgcggaauggggagccucauaugaucgugagcaggcaggaaaagggaaaaucccuccuuuuuaagaccgagaaugguguaaacaugugcacacugauggcaauggacuugggcgaauuaugugaggauacuauuaccuacaauugcccacugcugcggcaaaacgaaccggaggacaucgauuguuggugcaauucuacaucaaccugggugacuuaugggacauguaccgccacgggagagcaccgccgagaaaaacguagugucgcgcucgugccccauguuggcaugggucuggagacuagaaccgaaacauggaugagcuccgagggggcuuggaagcacgcccagaggauugagacuugggugcuucggcauccuggauucaccaucauggcagccauacuggcuuacacaaucggcaccacguauuuucagcgcgucuugauuuucauccuccugacugcaguggccccaucuaugacaaugagaugcauuggcaucucgaacagggacuuuguagaagggguuucaggagguagcuggguggauauaguccuggagcacggcaguugugugaccacuauggcuaaaaauaagcccacacucgacuucgaauuaaccaagacggaggccaaacacccugcgacccugcggaaguacugcauugaagcaaaacuuacaaacacuaccacagccucccgcuguccaacucagggggagcccucuuugaaugaggaacaagauaagcgauuugugugcaaacauagcauggucgacagaggauggggcaacgguugugggcuguucggaaagggcggcaucguuaccugcgcuauguuuacaugcaagaaaaauauggaggggaaggugguacagccugaaaaccuagaguauaccauugugaucacuccacacuccggagaagagaaugccgucgguaacgauacgggcaaacaugggaaggagaucaaagugacaccgcagucaaguauuaccgaagcagagcucacuggauacggcaccguuacaauggaauguagccccaggaccggucuggacuucaaugagauggugcuucugcagauggaagauaaggcuugguugguccaccggcaaugguuucucgaccugccuuuaccauggcugcccggggccgauacucagggcucuaacuggauacagaaagagacacucgugacguucaagaacccucacgcgaagaaacaggacguaguugugcuuggaucccaagagggcgccaugcauaccgcacugacuggggcuacagaaauccagaugucaagcggaaauuugcuauuuaccggucaccugaagugccgucuccgcauggacaaacugcagcuuaagggcaugaguuauucuauguguacagggaaauucaaggucgugaaggagauugccgaaacucaacauggaaccaucgucauaagagugcaguacgagggcgaugguuccccaugcaaaauucccuucgagaucauggaccuggaaaagaggcacguuuuggggcggcucaucacggugaacccgauuguaaccgagaaagauagcccugucaauaucgaagcugagcccccauuuggcgacucguacauuauaaucggaguggaaccuggccagcugaaguuaucuugguucaaaaagggguccucaauuggacagauguuugagacaacuaugcgaggugccaagcgcauggcaauccugggcgauaccgccugggacuucgggagucuaggaggcguuuuuacaagcaucgguaaagcucuccaucaaguguucggggcgauuuauggcgcagccuuuuccggagucucuuggacuaugaagauacugaucggcgugguaauuaccuggaucgggaugaacagcagaucaacgagucuuuccgugagcuugguucuggucggaguggugacacucuaccugggcgucaugguucaggcugauucugguuguguggugucauggaaaaauaaggagcuuaaaugcgggaguggaauuuucaucaccgacaacguacacacuuggacagaacaguauaaguuucagcccgagagcccauccaagcuggccucugcaauacaaaaagcccacgaagagggcaucugugguauuaggucggucacccgguuggaaaaucucauguggaagcagaucacucccgagcugaaccauauuuuaagcgagaaugaagugaaacugaccaucaugacaggcgauauaaaggggauuaugcaggcuggaaaacgcucccuaagaccucagccaacggagcucaaguacucauggaaagccuggggcaaggcaaagaugcugaguaccgaacuucacaaccauacuuucuugaucgacgggccggagacagcggaaugccccaauaccaacagggcuuggaacucucuggagguugaggauuauggauuuggcguguucacaacuaacauuuggcucaaacugaaggaacgucaagacgucuuuugugacagcaaauuaauguccgccgcaaucaaggauaaucgggccgugcacgcugacauggguuacuggauagagucagcccugaacgauaccuggaaaaucgaaaaggccagcuucauugagguuaagucuugccacuggccuaaaucccauacgcuuuggaguaacgggguguuggagagcgaaaugaucauuccaaagaauuucgcuggacccguaucucagcacaacuaucgaccuggcuaccauacacagaccgccgguccauggcaccucggcaaacuggagauggacuuugauuucugugaagggacuaccgucguggugacagaggacugcggaaauagaggccccucccuaaggacuaccacagcgucagggaagcugaucacggaauggugcugucgcaguugcacccucccgccucugcgguacagaggagaggauggcuguugguaugguauggagauaaggccacuuaaagaaaaggaggaaaacuuggucaauagccugguuacugccgggcauggacagauugacaacuuuucguuaggcgugcucgguauggcucuguuccuugaggaaaugcugcgcacacgaguaggcaccaagcacgcaaucuugcucguggccgucuccuuugugacucugaucacagggaauaugucuuuccgggaucuaggacguguuauggugauggucggcgcuaccaugacggacgauauugggaugggagugacuuaccuggcccuccuggcagcguuuaaaguuagacccaccuucgccgcuggccuuuugcugaggaaguuaacaagcaaagagcucaugaugaccacuaucgguauugugcugcuuucacaaaguacaauaccugagaccauccuggaacuaacagacgcccucgcacuggggaugauggucuugaagauuguacgcaacauggagaaauaucagcuggcugugacuaucauggccauuuuaugcguucccaaugcagugauccuccagaacgccuggaaggucuccuguaccauacuggcugugguaucugugagcccacuucuguugacguccucacaacagaaggcggauuggaucccucucgcccugacaauuaaaggacuaaaucccaccgcaaucuuucugacuacccuuagccggacaaguaagaaaagaucuuggccacucaacgaagcuauuauggccgucggcaugguuuccauccuggccagcucguugcugaagaaugacauaccgaugacuggcccuuuaguggcugggggacuccugaccgugugcuacguccuuacggguaggucagcagaccuggaguuggaacgagccgcggaugugcgcugggaggagcaggcugaaauuucuggcaguucccccauccucagcaucacaauuucugaggacgggagcauguccaucaagaaugaagaggaggaacagacccugacuauccuaauucggacaggacugcuuguuaucucaggccucuucccaguaaguauucccaucaccgccgcagccugguaucugugggaggugaagaaacaaagagcuggugucuugugggaugugccuagcccacccccuguugggaaggcagaauuagaggacggagccuacaggauaaagcagaaaggcauccugggcuauucucagauuggggcgggaguguacaaggaagguacuuuucacacaauguggcaugucacccguggcgcugugcucaugcacaaagggaagcgcaucgagccguccugggccgaugucaagaaggaccugauuucauacggaggcgguuggaaacuugagggggaauggaaagagggagaagagguccaggugcuggcauuggaaccaggcaagaauccccgggccguucaaacgaaaccuggccuauucaagacuaacaccgggacaaucggagcugugagucuggauuuuagcccagguaccuccggcucucccauagucgacaaaaaggggaaggugguuggacucuauggcaacgguguggucacaagaucggggacuuacgugagcgccauugcacagaccgagaaaucaaucgaggauaauccugaaaucgaggacgauauuuucaggaagaaacgacugacgaucauggaccuucauccgggagcuggcaagacaaaacgguauuuacccgccauaguacgcgaagcgauuaagagaggccugaggacucucaucuuggccccaacccgggugguugcagcugagauggaagaggcccugcgagggcucccuauuagauaccagacacccgcuauccgcgcagagcacaccggaagggaaauagucgaucugaugugucaugccacuuucaccaugcgucuucuguccccaauucgggugccuaacuauaauuugaucaucauggacgaggcccacuuuacagaccccgcuaguauugcggcaagagguuacaucucuacgaggguggaaaugggcgaggccgcugggauuuucaugacugccaccccaccgggaagccgcgauccuuuuccccaguccaacgcaccaauaauggacgaggaacgagagauccccgaaagaucauggaacucuggccacgagugggucacagauuucaaggguaaaaccguaugguuugugccuagcauuaaggccgggaacgacaucgcugcgugccuacggaaaaauggaaagaaaguuauccaacugaguaggaagacuuucgauuccgaauaugugaagacacgcaccaacgacugggauuuugucgugacgacugacauuagcgagaugggcgccaauuucaaagcagagcguguuauagauccaagacgguguaugaagcccgugauccucacagacggcgaagagagggucauuuuagcugggccuaugccggugacccauucuucagccgcacagcgccgaggaagaguaggucggaaccccaagaaugaaaacgaucaguacaucuacaugggcgagccccuggaaaaugacgaggacugcgcccacuggaaggaggcuaaaaugcuucuggauaacauuaauaccccugaagggaucauacccuccauguuugagccagaaagggagaagguggacgccaucgauggagaauaucgccucagaggcgaggcgaggaaaacuuucguugacuugaugcggcguggugaucugccugucuggcucgcauaccgcguggccgcugaggggauuaacuaugccgaccgaagaugguguuuugauggcgugaagaacaaucaaauccuggaagagaacgucgaaguugagauuuggacaaaggagggagaaaggaagaaacuuaaaccccgguggcuagacgcucgcaucuacagugauccacuggcauugaaagaguucaaagaguucgccgcuggcagaaagagcuuaacccugaaucucauaacagagauggggaggcugccuacuuuuaugacgcagaaggcccggaacgcacuugacaaucuggcggugcuccauaccgccgaagcuggaggucgagccuauaaccacgcauugucggagcugccggagacacuagaaacucugcuccuucugaccuuauuggcuacaguaaccggcgggauuuuccuguuucucaugucuggaaaaggcaucgguaagaugacucuggggaugugcugcauuaucacggccuccgugcuucugugguacgcacagauacagccccacuggaucgccgcuagcauuauccucgaguucuuuuugauuguccuguuaaucccagaaccugagaaacaaagaacaccacaggauaaucagcuaacauaugugguuauagcgauucugacuguggucgccgcaaccauggcuaacgaaaugggcuuccucgagaagaccaagaaggacuuuggacuuggcgggaucgccacccagcaaccagagucaaauauccuggauauugacuugcgcccugccagugcauggacucuguacgcuguagccacaacguucaucacccccaugcucaggcauucuauagaaaacuccagcgugaauguuucacugacugcgauugcuaaccaggccacagugcuuaugggacucgguaagggcuggccgcugaguaaaauggacaucggggucccauugcuggcaauuggauguuacagccaggugaauccuaucaccuuaaccgccgcucuacugcuccuugucgcacacuaugccauaaucggccccggucugcaggcgaaggcuacacgggaggcccaaaaacgugcagccgcugggauuaugaagaacccaacuguggauggcaucacgguuauugacuuggaucccaucccuuacgacccgaaauuugaaaagcagcugggacaggugaugcuccugguacuuugcgugacccaggucuuaaugaugagaacaacuugggcccugugugaggcacucaccuuggcuacaggccccauuuccacccugugggaagggaauccaggaagguucuggaacacuacgaucgccguuucuauggcgaauauauuucgcggcagcuaucuagccggugcagggcuacucuucuccauuaugaagaacacagcuaacacccggcgaggaacuggcaauaccggugagacacuuggcgagaaauggaagaacagacugaaugccuuggggaaaucagaauuucaaaucuacaagaaaucuggaauccaggagguggauaggacucuggcaaaggaaggcauuaaacgcggggagaccgaccaucacgcugucagucggggaucggccaagcucagaugguucguggagcguaaccugguaacaccugaaggcaaggugauggauuuagguugcgggaggggaggcuggagcuauuacugugguggccuuaaaaauguuaaggaggugaaagggcugacgaagggaggccccgggcaugaagaaccuauaccaauguccaccuauggauggaaccucguccggcuacagucuggcguggacgucuucuuuacucccccugaaaaaugcgauacacuguugugugacaucggugagucaagcccaaaucccaccguggaggccgggcgcacucugcgaguucucaaccuuguagaaaauuggcugaacaauaacacacaauucugcauuaagguguugaauccguacaugccuuccgucaucgagaagauggaagcgcugcagagaaaauacggaggcgcucucgugaggaacccauuaaguagaaauucuacccacgagauguauuggguuagcaacgcaucaggcaacauuguguccagugucaauaugaucagccgcaugcugauaaacagauuuacgaugaggcacaagaaagccaccuacgaacccgauguggaccuugggucuggaacacgaaauaucgguauugaguccgagaucccuaaccuggauauuaucggcaagcggauagagaaaauuaagcaggaacaugaaacuucauggcacuaugaccaggaccauccauacaagaccugggcuuaucacgggagcuacgagacaaaacaaacuggaucggccucuaguaugguaaauggcgugguucgucuacucaccaagcccugggaugucaucccgauggugacacagauggcaaugaccgacacuacgccuuucggucagcagagaguguuuaaagaaaaggucgauacacgcacccaagagcccaaagaggggacuaagaagcugaugaaaaucaccgccgaaugguuguggaaggagcugggcaaaaagaaaacaccaaggauguguacgcgggaagaguucaccagaaagguucgcuccaacgcugcgcucggcgccauuuuuacugacgagaauaaauggaaaagcgcaagggaagcuguggaggauucaggcuucugggaacuuguagacaaggagcgaaaccugcacuuagaagggaaaugcgagacauguguguauaauaugaugggaaagcgggagaaaaagcugggugaauuuggcaaagccaagggguccagagcaauaugguacaugugguugggagccagguuccucgaguuugaagcucugggcuuccuaaacgaggaucauugguuuucucgcgaaaauagccuuaguggugucgagggggagggacugcacaagcucggcuacauccugcgugacguguccaaaaaggaaggcggggccauguaugcggaugacaccgcaggaugggauacucggauuacauuggaggaccugaaaaacgaagagaugguuaccaaucauauggaaggugagcacaagaaacucgccgaggcuaucuucaaacuuacauaccagaacaagguggucagagugcagaggccuacuccccgcggcaccguaauggacauuaucagccgacgggaucagagagggucuggacaaguugugacguauggccugaauaccuucacaaacauggaagcccaguuaauaaggcagauggagggugaaggggucuuuaaaucaauccaacagcugacugcaaccgaggagauugcugugaagaacugguuggcccgcgugggaagagaacggcucaguaggauggcuaucuccggcgacgauugcgucguuaaaccacuggacgaucguuucgccagcgcacuaacagcgcuuaaugacaugggcaaggugcgaaaagauauucagcagugggagcccucucgcggguggaacgacuggacucaaguaccuuuuugcucgcaucacuuccacgaacugaucaugaaggauggaagagugcucgucgugccaugucggaaucaggacgagcugauugguagggcccgcauaucacagggcgcuggguggagcuugagagaaaccgccugcuuaggaaaguccuacgcacagauguggagucugauguauuuucaucggagggaucuccgacuugcugccaacgcaaucuguucugccguuccgagccacugggugcccacgucccguacaaccuggucaauucaugcgacucacgaguggaugacaaccgaggacaugcugacugucuggaauagaguguggauccaagaaaacccuuggaucgaggauaaaaccccaguagaaaguugggaggaaauucccuaccuaggcaagcgcgaggaccaguggugcgguucucugauagggcucacaagccgggcuacgugggccaaaaauauccagaccgcaauuaaccagguuagguccuugaucggaaaugaggaauauacugacuacaugccuucaaugaagagauuccgccgggaggaagaggaagccggcgugcugugguga

SEQ ID NO: 15064 - RNA, 9876 nt, Artificial Sequence
  derived and/or modified CDS sequence (opt3) from DENV-2__AY702036__SS-prME
accgccggcgugaucgucaugcugauucccacagcuauggcauuccaccucacuacgagaaacggggagccucauaugauaguuggaaggcaggaaaaggguaaaagccuucuguuuaagaccgaggacggcgugaauaugugcacauugauggccaucgauuuaggggaacugugugaggacacuauuaccuacaaaugcccacuacuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaagagcaggacaaacgauuuaucugcaagcauucuauggucgauagaggcugggguaacggguguggacuauucggcaagggcgggaucgugaccugcgccauguuuacaugcaaaaagaauauggaaggaaaagugguccagccugagaaccucgaauacaccauuguuauaacuccacacagcggugaggagcaugcugugggcaaugacacggggaagcacggaaaagaaaucaagauuacaccgcaguccucaaucaccgaggccgaacugacuggcuaugguaccguaacaauggaguguagucccaggaccgggcuugauuucaacgaaauggugcuguugcaaauggaggacaaagcauggcucguccaccggcagugguuucuggauuuaccucugccauggcuccccggcgcugacacucagggaagcaauuggauacagaaggagacacuugugacguucaagaacccucaugccaaaaagcaagacguugugguccugggcucucaggaaggggcgaugcacaccgccuugacuggagcaacagagauucagauguccucagguaaucuacuguuuaccggccaucucaaaugccgucugcgcauggauaagcuucaacugaaagggaugagcuacaguauguguacaggaaaguucaagaucgugaaagaaaucgcugagacucagcacggcaccauuguaaucagaguucaguaugagggugacgggucuccaugcaagauucccuucgaaauaacggauuuggagaaaaggcaugugcucggccggcugaucaccgucaacccgauugugacagaaaaggacuccccugucaacaucgaggccgaacccccauuuggagauagcuacaucauuauaggcguggagccugggcaguuaaaacugaauugguucaagaagggaucgucuaucggucaaauguuugagacuaccaugcgaggcgcuaaacgcauggccauucuaggggacacagcaugggauuucggaucccucggcgguguuuuuacuucaaucgggaaggcccugcaccagguguucggcgcuauuuacggagcggcauuuaguggcguaagcuggaccaugaaaauccuuauaggggucaucauuacguggaucggaaugaacuccagaucuacaagcuugucagugagucugguucucgugggcgucgugacccuguaucuuggugccaugguacaggcugacuccgggugugugguuagcuggaagaauaaagaacugaagugcggaucuggcauuuucaucacugauaacguccacacauggaccgagcaguacaaguuucaacccgaaucaccaaguaaauuggccagcgcaauacagaaggcccaugaggaagguauuuguggcaucagguccgugacucggcucgagaaucugauguggaaacagauuacccccgaguuaaaccacauccugucugaaaaugaggugaagcuaacaauaaugacgggggacaucaaaggaauuaugcaggcuggcaagcgcucgcucagaccucaaccaaccgaacugaaauauagcuggaagacuugggggaaggccaaaaugcuuuccacagagucacauaaccagaccuucuugaucgauggaccggaaacagcagagugccccaauacuaacagggcguggaauagucuggaggucgaagacuacggcuuugguguuuucucuaccaacauuuggcucaagcugcgugagaaacaggacguguuuugugauagcaaguuaauguccgcugccaucaaagacaaucgggcagugcacgccgauaugggguauuggauagaaucagcucugaacgacacguggaagauggagaaggccagcuucauugagguaaaaucuugccacuggccuaagucccauacacuuuggaguaauggagucuuggaaagcgagaugaucaucccaaaaaacuucgcaggccccgugucucagcacaacuaccgaccugguuaucauacccaaacugcuggcccauggcaccucgggaagcuggaaauggauuuugacuucugugagggaaccacaguuguggucacugaagauugcggcaauagagggcccucccuaaggaccacaacggccucaggaaaacugauuaccgaguggugcugucgcaguugcacucucccgccucugcgguacagaggcgaggacgguuguugguacgggauggaaaucaggccacuuaaggagaaggaagagaacuuggugaauagccugguuacagcgggacauggccagauugauaacuuuucguuaggugugcucggcauggcccuguuccuugaagagaugcugcgcacccgaguagggacuaaacacgcuauauugcucgucgcaguguccuuugugacacugaucaccggaaauaugucuuuccgggaccuaggccgugucaugguuauggugggggccacgaugacugaugacauuggaaugggcguaaccuaucuggcucuccuggccgcauuuaaggugagacccacauucgcggccggucuuuugcugaggaaauuaaccagcaaggagcucaugauggcuacuaucgggauugcccugcuuucacagaguacaaugccugaaaccauccuggagcuaacagaugcacucgcucugggaaugauggucuugaaaauagugcgcaacauggaaaaguaccaacuggccguuacuaucauggcaauuuccugcgugcccaaugccgucaucuuacagaacgcuuggaaggugucuuguaccauucucgcggccguuagcguguccccacugcuucugacgucaagccagcagaaagcagacuggaucccuuuggcucucacaauaaagggccugaaucccaccgccauuuuucuaacuacccugagucggacaucuaaaaagagauccuggccacuuaacgaggccaucauggcugucggcaugguaagcauccucgcaucgucacuguugaaaaaugacauuccgaugacugggccucugguggccggagguuuacucaccguuugcuaugugcugacgggcaggucugcggaucuugaacuggagcgagcugccgacgucaagugggaggaucaagcagaaauaaguggguccagccccaucuugucuauuacaaucagcgaggacggauccaugucaauuaaaaacgaagaggaggaacagacccucacuauccugauacgcacaggccuacuggugaucagugguguauucccagugagcauucccaucaccgccgcugcaugguaccuuugggaggucaagaagcagcgggccgggguucucugggaugugccuucuccacccccugugggaaaagcggaacuggaggacggcgcuuauagaauuaagcagaggggcaucuugggguacucccaaauaggagccggugucuauaaagaaggcacuuuucacacaauguggcaugugacccguggggcaguuuuaaugcaccgcggaaagcggauugagccgucaugggccgauguaaaaaaggaccugaucaguuacggcgguggguggaagcucgagggagaauggaaagagggcgaagaggugcagguccuggcucuugaaccaggcaagaaucccagagccgugcagacgaaaccugggaucuucaagacuaacaccggaacaauuggugcaguuagccuggauuuuuccccaggcaccucugggucgcccaucguggacaggaaaggaaaggucgugggcuuguacgguaaugggguagucacacgaagcggagcuuaugugucagccauagcgcagacugagaaguccauugaggauaacccugaaaucgaggacgauauuuuccggaaaaagcgccuaaccaucauggaccugcauccgggcgccggcaaaacgaagagauaccuccccgcaauaguuagggaagcuauuaaccgggggcugcgaacacuuaucuuagccccaacuagaguggucgcugcagagauggaagaggcccugcgcggacucccuaucagguaucaaacccccgccauucgugcugagcacacaggucgggaaaucguggacuugaugugucaugcgaccuucacuaugagacugcucaguccaguuagggugccuaauuacaaccugauuauaauggaugaggcacacuuuaccgaccccgccucuaucgcugcccgcggcuauauuagcacacgagucgaaaugggggaggcagccggaaucuucaugacggcuacuccaccgggcuccagagauccuuuuccccagucaaaugcgccaaucauggacgaggaacgggagauucccgaaaggucuuggaacagcggucacgagugggugaccgauuucaaagggaagacaguaugguuugugccuaguauaaaggccggaaaugacaucgcagcuugccuucgcaaaaacggcaagaaaguuauucagcugucccguaagaccuucgauagcgaauacgucaaaacuagagccaaugacugggauuuuguggugacaaccgacaucucugagaugggcgcaaacuucaaggccgagcgggucauugauccaaggcgcuguaugaagcccguaaucuugacggacggggaagagcgagugauacuagcuggaccuaugccgguuacucauucauccgccgcgcaaagacgggguaggaucggccgcaauccaaaaaacgaaaaugaccaguauauuuacaugggggagccccuggaaaacgaugaggacugcgcacacuggaaggaggccaaaaugcucuuagauaauaucaacacaccugaaggaauuauccccaguauguuugagccagaaagagagaagguggacgcuauagauggcgaauacaggcugcggggugaggcccguaaaaccuucgucgaccuuaugcgccgaggggaucugccuguguggcucgcuuauaagguugcagccgagggcauuaauuacgcugacagaaaaugguguuuugauggaaucaagaacaaccagauuuuggaagagaauguggaagucgagaucuggaccaaggagggcgaaaggaaaaagcugaaaccccgguggcucgacgcccgcauauauagcgauccacuggcacuuaaggaguucaaagaauucgcggccgggagaaagucgcuaacucugaacuugaucacagagaugggaagguuaccuaccuuuaugacacagaaggcucggaaugcccuggacaaccucgcagugcugcauacugcugaagccgguggccgagcauacaaucacgcccuuucugagcugccggagacgcucgaaaccuugcugcuacugacacuccuugcuacuguaaccgggggaauuuuccuguuuuuaauguccggcaaagguaucgggaagaugacauugggcaugugcugcauuaucaccgcgagcucacugcucugguaugcccaaauacagccccacuggauugcagcuaguaucauccuggaguucuuucuuauugugcugcucaucccagaaccugagaaacagagaacuccccaggauaaccaauugacguacguugucauagccauucugaccgugguggccgcaacaauggcuaaugaaaugggauucuuagagaagacuaaaaaggaccuaggccuggggucuaucaccacacaggaguccgaaagcaacauucucgacaucgaucuucgcccagccucagcguggacccuguaugcugucgccacuacauuuguuacgccuauguugaggcauaguauagagaauagcuccgugaacguaucucugaccgcaaucgccaaucaggcuacugugcucaugggacuggguaagggcuggccccuuagcaaaauggacauuggggucccgcuccuggcaaucggauguuacucccaggugaacccaauuacauugaccgccgcgcuguuacuacugguugcucacuacgccaucauuggcccuggucuccaagcaaaggccacccgggaagcucagaaacgugccgcagcugggaucaugaagaaucccacaguggauggcauaacugucauugaccuugagccaauccccuaugauccuaaauucgaaaagcagcugggacagguaauguugcugauccucugcgugacgcaaguucugaugaugagaaccacaugggcccuuugugaggcguuaacucuggccaccggcccgauuucaacacucugggaggggaaccccggaagguuuuggaauaccacuauagcagugucuauggcuaacaucuuccgcggcaguuacuuggccggugcagggcugcuauuuucgauuaugaagaauacgacaaacacccggcgaggaacuggcaacaucggugaaacccugggcgagaaauggaagagcagacucaaugcucuugggaaauccgaauuccagauuuauaagaaaucuggaauccaggaggucgacaggacacuggccaaggagggcauaaaacgcggggaaacugaucaucacgccgugucacggggaagcgcgaaguugagaugguuugucgagcguaacauggugaccccagaaggcaagguuguggaccuggguugcgggaggggaggcugguccuacuauugugguggccucaaaaauguacgggaggugaaggggcugacaaaaggaggcccugggcaugaagagcccaucccuaugaguacguacggauggaacuuaguccgccuucaaucuggcguugauguguucuucaccccacccgagaagugcgacacucugcucugugauauuggugaaagcucaccuaauccaacaaucgaggcugggcgaacccuaagaguccugaacuugguggaaaauuggcugaacaauaacacucaguuuugcauuaaaguacucaaucccuauaugccguccgugaucgagaagauggaaacacuucagaggaaguacggaggcgcacugguucggaacccuuugagucgcaauagcacccacgagauguacugggugucuaacgccacgggcaauauagucuccucagugaacaugauuagcagaaugcugaucaacagguucaccaugaaacacaagaaagcuacauaugagccagacgucgaucucgggucgggaacucgaaauaucgguauugaaucugagauacccaacuuagacaucauuggcaagcggaucgaaaaaauuaagcaggagcaugaaaccaguuggcacuacgaccaagaucauccuuauaagacaugggccuaccacggguccuaugagacuaaacagaccggaagcgcaucauccauggugaauggcguuguacgucugcuuacaaagccaugggacgugguccccauggugacccagauggccaugacugauacgacaccguuuggucagcaaagaguuuucaaagagaagguggacacccgcacucaggaaccuaaagaggggaccaagaagcugaugaaaaucacagcugaauggcuauggaaggagcucggaaaaaagaaaacgcccaggauguguacccgggaggaauuuacuagaaagguccgcucuaacgcggcccugggcgcaauauucacagaugagaauaaauggaagagcgcuagggaagccguggaggacggccgauuuugggaauugguagaucgggagagaaaccugcaccucgaggggaagugcgaaaccuguguguacaauaugaugggaaaaagggagaagaaacuuggugaauucggcaaggcaaaagggagucgcgccaucugguauauguggcugggagcucguuuuuuagaguucgaagcccugggcuuuuugaacgaggaccauugguucucccgggguaauagccucucugggguugagggagaaggccugcacagacuaggcuacauucuuagggaggucgggaagaaggaaggaggugcgauguacgcagaugacacugccggcugggauacacgcaucacccuggaggaccucaaaaacgaagagauggugacaaaucauaugaagggggagcacaaaaagcuggcugaagccauuuuuaaauugacuuaucagaacaaggugguccgaguucagcggccaaccccuagaggaacggugauggacaucauuucaaggcgcgaucaaagaggcaguggucagguagggaccuacggacugaauacauucacuaacauggaggcacagcucauacggcaaauggaaggcgagggcaucuucaaguccauucagcaucuuaccgcuacagaggaaaucgccgugcagaauuggcuggcuagggucgggcgugagcgauuaagccgcauggccaucucuggagacgauugcgugguuaaacccauugacgauagauuugcaucggcgcugacugccuugaacgacauggguaaggugcggaaagauauacagcaaugggaaccaucaaggggcuggaacgacuggacccagguccccuucugcagccaccacuuucaugagcucgugaugaaggaugggcgcguacugguugugccuuguagaaaucaggacgaacuaaucggacgggcuaggauuucccagggcgccgguuggagucuuaaagagacggcaugccuggggaagucuuaugcucaaauguggacacucauguacuuccaccgacgugaucugagauuggccgcaaacgccaucuguagcgcggucccaucccauugggugccgaccucacgcacuacauggaguauucacgcuaagcacgaguggaugaccacugaagacauguuagccguguggaaucgggucuggauccaggagaaccccuggauggaagauaaaaccccuguugagucuugggaagaggugccauaucugggaaagagggaggaccaguggugcggcagccucauaggccuuacauccagagcaacgugggccaaaaauauccagaccgcuauuaaccaaguacgcucacugaucgggaaugaagaguacacugacuauaugcccagcaugaagcgguuuaggcgagaagaggaagaggccggagugcuaugguga

SEQ ID NO: 15065 - RNA, 9876 nt, Artificial Sequence
  derived and/or modified CDS sequence (opt3) from DENV-2__AY702034__SS-prME
accgccggcgugaucgucaugcugauucccacagcuauggcauuccaccucacuacgagaaacggggagccucauaugauaguuggaaggcaggaaaaggguaaaagccuucuguuuaagaccgaggacggcgugaauaugugcacauugauggccaucgauuuaggggaacugugugaggacacuauuaccuacaaaugcccacuacuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaagagcaggacaaacgauuuaucugcaagcauucuauggucgauagaggcugggguaacggguguggacuauucggcaagggcgggaucgugaccugcgccauguuuacaugcaaaaagaauauggaaggaaaagugguccagccugagaaccucgaauacaccauuguuauaacuccacacagcggugaggagcaugcugugggcaaugacacggggaagcacggaaaagaaaucaagauuacaccgcaguccucaaucaccgaggccgaacugacuggcuaugguaccguaacaauggaguguagucccaggaccgggcuugauuucaacgaaauggugcuguugcaaauggaggacaaagcauggcucguccaccggcagugguuucuggauuuaccucugccauggcuccccggcgcugacacucagggaagcaauuggauacagaaggagacacuugugacguucaagaacccucaugccaaaaagcaagacguugugguccugggcucucaggaaggggcgaugcacaccgccuugacuggagcaacagagauucagauguccucagguaaucuacuguuuaccggccaucucaaaugccgucugcgcauggauaagcuucaacugaaagggaugagcuacaguauguguacaggaaaguucaagaucgugaaagaaaucgcugagacucagcacggcaccauuguaaucagaguucaguaugagggugacgggucuccaugcaagauucccuucgaaauaacggauuuggagaaaaggcaugugcucggccggcugaucaccgucaacccgauugugacagaaaaggacuccccugucaacaucgaggccgaacccccauuuggagauagcuacaucauuauaggcguggagccugggcaguuaaaacugaauugguucaagaagggaucgucuaucggucaaauguuugagacuaccaugcgaggcgcuaaacgcauggccauucuaggggacacagcaugggauuucggaucccucggcgguguuuuuacuucaaucgggaaggcccugcaccagguguucggcgcuauuuacggagcggcauuuaguggcguaagcuggaccaugaaaauccuuauaggggucaucauuacguggaucggaaugaacuccagaucuacaagcuugucagugagucugguucucgugggcgucgugacccuguaucuuggugccaugguacaggcugacuccgggugugugguuagcuggaagaauaaagaacugaagugcggaucuggcauuuucaucacugauaacguccacacauggaccgagcaguacaaguuucaacccgaaucaccaaguaaauuggccagcgcaauacagaaggcccaugaggaagguauuuguggcaucagguccgugacucggcucgagaaucugauguggaaacagauuacccccgaguuaaaccacauccugucugaaaaugaggugaagcuaacaauaaugacgggggacaucaaaggaauuaugcaggcuggcaagcgcucgcucagaccucaaccaaccgaacugaaauauagcuggaagacuugggggaaggccaaaaugcuuuccacagagucacauaaccagaccuucuugaucgauggaccggaaacagcagagugccccaauacuaacagggcguggaauagucuggaggucgaagacuacggcuuugguguuuucaccacgaacauuuggcucaagcugcgugagaaacaggacguguuuugugauucuaaguuaaugagcgcugccaucaaagacaaucgggcagugcacgccgauaugggguauuggauagaauccgcucugaacgacacauggaagauggagaaggccucauucauugagguaaaaagcugccacuggccuaagucucauacccuuugguccaauggagucuuggaaagugagaugaucaucccaaaaaacuucgcaggccccgugagccagcacaacuaccgaccugguuaucauacucaaaccgcuggcccauggcaccucgggaagcuggaaauggauuuugacuucugugagggaacaacuguuguggucaccgaagauugcggcaauagagggcccucucuaaggacaacgaccgccuccggaaaacugauuacugaguggugcugucgcucaugcacacucccgccucugcgguacagaggcgaggacgguuguugguacgggauggaaaucaggccacuuaaggagaaggaagagaacuuggugaauagucugguuaccgcgggacauggccagauugauaacuuuagcuuaggugugcucggcauggcccuguuccuugaagagaugcugcgcacucgaguagggacaaaacacgcuauauugcucgucgcagugucguuugugacccugaucacgggaaauauguccuuccgggaccuaggccgugucaugguuauggugggggccacuaugaccgaugacauuggaaugggcguaacauaucuggcucuccuggccgcauuuaaggugagacccaccuucgcggccggucuuuugcugaggaaauuaacuucuaaggagcucaugauggcuacaaucgggauugcccugcuuagccagucaaccaugccugaaacaauccuggagcuaacugaugcacucgcucugggaaugauggucuugaaaauagugcgcaacauggaaaaguaccaacuggccguuaccaucauggcaauuaguugcgugcccaaugccgucaucuuacagaacgcuuggaagguguccuguacgauucucgcggccguuucugugagcccacugcuucugacauccucacagcagaaagcagacuggaucccuuuggcucucaccauaaagggccugaaucccacugccauuuuucuaaccacacugagccggacuaguaaaaagagaucuuggccacuuaacgaggccaucauggcugucggcaugguauccauccucgcaagcucgcuguugaaaaaugacauuccgaugaccgggccucugguggccggagguuuacucacgguuugcuaugugcugacaggcaggucagcggaucuugaacuggagcgagcugccgacgucaagugggaggaucaagcagaaauaucugggaguucccccaucuugagcauuaccaucucugaggacggaagcauguccauuaaaaacgaagaggaggaacagacucucacaauccugauacgcaccggccuacuggugaucucagguguauucccagugaguauucccaucacugccgcugcaugguaccuuugggaggucaagaagcagcgggccgggguucucugggaugugccuagcccacccccugugggaaaagcggaacuggaggacggcgcuuauagaauuaagcagaggggcaucuugggguacucucaaauaggagccggugucuauaaagaaggcacauuucacaccauguggcaugugacgcguggggcaguuuuaaugcaccgcggaaagcggauugagccguccugggccgauguaaaaaaggaccugaucucauacggcgguggguggaagcucgagggagaauggaaagagggcgaagaggugcagguccuggcucuugaaccaggcaagaaucccagagccgugcagacuaaaccugggaucuucaagaccaacacaggaaccauuggugcaguuagucuggauuuuagcccaggcacauccgggucucccaucguggacaggaaaggaaaggucgugggcuuguacgguaaugggguagucacucgaucgggagcuuaugugagcgccauagcgcagaccgagaagucaauugaggauaacccugaaaucgaggacgauauuuuccggaaaaagcgccuaacgaucauggaccugcauccgggcgccggcaaaacaaagagauaccuccccgcaauaguuagggaagcuauuaaccgggggcugcgaacucuuaucuuagccccaaccagaguggucgcugcagagauggaagaggcccugcgcggacucccuaucagguaucaaacacccgccauucgugcugagcacaccggucgggaaaucguggacuugaugugucaugcgacuuucaccaugagacugcucuccccaguuagggugccuaauuacaaccugauuauaauggaugaggcacacuuuacagaccccgccaguaucgcugcccgcggcuauauuucuacgcgagucgaaaugggggaggcagccggaaucuucaugacugcuaccccaccgggcagcagagauccuuuuccccaguccaaugcgccaaucauggacgaggaacgggagauucccgaaaggucauggaacucuggucacgagugggugacagauuucaaagggaagaccguaugguuugugccuagcauaaaggccggaaaugacaucgcagcuugccuucgcaaaaacggcaagaaaguuauucagcugagucguaagacuuucgauuccgaauacgucaaaacaagagccaaugacugggauuuuguggugaccacggacaucagcgagaugggcgcaaacuucaaggccgagcgggucauugauccaaggcgcuguaugaagcccguaaucuugacugacggggaagagcgagugauacuagcuggaccuaugccgguuacacauucuucagccgcgcaaagacgggguaggaucggccgcaauccaaaaaacgaaaaugaccaguauauuuacaugggggagccccuggaaaacgaugaggacugcgcacacuggaaggaggccaaaaugcucuuagauaauaucaacaccccugaaggaauuauccccuccauguuugagccagaaagagagaagguggacgcuauagauggcgaauacaggcugcggggugaggcccguaaaaccuucgucgaccuuaugcgccgaggggaucugccuguguggcucgcuuauaagguugcagccgagggcauuaauuacgcugacagaaaaugguguuuugauggaaucaagaacaaccagauuuuggaagagaauguggaagucgagaucuggacuaaggagggcgaaaggaaaaagcugaaaccccgguggcucgacgcccgcauauauagugauccacuggcacuuaaggaguucaaagaauucgcggccgggagaaagagccuaacacugaacuugaucaccgagaugggaagguuaccuacauuuaugacucagaaggcucggaaugcccuggacaaccucgcagugcugcauacggcugaagccgguggccgagcauacaaucacgcccuuucggagcugccggagacccucgaaacauugcugcuacugacucuccuugcuaccguaacagggggaauuuuccuguuuuuaaugucuggcaaagguaucgggaagaugaccuugggcaugugcugcauuaucacugcguccagccugcucugguaugcccaaauacagccccacuggauugcagcuucaaucauccuggaguucuuucuuauugugcugcucaucccagaaccugagaaacagagaacgccccaggauaaccaauugaccuacguugucauagccauucugacagugguggccgcaacuauggcuaaugaaaugggauucuuagagaagaccaaaaaggaccuaggccuggggaguaucacaacccaggagucugaauccaacauucucgacaucgaucuucgcccagccagcgcguggacucuguaugcugucgccacaacguuuguuaccccuauguugaggcauucaauagagaauaguagcgugaacguaucccugacugcaaucgccaaucaggcuacagugcucaugggacuggguaagggcuggccccuuucuaaaauggacauuggggucccgcuccuggcaaucggauguuacagccaggugaacccaauuaccuugaccgccgcgcuguuacuacugguugcucacuacgccaucauuggcccuggucuccaagcaaaggccacacgggaagcucagaaacgugccgcagcugggaucaugaagaaucccacuguggauggcauaacggucauugaccuugagccaauccccuaugauccuaaauucgaaaagcagcugggacagguaauguugcugauccucugcgugacccaaguucugaugaugagaacaacuugggcccuuugugaggcguuaacccuggccacaggcccgauuuccacccucugggaggggaaccccggaagguuuuggaauacuacgauagcagugucaauggcuaacaucuuccgcggcucuuacuuggccggugcagggcugcuauuuaguauuaugaagaauacaaccaacacucggcgaggaaccggcaacaucggugaaacacugggcgagaaauggaagucgagacucaaugcucuugggaaaagcgaauuccagauuuauaagaaauccggaauccaggaggucgacaggacucuggccaaggagggcauaaaacgcggggaaaccgaucaucacgccgugucucggggaucagcgaaguugagaugguuugucgagcguaacauggugacaccagaaggcaagguuguggaccuggguugcgggaggggaggcuggagcuacuauugugguggccucaaaaauguacgggaggugaaggggcugacgaaaggaggcccugggcaugaagagcccaucccuauguccaccuacggauggaacuuaguccgccuucaaaguggcguugauguguucuucacuccacccgagaagugcgacacacugcucugugauauuggugaaucuagcccuaauccaaccaucgaggcugggcgaacucuaagaguccugaacuugguggaaaauuggcugaacaauaacacacaguuuugcauuaaaguacucaaucccuauaugccgucagugaucgagaagauggaaacccuucagaggaaguacggaggcgcacugguucggaacccuuugucccgcaauaguacgcacgagauguacugggugagcaacgccaccggcaauauagucucuuccgugaacaugauuucaagaaugcugaucaacagguucacaaugaaacacaagaaagcuacuuaugagccagacgucgaucucgggagcggaacccgaaauaucgguauugaaucggagauacccaacuuagacaucauuggcaagcggaucgaaaaaauuaagcaggagcaugaaacaucuuggcacuacgaccaagaucauccuuauaagacuugggccuaccacgggaguuaugagaccaaacagacaggauccgcaagcucaauggugaauggcguuguacgucugcuuaccaagccaugggacgugguccccauggugacucagauggccaugacggauacaaccccguuuggucagcaaagaguuuucaaagagaagguggacacucgcacccaggaaccuaaagaggggacaaagaagcugaugaaaaucacggcugaauggcuauggaaggagcucggaaaaaagaaaacccccaggauguguacucgggaggaauuuacaagaaagguccgcuccaacgcggcccugggcgcaauauucaccgaugagaauaaauggaagucugcuagggaagccguggaggacggccgauuuugggaauugguagaucgggagagaaaccugcaccucgaggggaagugcgaaacuuguguguacaauaugaugggaaaaagggagaagaaacuuggugaauucggcaaggcaaaagggagccgcgccaucugguauauguggcugggagcucguuuuuuagaguucgaagcccugggcuuuuugaacgaggaccauugguucagucgggguaauucccucagcgggguugagggagaaggccugcacagacuaggcuacauucuuagggaggucgggaagaaggaaggaggugcgauguacgcagaugacacagccggcugggauacccgcaucacacuggaggaccucaaaaacgaagagauggugacuaaucauaugaagggggagcacaaaaagcuggcugaagccauuuuuaaauugaccuaucagaacaaggugguccgaguucagcggccaacgccuagaggaaccgugauggacaucauuucuaggcgcgaucaaagaggcucaggucagguagggacauacggacugaauacuuucaccaacauggaggcacagcucauacggcaaauggaaggcgagggcaucuucaagaguauucagcaucuuacagcuacugaggaaaucgccgugcagaauuggcuggcuagggucgggcgugagcgauuaucccgcauggccaucagcggagacgauugcgugguuaaacccauugacgauagauuugcaucugcgcugaccgccuugaacgacauggguaaggugcggaaagauauacagcaaugggaaccaucgaggggcuggaacgacuggacgcagguccccuucugcucacaccacuuucaugagcucgugaugaaggaugggcgcguacugguugugccuuguagaaaucaggacgaacuaaucggacgggcuaggauuagccagggcgccgguuggucccuuaaagagacagcaugccuggggaagaguuaugcucaaauguggacccucauguacuuccaccgacgugaucugagauuggccgcaaacgccaucuguucugcggucccaagccauugggugccgacuucccgcacaaccuggucaauucacgcuaagcacgaguggaugacuaccgaagacauguuagccguguggaaucgggucuggauccaggagaaccccuggauggaagauaaaacaccuguugagaguugggaagaggugccauaucugggaaagagggaggaccaguggugcggcucucucauaggccuuacgagcagagcaaccugggccaaaaauauccagacugcuauuaaccaaguacgcucccugaucgggaaugaagaguacacagacuauaugcccucaaugaagcgguuuaggcgagaagaggaagaggccggagugcuaugguga

SEQ ID NO: 15066 - RNA, 9876 nt, Artificial Sequence
  derived and/or modified CDS sequence (opt3) from DENV-2__AF208496__SS-prME
accgcaggcgugaucguaaugcugauucccacagcuauggcauuccaccucacuacgagaaauggggagccucauaugauaguuggaaggcaggaaaaggguaaaagccuucuguuuaagaccgaggacggcgugaauaugugcacauugauggccaucgauuuaggggaacugugugaggacacuauuaccuacaaaugcccauuccuacggcaaaacgaaccggaggauaucgacuguuggugcaauuuuacauccaccugggugacuuauggaacauguaccacgacuggcgagcaccgccgagaaaagcguucuguggcgcucguaccccauguggguauggggcuggagaccagaacagaaacuuggaugucaagugagggagcuuggaaacacguucagaggauugagaccuggauccuucggcauccuggcuucacaauaauggccgcaauccuggccuacaccauuggcacgacucacuuucagcgcgcuuugaucuucauucuccugacagcaguggccccaagcaugaccaugagaugcaucgggauauccaacagggauuuugucgaaggagugucugguggcucguggguagacauuguucuggagcacgggucaugugugacuacaauggcuaagaauaagcccacccucgauuucgaauuaaucaaaacggaggccaagcagccugcgacccugcggaaauauugcauugaagcaaaacuuacaaacacuaccacagagagccgcuguccaacucaaggagagcccaguuugaaugaagaacaggacaaacgauuuaucugcaagcauuccauggucgauagaggcugggguaacggguguggacuguucggcaagggcgggaucgugaccugcgccauguuuacaugcaaaaagaauauggaaggaaaagugguccagccugagaaccuagaauacaccauuguuauaacuccacacucuggugaggagcaugcugugggcaaugacacggggaagcacggaaaagaaaucaagauuacaccgcagagcuccaucaccgaggccgaacucacuggcuaugguaccguaacaauggaguguucacccaggaccgggcuggauuucaacgaaauggugcuucugcaaauggaggacaaagcaugguugguccaccggcagugguuucucgaucugccuuuaccauggcugcccggcgcugacacucagggaaguaauuggauacagaaggagacacucgugacguucaagaacccucaugccaaaaagcaagacguugugguccuuggcagccaggaaggggcgaugcacaccgcccugacuggagcaacagagauucagaugucuuccgguaauuugcuauucaccggccaucugaaaugccgucuccgcauggauaagcugcaacuuaaagggaugucauacagcauguguacaggaaaguuuaagaucgugaaagaaaucgcugagacucagcacggcaccauuguaaucagaguucaguaugagggugacgggaguccaugcaagauucccuucgaaauaacggaucuggagaaaaggcauguguugggccggcucaucaccgucaacccgauugugacagaaaaggacucuccugucaacaucgaggccgaacccccauuuggagauuccuacaucauuauaggcguggagccugggcagcugaaauuaaauugguucaagaagggaagcucgaucggucaaauguuugagacuaccaugcgaggcgcuaaacgcauggccauucugggggacacagcaugggauuucggaucucuaggcgguguuuuuacuuccaucgggaaggcccuccaccagguguucggcgcuauuuacggagcggcauuuucaggcguaaguuggaccaugaaaauccugauaggggucaucauuacguggaucggaaugaacagcagauccacaucucuuagcgugucauugguucuggugggcgucgugacccucuaucugggugccaugguacaggcugacagugggugugugguuuccuggaagaauaaagaacuuaagugcggaagcggcauuuucaucacugauaacguccacacauggaccgagcaguacaaguuucaacccgaaucuccaucaaaacuggccagugcaauacagaaggcccaugaggaagguauuuguggcaucaggagcgugacucgguuggagaaucucauguggaaacagauuacccccgagcugaaccacaucuuauccgaaaaugaggugaagcugacaauaaugacgggggacaucaaaggaauuaugcaggcuggcaagcgcucucuaagaccucaaccaaccgaacucaaauauucguggaagacuugggggaaggccaaaaugcugagcacagagucccauaaccagaccuuccuuaucgauggaccggaaacagcagagugccccaauacuaacagggcguggaacucauuggaggucgaagacuacggcuuugguguuuucaccacgaacauuuggcugaagcuccgugagaaacaggacguguucugugauaguaagcugaugucugcugccaucaaagacaaucgggcagugcacgccgauaugggguauuggauagaaagcgcuuuaaacgacacauggaagauggagaaggccuccuuuauugagguaaaaucaugccacuggccuaagagccauacccuguggucuaauggaguccuugaauccgagaugaucauccccaagaauuucgcaggccccgugagucagcacaacuaccgaccugguuaucauacucaaaccgcuggcccauggcacuuggggaagcucgaaauggauuuugacuucugugagggaacaacuguuguggucaccgaagauugcggcaauagagggcccagccugaggacaacgaccgccucuggaaaacuaauuacugaguggugcugucgcuccugcacacugccgccucuccgguacagaggcgaggacgguuguugguacgggauggaaaucaggccacugaaggagaaggaagagaaccuuguaaauucauugguuaccgcgggacauggccagauugauaacuuuagucuggguguguuaggcauggcccucuuccuggaagagaugcuucgcacucgaguagggacaaaacacgcuauacuguuggucgcagugagcuuugugacccucaucacgggaaauaugucguuccgggaccugggccgugucaugguuauggugggggccacuaugaccgaugacauuggaaugggcguaacauaucuagcucugcucgccgcauuuaaggugagacccaccuucgcggccggucugcuuuugaggaaacugacuuccaaggaguuaaugauggcuacaaucgggauugcccuccugucucagagcaccaugccugaaacaauccuugagcugacugaugcacuagcucucggaaugaugguccugaaaauagugcgcaacauggaaaaguaccaauuggccguuaccaucauggcaauuucaugcgugcccaaugccgucauccugcagaacgcuuggaaggugaguuguacgauuuuagcggccguuuccgugucuccacuccugcuuacaagcucccagcagaaagcagacuggaucccucuggcuuugaccauaaagggccucaaucccacugccauuuuucugaccacacuaucacggacuagcaaaaagagaaguuggccacugaacgaggccaucauggcugucggcaugguaucuauccuugcauccagccuccugaaaaaugacauuccgaugaccgggccuuugguggccggaggucuguuaacgguuugcuaugugcucacaggcaggucggcggaucuggaacuugagcgagcugccgacgucaagugggaggaucaagcagaaauaucagggucuagucccauccuguccauuaccaucagcgaggacggaucuaugagcauuaaaaacgaagaggaggaacagacuuugacaauccucauacgcaccggccugcuagugaucuccgguguauucccagugucaauucccaucacugccgcugcaugguaccugugggaggucaagaagcagcgggccgggguucuuugggaugugccuaguccacccccugugggaaaagcggaacucgaggacggcgcuuauagaauuaagcagaggggcauccugggguacagccaaauaggagccggugucuauaaagaaggcacauuucacaccauguggcaugugacgcguggggcaguuuugaugcaccgcggaaagcggauugagccgucuugggccgaugucaaaaaggacuuaaucuccuacggcgguggguggaagcuggagggagaauggaaagagggcgaagaggugcagguccucgcucuggaaccaggcaagaaucccagagccgugcagacuaaaccugggaucuucaagaccaacacaggaaccauuggugcaguuucacuugauuucaguccaggcacaagcgggucccccaucguggacaggaaaggaaaggucgugggccuguacgguaaugggguagucacucgaucuggagcuuaugugucggccauagcgcagaccgaaaagagcauugaggauaacccugaaaucgaggacgauauuuuucggaaaaagcgcuugacgaucauggaccuacauccgggcgccggcaaaacaaagagauaccugcccgcaauaguuagggaagcuauuaaacgggggcuccgaacucugauccuugccccaaccagaguggucgcugcagagauggaagaggccuuacgcggacugccuaucagguaucaaacacccgccauucgugcugagcacaccggucgggaaaucguggaccucaugugucaugcgacuuucaccaugagauugcugucaccaguuagggugccuaacuacaaucucauuauaauggaugaggcacacuuuacagaccccgccuccaucgcugcccgcggcuauauuaguacgcgagucgaaaugggggaggcagccggaaucuucaugacugcuaccccaccgggcucuagagauccuuuuccccagagcaacgcgccaaucauggacgaggaacgggagauucccgaaagguccuggaacucaggucacgagugggugacagauuucaaggggaagaccguaugguuugugccuucuauaaaagccggaaacgacaucgcagcuugccugcgcaagaauggcaaaaagguuauucagcuuagccguaaaacuuucgauagugaauacgucaagacaagagccaacgacugggauuuuguggugaccacggacaucuccgagaugggcgcaaauuucaaggccgagcgggucauugauccaaggcgcuguaugaaacccguaauccugacugacggggaagaacgagugauauuggcuggaccuaugccgguuacacauagcucugccgcgcaaagacgggguaggaucggccgcaacccaaagaaugaaaacgaccaguauauuuacaugggggagccccuagaaaaugaugaggacugcgcacacuggaaagaggccaagaugcugcucgauaacaucaauaccccugaaggaauuauccccucaauguuugagccagaaagagagaaaguggacgcuauagauggcgaauacagguuacggggugaggcccguaagaccuucgucgaccugaugcgccgaggggaucuuccuguguggcuggcuuauaaaguugcagccgagggcauuaacuacgcugacagaaagugguguuucgauggaaucaagaauaaccagauucucgaagagaacguggaagucgagaucuggacuaaagagggcgaaaggaagaaauugaagccccgguggcuggacgcccgcauauauuccgauccacucgcacugaaagaguuuaaggaguucgcggccgggagaaagagucuuacacuaaaucugaucaccgagaugggaagguugccuacauuuaugacucagaaagcucggaacgccuuagacaaucuggcagugcuccauacggcugaagccgguggccgagcauacaaccacgcccugagcgagcuuccggagacccuggaaacacucuugcugcuaacucugcucgcuaccguaacagggggaauuuuccuuuuucugaugucgggcaaggguaucgggaaaaugaccuuaggcaugugcugcauuaucacugcgucuuccuugcugugguaugcccaaauacagccccacuggauugcagcuagcaucauccucgaguucuuucugauugugcuucugaucccagaaccugagaagcagagaacgccccaggauaaucaacucaccuacguugucauagccauuuugacagugguggccgcaacuauggcuaacgaaaugggauuccuggagaaaaccaagaaggacuuaggccuagggucaaucgccacacaggagagugaaucuaauauucuggacaucgaucuccgcccagcguccgcuuggacccuuuaugccgucgcaacuacauuuguuacgccuaugcugaggcauagcauagagaacucaagugugaaugucagcuugaccgccaucgcuaaccaggcaacugugcugaugggacucgguaaaggcuggccccuguccaagauggacauuggggucccgcuucucgccaucggauguuacucucaggugaauccaauuacacugaccgcggcuuugcugcuauuaguugcccacuacgcaaucauuggcccuggucugcaagccaaagcuacccgggaagcccagaagcgugcagcugccgggaucaugaaaaaccccacaguggauggcauaacugucauugaccucgagccaauccccuaugauccuaaguucgaaaagcagcuuggacagguaaugcuguugauccugugcgugacgcaaguucucaugaugagaaccacaugggcgcugugugaggcccuuacuuuagcaaccggcccgauuagcacacugugggaggggaaucccggaagguuuuggaacaccacuauagcuguguccauggccaauaucuuccgcggcucauaccucgccggugcuggguugcuguuuucuauuaugaaaaacacgacaaauacccggcgaggaacuggcaacaucggugaaacccuaggcgagaaguggaaaaguagacugaacgcccucgggaagucggaguuccagauuuauaaaaagagcggaauccaggaggucgacaggacacuugccaaagagggcauaaagcgcggggaaacugaucaucacgcggugucccggggaucugcuaagcugagaugguucgucgagcguaauauggugaccccagaaggcaaaguuguggacuuggguugcgggaggggaggcuggucauacuauugugguggccugaagaacguacgggaggugaaagggcucacaaagggaggcccugggcaugaggaaccaaucccuaugagcacguacggauggaaucugguccgcuuacaauccggcguugauguguuuuucaccccacccgagaaaugcgacacucuucugugugauauuggugaaaguucuccuaacccaacaaucgaggcagggcgaacccucagaguccuaaaucugguggaaaacugguugaauaacaauacucaguuuugcauuaagguacugaaccccuauaugccgagcgugaucgagaagauggaaacacuccagaggaaauacggaggcgcccuuguucggaauccucugucacgcaacuccacccacgagauguacugggugaguaaugcuacgggcaacauagucagcucugugaauaugauuuccagaauguugaucaacagguucaccaugaagcacaaaaaggccacauaugagccagacgucgaucuggggucaggaacucgaaacaucgguauugaaagcgagauacccaaucucgacaucauuggcaaacggaucgaaaagauuaagcaggagcaugaaaccucguggcacuacgaccaagaucauccuuauaaaacaugggcauaccacgggucuuaugagacuaagcagaccggaagugccuccagcauggugaacggcguuguacguuuacugacaaaaccaugggacgugguccccauggugacccagauggcuaugacugauacgacaccguuuggucagcaaagaguuuucaaggagaaaguggacacccgcacucaggaaccuaaggaggggaccaagaaacuuaugaagaucacagcggaauggcuguggaaagagcuaggaaagaaaaagacgcccaggauguguacccgggaggaauuuacuagaaaaguccgcucaaaugccgcacucggcgcuauauucacagaugagaacaaguggaaguccgccagggaagcaguggaggacggccgauuuugggaacugguagaucgggagagaaauuugcaccuggaggggaaaugcgaaaccuguguguacaacaugaugggaaagagggagaaaaagcucggugaguucggcaaagccaaggggucucgcgcuaucugguauauguggcuuggagcccguuuucuggaguucgaagcguuaggcuuucugaaugaggaccauugguucagccgggguaacaguuuguccgggguugagggagaaggccuccacagacugggcuacauucuaagggaggucgggaagaaagaaggaggugcaauguacgccgaugacacugcuggcugggauacacgcaucacccuugaggaccugaagaaugaagagauggugacaaaccauaugaaaggggagcacaagaaacucgccgaagcaauuuucaagcugacuuaucagaauaaggugguccgaguucagcggccaaccccuagaggaacggugauggacaucauuagcaggcgcgaucaaagaggcucuggucagguagggaccuacggauugaacacauuuacuaauauggaggcucagcugauacggcaaauggaaggcgagggcaucuucaaaucaauucagcaucucaccgccacagaggaaaucgcugugcagaacuggcuugccagggucgggcgugagcgacugagucgcauggcaaucuccggagacgauugcgugguuaagcccauugacgauagauuugcgagcgccuuaacugcucugaaugacauggguaaagugcggaaggauauacagcaaugggaaccaucuaggggcuggaacgacuggacccagguccccuucugcucgcaccacuuucaugaguuggugaugaaagaugggcgcguacucguugugccuuguagaaaccaggacgaacugaucggacgggccaggauuucacagggcgcagguuggagccuaaaggagacggcuugccuugggaaguccuaugcccaaauguggacacugauguacuuccacaaacgagaucuccgucuggcagccaaugcgaucuguagugcugucccaucucauugggugccgaccagcagaacuacaugguccauucacgccaagcacgaguggaugaccacugaagacauguuggcaguguggaaccgcgucuggauccaggagaaucccuggauggaagauaaaaccccuguugagucaugggaagaggugccauauuuaggaaagcgggaggaccaguggugcggcagucugauaggccucacaucuagggccacgugggcuaaaaacauccagaccgccauuaaucaaguaagaagccuuaucgggaacgaagaguacacugacuauaugcccuccaugaagcgcuuucggagggaagaggaagaggcaggagugcugugguga

SEQ ID NO: 15067 - RNA, 9876 nt, Artificial Sequence
  derived and/or modified CDS sequence (opt3) from DENV-2__AY702040__SS-prME
accgcaggaaugaucauuaugcugauacccaccgugauggcuuuccaccucacuacgcggaauggggagccucauaugaucgucagcaggcaggaaaaggggaaaucccuucuguuuaagaccaaagacgguacaaauaugugcacuuugauggcaauggauuuaggcgagcugugugaagacaccauuacauacaagugcccauuccuaaaacaaaacgagccggaagauaucgacuguuggugcaauucuaccucaacuuggguuacauaugggaccuguacgacuaccggagagcaccggcgcgagaagcgaaguguggcccucgucccccaugugggcaugggucuggaaacacguacugagaccuggaugagcuccgaaggggcguggaagcacgcucagcggauugagacauggauccuuaggcauccuggauuuaccauaauggccgcaauccuggccuacacgauuggcacuacacacuuccagcgggucuugaucuuuauucuccugaccgcuaucgcaccaucuaugacuaugcgcugcauaggcauuucgaacagagauuucguggaggggguuucaggagguagcuggguggacaucguccuggaacacggcaguugugugacaaccauggccaaaaauaagcccacgcucgauuuugaguuaauuaaaaccgaagcuaagcagccugccacacugaggaaauauugcaucgaggcgaaacuuacuaacaccacaacugacucccgguguccaacccaaggggaacccacauugaaugaggagcaggauaagcgcuucguaugcaaacauucuaugguugaccgaggauggggcaacgguugugggcuguuuggaaagggcggcaucgugaccugcgcaauguucacuugcaaaaagaauauggaagggaaaauuguccagccugagaaccuagaauacacgguggugauaacaccacacagcggagaggaacaugccgucgguaaugauaccggcaagcacgggaaagagguuaagaucacuccgcaguccucaauuaccgaggcugaacucacaggauauggcaccgugacuauggaguguagucccagaacaggucuggacuuuaacgaaaugguacuucugcaaauggaggauaaggccugguuggugcacaggcagugguuccucgaccugccuuuaccauggcugcccggggcagacacgcagggcagcaauuggauccagaaagaaacccucgucacuuuuaagaacccucaugcuaaaaagcaagaugugguugugcuuggaucucaggagggcgccaugcacacagcgcugaccggggccacagagauacagauguccucaggaaauuugcuauucacuggucaucugaaaugccggcuccguauggacaagcugcaacuuaagggcaugagcuacaguauguguaccgggaaauucaagauugucaaagaaaucgcagagacgcagcacggaaccaucgugauucgcguacaguaugaaggcgaugguucuccaugcaagauccccuuugagauuauggaccuggagaaaagacauguuuuggggaggcucauaacagugaacccgaucgucacugaaaaggauuccccugugaacauugaggcugaacccccauucggcgacagcuacaucaucauuggagucgagccuggccagcugaaguuagauugguuuaaaaaggggucgucuauaggacaaauguucgaaaccacaaugcggggugccaaacgaauggcuauccugggcgacacugccugggauuuugggucccuaggaggcguguucaccucaauugguaaggcacuccaccagguuuuuggggccaucuacggcgcugcguucaguggagugagcuggacgaugaaaauucugaucggcguaauaaucacauggauugggaugaacucccgcucuaccagccuuucagucaguuuggugcugguuggaaucgugacucucuaucugggcgucauggugcaggcagacuccgguuguguagugagcuggaagaacaaggagcuuaaaugcgggucuggaauuuuuguuacagauaauguccacaccuggacugagcaguacaaguuccaacccgaaucaccaaguaaacuggccagcgcuauccagaaggcccaugaggaaggcauaugugguauuagauccgugaccagguuggagaaccucauguggaaacagaucacaucugaacugaaucacauuuuaucggagaacgaggugaagcugacgaucaugaccggcgacauaaaagggaucaugcaggucggaaagcggagccuacgcccccaaccuacugaacucagauauuccuggaagacauggggcaaagcaaagaugcugucaaccgagcuucauaaucagacauuuuugauugacgggccagaaacugccgagugcccgaacaccaauagggcuuggaacagucuggaaguugaggauuacggauucggcguguuuacgacaaauaucuggcuccgucugcgggagaaacaggacgccuucugugaucccaaguuaaugucugcagcgauuaaagacaaccgagcugugcacgccgauauggguuauuggaucgaaagcgcacugaaugacaccuggaagauagagaaggccuccuucauugaaguaaaaucaugccacuggccuaagagccauacucuuuggucuaacggggucuuggaguccgagauggugauccccaagaauuuugcuggacccguuagucagcacaacaacagaccuggcuaccauacccaaacagccgguccauggcaccucggcaagcuggaaauggauuucgacuuuugugaggggacuaccguggucgugacagaagagugcggaaauaggggccccagccuacgcacgaccacugcaucugggaaacugaucacagaauggugcugucgguccugcacccucccgccucugagauauaggggagaggauggcuguugguacgguauggagauucgcccacuuaaggaaaaggaggaaaacuugguuucaagucuggugacugcugggcauggacagaucgacaauuucagcuuaggcauucucgguauggcccuguuucuugaggaaaugcugcgaacacggguaggcaccaaacacgcgauauugcucgucgccgugucguucgugacgcugaucacugggaacauguccuuucgugaucuaggaagagucaugguuauggugggcgcuaccaugacagacgauauugggaugggaguaaccuaccuggcacuccuggccgcuuucaaggugaggcccacuuuugccgcaggccuuuugcugcgcaaauuaacaucuaaggagcucaugaugaccacaaucgguauuguccugcuuagccagucaaguaucccugagacuauacuggaacuaaccgacgcgcucgcccuggggaugaugguguugaaaaugguucggaauauggagaaguaucaacuggcugugacgaucauggccauuuuaugcguccccaacgcagugauccuccagaaugcuuggaagguuuccuguacaauucuggccguggucucuguaagcccacuucuguugaccuccucacagcagaaagcagacuggaucccucucgcccugacuauaaagggacuaaaccccaccgcuauuuuccugacaacucuuagcagaaccaguaaaaagaggucuuggccacucaaugaagcgaucauggccgugggcaugguuuccauccuggcaagcucguugcugaaaaacgauauuccgaugacgggcccuuuaguggcugggggacuccugacagucugcuacgugcuuaccggucgaucagccgaccuggaguuggaacgcgccacugauguaaagugggacgaucaagcugagauaucuggcaguucccccauccucagcauuaucauuucugaggacgggagcauguccaucaaaaaugaagaggaggaacagacacugaccauacuaauccggacuggacugcuugugauuucaggccucuuuccagucaguauccccauuacagcagccgcgugguaucugugggagguuaagaagcagagagcugguguguugugggaugugccuagcccacccccugucgggagggccgaauuagaggacggagcauaccguaucaaacagaagggcauacugggcuauucucaaauuggggccggaguguacaaagaagguaccuuccacacgauguggcauguuacucgcggcgcuguacucaugcacaaggggaaacggaucgagccguccugggcagaugugaagaaggaccugaucucauauggaggcgguuggaaacuugaaggggaguggaaggagggagaagagguccaggugcuggccuuggaaccaggcaaaaaccccagagcgguucagaccaagccuggccuauuuaggacaaauaccgggacaauuggagcugugagucuggauuucagcccagguacuuccggcucucccaucgucgacaaaaaggggaaggugguaggacucuacggcaacggugucgugacccgagggggagccuacguuucggcaauagcccagacggagaaaagcauugaagauaauccugagaucgaggacgacauuuuccggaagcgcagacugacaaucauggaucuucauccgggcgcuggcaaaacuaagagguauuuacccgccauagugcgggaagcaauuaaacgagggcugagaacccucaucuuggcuccaacacgcgucguggccgcggagauggaagaggcccugaggggacucccuauccguuaccaaacccccgcaauucgggcugaacacacugguagagagaucguugaccugaugugucaugccaccuuuacaaugaggcuucugucaccaauucgcgugccuaacuauaacuugauaaucauggaugaggcucacuucacggaccccgcauccauugccgcccgaggcuacaucaguacuagagucgaaaugggggaggcugcgggaaucuuuaugaccgcaacaccaccgggcucucgggauccuuucccccagagcaaugccccaauuauggacgaagagagggagauacccgaacgcuccuggaacucaggucacgagugggugaccgauuuuaaggggaagacuguaugguucgugccuucuaucaaaacaggaaaugacauugcugccugccuacguaagaacggcaaaagaguuauccagcugagccggaagaccuuugauagugaauaugucaaaacgaggacuaaugacugggauuucguggugacaaccgacauuuccgagaugggcgcaaacuuuaaggccgaacgcgucaucgacccacgaagauguaugaagcccguaauacucaccgauggggaggagcgggugaucuuagcuggaccuaugccgguuacucauagcucugcggcccaaaggcgcgguagaauuggcaggaauccacggaacgaaaaugaccaguacaucuauaugggggagccccuggaaaacgaugaggacugcgcacacuggaaagaagcuaagaugcuucuggauaauauuaacacaccugagggaaucauacccucaauguucgagccagaacgugagaaaguggacgccauugauggcgaauaccgccuccgaggugaggcaagaaagaccuuugucgacuugaugaggagaggggaucugccuguguggcucgccuacaaaguugcugccgaaggcaucaauuaugcggaccgcagaugguguuucgauggaacaaggaacaaucagauucuggaggagaacguggaagucgagaucuggacuaaggaaggcgagcggaagaaacuuaaaccccgauggcuagacgcaagaauauacuccgauccacuggccuugaaagaguucaaggaauuugcugccgggcgcaaaaguuuaacgcugaaccucaucaccgagaugggaaggcugccuacauucaugacucagaaggcucgggacgcacuugacaaucuggccgugcuccauaccgcugaagccgguggcaaagcauauaaccacgcguugagcgagcugccggaaacacuagagacccugcuccuucugacuuuauuggccacgguaaccgggggaauuuuucuguuccucaugucgggccgugguaucgggaagaugacacugggcaugugcugcauuaucacugcuucuauacuucugugguacgcccaaauucagccccacuggaucgcagcuuccaucauucucgaguuuuucuugaucgugcuguuaauaccagaaccugagaagcagagaaccccacaggauaaucaacuaacauauguuauuaucgccauucugaccgucguggcagccacuauggcuaacgaaaugggauuucucgagaaaacaaagaaagacuucggccuugggcauaucgcgacgcagcagccagaaagcaauauacuggauaucgacuugaggccugccucagcauggacccuguacgcuguggccacuacauuuauuacccccaugcuccgccacaguaucgagaacucuuccgucaauguuagccugaccgccauugcaaaccaggcuacagugcuuaugggacucgguaagggcuggccgcugucaaaaauggauaucgggguaccauugcuggccauuggauguuauagucaagugaauccuaucacuuuaacggcggcucuacugcuccuugucgcccauuacgcaauaauuggccccggucugcaggccaaggcuacccgggaggcacagaagcgagccgcggcugggaucaugaaaaacccaacaguggacggcaucacuguuauugauuuggaccccauaccuuacgauccgaaguucgaaaaacagcugggacaagugaugcuccugguccuuugcguaacccagguguuaaugaugagaacaaccugggcccugugugaggcacucacuuuggccacgggccccguuagcacacugugggaagggaauccaggaagguuuuggaacaccacuaucgcuguguccauggccaauauuuuccgcggcucuuaucuagccggugcugggcugcucuuuagcaucaugaagaacaccacauccgcccggagaggaacuggcaauaugggugagacccuuggcgaaaaauggaagucacgucugaacgcguuggggaagucugaguuccagauuuacaaaaagaguggaauccaagaggucgacaggacacuggccaaagaaggcauaaagagaggggaaacggaucaccaugcagugucgcgcggaagcgcuaaacuccgaugguucgucgaaagaaaucuggugaccccugagggcaagguuguggacuuagguugcgggaggggaggcugguccuauuacugugguggccuuaaaaacguacgggaggugaaggggcugacuaagggaggccccgggcacgaggagccuaucccaaugucuacauauggauggaaccucguccgccuacagucaggcguugauguguuuuucguacccccugaaaaaugcgacacccuguugugugacauuggugagagcuccccaaaucccacuguggaagccgggagaacacugaggguacucaaccuuguggagaauuggcugaacaauaacacccaguuuugcguuaagguguugaauccguacaugccuagugucaucgagcgaauggaaacgcugcagcggaaauauggaggcgcacucgugcguaacccauuaucuagaaauagcacccacgagauguacugggucucaaacgcuuccggcaauauugugaguagcguuaacaugaucucucgcaugcugauaaauagguucacaaugcggcauaagaaagccacuuacgaacccgauguagaccuuggguccggaaccagaaacauugguaucgagucagaaacaccuaaucuggauaucauuggcaagcgcauagagaagaucaaacaagagcacgaaacuagcuggcauuaugaccaggaucacccauacaagaccugggccuaucacgggucguacgagacaaaacagaccggaucugcgaguuccauggugaacggcgucgugaggcuacucacuaagcccugggacguuauuccgauggugacgcagauggcuaugacagauaccacuccuuuuggucaacagcgagucuucaaagaaaagguggacacccggacacaggagcccaaggaagggacgaaaaagcugaugaaaaucaccgcagagugguuguggaaggagcugggcaagaagaagacuccaagaauguguacaagggaagaguuuaccaaaaagguacgcagcaacgccgcucucggcgccauuuucacugaugaaaauaaauggaagucagcacgugaggccguggaggacaaccgguuuugggaacuuguugauaaagagagaaaucugcauuuagaaggcaagugcgagacaugugucuauaacaugauggggaaaagggaaaagaagcugggagaguucgguaaagcuaagggcucccgcgcgaucugguacaugugguugggggcccgauuucucgaguucgaagcacugggauuucuaaaugaggaccacugguucucucgggaaaacagccuuaguggcguggagggugaagggcugcauaaacucggauauauacugagagagguguccaagaaagagggcggcgcuauguacgccgacgauaccgcagggugggacacaaggaucacuauugaagauuugaagaaugaggaaaugaucaccaaccacauggccggagagcauaagaaacuggcugaagccauuuucaagcucacguaccagaauaaagucguucgcgugcaaagaccuacaccccgggguacaguaauggacaucauuagcaggaaggaucagcguggcucuggacaggugggaacuuauggccuuaacaccuuuacaaauauggaggcgcaacugauacgacagauggagggugaagggaucuucaaaucaauucagcacuuaacugcaagugaggaaaucgccguccaggacuggcuggugcgcguuggaagagagcgguuguccaggauggcuaucagcggcgaugacugcguggucaagccacucgaugaccgcuuugccaaggcacugaccgcucuaaacgauaugggcaaagugagaaaggacauucaacagugggagcccucucggggguggaaugauuggacgcagguaccuuucugcucgcaccauuuucacgaacuuauaaugaaagacggaaggacacugguugugccaugucgaaaccaggacgagcucaucggucgugccagaauuucacaaggcgcuggguggagccugcgcgaaaccgccugcuugggaaaguccuacgcacagauguggaguuuaauguauuuccaucggagggaucugagacucgcggccaaugcuaucuguucugccgucccgagccacugggugcccacuucccgcacaaccuggucaauucacgcaagucaugaguggaugacuaccgaagacaugcuuacaguguggaaccgggucuggauccuggagaacccuuggauggaggauaaaacgccaguugaaucuugggaggaaauacccuaccuaggcaagagggaggaccaguggugcgguagccugaucgggcucaccucccgagcuacuugggccaagaauauucagacagcaaucaaccaagugagaucauugauuggaaaugaagaguauaccgauuacaugccuagcaugaaacgguuuaggcgcgaggaagaggaagccggcguacugugguga

SEQ ID NO: 15068 - RNA, 9876 nt, Artificial Sequence
  derived and/or modified CDS sequence (opt3) from DENV-2__AY037116__SS-prME
accgccggcaucauuauaaugaugauccccacugugauggcuuuccaccugacuacgcgaaauggggagccucauaugauugucagcaggcaggaaaaaggaaaaucccuccuuuuuaagaccgagaaugguguuaauaugugcacccugauggcaauggacuugggcgaauuaugugaggauacuaucaccuacaauugcccacugcuacggcaaaacgaaccggaggacauugauugugggugccacucuaccucaaccugggugacuuauggaacauguaccgccacgggcgagcaucgccgagaaaaacguaguguagcgcucgugccccacgucgguauggggcuggagacucggaccgaaacauggaugagcuccgagggagcuuggaagcaugcccagaggaucgagacuugggugcuucggcacccuggcuucaccauaauggcagccauccuggcuuacacaauuggcaccacguauuuucagcgcguuuugaucuucauucuccugacugcagugacaccaucuaugaccaugagaugcaucgggauaucgaauagggacuuugucgaaggagugucagguggcagcuggguagauauuguucuggagcacgggaguugugugacuacaauggccaaaaacaagcccacccucgacuucgaauuagucaagacggaggcuaaacauccugccacccugcggaaguacugcaucgaagcgaaacuuacaaauacuaccacagcaucccgcuguccaacucagggagagcccucuuugaacgaggaacaagauaagcgauuugugugcaaacacagcaugguggacagaggcugggguaauggguguggacuguucggcaagggcgggauuguaaccugcgccauguuuacaugcaagaaaaacauggagggaaagguugugcagccugaaaaucuagaguauaccaucguaaucacuccacauuccggugaagagaacgcugugggcaaugauacggggaaacacggaaaggagauuaaagucacaccgcagucaaguauaaccgaagccgagcucacuggcuacgguaccgugacaauggaauguagccccaggaccgggcuggacuucaacgagaugguucuucugcagauggaaaauaaggcaugguuggugcaccggcaaugguuucucgaucugccuuuaccauggcugcccggcgcugacacucagggaucuaacuggauccagaaagagacacucgucacguucaagaacccucaugccaagaaacaggaugugguaguucuuggcucccaagagggggcgaugcacaccgcccugacuggagcaacagaaauucagaugucaagcgguaauuugcuauuuaccggccaucugaagugccgucuccgcauggacaaacugcagcuuaaggggaugaguuauucuauguguacaggaaaauucaagguggucaaggagaucgcugaaacucaacacggcaccauagugauuagaguccaguacgagggugacggguccccaugcaaaauccccuucgagaucauggaucuggaaaagaggcauguguugggccggcucauuacgguuaacccgaucgugaccgagaaagacagcccuguaaauauugaagccgagcccccauuuggagauucguacauaaucauuggcgucgaaccugggcagcugaaguuaucuugguucaaaaagggauccucaaucggucagauguuugagacaacuaugcgaggcgcuaagcgcauggccauccugggggacaccgcaugggauuucggaagucuaggcgguguguuuacaagcauugggaaagcccuccaccaaguuuucggcgcuauauauggagcggcauuuuccggcgugucuuggacuaugaagauccugauuggggucgugaucaccuggauuggaaugaacagcagaucaacgagucuuuccgucagcuuggugcugguuggcgucgugacacucuaccugggugugaugguccaggccgacucuggguguguugugucauggaaaaauaaggagcuuaaaugcggaaguggcaucuucauaaccgauaacgugcacacuuggacagaacaguauaaguuucagcccgagagcccauccaagcuggcuucugccauccaaaaagcacaugaagaggguauuuguggcaucaggucgguaacccgguuggaaaaucucauguggaagcagauuacucccgagcugaaccacaucuuaagcgagaaugaagucaaacugaccauaaugacaggggacauuaagggaaucaugcaggccggcaaacgcucccuaagaccucagccaacggagcucaaguacucauggaaggcuugggggaaggccaagaugcugaguaccgaacuucauaaccacacuuucuugauugauggaccggagacagcagaaugccccaauaccaacagggcguggaacucucuggagguggaggacuauggcuuugguguuuucacaacuaacaucuggcucaaacugaaggaacgucaagauguguuuugugacagcaaauuaauguccgcugccauaaaggacaaucgggcaguccacgccgauaugggguacuggaucgagucagcucugaacgacaccuggaaaauugaaaaggccagcuucaucgaggugaagucuugccauuggccuaaaucccacacgcuuuggaguaacggaguuuuggagagcgaaaugauuaucccaaagaauuucgcaggccccgugucucagcauaacuaucgaccugguuaccacacacagaccgcuggcccauggcaucucgggagacuggagauggauuuugacuucugugaaggaacuaccguagucgugacagaggauugcggcaauagggggcccucccuacgcacuaccacagccucaggaaaacugauaacggaauggugcugucggaguugcacccucccgccucugagauacaggggcgaggacgguuguugguaugggauggagauucgcccacuuaaggaaaaagaggaaaacuuggugaauagccuggucacugcgggacacggccagaucgauaacuuuucguuagguguucucggcauggcccuguuccuugaggaaaugcugcgaacacggguggggaccaagcacgcuaucuugcucguagcaguguccuuugucacucugauuacaggaaauaugucuuuccgugaccuaggcagagugaugguuauggugggggccaccaugacggaugacaucggaaugggcgucacuuaccuggcucuccuggccgcauuuaaggugaggcccaccuucgcggccggucuuuugcugcgcaaauuaacaagcaaggagcucaugaugaccacuauugggauaguucugcuuucacaaaguacaaucccugagaccauucuggaacuaacagaugcuugggcccucggaaugauggugcugaaaaucguccggaacauggagaaguaucaguuggcaguaacuauuauggcuauccugugcgugcccaaugccguuauauuacagaacgcauggaaaguguccuguaccacgcucgccgucgugucuguaagcccacugcuucugacauccucacaacagaaggcugacuggaucccuuuggcgcucaccauuaagggccugaaucccacugccaucuuucuaaccacacugagcagaacaaguaaaaagaggucuuggccacuuaacgaagcaauuauggcugugggcauggucuccauccucgccagcucgcuguugaaaaaugauauaccgaugaccgggccucugguugccggagguuuacucacggugugcuacgugcugacaggccgaucagcugaccuugagcuggaacgcgcagccgacguccggugggaggagcaggcggaaauuucugggaguucccccaucuugagcaucaccauuucugaggauggaagcauguccauaaagaacgaagaggaggaacagacucucacaauccugauuagaaccggccuacuggugaucucaggucuuuucccagcuaguauucccaucacugccgcagccugguaucucugggagguuaaaaagcaaagggcugggguacugugggacgugccuagcccacccccugucggaaaagcagaauuggaggauggcgccuaccguauaaagcagaagggcaucuuaggguauucucagauuggagcggguguguacaaagaaggcacauuucauaccauguggcacguuacgcgcggggcugugcugaugcauaagggaaaacggaucgagccguccugggccgacgucaagaaagaucucauuucauacggcgguggguggaagcuggagggagaauggaaggagggcgaagaggugcagguacuugcacuggaaccaggcaaaaaucccagagccguccaaacuaagccuggguuguucaaaaccaacacaggaaccaucggugcugugagucuagacuuuagcccaggcacauccgggucucccauaguugauaagaaaggaaagguggucggccuguaugguaacggggugguuacuaggucgggagccuacgugagcgcaauugcucagaccgagaagucaaucgaggacaauccugaaaucgaggaugacauuuucaggaagaaacggcucacgaucauggaucugcacccgggcgccggcaaaacaaaacgcuaucuucccgcgauagucagagaagccauuaaaaggggguuacggacucugauccucgcaccaacccgagugguagcugccgagauggaagaggcuuugagaggacugccuauucgcuaccagacacccgcaaucagggccgagcauaccggucgugaaauaguggaccucaugugucacgccacuuucaccaugcggcugcuuuccccaauuagaguuccuaacuauaaucugaucaucauggaugaggcucacuuuacagaccccgcgaguauugcagccaggggcuacaucucuacgcgcgucgaaaugggggaggcugccggaauuuucaugacugcaaccccaccgggcagccgagacccuuuuccccaguccaacgccccaauaauggaugaggaaagagagauccccgaacggucauggaacucuggucaugagugggugacagacuucaaggggaagaccgugugguuugucccuagcauuaaagcuggaaacgauaucgcggccugcuugaggaagaauggcaaaaagguaauccaacuaagucgcaaaacuuucgacuccgaauauauuaagacacguaccaacgauugggacuuugugguuacgacugauauaagcgagaugggcgcaaauuucaaggcugagagagugaucgacccacggagguguaugaaacccgucauucugacagauggggaagaacgcgugauccucgccggaccuaugccgguuacccacucuucagcagcccagcgaagaggucgggugggcaggaacccaaagaaugaaaacgaccaguacauuuacaugggggagcccuuagaaaaugaugaggacugcgcucauuggaaagaggccaagaugcugcuugacaacaucaauaccccugaaggaauaauccccuccauguuugagccagaacgcgagaaagucgaugcgauugacggcgaauauagacugaggggugaggcacggaagacuuucguggaucucaugcgucgcggggacuugccuguauggcuggccuaccgaguggcugccgagggcaucaacuaugcugauagaaggugguguuuugacggaguuaaaaacaaucaaauucucgaagagaacgucgaaguggagaucuggacaaaggagggcgaacggaagaaacugaagccccgcuggcuugaugcaagaauauacagugacccacuagcccugaaagaguucaaggaguucgcugccgggagaaagagcuugaccuuaaaucugauuacagagaugggacggcucccuacuuuuaugacgcagaaggcacgaaacgcgcuggauaaucuugccgugcugcacaccgcugaagccgguggcagagcauauaaccacgcucucucggaguugccggagacacuggaaacucuacugcuccuuacccuguuagccacagucaccgggggaaucuucuuguuucugaugucuggcaaggguauugggaaaaugacucucggcaugugcugcaucauaacggcauccauccugcuuugguacgcccagauucagccccauuggaucgcugcgagcauuauccuggaguucuuucucauaguuuugcugauuccagaaccugagaagcaacgcacaccccaggacaaucaguuaacauaugugguaaucgccauccuaacuguggucgcagcuaccauggccaacgaaaugggauuccuggagaaaacaaagaaagauuuuggccucgggucaauugccacccagcaaccagagaguaauauccuugacauagaucugaggccugcaucugcuuggacuuuguacgccguggcgacaacguucauuacccccaugcugcggcacuccaucgaaaacagcucaguuaaugugagucucacugcuauugccaaccaggcaacaguccugaugggacuugguaagggcuggccgcucagcaagauggacaucgggguaccacuguuggccauaggauguuacucccaggugaauccuaucacccugaccgcugcauuacuacugcucguugcccauuaugcgauuaucggccccggucuucaggcuaaagccacacgugaggcacaaaagagagccgcugccgggauuaugaaaaacccaacuguggacggcaucacggucauugaucuggaccccaucccuuacgauccgaaguuugaaaaacaguugggacaggugaugcugcucguccugugcgugacccagguucuuaugaugaggacaacuugggcauuaugugaggcucugacccucgccacaggccccauaucuaccuugugggaagggaauccaggacgcuucuggaacacuacgauugcggugagcauggccaauaucuuucggggcuccuaucuggcuggugcagggcuacuguucucaaucaugaagaacacagccaacacccgaagaggaacuggcaauaccggugagacacucggcgagaaguggaaaaacaggcuuaaugcacuggggaagucugaauuucaaauuuacaaaaagaguggaauacaggagguagaccgcacuuuggcuaaagaaggcaucaagagaggggaaaccgaucaccaugccgugucgagaggaagcgccaaacugcguugguucgucgagaggaaccucguuacaccugaaggcaagguggucgaccuggguugcgggcggggaggcugguccuauuacugugguggcuuaaagaaugugaaagagguaaaggggcuuacgaaaggaggccccgggcacgaggaaccuauuccaaugucuaccuauggauggaaccuggugcgccuccagucaggcguugauguguucuuuacucccccugaaaagugcgacacacuacugugugauaucggugagagcuccccaaaucccaccgucgaggcggggcgaacuuugagagugcugaaccucgucgaaaauuggcuuaacaauaacacacaauucugcauuaaagugcugaauccguacaugccuaguguuaucgagaagauggaggcuuugcagaggaaguacggaggcgcacugguacggaacccacucucucgcaauagcacccacgagauguauugggugucaaacgccuccggcaacauagucaguagcgugaauaugaucucuagaauguuaauuaacagguuuacgaugcgacauaaaaaggcuaccuacgaacccgacguugaucugggguccggaacacggaauaucgguauugagucagagacuccuaaccuugacaucauaggcaaacguauugaaaagaucaaacaggagcacgaaaccagcuggcauuaugaucaggaccacccauacaagacaugggccuaucacgggucguacgagacuaagcaaaccggaucugcaaguuccauggugaauggcgucgugagacugcuaacaaaacccugggacaucauuccgaugguaacccagauggccaugacugauacgacaccuuucggucagcagcgcguguuuaaggaaaaaguugacaccaggacucaagagcccaaggaggggaccaaaaagcucaugaagauaacagcugaauggcuguggaaagaguugggaaagaaaaagacgccacggauguguaccagagaagaguucacucgcaaagucaggagcaacgcggcccugggcgcaaucuuuacagaugagaauaaguggaaaucagcucgagaagccguggaggacuccggcuucugggaacucguggauaaggagcggaaccuucaucuggaagggaagugcgagaccugugucuauaauaugaugggaaaaagagagaagaaauuaggugaauuuggcaaggcaaaagggucuagggccauuugguacauguggcugggagcucgcuucuuggaguuugaagcccucggcuuccugaacgaggaccacugguuuagccgugaaaauagucuauccgguguugagggggagggacuucauaagcugggcuacauccuccgggaugugagcaagaaagaaggcggggcgauguaugcagacgauacugccggaugggacacaagaauuacccuggaggauuugaagaacgaagagaugguaacaaaucacauggaaggugagcauaaaaagcuggcugaggccaucuucaaacucacuuaccagaacaagguggucagggugcagcgcccuacaccccgaggcacgguuauggacauaaucucucggagagaccagagggggucaggacaaguggucaccuauggccuuaauacauucacuaacauggaagcacagcugauucgccagauggagggugaagggguguuuaagaguauccaacacuuaaccguaacagaggagauugcuguuaaaaacuggcuggugagagucggacgggaaagguugucccguauggccaucagcggcgaugacugcguggugaagccacucgaugaccgauucgcuucugcccugacugcacuaaaugauaugggcaaaguccgcaaggacauucagcagugggagcccucgagaggguggaacgauuggacccagguuccuuuuugcucacaccauuuccacgaacuuauaaugaaagacggacgggugcugguagugccauguaggaaucaagaugagcucaucggucgcgcgagaauuagccagggcgccggguggucccugcgggaaacggcuugcuugggaaagaguuacgcccagauguggucuuuaauguauuuucauaggcgagaccugcgucucgcagcuaacgccaucuguagcgcagucccgucccacugggugcccacaucaagaaccacuuggaguauccacgccacacaugaguggaugaccacugaggauaugcuuaccguuuggaaucgcguguggauucaggaaaacccuuggauggaggacaagacaccagucgaaucuugggaggaaauacccuaccugggcaaacgggaggaucaauggugcgguagccuaaucgggcugacguccagggcgaccugggcuaagaauauucagacugccaucaaccaggugagaucacucauuggaaaugaggaauauacagacuacaugccuagcaugaaacgcuuccggagggaggaagaggaagcaggcguauugugguga

SEQ ID NO: 15069 - RNA, 9876 nt, Artificial Sequence
  derived and/or modified CDS sequence (opt3) from DENV-2__AF169678__SS-prME
agcgcaggcaugauaauuaugcugauacccaccgugauggcuuuccaccucaccacuagaaacggggaaccucauaugaucguauccauucaggaaaagggaaaaucucuucuguuuaagacggaggacgguguuaauaugugcaccuugauggcaauggauuuaggcgaacugugugaggacacaaucacuuacaaaugcccauuacucagacaaaacgaaccggaggauauugacuguuggugcaauucaaccaguacaugggugaccuaugggacuuguacaaccacgggagagcaccggcgcgaaaagcgaagcguagcccuggugccccaugucggcaugggucuugagacucguaccgaaacauggauguccucugagggggcguggaaacacgcucagagaaucgagacuuggauacugaggcauccuggauucaccaucauggccgcaauuuuggccuacacaaucggcaccacgcacuuucagcgggcucucauuuucauccugcugacugcaguggccccaucgaugacaaugcgcugcauaggcauuucaaacagagauuuuguugaaggggugagcggagguaguugggucgacaucgugcucgagcacggcuccuguguaaccacuauggcuaagaauaagcccacauuagauuucgaacugauuaaaaccgaggccaagcagccugcgacgcuuaggaaauauugcaucgaagcaaaguugaccaacacaacuaccgagucucgguguccaacacaaggggagcccagccugaaagaagaacaggacaagcgcuuuguuugcaagcauuccaugguggaucgaggauggggcaaugguugugggcuauucggaaaaggcggcaucgucacuugcgccauguuuaccugcaagaaaaacauggaagggaagauugugcagccugagaaucucgaauacacaauaguggucaccccacacucaggagaggagcaugcuguugguaacgacacuggcaaacacgggaaggaaaucaaagugacgccgcagaguagcauuacagaggccgaacugaccggauauggcacuguaaccauggaguguucucccagaacaggucuugauuucaaugaaauggugcuguugcaaauggagaacaaggcauggcucguccacaggcagugguuucuggacuuaccucugccauggcuccccggggcugauacccagggcuccaauuggauccagaaggagacucuugugacauucaaaaacccucaugccaagaaacaagacguugugguccugggaucacaggaaggcgcgaugcacacggccuugaccggggcaacugagauacagaugagcaguggaaaucuacuguuuacaggucaucucaagugccggcugcguauggacaaacuucaacugaagggcaugucuuacuccauguguaccgggaaguucaaagugguaaaggaaauugcugagacacagcacggaacuaucguuauccgcgugcaguaugagggcgaugguagcccaugcaaaauucccuucgaaaucauggacuuggagaagagauacguccucgggaggcugauuaccgugaacccgauagucacggaaaaagauucgccugugaacaucgaggccgaacccccauuuggcgacucuuacauuaucaucggaguugagccuggccaguuaaagcugaauugguucaagaaaggguccucaauuggacaaauguuugagaccacaaugcggggugcuaagcgaauggccauacuaggcgauacugcaugggacuucgggagucucggaggcguguuuaccagcaucgguaaagcccugcaucagguauucggggcuauuuauggcgcggcauuuuccggagucucuuggacaaugaagauccuuauuggcgugaucauaacuuggaucgggaugaacagccgcucaaccaguuuguccguuagccuggugcucgucggaauugugacgcuguaccuuggcguaauggugcaggccgauucugguuguguugucucauggaaaaauaaggaacugaagugcgggaguggaaucuucauuacagacaacgugcacaccuggacugagcaguauaaauuucaacccgaaagcccauccaaguuggcuucugccauccagaaagcacaggaggaaggcauaugugguauuagaucggugacaaggcucgagaaucugauguggaagcagaucacccccgaguuaaaccacauucuggccgaaaaugaggucaaacuaacuaucaugaccggcgauauaaaggggaucaugcaagcuggaaaacggagccuccgcccucagccaacagaacugaaguacuccuggaagacguggggcaaagccaagaugcuuucaaccgagagucauaaccagacuuucuugauugacgggccggaaacagcagagugccccaauaccaacagagcguggaacucucuggagguugaagauuauggauuuggcguguucacaacuaacaucuggcucaaacugaaggagaaacaggacgcuuuuugugacagcaaguuaauguccgccgcaauuaaggauaauagggccgugcacgcugacauggguuacuggaucgaaucagcccugaacgauaccuggaaaauagagaaggccagcuucauugaggucaagaauugccauuggccuaagucucacacgcuuugguccaacggggucuuggaaagugagaugaucauccccaagaaucucgcuggacccgugagccaacacaauuaucguccuggcuaccauacacagauugccgguccauggcaccugggcaagcuagaaauggacuucgauuuuugugacgggaccacuguuguggucaccgaggauugcggaaaccggggccccucucugcgaacaacuaccgcguccgggaagcucaucacagaauggugcuguagaucaugcacgcugccgccucuuagguaccgcggagaggacggcuguugguaugguauggagauucggccauugaaagaaaaggaggaaaaucuggugaacaguuuaguuaccgccgggcauggacagguggauaauuucagccucggcguacuggguauggcucuuuuucuggaggaaauguugagaacuagggucggcacaaaacacgcaauacuccugguggccgugucguucgucacccuaaucacugggaacauguccuuuaaggaccugggacgcguugugguaauggugggcgcuacaaugaccgaugacauugggaugggagucacguaccucgcccugcuugcagcguucaaagugcgacccacuuuugccgcuggcuugcuguuacggaagcucaccucuaaggagcugaugaugacaaccaucgguauuguucuucugagccaaucaacuaucccugagacaauacuagaacucaccgaugcccuggcauuggggaugauggugcugaaaaucguccguaauauggagaaguaucaguuagcugugacaauuauggccauccucugcguucccaacgcagugauucugcagaaugccuggaaagucaguuguacuauccuugcuguaguguccguuucuccacugauauugaccagcucccagcaaaagacggacuggauuccucucgcgcugacaaucaaaggacuaaaccccaccgccaucuuccugacuacccuuucaagaacaaauaagaaaaggagcuggccacucaacgaagcaauuauggcugugggcauggucaguauacuggccucuuccuugcugaagaaugacaucccgaugacuggcccuuuaguggccgggggacuccugaccguaugcuacgugcuuacgggucgcagcgcugaucuggaguuggaacgggcagccgacgucaagugggaggaucaggcggagauuucgggcucaucucccauccucaguauuacaaucuccgaagacgggagcaugucuaucaaaaaugaggaagaggagcagacccugacuauccuaauuagaacaggacugcuuguuaucagcggccucuuuccaguguccauucccaucaccgcugccgcaugguaucugugggaagugaagaaacagagggccggugucuugugggaugugccuucaccacccccuauggggaaggcugaguuagaagacggagcauaccgaauaaaacaaaagggcauucugggcuauagucagaucggggccggaguuuacaaggaggguacuuuccauacaauguggcacguaacccgcggcgcggugcucaugcacaaagggaagcggaucgaaccgagcugggcugaugucaaaaaggaccugauuucuuacggaggcgguuggaaacuugagggggaguggaaggaaggagaggaagugcagguucuggccuuggagccaggcaagaaucccagagcagugcagacgaaaccuggccuauuuaagacuaacaccgggacaaucggagccgucucccuggauuucucaccagguaccaguggcagccccauaauugacaaaaaggggaaagugguaggacucuauggcaacggugucgugacaagguccggggcuuacguuucugccaucgcacaaacugaaaagucgauugaggauaauccugagaucgaagacgauauauuucguaagaaacgccugaccauuauggaccuucauccgggagcuggcaagacgaaacgguauuuacccgccaucgugagagaggcgaucaagaggggccugcgaacacucauuuuggccccaacucgggucguggcagcugaaauggaggaagcccugcgcgggcucccuaucagauaccagacccccgcuauuagggcagagcacacaggacgggagauaguugaccugaugugucaugccaccuucacuaugcgacuucugagcccagugagagucccuaacuauaauuugaucauuauggaugaagcccacuucaccgaccccgcuucaaucgcggcacgcgguuacaucuccacaaggguggagaugggcgaagccgcugggauuuuuaugacggccacuccaccgggaagucgugauccuuucccccagucuaacgcaccaauaaucgacgaggagcgggaaauucccgagagaagcuggaacuccggccaugaauggguaaccgauuuuaaagguaagacagugugguucguuccuucaaucaaggccgggaacgacauugcugcgugccuaaggaaaaauggaaagaaagucauccaacugucucgcaagaccuuugauagcgaguaugugaaaacucgaacaaacgacugggauuucguggucaccacggacauaagugaaaugggcgccaauuuuaaggcagagagaguaaucgauccacggagguguaugaaacccgugauucucacugacggcgaggaacgcguuaucuuagcugggccuaugccggugacacacuccagcgccgcacagcguagaggacggauugguaggaacccaaagaaugagaacgaccaguacaucuacaugggcgaaccccuggagaaugaugaagacugcgcccacuggaaggaggcuaaaaugcuucuggauaacauaaauaccccugaggggauuauccccucuauguucgaaccagagcgcgaaaaggucgacgccauugauggagaguaucgacucagaggcgaagcgcggaaaaccuuuguggacuugaugaggcgcggugaucugccuguuuggcucgcauacaagguggccgcugaggggaucaacuaugccgacagaaggugguguuucgauggcauacagaacaaucaaauccuggaggaaaacgucgagguggaaauuuggacuaaagagggagagcggaagaaacuuaaaccccguuggcuagacgcucgcaucuacucagauccacuggcauugaaggaauuuaaagaguucgccgcuggccgaaaguccuuaacacugaaucucauuaccgaaauggggagacugccuacauucaugacucagaaagccagggacgcacuugauaaccuggcgguacuccauacggccgaggcuggaggucgggccuauaaucacgcauugagugaacugccggagacccuagagacacugcuccuucugacuuuauuggcuaccgugacaggcgggaucuuucuguuccucaugagcggacgcggcauagguaagaugacccuggggaugugcugcauuaucacugccucgauccuucugugguacgcacagauucagccccauuggaucgccgcuucuauaauucucgaauuuuucuugaucguucuguuaauuccagagccugaaaagcaaagaacgccccaggacaaccagcuaaccuaugucgugaucgcgauacugacaguggucgccgcaacuauggcuaaugagaugggcuuucucgagaaaaccaagaaagaccuuggauucggcuccaucgccacacagcaaccagagagcaacauucuggauaucgacuugaggccugccucagcauggacccuguacgcuguugccacuacauuugugacgcccaugcuccggcacaguauugaaaauucuuccguaaacgugagccugaccgcgaucgcuaaucaggccacuguccuuauggggcucggaaaggguuggccgcugucaaaaauggauauuggcgugccauugcuggcaaucggguguuacagucagguuaacccuauaacauuaaccgccgcucuacugcuccuuguggcacacuaugccauuaucggacccggccugcaggcgaaggcuacccgagaagcccaaaagagagcagccgcugguaucaugaaaaauccaacagucgacgggauuacuguaauagauuuggaccccaucccuuacgauccgaaguucgagaaacagcugggccaggugaugcuccugguucuuugcgugacgcaagucuuaaugaugcgcaccacaugggcccugugugaagcacucacuuuggcuaccggacccauuagcacacugugggagggcaacccagggagguuuuggaauaccacuaucgccguguccauggcgaacauuuuccggggaucuuaucuagccggcgcaggucugcucuuuagcaucaugaagaauacgacaaacacccguagagggacuggaaacauaggcgaaacccuuggugagaaauggaaguccaggcugaaugcuuugggcaaaucagaguuccagaucuacaagaagucugggauucaggaagucgaccgcacacuggccaaagagggaaucaagcggggcgaaacugaucaucacgcagugagucgagggucggcuaaacucagaugguuuguugagaggaacaugauuaccccugagggaaaggugguagaccugggcugcggucgcgggggauggagcuauuacuguggcggucuuaaaaaugugcgggaagucaagggccuaacaaaagggggacccggccaugaggaaccuaucccaauguccacguauggguggaaccugguuagacuccagucuggaguggaugucuucuucacaccaccugagaaaugcgacacucuacugugugauauaggcgaaucaagcccaaaucccacaguggaggccggucguaccuugaggguacugaaccucguggagaauuggcuuaacaauaacacucaauuuugcauuaagguucugaauccguacaugccuuccgugaucgagaaaauggaggccuugcagcggaaguacgggggagcgcugguccgcaacccacucagucgaaauucuacacacgaaauguauugggugagcaacgcuucaggcaauaucgucuccagugugaacaugauuagcagaauguuaauaaacagguucaccaugaaacauaagaaggcaacguacgagcccgacguugaccugggcucugggacccggaauaucggaauugaauccgagguaccuaaccuugauaucauugguaaacgcaucgagaagauaaaacaggaacacgagacaucauggcacuaugaccaggaucauccauacaagacuugggccuaucacggcagcuacgaaaccaaacaaacagggucggcuucuaguauggugaauggagucgugagacugcuaacuaagcccugggacguucucccgaccgugacacagauggccaugaccgauacuacgccuuuuggccagcagagggucuucaaggagaaaguggacacacgaacccaagaacccaaggaggguacuaaaaagcugaugaaaaucaccgcagagugguuguggaaggaacuggggaaaaagaagacaccacggauguguacgcgugaggaauuuaccagaaaaguacgcuccaacgccgcucucggagcgauuuucacugaugagaauaaguggaaaagcgccagggaggcaguggaagacucacgguuuugggagcuuguugauaaggaaagaaaccugcauuuagagggcaaaugcgaaacaugugucuauaauaugaugggcaagcgcgagaagaaacugggggaguucggaaaggcuaaagguuccagggccaucugguacaugugguugggcgcacgauuucucgaguucgaggcccugggguuucuaaacgaagaccacugguucucucgggagaauagccuuaguggaguggaaggcgagggucugcacaagcucggguacauucugagagauguguccaaaaaggagggaggcgcuauguaugccgacgacaccgcgggcugggauacuaggaucacauuggaagaccugaagaacgaggaaauggucaccaaucauauggagggggaacacaaaaagcucgcagaggccauuuuuaaacuuacauaccagaacaagguugugcgcguacagcguccuacuccccggggaaccgugauggauauaaucagcagaagggaccaacgcgguucuggccaggucgggacguauggacugaauaccuucacaaacauggaggcucaguuaauucgacagauggaaggcgaggguguguucaaaaauauccaacaucugacugccaccgaagagaucgcaguucagaacugguuggcucggguggggagagagaggcucucacgcauggccauuaguggagaugacugcgucgugaagccacuggaugacagauuugcuuccgcccuaacagcacuuaacgauaugggcaagguacggaaagacauacagcagugggaacccagcaggggcuggaaugauuggacucaaguuccuuucugcucucaccauuuucacgagcugaucaugaaggacgggcgugugcucgucgugccaugucgaaaccaggaugaacugauuggacgcgcgagaaucucgcagggugccggcuggucauugcgggagaccgcuugcuuagggaaaagcuacgcccagauguggucccugauguauuuccacaggcgcgaccucagacuugcagcuaaugccauuuguagugcagugccgucucauuggguccccacgagccggacaaccugguccauccacgccaagcaugaauggaugacuacagaggacaugcugaccguuuggaacaggguguggauacaagagaauccuuggauggaagauaaaacuccaguagagucaugggaagagauccccuaccuaggaaagcgagaagaccaguggugcggcagucugauuggucucaccucucgugcgacaugggcuaagaacauccaggccgcaauuaaucaggugaggagcuugaucgggaacgaggaguauacggauuacaugccuuccaugaaacgcuuucggagggaagaggaagaggccggaguccugugguga

SEQ ID NO: 15070 - RNA, 9876 nt, Artificial Sequence
  derived and/or modified CDS sequence (opt3) from DENV-2__AF169679__SS-prME
agcgccggcaugaucauuaugcugauacccaccgugauggcuuuccaccucacaacuagaaacggggagccucauaugaucgucuccauucaggaaaagggaaaaucucuucuguuuaagacggaggacgguguuaauaugugcaccuugauggcaauggauuuaggcgaacugugugaggacacaaucacuuacaaaugcccacuacucaggcaaaacgaaccggaggauauugacuguuggugcaauucaaccaguacaugggugaccuaugggacuuguacaaccacgggagagcaccggcgcgaaaagcgaagcguagcccuggugccccaugucggcaugggucuugagacucguaccgaaacauggauguccucugagggggcguggaaacacgcucagagaaucgagacuuggauacugaggcauccuggauucaccaucauggccgcaauuuuggccuacacaaucggcaccacgcacuuucagcgggcucucauuuucauccugcugacugcaguggccccaucgaugacaaugcgcugcauaggcauuucaaacagagauuuuguugaaggggugagcggagguaguugggucgacaucgugcucgagcacggcuccuguguaaccacuauggcuaagaauaagcccacauuagauuucgaacugauuaaaaccgaggccaagcagccugcgacgcuuaggaaauauugcaucgaagcaaaguugaccaacacaacuaccgagucucgguguccaacacaaggggagcccagccugaaagaagagcaggacaagcgcuuuguuugcaagcauuccaugguggaucgaggauggggcaaugguugugggcuauucggaaaaggcggcaucgucacuugcgccauguuuaccugcaagaaaaacauggaagggaagauugugcagccugagaaucucgaauacacaauaguggucaccccacacucaggagaggagcaugcuguugguaacgacacuggcaaacacgggaaggaaaucaaagugacgccgcagaguagcauuacagaggccgaacugaccggauauggcacuguaaccauggaguguucucccagaacaggucuugauuucaaugaaauggugcuguugcaaauggagaacaaggcauggcucguccacaggcagugguuucuggacuuaccucugccauggcuccccggggcugauacccagggcuccaauuggauccagaaggagacucuugugacauucaaaaacccucaugccaagaaacaagacguugugguccugggaucacaggaaggcgcgaugcacacggccuugaccggggcaacugagauacagaugagcaguggaaaucuacuguuuacaggucaucucaagugccggcugcguauggacaaacuucaacugaagggcaugucuuacuccauguguaccgggaaguucaaagugguaaaggaaauugcugagacacagcacggaacuaucguuauccgcgugcaguaugagggcgaugguagcccaugcaaaauucccuucgaaaucauggacuuggagaagagauacguccucgggaggcugauuaccgugaacccgauagucacggaaaaagauucgccugugaacaucgaggccgaacccccauuuggcgacucuuacauuaucaucggaguugagccuggccaguuaaagcugaauugguucaagaaaggguccucaauuggacaaauguuugagaccacaaugcggggugcuaagcgaauggccauacuaggcgauacugcaugggacuucgggagucucggaggcguguuuaccagcaucgguaaagcccugcaucagguauucggggcuauuuauggcgcggcauuuuccggagucucuuggacaaugaagauccuuauuggcgugaucauaacuuggaucgggaugaacagccgcucaaccaguuuguccguuagccuggugcucgucggaauugugacgcuguaccuuggcguaauggugcaggccgauucugguuguguugucucauggaaaaauaaggaacugaagugcgggaguggaaucuucauuacagacaacgugcacaccuggacugagcaguauaaauuucaacccgaaagcccauccaaguuggcuucugccauccagaaagcacaggaggaaggcauaugugguauuagaucggugacaaggcucgagaaucugauguggaagcagaucacccccgaguuaaaccacauucuggccgaaaaugaggucaaacuaacuaucaugaccggcgauauaaaggggaucaugcaagcuggaaaacggagccuccgcccucagccaacagaacugaaguacuccuggaagacguggggcaaagccaagaugcuuucaaccgagagucauaaccagacuuucuugauugacgggccgaaaacagcagaaugccccaauaccaacagagcguggaauucucuggagguugaggauuauggauuuggcguguucacaacuaacaucuggcucaagcugaaagaaaagcaggacgcuuuuugugacagcaaguuaauguccgccgcaauuaaagauaauagggccgugcacgcugacauggguuacuggaucgagucagcccugaacgauaccuggaagauagaaaaagcaagcuucauugagguaaagaauugccauuggccuaaaucucacacgcuuugguccaacggggucuuggagagugaaaugaucaucccaaagaaccucgcuggacccgugagccaacacaauuaucguccuggcuaccauacacagauugccgguccauggcaccugggcaagcuagagauggacuucgauuuuugugacgggaccacuguuguggucaccgaagauugcggaaaccggggccccucucugcgaacaacuaccgcguccgggaaacucaucacagaguggugcuguagaucaugcacgcugccgccucuuagguaccgcggagaagacggcuguugguaugguauggagauucggccauugaaggagaaagaagagaaucuggugaacaguuuaguuaccgccgggcauggacagguggauaauuucagccucggcguacuggguauggcucuuuuucuggaagagauguugagaacuagggucggcacaaagcacgcaauacuccugguggccgugucguucgucacccuaaucacugggaacauguccuuuaaagaccugggacgcguugugguaauggugggcgcuacaaugaccgaugacauugggaugggagucacguaccucgcccugcuugcagcguucaaggugcgacccacuuuugccgcuggcuugcuguuacggaagcucaccucuaaagaacugaugaugacaaccaucgguauuguucuucugagccaaucaacuaucccugagacaauacuagagcucaccgaugcccuggcauuggggaugauggugcugaagaucguccguaauauggaaaaauaucaguuagcugugacaauuauggccauccucugcguucccaacgcagugauucugcagaaugccuggaaggucaguuguacuauccuugcuguaguguccguuucuccacugauauugaccagcucccagcaaaaaacggacuggauuccucucgcgcugacaaucaagggacuaaaccccaccgccaucuuccugacuacccuuucaagaacaaauaaaaagaggagcuggccacucaacgaggcaauuauggcugugggcauggucaguauacuggccucuuccuugcugaagaaugacaucccgaugacuggcccuuuaguggccgggggacuccugaccguaugcuacgugcuuacgggucgcagcgcugaucuggaauuggagcgggcagccgacgucaaaugggaagaucaggcggagauuucgggcucaucucccauccucaguauuacaaucuccgaggacgggagcaugucuauaaagaacgaagaggaagagcagacccugacuauccuaauuagaacaggacugcuuguuaucagcggccucuuuccaguguccauucccaucaccgcugccgcaugguaucugugggaggugaaaaagcagagggccggugucuugugggaugugccuucaccacccccuauggggaaagcugaauuagaggacggagcauaccgaauaaagcaaaagggcauucugggcuauagucagaucggggccggaguuuacaaagaagguacuuuccauacaauguggcacguaacccgcggcgcggugcucaugcacaaggggaaacggaucgagccgagcugggcugaugucaagaaagaccugauuucuuacggaggcgguuggaagcuugaaggggaguggaaggagggagaagaggugcagguucuggccuuggaaccaggcaaaaaucccagagcagugcagacgaagccuggccuauuuaaaacuaacaccgggacaaucggagccgucucccuggauuucucaccagguaccaguggcagccccauaauugacaagaaagggaaggugguaggacucuauggcaacggugucgugacaagguccggggcuuacguuucugccaucgcacaaacugagaagucgauugaagauaauccugagaucgaggacgauauauuucguaaacgccggcugaccauuauggaccuucauccgggagcuggcaagacgaaaagauauuuacccgccaucgugagggaagcgaucaagcgaggccugcggacacucauuuuggccccaacucgcgucguggcagcugagauggaagaggcccugagagggcucccuaucagguaccagacccccgcuauucgggcagaacacacaggacgagagauaguugaccugaugugucaugccaccuucacuaugagacuucugagcccagugcgcgucccuaacuauaauuugaucauuauggaugaggcccacuucaccgaccccgcuucaaucgcggcaagggguuacaucuccacacguguggaaaugggcgaggccgcugggauuuuuaugacggccacuccaccgggaagucgggauccuuucccccagucuaacgcaccaauaauggacgaagagagagagauccccgaaaggagcuggaauuccggccaugaguggguaaccgauuuuaaagguaagacagugugguucguuccuucaauuaaggccgggaacgacaucgcugcgugccuacgcaaaaauggaaagaaagucauucaacugucucgaaagaccuuugauagcgaauaugugaaaacuagaacaaacgacugggauuucguggucaccacggacaucagugagaugggcgccaauuuuaaggcagaacggguaauagauccaaggcgcuguaugaaacccgugauccucacugacggcgaggagcguguuauuuuagcugggccuaugccggugacacacuccagcgccgcacagagacggggaaggaucggucgcaacccaaagaaugaaaacgaccaguacauuuacaugggcgagccccuggaaaaugaugaggacugcgcccacuggaaggaagcuaaaaugcuucuggauaacaucaauaccccugaggggauaauucccucuauguucgagccagaacgagagaaggucgacgccaucgauggagaauauagacuccggggcgaggcgaggaaaaccuuuguggacuugaugcgcagaggugaucugccuguuuggcucgcauacaagguggccgcugaagggauuaacuaugccgacaggcggugguguuucgauggcauccguaacaaucagauacuggaggagaacgucgaaguggagaucuggacuaaagaaggagagcgcaagaagcuuaaaccccgauggcuagacgcuagaauuuacucagauccacuggcauugaaggaguuuaaagaauucgccgcuggcaggaaguccuuaacacugaaucucaucaccgagauggggcggcugccuacauucaugacucaaaaagcccgcgacgcacuugauaaccuggcgguacuccauacggccgaagcuggagguagagccuauaaucacgcauugagugagcugccggaaacccuagagacacugcuccuucugacuuuauuggcuaccgugacaggcgggauuuuucuguuccucaugagcggaaggggcaucgguaagaugacccuggggaugugcugcauaauuacugccucgauccuucugugguacgcacagauccagccccauuggauugccgcuucuaucauacucgaguuuuucuugauuguucuguuaaucccagaaccugagaagcagcggacgccccaagacaaccagcuaaccuaugucgugauugcgauccugacaguggucgccgcaacuauggcuaaugaaaugggcuuucucgagaaaaccaagaaagaccuuggauucggcuccauagccacacagcagccagaaagcaacauccuggauauugacuugcgaccugccucagcauggacccuguacgcuguugccacuacauuugugacgcccaugcucagacacaguaucgagaauucuuccguaaacgugagccugaccgcgauugcuaaucaagccacuguccuuauggggcucggaaaggguuggccgcugucaaaaauggauaucggcgugccauugcuggcaauuggguguuacagucagguuaacccuaucacauuaaccgccgcucuacugcuccuuguggcacacuaugccauaauuggacccggccugcaggcgaaggcuacccgcgaggcccagaagagggcagccgcugguaucaugaaaaauccaacagucgacgggaucacuguaauugauuuggaccccauaccuuacgauccgaaguucgaaaaacaacugggccaggugaugcuccugguucuuugcgugacgcaggucuuaaugaugcggaccacaugggcccugugugaggcacucacuuuggcuaccggacccaucagcacacugugggaaggcaacccagggcguuuuuggaauaccacuauugccguguccauggcgaacaucuucagaggaucuuaucuagccggcgcaggucugcucuuuagcauuaugaagaauacgacaaacaccaggcgcgggacuggaaacaucggcgagacccuuggugaaaaauggaagucccggcugaaugcuuugggcaaaucagaguuccaaauauacaagaagucugggauccaggaggucgaccgaacacuggccaaagaaggaauuaagagaggcgagacugaucaucacgcagugaguagggggucggcuaaacuccgcugguuuguugaacggaacaugaucaccccugagggaaaggugguagaccugggcugcgguagagggggauggagcuauuacuguggcgguuuaaaaaaugugcgugaggucaagggccuuacaaaggggggacccggccaugaagagccuauuccaauguccacguauggguggaaccugguuaggcuccagucuggaguggaugucuucuucacccccccugaaaaaugcgacacucuacugugugauaucggcgagucaagcccaaaucccacaguggaagccggucggaccuugcgcguacugaaccucguggagaauuggcuuaacaauaacacucaguuuugcauaaagguucugaauccguacaugccuuccgugauugagaaaauggaagccuugcaacgaaaguacgggggagcgcuggucagaaacccacucaguaggaauucuacacacgagauguauugggugagcaacgcuucaggcaauaucgucuccagugugaacaugaucagccggauguuaauuaaccgcuucaccaugaaacauaagaaggcaacguacgaacccgacguugaccugggcucugggaccagaaauauaggaaucgaguccgaaguaccuaaccuugauauuaucgguaaaaggauugagaagaucaaacaggagcacgaaacaucauggcacuaugaccaggaucauccauacaagacuugggccuaucacggcagcuacgagaccaaacagacagggucggcuucuaguauggugaauggagucgugcgacugcuaacuaagcccugggacguucucccgaccgugacacaaauggccaugaccgauacuacgccuuuuggccagcagcgggucuucaaggaaaaaguggacacacguacccaggagcccaaggaagguacuaaaaagcugaugaaaauaaccgcagagugguuguggaaggagcuggggaaaaagaagacaccaagaauguguacgcgcgaagaguuuaccaggaaaguacgguccaacgccgcucucggagcgaucuucacugaugaaaauaaguggaaaagcgccagagaggcaguggaggacucacgcuuuugggaacuuguugauaaggagaggaaccugcauuuagaaggcaaaugcgagacaugugucuauaauaugaugggcaagcgagaaaagaaacugggggaguucggaaaggcuaaagguucccgggccauuugguacaugugguugggcgcaagauuucucgaguucgaagcccugggguuucuaaacgaggaccacugguucucuagggaaaauagccuuaguggaguggagggcgaaggucugcacaagcucggguacauccugcgcgauguguccaaaaaggagggaggcgcuauguaugccgacgacaccgcgggcugggauacucguauuacauuggaggaccugaagaacgaagagauggucaccaaucauauggaaggggagcacaaaaagcucgcagaagccaucuuuaaacuuacauaccaaaacaagguugugcggguacagagaccuacucccaggggaaccgugauggauauuauaagccgccgagaccagcgggguucuggccaagucgggacguauggacugaauaccuucacaaacauggaggcucaguuaaucagacagauggagggcgaagguguguucaaaaauauucagcaucugacugccaccgaggaaaucgcaguucaaaacugguuggcuaggguggggcgcgagagacucucacggauggccaucaguggagaugacugcgucgugaagccacuggaugacagguuugcuuccgcccuaacagcacuuaacgauaugggcaagguacguaaagacauucagcagugggagcccagccgaggcuggaaugauuggacucagguuccuuucugcucucaccauuuucacgaacugauaaugaaggacgggcgcgugcucgucgugccauguagaaaccaagaugagcugaucggacgggcgaggauuucgcagggugccggcuggucauugcgcgaaaccgcuugcuuagggaaaagcuacgcccagauguggucccugauguauuuccacagacgggaccucaggcuugcagcuaaugccaucuguagugcagugccgucucauuggguccccacgagccgaacaaccugguccauucacgccaagcaugaguggaugacuacagaagacaugcugaccguuuggaaccguguguggauccaggagaauccuuggauggaggauaaaacuccaguagaaucaugggaggaaauacccuaccuaggaaagagagaggaccaauggugcggcagucugaucggucucaccucucgcgcgacaugggcuaagaacauucaggccgcaaucaaucaggugcggagcuugauugggaacgaagaguauacggauuacaugccuuccaugaaaagguuuagacgcgaggaagaggaagccggaguccugugguga

SEQ ID NO: 15071 - RNA, 9876 nt, Artificial Sequence
  derived and/or modified CDS sequence (opt3) from DENV-2__AF169680__SS-prME
agcgccggcaugaucauuaugcugauacccaccgugauggcuuuccaccucacaacuagaaacggggagccucauaugaucgucuccauucaggaaaagggaaaaucucuucuguuuaagacggaggacgguguuaauaugugcaccuugauggcaauggauuuaggcgaacugugugaggacacaaucacuuacaaaugcccacuacucaggcaaaacgaaccggaggauauugacuguuggugcaauucaaccaguacaugggugaccuaugggacuuguacaaccacgggagagcaccggcgcgaaaagcgaagcguagcccuggugccccaugucggcaugggucuugagacucguaccgaaacauggauguccucugagggggcguggaaacacgcucagagaaucgagacuuggauacugaggcauccuggauucaccaucauggccgcaauuuuggccuacacaaucggcaccacgcacuuucagcgggcucucauuuucauccugcugacugcaguggccccaucgaugacaaugcgcugcauaggcauuucaaacagagauuuuguugaaggggugagcggagguaguugggucgacaucgugcucgagcacggcuccuguguaaccacuauggcuaagaauaagcccacauuagauuucgaacugauuaaaaccgaggccaagcagccugcgacgcuuaggaaauauugcaucgaagcaaaguugaccaacacaacuaccgagucucgguguccaacacaaggggagcccagccugaaagaagagcaggacaagcgcuuuguuugcaagcauuccaugguggaucgaggauggggcaaugguugugggcuauucggaaaaggcggcaucgucacuugcgccauguuuaccugcaagaaaaacauggaagggaagauugugcagccugagaaucucgaauacacaauaguggucaccccacacucaggagaggagcaugcuguugguaacgacacuggcaaacacgggaaggaaaucaaagugacgccgcagaguagcauuacagaggccgaacugaccggauauggcacuguaaccauggaguguucucccagaacaggucuugauuucaaugaaauggugcuguugcaaauggagaacaaggcauggcucguccacaggcagugguuucuggacuuaccucugccauggcuccccggggcugauacccagggcuccaauuggauccagaaggagacucuugugacauucaaaaacccucaugccaagaaacaagacguugugguccugggaucacaggaaggcgcgaugcacacggccuugaccggggcaacugagauacagaugagcaguggaaaucuacuguuuacaggucaucucaagugccggcugcguauggacaaacuucaacugaagggcaugucuuacuccauguguaccgggaaguucaaagugguaaaggaaauugcugagacacagcacggaacuaucguuauccgcgugcaguaugagggcgaugguagcccaugcauuauccccuucgaaauuauggacuuggagaaaagauacguccucgggaggcugauaaccgugaacccgaucgucacggaaaaggauucgccugugaacauugaggccgaacccccauuuggcgacucuuacaucaucauuggaguugagccuggccaguuaaaacugaauugguucaagaagggguccucaauaggacaaauguuugagaccacaaugcggggugcuaaacgaauggccauccuaggcgauacugcaugggacuucgggagucucggaggcguguuuaccagcauugguaaggcccugcaucagguauucggggcuaucuauggcgcggcauuuuccggagucucuuggacaaugaaaauucuuaucggcgugauaaucacuuggauugggaugaacagccgcucaaccaguuuguccguuagccuggugcucgucggaaucgugacgcuguaccuuggcguaauggugcaggccgauucugguuguguugucucauggaagaauaaagaacugaagugcgggaguggaauuuucaucacagacaacgugcacaccuggacugagcaguauaaguuucaacccgaaagcccauccaaauuggcuucugccauacagaaggcacaggaggaaggcauuugugguaucagaucggugacaaggcucgagaaucugauguggaaacagauuacccccgaguuaaaccacauccuggccgaaaaugaggucaagcuaacuauaaugaccggcgauaucaaagggauuaugcaagcuggaaagcggagccuccgcccucagccaacagaacugaaauacuccuggaagacguggggcaaggccaaaaugcuuucaaccgagagucauaaccagaauuucuugaucgacgggccggaaacugcagagugccccaacacaaauagagcguggaacucucuggagguugaagauuauggauuuggcguguucaccacaaauguguggcucaagcugaaagagaagcaggacgcuuuuugugacagcaaauuaauguccgccgcaauuaaggauaacagggccguacacgcugacauggguuacuggaucgaaucagcccugaaugauacuuggaagauagagaaagcaagcuucauugaggucaagaacugccauuggccuaaaucucacacccuuugguccaacgggguguuggaaagugagaugaucaucccaaagaaucucgcuggacccguuagccaacacaacuaucguccuggcuaccauacgcagauugccgguccauggcaccugggcaaacuagaaauggacuucgauuuuugugacgggacaaccguggucgugacugaggauugcggaaaucggggccccucucugcgaaccacaacugcguccgggaagcucaucaccgaauggugcuguagaucaugcacacugccgccucuuagguaccgcggagaggacggcuguugguaugguauggagauucggccauugaaggaaaaagaggaaaaccugguuaauaguuuagugacggccgggcauggacagguagauaacuucagccucggcguccuggguauggcucuuuuucuggaggaaauguugagaaccagggugggcacuaagcacgcaauacuccugguggccgucucguucguuacacuaaucaccgggaauauguccuuuaaagaccugggacgcgugguagugauggucggcgcuacuaugacagaugacauugggaugggagugaccuaccucgcccugcuugcagcguucaagguucgacccacguuugccgcuggcuugcuguuacggaaacucacuucuaaggagcugaugaugaccacaaucgguauugugcuucugagccaaucaaccaucccugagacuauacuagaacucacagaugcccuggcauuggggaugaugguccugaagaucgugcguaacauggagaaauaucaguuagcuguuaccauuauggccauccucugcgugcccaaugcagucauucugcagaacgccuggaagguaaguuguacaauccuugcugugguuuccgugucuccacugauauugacuagcucccagcaaaaaaccgacuggauuccucucgcgcugacgaucaagggacuaaaucccacagccaucuuccugaccacucuuucaagaaccaacaaaaagaggagcuggccacucaaugaagcaauuauggcugucggcauggugaguauacuggccucuuccuugcugaaaaacgacaucccgaugacaggcccuuuaguagccgggggacuccugacugugugcuacguccuuaccggucgcagcgcugaucuggaguuggaacgggcaacggacguuaagugggagagacaggccgagauuucgggcucaucucccauccucaguauuacaaucuccgaagaugggagcaugucuauaaagaaugaggaagaggagcagacccugacuauccuaauuaggacaggacugcuugugaucagcggccucuuuccaguguccauucccaucaccgcggcugccugguaucugugggaagucaaaaagcagcgagcagguguguugugggacguuccuucaccacccccuauggggaaagccgaguuagaagauggagcuuaccgcauaaagcaaaaaggcauucugggcuauagucagaucggggcaggaguauacaaggaggguacuuuccauacaauguggcacgugacccggggcgccguccucaugcacaaggggaaaagaaucgaaccgagcugggcggacgugaagaaagaucugauuucuuacggaggcgguuggaagcuugagggggaguggaaagaaggagaggaaguucaggugcuggcuuuggagccaggcaagaaccccagggccguccagacgaagccuggccuauuuaaaacuaacaccgggacaaucggagcagugucccuggacuucucaccagguaccaguggcagccccauaauugauaagaaagggaagguagucggacucuauggcaauggugugguuacacguuccggggccuacgugucugcuaucgcccaaacugaaaaaucgauugaggacaacccugagaucgaagaugacauauuucgcaagcggaagaugaccauuauggaucugcauccgggagcaggcaaaacgaagagauaucuucccgcuaucgucagggaggccaucaaacgaggcuuacggacacugauucucgcgccaacucgcgugguugccgcagaaauggaggaagcuuugagagggcugccuaucagguaccagacccccgccauucgggcugagcacacaggacgagagauaguggaccucaugugucaugcaaccuucacuaugagacugcuuagcccaguccgcgugccuaauuauaaccugaucauuauggacgaagcccacuucaccgaucccgccucaaucgcugcgagggguuacaucuccacacguguagagaugggcgaagcagccgggauuuuuaugacggcuacuccaccgggaagucgggacccuuucccccagucuaaugccccaauaaucgaugaggagagagaaauucccgagaggagcuggaacuccggccaugaaugggugaccgacuuuaaggguaaaacaguuugguucgucccuucaaucaaggcagggaaugauauugccgcuugcuugcgcaagaacggaaaaaaggugauccaacuaucucgaaaaaccuuugacagcgaguaugugaagacuagaacaaaugauugggacuucgucguaaccacggauauaagugaaaugggcgcgaacuuuaaagccgagcgggugaucgacccaaggcgcuguaugaagcccguuauucugacugauggcgaggaacgugugauccucgcagggccuaugccggucacacacuccagcgcugcccagagacggggaaggauuggucgcaauccaaaaaacgagaaugaccaguacaucuacaugggcgaacccuuagagaacgacgaagauugcgcacacuggaaggaggccaagaugcugcuugacaauauaaacaccccugaggggauuauccccucuauguucgaaccagagcgagaaaaaguggaugcuauugacggagaguauagacugcggggcgaagccaggaagaccuuuguugaucucaugcgcagaggugacuugccuguguggcuggcguacaaagucgcagccgaggggaucaacuaugcugauaggcggugguguuucgacggcauacguaauaaccagauccucgaggaaaauguggagguagaaauuuggacuaaggagggagagcgcaaaaagcugaagccccgauggcuugaugccagaaucuacucagacccacuagcucugaaagaauuuaaggaguucgcagccggcaggaaauccuugacauuaaaccugauuaccgaaauggggcggcucccuacauucaugacucaaaaggcucgcgaugcccuggacaaucuugcagugcugcauacggcggaggccggagguagagcuuauaaccacgcccucagugaauugccggagacccuggagacacuacugcuccuuacucuguuagcaaccguuacaggcgggaucuuuuuguuccugaugagcggaaggggcauagguaaaaugacccucgggaugugcugcauuaucacugcuucgauccugcuuugguacgcccagauucagccccauuggaucgcagccucuauaauucuggaauuuuuccucaucgucuugcugauuccagagccugaaaagcagcggacgccccaagauaaucaguuaaccuauguggugaucgcuauacuaacagucguugcggccacuauggcaaacgagaugggcuuucuggaaaagaccaaaaaggaccucggauucggcuccaucgcuacacagcagccagagagcaauauucuugacaucgaucugcgaccugccucagccuggaccuuguacgcaguggcuacuacauuuguaacgcccaugcugagacacaguauugagaacucuuccgugaaugucagccucaccgccaucgcgaaccaagcuacugugcugauggggcuuggaaaagguuggccgcucucaaagauggacauuggcguuccacuguuggccaucggguguuacagucaggugaauccuauaacacugaccgcagccuuacuacugcucgucgcucacuaugcaauuaucggacccggccuucaggccaaagcgacccgcgaagcucagaagagggccgcagccgguaucaugaagaacccaagcguagaugggauuacagugauagaccuggaucccaucccuuacgacccgaaauucgagaagcaauugggccagguuaugcugcucgugcugugcgucacucaggugcuuaugaugcggacgaccugggcuuuaugugaagcccugacacucgcaacuggacccauuuccaccuugugggagggcaauccagggcguuuuuggaacacaaccaucgcugucucuauggccaauauuuucagaggaagcuaucuggcgggcgccggucuacuguuuuccaucaugaaaaacacuacgaacacaaggcgcgggaccggaaauauaggcgaaacucucggugagaaguggaaaucacggcuuaacgcacugggcaagucugaguuccaaaucuacaaaaagagugggauucaggaaguggaucgaaccuuggcuaaggagggaaucaaaagaggcgaaacagaccaucacacuguuucgagggggagcgccaagcugcgcugguuuguggagcggaauaugauuaccccugagggaaaaguacucgaucugggcugcgguagagggggaugguccuauuacuguggcgguuuaaagaacgugcgugaagucaaaggccuuacaaaggggggacccggccaugaggaaccuaucccaaugucuacguauggguggaaucugguuaggcuccagucaggaguggacgucuucuucacccccccugagaagugcgauacucuacugugugacauaggcgaaagcuccccaaaccccacaguggaggcaggucggaccuugcgcguacugaaucucguggagaacuggcuuaauaacaauacucaguuuugcauuaaaguucugaacccguacaugccuagugugaucgaaaagauggaggcuuugcaacgaaaauacgggggagcccuggucagaaauccacucucuaggaacagcacacacgaaauguauugggugucaaaugccuccggcaacaucgucaguagcgugaacaugauuucucggauguuaauaaaucgcuucaccaugaagcauaaaaaggcgacguacgagcccgauguugaccugggcuccgggaccagaaacaucggaauugaaucagagguaccuaaucuugacaucauugguaagaggaucgagaaaauaaagcaggaacacgagacaagcuggcacuaugaucaggaccauccauacaaaacuugggcuuaucacggcucguacgaaaccaagcagacagggucugcaaguuccauggugaacggagucgugcgacugcuaacuaaacccugggauguucucccgaccgugacacaaauggccaugaccgacacuacgccuuuuggccagcagcgggucuucaaggagaagguggauacacguacccaggaacccaaagaggguacuaagaaacugaugaagaucaccgcugagugguuguggaaagaacuggggaagaaaaagacaccaagaauguguacgcgcgaggaauuuaccaggaagguacggagcaaugccgcacucggagccauuuucacugacgagaacaaauggaagucagcuagagaggcgguggaagauucccgcuuuugggagcuuguugacaaagaaaggaaucugcauuuagagggcaagugcgaaacaugugucuauaacaugaugggcaaacgagagaagaagcugggggaguucggaaaagccaaggguucucgggcaaucugguacaugugguugggcgcuagauuucucgaauucgaggcccugggguuucuaaaugaagaucacugguucagcagggagaacagucuuuccggaguggaaggcgagggucugcacaaacucggguacauucugcgcgacgugagcaagaaagagggaggcgcaauguaugccgaugacaccgcuggcugggacacucguaucacauuggaagaucugaagaaugaggaaauggucaccaaccauauggagggggaacacaagaaacucgccgaggcgauuuuuaagcuuacauaccaaaauaaaguugugcggguacagagaccuacucccaggggaaccgugauggacauaaucucucgccgagaucagcgggguucaggccaagucgggacguauggacugaacaccuucacaaauauggaggcacaguuaauuagacagauggaaggcgaggguguguucaagaacauccagcaucugacugccaccgaagagaucgcuguucaaaacugguuggccaggguggggcgcgagagacucagucggauggcaauuuccggagacgauugcgucgugaaaccacuggacgauagguuugcuagcgcccuaacagcucuuaaugacaugggcaagguacguaaggauauacagcagugggaacccucucgaggcuggaacgacuggacucagguuccuuucugcucgcaccauuuucacgagcugaucaugaaagaugggcgcgugcucgucgugccauguagaaaucaagacgaacugauuggacgggccaggaucucacagggugcaggcuggagcuugcgcgagaccgcgugcuuagggaaguccuacgcccagauguggagucugauguauuuccacagacgggaucucaggcuugcugccaacgcaauuuguucugcugugccgagccauuggguccccacgucccgaacaaccuggucaauccacgccaaacaugaauggaugacuacagaggacaugcugaccguuuggaaucguguguggauacaggagaacccuuggauggaagacaagacuccaguagagaguugggaagagauccccuaccuaggaaaaagagaagaucaauggugcggcucucugauuggucucaccagccgcgcaacaugggccaagaauauccaggcggcuauuaaccaggugcgguccuugaucgggaaugaggaguauacggacuacaugccuucaaugaagagguuuagacgcgaagaggaagaggccggaguccugugguga

SEQ ID NO: 15072 - RNA, 9876 nt, Artificial Sequence
  derived and/or modified CDS sequence (opt3) from DENV-2__AF169682__SS-prME
agcgcaggcaugaucauuaugcugauacccaccgugauggcuuuccaccucacaacuagaaauggggagccucauaugaucgucuccauucaggaaaagggaaagucucuucuguuuaagacggaggacgguguuaauaugugcaccuugauggcaauggauuuaggcgaacugugugaggacacaaucacuuacaagugcccacuacucagacaaaaugaaccggaggauauugacuguuggugcaauucaaccaguacaugggugaccuaugggacuuguacaaccacgggagagcaccggcgcgaaaagcgaagcguagcacuggugccccaugucggcaugggucuugagacucguaccgaaacauggauguccucugagggggcguggaaacacgcucagagaaucgagacuuggauacugaggcauccuggauucaccaucauggccgcaauuuuggccuacacaaucggcaccacgcacuuucagcgggcucucauuuucauccugcugacugcaguggccccaucgaugacaaugcgcugcauaggcauuucaaacagagauuuuguugaaggggugagcggagguaguugggucgacaucgugcucgagcacggcuccuguguuaccacuauggcuaagaauaagcccacauuagauuucgaacugauuaaaaccgaggccaagcagccugcgacgcuuaggaaauauugcaucgaagcaaaguugaccaacacaacuaccgagucucgguguccaacacaaggggagcccagccugaaagaggaacaagacaagcgcuuuguuugcaagcauuccaugguggaucgaggauggggcaaugguugugggcuauucggaaaaggcggcaucgucacuugcgccauguuuaccugcaagaaaaacauggaagggaagauugugcagccugagaaucucgaauacacaauaguggucaccccacacucaggagaggagcaugcuguugguaacgacacuggcaaacacgggaaggaaaucaaagugacgccgcagaguagcauuacagaggccgaacugaccggauauggcacuguaaccauggaguguucucccagaacaggucuugauuucaaugaaauggugcuguugcaaauggagaacaaggcauggcucguccacaggcagugguuucuggacuuaccucugccauggcuccccggggcugauacccagggcuccaauuggauccagaaggagacucuugugacauucaaaaacccucaugccaagaaacaagacguugugguccugggaucacaggaaggcgcgaugcacacggccuugaccggggcaacugagauacagaugagcaguggaaaucuacuguuuacaggucaucucaagugccggcugcguauggacaaacuucaacugaagggcaugucuuacuccauguguaccgggaaguucaaagugguaaaggaaauugcugagacacagcacggaacuaucguuauccgcgugcaguaugagggcgaugguagcccaugcaggauucccuucgaaaucauggacuuggagaaaagguacguccucgggcggcugauuaccgugaacccgauagucacggaaaaggauucgccugugaacaucgaggccgaacccccauuuggcgacucuuacauuaucaucggaguugagccuggccaguuaaaacugaauugguucaagaagggguccucaauuggacaaauguuugagaccacaaugcgaggugcuaaacgcauggccauacuaggcgauacugcaugggacuucgggagucucggaggcguguuuaccagcaucgguaaggcccugcaucagguauucggggcuauuuauggcgcggcauuuuccggagucucuuggacaaugaaaauccuuauuggcgugaucauaacuuggaucgggaugaacagcagaucaaccaguuuguccguuagccuggugcucgucggaauugugacgcuguaccuuggcguaauggugcaggccgauucugguuguguugucucauggaagaauaaagaacugaagugcgggaguggaaucuucauuacagacaacgugcacaccuggacugagcaguauaaguuucaacccgaaagcccauccaaauuggcuucugccauccagaaggcacaggaggaaggcauaugugguauuaggucggugacacggcucgagaaucugauguggaaacagaucacccccgaguuaaaccacauucuggccgaaaaugaggucaagcuaacuaucaugaccggcgauauaaaagggaucaugcaagcuggaaagcgcagccucagaccucagccaacagaacugaaauacuccuggaagacguggggcaaggccaaaaugcuuucaaccgagagucauaaccagacuuucuugauugacgggccggaaacagcagagugccccaauaccaacagggcguggaacucucuggagguugaagauuauggauuuggcguguucacaacuaacaucuggcucaagcugaaagagaagcaggacgcuuuuugugacagcaaauuaauguccgccgcaauuaaggauaaucgugccgugcacgcugacauggguuacuggaucgaaucagcccugaacgauaccuggaagauagagaaagccagcuucauugagguaaagaauugccauuggccuaaaucucacacgcuuugguccaacggggucuuggaaagugagaugaucaucccaaagaaccucgcuggacccgugagccaacacaauuaucggccuggcuaccauacacagauugccgguccauggcaccugggcaaacuagaaauggacuucgauuuuugugacgggaccacuguuguggucaccgaggauugcggaaaccgaggccccucucugagaacaacuaccgcguccgggaagcucaucacagaauggugcuguaggucaugcacgcugccgccucuucgcuaccggggagaggacggcuguugguaugguauggagauuagaccauugaaggaaaaagaggaaaaucuggugaacaguuuaguuaccgccgggcauggacagguggauaauuucagccucggcguacuggguauggcucuuuuucuggaggaaauguugaggacucgcgucggcacaaagcacgcaauacuccugguggccgugucguucgucacccuaaucacugggaacauguccuuuaaagaccugggacgaguugugguaauggugggcgcuacaaugaccgaugacauugggaugggagucacguaccucgcccugcuugcagcguucaaggugcggcccacuuuugccgcuggcuugcuguuacguaaacucaccucuaaggagcugaugaugacaaccaucgguauuguucuucugagccaaucaacuaucccugagacaauacuagaacucaccgaugcccuggcauuggggaugauggugcugaagaucgucagaaauauggagaaauaucaguuagcugugacaauuauggccauccucugcguucccaacgcagugauucugcagaaugccuggaaggucaguuguacuauccuugcuguaguguccguuucuccacugauauugaccagcucccagcagaagacggacuggauuccucucgcgcugacaaucaagggacuaaaccccaccgccaucuuccugacuacccuuucaaggacaaauaaaaagcgcagcuggccacucaacgaagcaauuauggcugugggcauggucaguauacuggccucuuccuugcugaaaaaugacaucccgaugacuggcccuuuaguggccgggggacuccugaccguaugcuacgugcuuacgggucggagcgcugaucuggaguuggaaagagcaacagacgucaagugggaggaucaggccgagauuucgggcucaucucccagucucuccaucaccauuagcgaagacgggucuaugagcaucaagaacgaggaagaggagcagacucugacaauacuaaucaggaccggacugcuuguuauuuccggccucuuuccagugucaauccccauuacugcggcugccugguaucugugggaagugaaaaagcagcgagccggugucuugugggaugugccuaguccacccccuauggggaaagccgaguuagaagacggagcuuaccgcaucaagcaaaaaggcauacugggcuauagccagauuggggcaggaguuuacaaggaggguacauuccauaccauguggcacguaacgcggggcgccgugcucaugcacaaggggaaaagaaucgaaccgucuugggcggaugucaagaaagaccugaucuccuacggaggcgguuggaaacuugagggggaguggaaagaaggagaggaagugcagguucuggcuuuggagccaggcaagaaucccagggccgugcagacuaagccuggccuauuuaaaaccaacacagggaccauuggagcagucucacuggauuucaguccagguacaagcggcucccccaucauagacaagaaagggaaggugguaggacucuauggcaacggugucgugacucguucuggggccuacguuucggcuauugcccaaaccgagaaaagcaucgaagauaauccugagauugaagacgauaucuuucgcaagcggagacugacgauaauggaccuucauccgggagcaggcaagacaaaaagguauuuacccgcuauugugcgagaggccaucaagcggggccugcgcacucucaucuuggcgccaaccagagucguggccgcagaaauggaggaagcucugagggggcucccuauucgguaccagacacccgccauccgagcugagcacaccggaagagagauuguugaccugaugugucaugcaacuuucaccaugcgccuucugucaccagugagggucccuaacuauaauuugauaaucauggaugaagcccacuucacagaccccgccuccauugcugcgcgugguuacaucaguacgcggguggagaugggcgaagcagccgggaucuuuaugacugcuaccccaccgggaucuagagauccuuucccccagagcaacgccccaauuauagacgaggagagggaaauccccgagcgcuccuggaacucaggccaugaauggguaacagauuuuaaagguaagaccgugugguucguuccuucuauuaaagcagggaacgacaucgccgcuugccuacgaaagaauggaaagaaagucauucaacugagcagaaagacuuuugauagugaguaugugaaaacacggaccaacgacugggauuucguggucacgacugacaucuccgaaaugggcgcgaauuuuaaggccgagaggguaauagauccacgccguuguaugaaacccgugauccucacagacggcgaggaaagaguuauuuuagcagggccuaugccggugacccacagcucugcugcccagcggaggggacgcaucggucgaaacccaaagaaugagaacgaccaguacauuuacaugggcgaaccccuggagaaugaugaagacugcgcacacuggaaagaggccaagaugcuucuggauaacaucaauaccccugaggggauaauucccucaauguucgaaccagagagagaaaaggucgacgcuaucgauggagaguaucggcucaggggcgaagcccgcaaaacuuuuguggacuugaugagaaggggugaucugccuguuuggcucgcguacaagguggcagccgaggggauuaacuaugcugaccggcguugguguuucgauggcaucaaaaacaaucagauacuggaggaaaacgucgagguggaaaucuggacaaaggagggagagcgcaagaaacuuaaaccccgauggcuagacgccagaauuuacuccgauccacuggcuuugaaagaauuuaaggaguucgcagccggcaggaaaaguuuagcucugaaucucaucaccgaaauggggcggcugccuacauucaugacucaaaagacgcgcgacgcccuugauaaccuggcaguacuccauaccgcggaggccggagguagagcuuauaaucacgccuugagcgaacugccggagacacuagagacucugcuccuucugaccuuauuggcaacagugaccggcgggauuuuucuguuccucaugucgggaaggggcaucgguaaaaugacucuggggaugugcugcauaauuacggcuucuauccuucugugguacgcccagauccagccccauuggauugcagccuccaucauacucguauuuuucuugauuguccuguuaaucccagaaccugagaagcagcggacaccccaagacaaccagcuaacauauguggugauugcuauccugacugucguugcggccaccauggcaaaugaaaugggcuuucucgagaagaccaagaaggaccuuggauucggcagcauagcuacccagcagccagaaucaaacauccuggauauugacuugcgaccugccagugccuggacucuguacgcaguggcuacaacguuuguaacccccaugcucagacacucuaucgaaaauuccagcgugaacgucucacugacugccauugcgaaucaagcuacagugcuuauggggcucggaaaagguuggccgcugaguaagauggauaucggcguuccauugcuggccauuggguguuacagccaggugaacccuaucaccuuaaccgcagcccuacugcuccuugucgcucacuaugcaauaauuggacccggccugcaggccaaagcgacacgcgaggcucagaagagggccgcagccgguaucaugaagaauccaacuguagacgggaucacggugauugauuuggaccccauaccuuacgauccgaaauucgaaaagcaacugggccagguuaugcuccuggugcuuugcgucacccagguguuaaugaugcggacaacuugggcucugugugaggcccucaccuuggcaacaggacccaucuccacccugugggaaggcaacccagggcguuuuuggaauacuacgauugcugucucuauggccaacaucuucagaggaagcuaucuagcgggcgccggucugcucuuuuccauuaugaaaaauacaaccaacacuaggcgcgggaccggaaacaucggcgagacacuuggugaaaaguggaaaucacggcugaaugcauugggcaagucugaguuccaaauauacaaaaagagugggauccaggagguggaccgaacucuggcuaaggaaggaauuaaaagaggcgagaccgaucaucacgccguuucgagggggagcgcaaagcuccgcugguuuguggaacggaacaugguaacaccugagggaaaaguggucgaccugggcugcgguagagggggaugguccuauuacuguggcgguuuaaagaauguucgugaggugaaaggccuuacgaaagggggacccggccaugaggagccuaucccaaugucuaccuauggguggaaccuggucaggcuccagucaggaguggauguauucuucacucccccugaaaagugcgacacacuacugugugauauuggcgagagcuccccaaaucccaccguggaagcuggucggacuuugcgcguucugaaccucguggagaauuggcuuaacaauaacacacaguuuugcaucaaaguccugaauccguacaugccuagugugauagagaagauggaagccuugcaacgaaaauacgggggagcccuggucagaaacccacucucuaggaauagcacccacgagauguauugggugucaaacgcguccggcaauauuguuaguagcguaaacaugaucucucggauguuaaucaaccgcuucacgaugaagcauaaaaaggcuaccuacgaacccgacguggaccugggcuccgggacaagaaauauuggaauagagucagaagucccuaaccuugauaucauugguaagaggaucgagaaaauuaagcaggagcacgaaacuagcuggcacuaugaccaggaucauccauacaaaaccugggcauaucacggcucguacgagacaaagcagacugggucugccaguuccauggugaauggaguugugcgacugcuaaccaaacccugggacguccucccgacagugacccaaauggcuaugacugauacgacaccuuuuggccagcagcggguauucaaggaaaagguggacacccguacucaggagcccaaagaagguaccaagaaacugaugaagaucacagccgagugguuguggaaagagcuggggaagaaaaagacgccaagaauguguacccgcgaagaguuuacuaggaagguucggagcaacgcagcccucggagcuauauucacagaugaaaauaaauggaagucagcgagagaggccgucgaggacucccgcuuuugggaacuuguggauaaagagaggaaccugcauuuagaaggcaagugcgagaccuguguguauaauaugaugggcaaacgagaaaagaagcugggggaguucggaaaagcaaaggguucucgggcuaucugguacaugugguugggcgccagauuucucgaguucgaagcacugggguuucuaaacgaggaccacugguucagcagggaaaauagucuuuccggagucgagggcgaaggucugcacaaacucggguacauucugcgcgauguuagcaagaaagagggaggcgccauguaugcugacgacacugccggcugggauacacguaucaccuuggaggaccugaagaacgaagagauggugacaaaucauauggaaggggagcacaagaaacucgcggaagcaauuuuuaaacuuacuuaccaaaacaaaguagugcggguccagagaccuacccccaggggaacggugauggauaucauuucucgccgagaccagcgggguucaggccaaguugggaccuauggacugaauacauucacuaacauggaggcccaguuaauaagacagauggagggcgaagguguguucaagaauauccagcaucugaccgcuacagaggaaauugccguccaaaacugcuuggcaaggcucgggcgcgagagacugagucggauggcuaucuccggagaugacugcgugguaaaaccacuagaugacagguuugccagcgcucuuacugcccugaacgauaugggcaagauccguaaggacauucagcagugggagcccucucgaggcuggaaugauuggacccagguuccuuucuguucgcaccauuuucacgaacucauaaugaaagacgggcgcgugcuggucgugccaugcagaaaccaagaugaguugaucggacgggcaaggauuucacagggugcgggcuggagcuuacgcgaaacggccugucuggggaaguccuacgcucagauguggagucucauguauuuccacagacgggaccuuaggcuggccgcaaaugcuaucugcucugccgugccgagccauuggguccccacaucccgaaccacuuggucaauucacgcaaaacaugaguggaugacaaccgaagacaugcuaacuguuuggaaccguguguggauccaggagaauccuuggauggaggauaagaccccaguagaaaguugggaggaaauacccuaccugggaaaaagagaggaccaaugguguggcucucucaucgguuugacaagccgcgccacgugggcgaagaacauucaggcugccaucaaucaggugcggucccugauugggaacgaagaguauaccgauuacaugccuucaaugaagagguuuagacgcgaggaagaggaagcaggaguccuuugguga

SEQ ID NO: 15073 - RNA, 9876 nt, Artificial Sequence
  derived and/or modified CDS sequence (opt3) from DENV-2__AF169681__SS-prME
agcgcaggaaugaucauuaugcugauacccaccgugauggcuuuccaccucacaacuagaaacggggagccucauaugaucgucuccauucaggaaaagggaaaaucucuucuguuuaagacggaggacgguguuaauaugugcaccuugauggcaauggauuuaggcgaacugugugaggacacaaucacuuacaaaugcccacuacucaggcaaaacgaaccggaggauauugacuguuggugcaauucaaccaguacaugggugaccuaugggacuuguacaaccacgggagagcaccggcgcgaaaagcgaagcguagcccuggugccccaugucggcaugggucuugagacucguaccgaaacauggauguccucugagggggcguggaaacacgcucagagaaucgagacuuggauacugaggcauccuggauucaccaucauggccgcaauuuuggccuacacaaucggcaccacgcacuuucagcgggcucucauuuucauccugcugacugcaguggccccaucgaugacaaugcgcugcauaggcauuucaaacagagauuuuguugaaggggugagcggagguaguugggucgacaucgugcucgagcacggcuccuguguaaccacuauggcuaagaauaagcccacauuagauuucgaacugauuaaaaccgaggccaagcagccugcgacgcuuaggaaauauugcaucgaagcaaaguugaccaacacaacuaccgagucucgguguccaacacaaggggagcccagccugaaagaagaacaagacaagcgcuuuguuugcaagcauuccaugguggaucgaggauggggcaaugguugugggcuauucggaaaaggcggcaucgucacuugcgccauguuuaccugcaagaaaaacauggaagggaagauugugcagccugagaaucucgaauacacaauaguggucaccccacacucaggagaggagcaugcuguugguaacgacacuggcaaacacgggaaggaaaucaaagugacgccgcagaguagcauuacagaggccgaacugaccggauauggcacuguaaccauggaguguucucccagaacaggucuugauuucaaugaaauggugcuguugcaaauggagaacaaggcauggcucguccacaggcagugguuucuggacuuaccucugccauggcuccccggggcugauacccagggcuccaauuggauccagaaggagacucuugugacauucaaaaacccucaugccaagaaacaagacguugugguccugggaucacaggaaggcgcgaugcacacggccuugaccggggcaacugagauacagaugagcaguggaaaucuacuguuuacaggucaucucaagugccggcugcguauggacaaacuucaacugaagggcaugucuuacuccauguguaccgggaaguucaaagugguaaaggaaauugcugagacacagcacggaacuaucguuauccgcgugcaguaugagggcgaugguagcccaugcaggauuccauucgaaaucauggacuuggagaaaagauacguccucgggcggcugauuaccgugaacccgauagucacggaaaaggauucgccugugaacaucgaggccgaacccccauuuggcgacucuuacauuaucaucggaguugagccuggccaguuaaaacugaauugguucaagaagggguccucaauuggacaaauguuugagaccacaaugcgaggugcuaaacgcauggccauacuaggcgauacugcaugggacuucgggagucucggaggcguguuuaccagcaucgguaaggcccugcaucagguauucggggcuauuuauggcgcggcauuuuccggagucucuuggacaaugaaaauccuuauuggcgugaucauaacuuggaucgggaugaacagcagaucaaccaguuuguccguuagccuggugcucgucggaauugugacgcuguaccuuggcguaauggugcaggccgauucugguuguguugucucauggaagaauaaagaacugaagugcgggaguggaaucuucauuacagacaacgugcacaccuggacugagcaguauaaguuucaacccgaaagcccauccaaauuggcuucugccauccagaaggcacaggaggaaggcauaugugguauuaggucggugacacggcucgagaaucugauguggaaacagaucacccccgaguuaaaccacauucuggccgaaaaugaggucaagcuaacuaucaugaccggcgauauaaaagggaucaugcaagcuggaaagcgcagccucagaccucagccaacagaacugaaauacuccuggaagacguggggcaaggccaaaaugcuuucaaccgagagucauaaccagacuuucuugauugacgggccgaagacagcagaaugccccaauaccaacagggcguggaacucucuggagguugaggauuauggauuuggcguguucacaacuaacaucuggcucaaacugaaggaaaaacaggacgcuuuaugugacagcaagcugauguccgccgcaauuaaggauaaucgugccgugcacgcugacauggguuacuggaucgagucagcccuuaacgauaccuggaaaauagaaaaggccagcuuuauugaggucaagaauugccauuggccuaagucucacacguugugguccaacgggguccucgagagugaaaugaucauccccaagaaucuggcuggacccgugagccaacacaauuaucggccuggcuaccauacacagauugccgguccauggcaccuaggcaagcuggagauggacuucgauuucugugacgggaccacuguuguggucaccgaagauugcggaaaccgaggccccucucucagaacaacuaccgcguccgggaagcugaucacagaguggugcuguaggucaugcacgcuuccgccuuugcgcuaccggggagaagacggcuguugguaugguauggagauuagaccacugaaagagaaggaagagaauuuagugaacagucucguuaccgccgggcauggacagguggauaauuuuagccugggcguacuugguauggcucuguucuuggaagagaugcucaggacucgcgucggcacaaaacacgcaauacugcuaguggccgugucguuugucacccugaucacugggaacauguccuucaaggaccucggacgaguugugguaauggugggcgcuacaaugaccgaugacauugggaugggagucacguaccuggcccuuuuggcagcguuuaaagugcggcccacuuucgccgcuggccuguuacuccguaagcugaccucuaaggaacuuaugaugacaaccaucgguauuguucugcuaagccaaucaacuaucccugagacaauacucgagcugaccgaugccuuggcacuggggaugaugguguuaaaaaucgucagaaauauggaaaaguaucagcucgcugugacaauuauggccauccugugcguucccaacgcagugauucuucagaaugccuggaaagucaguuguacuauccuggcuguaguguccguuucuccauugauacucaccagcucccagcaaaagacggacuggauuccucuggcgcuaacaaucaaaggacugaaccccaccgccaucuuucuuacuacccucucaaggacaaauaagaaacgcagcuggccacugaacgaggcaauuauggcugugggcauggucaguauauuggccucuucccuguuaaagaaugacaucccgaugacuggcccucucguggccgggggacugcuuaccguaugcuacgugcugacgggucggagcgcugauuuggaacucgagagagcaacagacgucaagugggaaaaccaggccgagauuucgggcucaucucccauccugaguauuaccaucuccgaggaugggagcaugucuaucaaaaaugaagaggaagaacagacucuaacaauccugauuaggaccggacuucucguuaucagcggccuguucccaguguccauucccaucacugcggcugccugguauuugugggaggugaagaaacagcgagccgguguauuaugggacgugccuucaccacccccuauggggaaggcagaacuggaggauggagcuuaccgcauaaaacaaaagggcauucucggcuauagucagaucggggcaggaguuuacaaggaagguacauuucauaccauguggcacguaacgcggggcgccgugcugaugcacaaagggaagagaaucgagccgagcugggcggacgucaaaaaggaucuuauuucuuacggaggcgguuggaaacuggaaggggaguggaaggagggagaagaggugcagguuuuggcucuagaaccaggcaagaaccccagggccgugcagacuaaaccuggccuguucaagaccaacacagggaccaucggagcagucucccucgacuuuucaccagguacaaguggcagccccauaauugauaaaaaggggaaagugguaggacuguauggcaauggugucgugacucguuccggggccuacguuucugcuaucgcccaaaccgagaagucgauugaagacaacccugagaucgaggaugacauauuccgcaagcggagacuuacgauuauggauuuacauccgggagcaggcaaaacaaagagguaucugcccgcuaucgugcgagaagccaucaaacggggccuccgcacuuugauucuggcgccaaccagagucguggccgcagagauggaagaggcucucagggggcugccuauccgguaccagacacccgccauucgagcugaacacaccggaagagagauaguugaccuuaugugucaugcaacuuuuaccaugcgccuguugagcccagugagggucccuaauuauaaccuaaucauuauggacgaggcccacuucacagaucccgccucaaucgcugcgcgugguuacaucuccacgcggguggaaaugggcgaggcagccgggauuuucaugacugcuaccccaccgggaaguagagacccuuuuccccagucuaaugccccaauaaucgaugaagagagggagauucccgaacgcagcuggaacuccggccaugaguggguaacagacuucaaggguaaaaccgugugguuuguuccuucaaucaaggcagggaaugauauugccgcuugccugcgaaagaacggcaaaaaggucauccaacucucuagaaaaacuuucgacagcgaauaugugaagacacggaccaaugauugggacuuuguggucacgacugauauaagugagaugggcgcgaacuucaaagccgaaaggguaaucgacccacgccguuguaugaagcccgugauuuuaacagauggcgaggagagaguuauccuggcagggccuaugccggugacccacuccagcgcugcccagcggaggggacgcauuggucgaaaucccaaaaacgaaaaugaccaguacaucuacaugggcgagccccuugaaaacgacgaggauugcgcacacuggaaggaagccaagaugcugcucgacaauauaaacaccccugaggggauuauccccucuauguuugagccagaaagagagaaagucgaugcuauugacggagaauaucgguugaggggcgaggcccgcaagacuuucguggaucugaugagaaggggugaccucccuguuuggcuggcguacaaaguggcagccgaagggaucaacuaugcugaucggcguugguguuuugacggcauaaagaauaaccagauccuugaggagaaugucgaaguggagauuuggacaaaagaaggagagcgcaagaagcuaaaaccccgauggcuggaugccagaaucuacucagacccauuggcuuuaaaggaguucaaagaauuugcagccggcaggaagucccuggcucucaaccugauuaccgagauggggcggcuuccuacauucaugacucagaaaacgcgcgaugcccuggacaaucucgcaguauugcauaccgcggaagccggagguagagcuuauaaccacgcccugagugagcuaccggaaacacuggagacucuccuucuguuaaccuugcuggcaacagugaccggcgggaucuuccucuuucugaugagcggaaggggcauagguaagaugacucuugggaugugcugcauuaucacggcuucgauccugcucugguacgcccagauucagccccauuggaucgcagccucuauaauuuugguuuucuuucugaucgucuuacuaauuccagagccugaaaagcagcggaccccacaagauaaucagcugacauauguggugaucgcuauacucacugucguugcggccaccauggcaaacgagaugggcuuccuugagaaaacaaagaaagaccugggauuuggcuccaucgcuacccagcagccagagagcaauauuuuggacaucgaucugcgaccugccucagccuggacucucuacgcaguggcuacaacguucguaacccccaugcugagacacaguauugaaaacucuuccgugaaugucagccuuacugccaucgcgaaccaagcuacagugcucauggggcugggaaaggguuggccguugucaaaaauggacauuggcguuccacuguuagccaucggguguuacagucaggugaauccuauaacccuaaccgcagcccugcuccuucuggucgcucacuaugcaauuaucggacccggcuugcaggccaaggcgacacgcgaggcucagaagagggccgcagccgguaucaugaaaaacccaacuguagaugggauuacggugauagaccuggaucccaucccuuacgacccgaaguuugagaaacaacucggccagguuaugcugcuuguguuaugcgucacccaggugcugaugaugcggacaacuugggcucucugugaagccuugacccuggcaacaggacccauuagcacccuaugggagggcaauccagggcguuucuggaacacuacgaucgcugucuccauggccaauauuuuuagaggaucuuaucuggcgggcgccggucuccuuuucagcaucaugaagaacacaaccaacacuaggcgcgggaccggaaauauaggcgaaacacugggugagaaauggaagucccgguugaacgcacugggcaaaucagaauuucaaaucuacaagaagucugggauucaggagguggaucgaacucucgcuaaagagggaaucaagagaggcgaaaccgaccaucacgccguuaguagggggucggcaaaacugcgcugguucguggagcggaauaugguaacaccugaaggaaagguggucgauuuaggcugcgguagagggggauggagcuauuacuguggcggucuuaaaaacguucgugaggugaagggccugacgaaagggggacccggccaugaggaaccuauuccaauguccaccuauggguggaaucucgucaggcuacagucuggaguggacguauuuuucauacccccugagaaaugcgauacucuguugugugacauaggcgaaucaagcccaaaccccacaguggaggcuggucggacccugcgcguucucaaucuuguggaaaacuggcugaauaacaauacucaguucugcauuaaggucuugaacccguacaugccuuccgugaucgagaaaauggaggcccugcaacgaaaguacgggggagcccucgucagaaauccauuaaguaggaacucuacacacgaaauguauugggugagcaaugcgucaggcaacaucguuuccaguguaaacaugauuagccggaugcugauaaaucgcuuuaccaugagacauaaaaaggcuacguacgagcccgauguggaccuuggcucugggaccaggaacaucggaauugaauccgagaucccuaaucuggacauuaucgguaagcgaauagagaaaaucaagcaggaacacgagacaucauggcacuaugaucaggaccauccauacaaaacuugggcauaucacggcagcuacgaaaccaagcagacagggucggccucuaguauggucaacggagugguucggcuacucacuaaacccugggaugugcugccgaccgucacacaaauggcuaugaccgacacuacgccuuucggccagcagcguguguuuaaggagaagguagauacaagaacccaggaacccaaagaggguacuaagaaauugaugaagauuaccgccgaauggcuguggaaagagcucgggaagaaaaagacaccacgcauguguacgagggaggaguucacccggaaggugagauccaaugcagcccuuggagcuaucuuuacugacgagaacaaauggaaaagcgcgcgcgaagccguugaggauucaagguucugggagcuggucgacaaagaacgaaauuuacaucuggagggcaagugcgaaacauguguguauaacaugaugggcaaacgggagaagaaguugggggaauuuggaaaagcaaaggguuccagagcuauuugguacauguggcucggcgccagguuccuggaguuugaggcacuaggguuccuuaaugaagaucacugguuuucucgcgagaacagccugaguggaguggaaggcgagggucuccacaaacugcguuacaucuugcgggacgucuccaagaaagaagggggagccauguaugcugaugacaccgccggcugggacacuagaauuacacuggaggaucucaagaaugaggaaaugguuaccaaccauauggagggcgaacacaagaaacuugcggaggcaauauucaagcugacauaccaaaauaaagugguaagggugcagcgcccuacuccccgagggaccgucauggacaucauuagccggagagaucagaggggaucuggucaagugggcacguauggguuaaacaccuuuacaaauauggaagcccagcugauccgccagauggagggagagggcguuuucaagaacauccagcauuugacugcuaccgaagagauugccgugcaaaacuggcucgcaagagucggucgggaaaggcugucacguauggcuauaaguggggacgauugcgugguaaaaccacuagacgaucgauucgccuccgcucuuacagcccugaaugacaugggaaagauccgcaaggauauucagcagugggagcccagcagaggcuggaacgacuggacucagguuccuuuuugcucucaccauuuccacgagcucaucaugaaagauggccgggugcuggucgugccauguaggaaucaagacgaauugauugggcgcgcaagaaucucgcagggagcggguuggucauuacgggagaccgccugccugggcaagagcuacgcucagauguggucccucauguauuuucacaggcgagaucuucgucuggccgcaaacgcuauauguagugccgugccgucucauuggguccccacgagcagaacaaccugguccauccacgcaaaacaugaauggaugacuacagaggacaugcuaaccguuuggaaucgcguguggauucaggaaaacccuuggauggaggacaagacuccaguagagucaugggaagagauccccuaccuggggaaacgggaagaucaauggugcggaagucucauuggcuugaccucuagggccacaugggcgaagaauauccaggcugccauaaaccaggugagaagccugauugguaaugaggaauauacggacuacaugccuuccaugaagcgcuuccggagggaggaggaagaggcagggguccuuugguga

SEQ ID NO: 15074 - RNA, 9876 nt, Artificial Sequence
  derived and/or modified CDS sequence (opt3) from DENV-2__AF169683__SS-prME
agcgcaggcaugauaauuaugcugauacccaccgugauggcuuuccaccucacaacuagaaauggggagccucauaugaucgucuccauucaggaaaagggaaaaucucuucuguuuaagacggaggacgguguuaauaugugcaccuugauggcaauggauuuaggcgaacugugugaggacacaaucacuuacaaaugcccacugcucaggcaaaacgaaccggaggauauugacuguuggugcaauucaaccaguacaugggugaccuaugggacuuguacaaccacgggagagcaccggcgcgaaaagcgaagcguagcacuggugccccaugucggcaugggucuugagacucguaccgaaacauggauguccucugagggggcguggaaacacgcucagagaaucgagacuuggauacugaggcauccuggauucaccaucauggccgcaauuuuggccuacacaaucggcaccacgcacuuucagcgggcucucauuuucauccugcugacugcaguggccccaucgaugacaaugcgcugcauaggcauuucaaacagagauuuuguugaaggggugagcggagguaguugggucgacaucgugcucgagcacggcuccuguguaaccacuauggcuaagaauaagcccacauuagauuucgaacugauuaaaaccgaggccaagcagccugcgacgcuuaggaaauauugcaucgaagcaaaguugaccaacacaacuaccgagucucgguguccaacacaaggggagcccagccugaaagaagaacaggacaagcgcuuuguuugcaagcauuccaugguggaucgaggauggggcaaugguugugggcuauucggaaaaggcggcaucgucacuugcgccauguuuaccugcaagaaaaacauggaagggaagauugugcagccugagaaucucgaauacacaauaguggucaccccacacucaggagaggagcaugcuguugguaacgacacuggcaaacacgggaaggaaaucaaagugacgccgcagaguagcauuacagaggccgaacugaccggauauggcacuguaaccauggaguguucucccagaacaggucuugauuucaaugaaauggugcuguugcaaauggagaacaaggcauggcucguccacaggcagugguuucuggacuuaccucugccauggcuccccggggcugauacccagggcuccaauuggauccagaaggagacucuugugacauucaaaaacccucaugccaagaaacaagacguugugguccugggaucacaggaaggcgcgaugcacacggccuugaccggggcaacugagauacagaugagcaguggaaaucuacuguuuacaggucaucucaagugccggcugcguauggacaaacuucaacugaagggcaugucuuacuccauguguaccgggaaguucaaagugguaaaggaaauugcugagacacagcacggaacuaucguuauccgcgugcaguaugagggcgaugguagcccaugcaggauucccuucgaaaucauggacuuggagaaaagguacguccucgggcggcugauuaccgugaacccgauagucacggaaaaggauucgccugugaacaucgaggccgaacccccauuuggcgacucuuacauuaucaucggaguugagccuggccaguuaaaacugaauugguucaagaagggguccucaauuggacaaauguuugagaccacaaugcgaggugcuaaacgcauggccauacuaggcgauacugcaugggacuucgggagucucggaggcguguuuaccagcaucgguaaggcccugcaucagguauucggggcuauuuauggcgcggcauuuuccggagucucuuggacaaugaaaauccuuauuggcgugaucauaacuuggaucgggaugaacagcagaucaaccaguuuguccguuagccuggugcucgucggaauugugacgcuguaccuuggcguaauggugcaggccgauucugguuguguugucucauggaagaauaaagaacugaagugcgggaguggaaucuucauuacagacaacgugcacaccuggacugagcaguauaaguuucaacccgaaagcccauccaaauuggcuucugccauccagaaggcacaggaggaaggcauaugugguauuaggucggugacacggcucgagaaucugauguggaaacagaucacccccgaguuaaaccacauucuggccgaaaaugaggucaagcuaacuaucaugaccggcgauauaaaagggaucaugcaugcuggaaagcgcagccucagaccucaaccaacagaacugaaauacuccuggaagacguggggcaaggccaaaaugcuuucaaccgagagucacaaccagacuuucuugauugacgggccggaaacagcagagugccccaauaccaacagggcguggaacucucuggagguugaagauuauggauuuggcguguucacaacuaacaucuggcucaagcugaaagagaagcaggacgcuuuuugugacagcaaauuaauguccgccgcaauuaaggauaaucgugccgugcaugcugacauggguuacuggaucgaaucagcccugaacgauaccuggaagauagagaaagccagcuucauugagguaaagaauugccacuggccuaaaucucacacgcuuugguccaacggggucuuggaaagugagaugaucaucccaaagaaccucgcuggacccgugagccagcauaauuaucggccuggcuaccacacacaaauugccgguccauggcaucugggcaaacuagaaauggacuucgauuuuugugacgggaccacuguuguggucaccgaggauugcggaaaccgaggccccucucugagaacaacuaccgcguccgggaagcucaucacagaauggugcuguaggucaugcacgcugccgccucuucgcuaccggggagaggacggcuguugguaugguauggagauuagaccauugaaggaaaaagaggaaaaucuggugaacaguuuaguuaccgccgggcacggacagguggauaauuucagccucggcguacuggguauggcucuuuuucuggaggaaauguugaggacucgcgucggcacaaagcaugcaauacuccugguggccgugucguucgucacccuaaucacugggaacauguccuuuaaagaccugggacgaguugugguaauggugggcgcuacaaugaccgaugacauugggaugggagucacguaccucgcccugcuugcagcguucaaggugcggcccacuuuugccgcuggcuugcuguuacguaaacucaccucuaaggagcugaugaugacaaccaucgguauuguucuucugagccagucaacuaucccugagacaauacuagaacucaccgaugcccuggcauuggggaugauggugcugaagaucgucagaaauauggagaaauaucaauuagcugugacaauuauggccauccucugcguucccaacgcagugauucugcagaaugccuggaaggucaguuguacuauccuugcuguaguguccguuucuccacugauauugaccagcucccagcagaaaacggacuggauuccucucgcgcugacaaucaagggacuaaaccccaccgccaucuuccugacuacccuuucaaggacaaauaaaaagcgcagcuggccacucaacgaagcaauuauggcugugggcauggucaguauacuggccucuuccuugcugaaaaaugacaucccgaugacuggcccuuuaguggccgggggacuccugaccguaugcuacgugcuuacgggucggagcgcugaucuggaguuggaaagagcaacagacgucaagugggaggaucaagccgagauuucgggcucaucucccauccucaguauuaccaucuccgaagacgggagcaugucuauaaagaacgaggaagaggagcagacucugacaauccuaauuaggaccggacugcuuguuaucagcggccucuuuccaguguccauucccaucacugcggcugccugguaucugugggaagugaaaaagcagcgagccggugucuugugggaugugccuucaccacccccuauggggaaagccgaguuagaagacggagcuuaccgcauaaagcagaaaggcauucugggcuauagucaaaucggggcaggaguuuacaaggaggguacauuccacaccauguggcacguaacgcggggcgccgugcucaugcauaaggggaaaagaaucgaaccgagcugggcggaugucaagaaagaccugauuucuuacggaggcgguuggaaacuugagggggaguggaaagaaggagaggaagugcagguucuggcuuuggagccaggcaagaaucccagggccgugcagacuaagccuggccuauuuaaaaccaacacagggaccaucggagcagucucccuggauuucucaccagguacaaguggcagccccauaauugacaagaaagggaaggugguaggacucuauggcaacggugucgugacucguuccggggccuacguuucugcuaucgcccagaccgaaaaaucgauugaggauaauccugagaucgaagacgauauauuucgcaagcggagacugacgauuauggaccuucacccgggagcaggcaagacaaaaagguauuuacccgcuaucgugcgagaggccaucaagcggggccugcgcacucucauuuuggcgccaaccagagucguggccgcagaaauggaggaagcucugagggggcucccuauccgguaccaaacacccgccauucgagcugagcauaccggaagagagauaguugaccugaugugucacgcaacuuucaccaugcgccuucugagcccagugagggucccuaacuauaauuugaucauuauggaugaagcccauuucacagaccccgccucaaucgcugcgcgugguuacaucuccacgcggguggagaugggcgaagcagccgggauuuuuaugacugcuaccccaccgggaaguagagauccuuucccccagucuaacgccccaauaaucgacgaggagagggaaauucccgagcgcagcuggaacuccggccacgaauggguaacagauuuuaaagguaagaccgugugguucguuccuucaaucaaagcagggaacgacauugccgcuugccuacgaaagaauggaaagaaagucauccagcugucuagaaagacuuuugauagcgaguaugugaaaacacggaccaacgacugggauuucguggucacgacugacauaagugaaaugggcgcgaauuuuaaggccgagaggguaaucgauccacgccguuguaugaaacccgugauucucacagacggcgaggaaagaguuaucuuagcagggccuaugccggugacccacuucuccgcugcccaacggaggggacgcauuggucgaaacccaaagaaugagaacgaccaguacaucuacaugggcgaaccccuggagaaugaugaagacugcgcacauuggaaagaggccaagaugcuucuggauaacauaaauaccccugaggggauuauccccagcauguuugaaccagagagagaaaaggucgacgcuauugauggagaguaucggcucaggggcgaagcccgcaaaacuuucguggacuugaugagaaggggugaucugccuguuuggcucgcguacaagguggcagccgaggggaucaacuaugcugaccggcguugguguuuugauggcaucaagaauaaucagauccuggaggaaaacgucgagguggaaauuuggacaaaggagggagagcgcaagaaacuuaaaccccgauggcuagacgccagaaucuacucugauccacuggcuuugaaagaguucaaggaguucgcagccggcaggaaaucauuagcucugaaucucauuaccgaaauggggcggcugccuacauuuaugacucagaagacgcgcgacgcccuugauaaccuggcaguacuccacaccgcggaggccggagguagagcuuauaaucaugccuuguccgaacugccggagacacuagagacucugcuccuucugaccuuauuggcaacagugaccggcgggaucuuccuguuucucaugaguggaaggggcauagguaaaaugacucuggggaugugcugcauuaucacggcuagcauccuucugugguacgcccaaauucagccccacuggaucgcagccucgauaauucucguuuucuuuuugaucguccuguuaauuccagaaccugagaagcagcggacaccccaggacaaccaacuaacauauguggugaucgcuauacugacugucguugcggccaccauggcaaaugaaaugggcuuccucgagaagaccaagaaggaccuuggauuuggcucuaucgcuacccagcagccagaauccaacauucuggauaucgacuugcgaccugccagcgccuggacucuguacgcaguggcuacaacguucguaacccccaugcucagacacucaauugagaauaguucugugaacgucucccugacugccaucgcgaaucaggcuacagugcuuauggggcucggaaaagguuggccgcugagcaagauggauauuggcguuccauugcuggccaucggguguuacucacaagugaacccuauaaccuuaaccgcagcccuacugcuccuugucgcucauuaugcaauuaucggacccggccugcaggccaaagcgacacgcgaggcucagaagagggccgcagccgguaucaugaagaauccaacuguagacgggauuacggugauagauuuggaccccaucccuuacgauccgaaauuugaaaagcagcugggccaaguuaugcuccuggugcuuugcgucacccagguguuaaugaugcggacaacuugggcucugugugaggcccucaccuuggcaacaggacccauuaguacccugugggaaggcaacccagggcguuucuggaauacuacgaucgcugucagcauggccaacauuuuuagaggauccuaucuagcgggcgccggucuacucuucucuaucaugaaaaauacaaccaacacuaggcgcgggaccggaaacauaggcgagacacuuggugaaaaguggaaaagccggcugaaugcauugggcaaguccgagucacagaucuacaaaaagucugggauucaagagguggaccgaacucuggcuaaggaaggaaucaaaagaggcgagaccgaucaccaugccguuaguagggggucggcaaagcuccgcugguuuguggaacggaacaugguaacaccugagggaaaaguggucgaccugggcugcgguagagggggauggagcuauuacuguggcgguauuaagaauguucgugaggugaaaggcuuaacgaaagggggacccggccacgaagaaccuaucccaauguccaccuauggguggaaccuugucaggcugcagucuggaguggauguauucuucauacccccugaaaagugcgacacucuccuaugugauauuggcgagucaagcccaaaucccacaguggaagcuggucggacccugcgcguuuugaaccugguggagaauuggcucaacaauaacacucaguuuugcaucaaaguccuuaauccguacaugccuuccgugaucgagaagauggaagcccugcagcgaaaauacgggggagccuuggucagaaacccacugaguagaaauucuacacaugagauguauugggugagcaacgcgucaggcaauauuguuuccaguguaaacaugauaagccggaugcucaucaaccgcuucaccaugagacacaagaaagcuacguacgaacccgacguggacuuaggcucugggaccaggaauauuggaaucgaguccgaaauuccuaaccuggauaucauagguaagcgaaucgagaagauuaaacaagagcacgaaacaucauggcauuaugaccaggaucacccauacaagacuugggcauaucauggcagcuacgagaccaaacagacagggucggccucuaguauggucaauggagugguucggcuucugacuaagcccugggacgugcuaccgaccgucacacagauggcuaugaccgauacuacgccuuuuggccaacagcguguguucaaagaaaagguagacacaagaacccaggagcccaaggaagguacuaaaaagcucaugaaaaucaccgccgaguggcuguggaaggaguuggggaaaaagaaaacaccacgcauguguacgagggaagaguuuacccggaaggugagauccaacgcagcccugggagcuauuuucacugaugaaaauaaguggaaaagcgcgcgcgaggccguugaggacucaagguuuugggaacucgucgauaaggagcgaaaccuucaccuggaaggcaaaugcgagacauguguguauaauaugaugggcaagcgggagaagaaguuaggggaguucggaaaggcaaaagguuccagagcuaucugguacauguggcugggcgccagguuuuuggaguucgaagcacucggguuucugaacgaggaccacugguucucucgcgaaaauagccuaaguggacuugagggcgaaggucugcauaagcucggguacauucugcgugauguguccaaaaaggagggaggcgccauguaugcugacgacaccgccggcugggauacucggauaacauuggaggaccugaaaaacgaagagauggucaccaaucacauggaaggggagcauaagaagcucgcggaagcaaucuuuaaacuuacauaccagaacaagguugugagaguacaaaggccuacuccccgcggaaccgugauggauauuaucagccgacgggaccagagagguucuggccaggucgggacguauggacugaauaccuucacaaacauggaggcccaauuaaucaggcagauggagggcgaagguguguucaaaaauauucagcaccugacugcuaccgaggaaauagccguucagaacugguuggcacgcguggggagagagcggcucucaaggauggcuaucaguggagaugacugcgucgugaagccacuggaugaccguuuugccuccgcucuaacagcccuuaacgauaugggcaaaauucgaaaggacauccaacagugggagcccagccgcggcuggaaugauuggacucagguaccuuucugcucucaucacuuucacgaacugauuaugaaggacgggagaguucucguggucccaugucggaaccaggaugagcugaucggaagggcacgcauaucgcaaggugcgggcuggucauugagagaaaccgccugcuuagggaaaagcuacgcucagauguggucccugauguauuuccaucggagggaccuccgacuugccgcaaaugcuaucuguagugccgugccgucucacugggugcccacgagccguacaaccugguccauucaugcaaagcacgaguggaugacuacagaagacaugcugaccgucuggaacagaguuuggauccaggagaauccuuggauggaggauaaaacuccaguggaaucaugggaggaaauucccuaccuaggaaagcgcgaggaccaguggugcggcagucugaucggucucaccucucgggccacaugggcgaaaaacauacaagcugccauuaaucagguaaggagcuugaucgggaacgaagaguauacggauuacaugccuuccaugaagagauuucgccgggaggaagaggaagcaggagugcugugguga

SEQ ID NO: 15075 - RNA, 9876 nt, Artificial Sequence
  derived and/or modified CDS sequence (opt3) from DENV-2__AF169684__SS-prME
agcgcaggaaugaucauuaugcugauccccaccgugauggcuuuccaccucacaacuagaaauggggaaccucauaugaucgucuccauucaagaaaagggaaaaucucuucuguuuaagacggaagacgguguuaauaugugcaccuugauggcaauggauuuaggagaacugugugaagacacaaucacuuacaaaugcccauuacucaggcaaaaugaaccggaggauauugacuguuggugcaauucaaccaguacaugggugaccuaugggacuuguacaaccacgggagagcaccggcgcgaaaagcgaagcguagcccuggugccccaugucggcaugggucuugagacucguaccgaaacauggauguccucugagggggcguggaaacacgcucagagaaucgagacuuggauacugaggcauccuggauucaccaucauggccgcaauuuuggccuacacaaucggcaccacgcacuuucagcgggcucucauuuucauccugcugacugcaguggccccaucgaugacaaugcgcugcauaggcauuucaaacagagauuuuguugaaggggugagcggagguaguugggucgacaucgugcucgagcacggcuccuguguaaccacuauggcuaagaauaagcccacauuagauuucgaacugauuaaaaccgaggccaagcagccugcgacgcuuaggaaauauugcaucgaagcaaaguugaccaacacaacuaccgagucucgguguccaacacaaggggagcccagccugaaagaggaacaagacaagcgcuuuguuugcaagcauuccaugguggaucgaggauggggcaaugguugugggcuauucggaaaaggcggcaucgucacuugcgccauguuuaccugcaagaaaaacauggaagggaagauugugcagccugagaaucucgaauacacaauaguggucaccccacacucaggagaggagcaugcuguugguaacgacacuggcaaacacgggaaggaaaucaaagugacgccgcagaguagcauuacagaggccgaacugaccggauauggcacuguaaccauggaguguucucccagaacaggucuugauuucaaugaaauggugcuguugcaaauggagaacaaggcauggcucguccacaggcagugguuucuggacuuaccucugccauggcuccccggggcugauacccagggcuccaauuggauccagaaggagacucuugugacauucaaaaacccucaugccaagaaacaagacguugugguccugggaucacaggaaggcgcgaugcacacggccuugaccggggcaacugagauacagaugagcaguggaaaucuacuguuuacaggucaucucaagugccggcugcguauggacaaacuucaacugaagggcaugucuuacuccauguguaccgggaaguucaaagugguaaaggaaauugcugagacacagcacggaacuaucguuauccgcgugcaguaugagggcgaugguagcccaugcaggauuccauucgaaaucauggacuuggagaaaagauacguccucgggcggcugauuaccgugaacccgauagucacggaaaaggauucgccugugaacaucgaggccgaacccccauuuggcgacucuuacauuaucaucggaguugagccuggccaguuaaaacugaauugguucaagaagggguccucaauuggacaaauguuugagaccacaaugcgaggugcuaaacgcauggccauacuaggcgauacugcaugggacuucgggagucucggaggcguguuuaccagcaucgguaaggcccugcaucagguauucggggcuauuuauggcgcggcauuuuccggagucucuuggacaaugaaaauccuuauuggcgugaucauaacuuggaucgggaugaacagcagaucaaccaguuuguccguuagccuggugcucgucggaauugugacgcuguaccuuggcguaauggugcaggccgauucugguuguguugucucauggaagaauaaagaacugaagugcgggaguggaaucuucauuacagacaacgugcacaccuggacugagcaguauaaguuucaacccgaaagcccauccaaauuggcuucugccauccagaaggcacaggaggaaggcauaugugguauuaggucggugacacggcucgagaaucugauguggaaacagaucacccccgaguuaaaccacauucuggccgaaaaugaggucaagcuaacuaucaugaccggcgauauaaaagggaucaugcaagcuggaaagcgcagccucagaccucagccaacagaacugaaauacuccuggaagacguggggcaaggccaaaaugcuuucaaccgagagucauaaccagacuuucuugauugacgggccggaaacagcagagugccccaauaccaacagggcguggaacucucuggagguugaagauuauggauuuggcguguucacaacuaacaucuggcucaagcugaaagagaagcaggacgcuuuuugugacagcaaauuaauguccgccgcaauuaaggauaaucgugccgugcacgcugacauggguuacuggaucgaaucagcccugaacgauaccuggaagauagagaaagccagcuucauugagguaaagaauugccauuggccuaaaucucacacgcuuugguccaacggggucuuggaaagugagaugaucaucccaaagaaccucgcuggacccgugagccaacacaauuaucggccuggcuaccauacacagauugccgguccauggcaccugggcaaacuagaaauggacuucgauuuuugugacgggaccacuguuguggucaccgaggauugcggaaaccgaggccccucucugagaacaacuaccgcguccgggaagcucaucacagaauggugcuguaggucaugcacgcugccgccucuucgcuaccggggagaggacggcuguugguaugguauggagauuagaccauugaaggaaaaagaggaaaaucuggugaacaguuuaguuaccgccgggcauggacagguggauaauuucagccucggcguacuggguauggcucuuuuucuggaggaaauguugaggacucgcgucggcacaaagcacgcaauacuccugguggccgugucguucgucacccuaaucacugggaacauguccuuuaaagaccugggacgaguugugguaauggugggcgcuacaaugaccgaugacauugggaugggagucacguaccucgcccugcuugcagcguucaaggugcggcccacuuuugccgcuggcuugcuguuacguaaacucaccucuaaggagcugaugaugacaaccaucgguauuguucuucugagccaaucaacuaucccugagacaauacuagaacucaccgaugcccuggcauuggggaugauggugcugaagaucgucagaaauauggagaaauaucaguuagcugugacaauuauggccauccucugcguucccaacgcagugauucugcagaaugccuggaaggucaguuguacuauccuugcuguaguguccguuucuccacugauauugaccagcucccagcagaagacggacuggauuccucucgcgcugacaaucaagggacuaaaccccaccgccaucuuccugacuacccuuucaaggacaaauaaaaagcgcagcuggccacucaacgaagcaauuauggcugugggcauggucaguauacuggccucuuccuugcugaaaaaugacaucccgaugacuggcccuuuaguggccgggggacuccugaccguaugcuacgugcuuacgggucggagcgcugaucuggaguuggaaagagcaacagacgucaagugggaggaucaggccgagauuucgaggucaucucccauccucaguauuaccaucuccgaagacggcagcaugucuauaaagaacgaggaagaggagcagacucugacaauccuaauucgaaccgggcugcuuguuaucagcggacucuuuccaguguccauucccaucacugcggcugccugguaucugugggaagugaaaaagcagcgcgcaggcgucuugugggaugugccuucaccacccccuauggguaaagccgaguuagaagacggggcuuaccggauaaagcaaaaaggcauucugggcuauagucagaucggcgcagggguuuacaaggagggaacauuccauaccauguggcacguaacgagaggugccgugcucaugcacaagggcaaaaggaucgaaccgagcugggcggaugucaagaaagaccugauuucuuacgggggaggcuggaaacuugagggugaguggaaagaaggggaggaagugcagguucuggcuuuggagccaggaaagaauccccgugccgugcagacuaagccuggccuauuuaaaaccaacacaggcaccaucggggcagucucccuggauuucucaccaggaacaagugguagccccauaauugacaagaaaggcaaggugguagggcucuauggaaacggcgucgugacucgcuccggugccuacguuucugcuaucgcccaaaccgaaaaaucgauugaggauaauccugagaucgaagacgauauauuucggaagagaaggcugacgauuauggaccuucauccgggggcaggaaagaccaagaaguauuuacccgcuaucgugcgagaggccaucaaacggggccugcgcacucucauuuuggcgccaaccagagucguggccgcagaaauggaggaagcucugaggggccucccuauccgguaccagacacccgccauucgagcugagcacaccgggagagagauaguugaccugaugugucaugcaacuuucaccaugcgccuucugagcccagugagggucccuaacuauaauuugaucauuauggaugaagcccacuucacagaccccgccucaaucgcugcgcguggauacaucuccacgcggguggagaugggugaagcagccggcauuuuuaugacugcuaccccaccggggaguagagauccuuucccccagucuaacgccccaauaaucgacgaggagagggaaauucccgagcgcagcuggaacuccggacaugaauggguaacagauuuuaagggcaaaaccgugugguucguuccuucaaucaaggcagguaacgacauugccgcuugccuacgaaagaaugggaaaaaggucauccaacugucuagaaaaacuuuugauagcgaguaugugaagacacggaccaacgacugggauuucguggucacgacugacauaagugaaaugggagcgaauuuuaaagccgagaggguaaucgauccacgccguuguaugaagcccgugauucucacagacggcgaggaaagaguuaucuuagcaggcccuaugccggugacccacuucuccgcugcccagcggagggggcgcauuggacgaaaccccaagaaugagaacgaccaguacaucuacaugggugaaccccuggagaaugaugaagacugcgcacacuggaaggaggccaagaugcuucuggauaacauaaauaccccugagggcauuauccccagcauguuugaaccagagagagaaaaagucgacgcuauugauggggaguaucggcucaggggagaagcccgcaagacuuucguggacuugaugagaaggggcgaucugccuguuuggcucgcguacaaaguggcagccgaggguaucaacuaugcugaccggcguugguguuuugaugggauaaagaacaaucagauccuggaggaaaacgucgagguggaaauuuggacaaaagagggcgagcgcaagaaacuuaaaccccgauggcuagacgccagaaucuacucugauccacuggcuuugaaggaguucaaagaguucgcagccggaaggaagucauuagcucugaaucucauuaccgaaaugggccggcugccuacauuuaugacucagaagacgcgcgacgcccuugauaaccuggcaguacuccauaccgcggaggccgggggcagagcuuauaaucacgccuuguccgaacugccggagacacuagagacucugcuccuucugaccuuauuggcaacagugaccgguggcaucuuccuguuucucaugagugggaggggaauaggcaagaugacucuggguaugugcugcauuaucacggcuagcauccuucugugguacgcccagauucagccccauuggaucgcagccucgauaauucucgaguucuuuuugaucuuccuguuaauuccagagccugaaaagcagcggacaccccaagacaaccagcuaacauauguugucaucgcuauacugacugugguggcggccaccauggcaaaugagaugggguuucucgagaaaacaaagaaagaccuuggcuucggaucuaucgcuacccagcagccagaguccaacauucuggauaucgacuugcgaccugccagcgccuggacucuguacgcagucgcuacaacguuuguuacccccaugcucagacacucaauugagaauaguucugugaacguaucccugacugccaucgcgaaucaagcuacagugcuuaugggccucgggaagggauggccgcugagcaaaauggauauuggugucccauugcuggccaucggcuguuacucacaggugaacccuauaaccuuaaccgcagcccuacugcuccuuguugcucacuaugcaauuaucgggcccggacugcaggccaaggcgacacgcgaagcucagaagagggccgcagccggcaucaugaaaaauccaacuguggacgguauuacggucauagauuuggaccccaucccuuacgauccgaaguucgagaaacaacuggggcagguaaugcuccuggugcuuugcguuacccagguguuaaugaugcggacaacuugggcucugugugaagcccucaccuuggcaacaggccccauuaguacccugugggagggaaacccaggccguuuuuggaauacuacgaucgcugucagcauggccaacauuuucagaggguccuaucuagcgggagccggccugcucuuuucuaucaugaagaauacaaccaacacuaggcgcgguaccgggaacauaggagaaacacuuggcgagaaauggaaaagccggcugaaugcauuggguaaauccgaguuccaaaucuacaagaagucaggcauucaggaaguggaccgaacucuggcuaaagaggggaucaagagaggagaaaccgaucaucacgccgucucuaggggcagugcaaaacuccgcugguucguggagcggaacaugguuacaccugaggggaaggugguagaccugggaugcggcagagguggguggucguauuacuguggaggccuuaaaaaugugcgugaagucaagggucuaacgaagggcgggcccggacaugaggaaccuauuccaaugagcaccuauggcuggaaccugguuaggcuccaguccgggguggaugucuuuuucauacccccugagaaaugcgacacucuacugugugauauaggagaaucuucaccaaaucccacaguggaggcuggccggaccuugcgcguacugaaccucguggagaauuggcuuaacaauaacacucaguuuugcauuaagguucugaauccguacaugccuagcgugaucgagaaaauggaggccuugcaacgaagauacgguggggcccuggucaggaacccacucucccggaauaguacacacgaaauguauugggugucuaacgcgagcggaaauaucgucucauccgugaacaugauuagucgcauguuaauaaacagauucaccaugaagcauaaaaaggcuacguacgagcccgacguugaccugggcagcggcaccaggaauaucgggauugaaucugagguaccuaaccuugauaucauuggaaagcgaaucgagaaaauaaagcaggaacacgagacauccuggcacuaugaccaggaucauccauacaaaacuugggcauaucacgguucauacgaaaccaagcagacaggcagcgccucgucuauggugaauggggucgugcggcugcuaacuaaacccugggacguucucccgaccgugacacaaauggcuaugaccgauacuacgccuuuuggacagcagcgugucuucaaggagaagguggacacaagaacccaggaacccaaagagggcacuaagaaacugaugaagaucaccgccgagugguuguggaaagaacuggguaagaaaaagacaccacgcauguguacgagggaggaauuuacccggaagguaagaaguaacgcagcccucggggcuauuuucacugaugagaauaaauggaaguccgcgcgcgaggccguggaagacagcagguuuugggagcuuguugauaaagaacgaaaccugcauuuagagggaaagugcgaaacaugugucuauaauaugaugggcaaacgggagaagaagcugggcgaguucgggaaagcaaagggaucaagagcuaucugguacaugugguugggugccagguuucucgaguucgaggcacugggcuuucuaaacgaagaccacugguucucccgcgaaaauucucuuagcgggguggaaggagagggccugcacaaacucgguuacauucugcgugaugugaguaagaaagaagggggagccauguaugcugacgacaccgccggcugggauacucggaucacauuggaagaccugaagaacgaggaaauggucaccaaucauauggagggcgaacacaagaaacucgcggaggcaauuuucaaacuuacauaccaaaacaaaguugugagaguacagaggccuacuccccgcgggaccgugauggauauaaucucccgacgggaccagagaggaagcggucaagucggcacguaugggcugaauaccuuuacaaacauggaggcccaguuaauuaggcagauggaaggagagggcguguucaagaauauccagcaucugacugcuaccgaagagaucgccguucaaaacugguuggcacgcguggguagagagcggcucucuaggauggcuauuucaggggaugacugcgucgugaaaccacuggaugaccguuuugccagugcucuaacagcccuuaacgauaugggaaagauacgaaaggacauccagcagugggaacccucccgcggcuggaaugauuggacucagguaccuuucugcagccaccauuuucacgagcugauuaugaaagacggcagaguucucguggucccaugucggaaccaagaugaacugaucgggagggcacgcauuucucagggagcggguuggucguugagagagaccgccugcuuaggcaagucauacgcucagauguggagccugauguauuuccaccggagggaccuccgacuugccgcaaaugcuaucuguuccgccgugccgagucauugggugcccacgucucguacaaccuggagcauacacgcaaaacaugaauggaugacuacagaggacaugcugaccgucuggaacagaguuuggauccaggagaauccuuggauggaagauaagacuccaguggaguccugggaagagauucccuaccuagggaaacgcgaagaccaauggugcggaucacugaucggccucaccagucgggccacaugggcgaagaacauucaggcugccaucaaucagguaaggucuuugauagguaacgaggaguauacggauuacaugccuagcaugaagagauuucgccgggaagaggaagaggcaggggugcugugguga

SEQ ID NO: 15076 - RNA, 9876 nt, Artificial Sequence
  derived and/or modified CDS sequence (opt3) from DENV-2__AF169685__SS-prME
agcgcaggcaugaucauuaugcugauacccaccgugauggcuuuccaccucacaacuagaaauggggagccucauaugaucgucuccauucaggaaaagggaaagucucuucuguuuaagacggaggacgguguuaauaugugcaccuugauggcaauggauuuaggcgaacugugugaggacacaaucacuuacaaaugcccacugcucagacaaaacgaaccggaggauauugacuguuggugcaauucaaccaguacaugggugaccuaugggacuuguacaaccacgggagagcaccggcgcgaaaagcgaagcguagcacuggugccccaugucggcaugggucuugagacucguaccgaaacauggauguccucugagggggcguggaaacacgcucagagaaucgagacuuggauacugaggcauccuggauucaccaucauggccgcaauuuuggccuacacaaucggcaccacgcacuuucagcgggcucucauuuucauccugcugacugcaguggccccaucgaugacaaugcgcugcauaggcauuucaaacagagauuuuguugaaggggugagcggagguaguugggucgacaucgugcucgagcacggcuccuguguaaccacuauggcuaagaauaagcccacauuagauuucgaacugauuaaaaccgaggccaagcagccugcgacgcuuaggaaauauugcaucgaagcaaaguugaccaacacaacuaccgagucucgguguccaacacaaggggagcccagccugaaagaagaacaagacaagcgcuuuguuugcaagcauuccaugguggaucgaggauggggcaaugguugugggcuauucggaaaaggcggcaucgucacuugcgccauguuuaccugcaagaaaaacauggaagggaagauugugcagccugagaaucucgaauacacaauaguggucaccccacacucaggagaggagcaugcuguugguaacgacacuggcaaacacgggaaggaaaucaaagugacgccgcagaguagcauuacagaggccgaacugaccggauauggcacuguaaccauggaguguucucccagaacaggucuugauuucaaugaaauggugcuguugcaaauggagaacaaggcauggcucguccacaggcagugguuucuggacuuaccucugccauggcuccccggggcugauacccagggcuccaauuggauccagaaggagacucuugugacauucaaaaacccucaugccaagaaacaagacguugugguccugggaucacaggaaggcgcgaugcacacggccuugaccggggcaacugagauacagaugagcaguggaaaucuacuguuuacaggucaucucaagugccggcugcguauggacaaacuucaacugaagggcaugucuuacuccauguguaccgggaaguucaaagugguaaaggaaauugcugagacacagcacggaacuaucguuauccgcgugcaguaugagggcgaugguagcccaugcaggauucccuucgaaaucauggacuuggagaaaagguacguccucgggcggcugauuaccgugaacccgauagucacggaaaaggauucgccugugaacaucgaggccgaacccccauuuggcgacucuuacauuaucaucggaguugagccuggccaguuaaaacugaauugguucaagaagggguccucaauuggacaaauguuugagaccacaaugcgaggugcuaaacgcauggccauacuaggcgauacugcaugggacuucgggagucucggaggcguguuuaccagcaucgguaaggcccugcaucagguauucggggcuauuuauggcgcggcauuuuccggagucucuuggacaaugaaaauccuuauuggcgugaucauaacuuggaucgggaugaacagcagaucaaccaguuuguccguuagccuggugcucgucggaauugugacgcuguaccuuggcguaauggugcaggccgauucugguuguguugucucauggaagaauaaagaacugaagugcgggaguggaaucuucauuacagacaacgugcacaccuggacugagcaguauaaguuucaacccgaaagcccauccaaauuggcuucugccauccagaaggcacaggaggaaggcauaugugguauuaggucggugacacggcucgagaaucugauguggaaacagaucacccccgaguuaaaccacauucuggccgaaaaugaggucaagcuaacuaucaugaccggcgauauaaaagggaucaugcaagcuggaaagcgcagccucagaccucagccaacagaacugaaauacuccuggaagacguggggcaaggccaaaaugcuuucaaccgagagucauaaccagacuuucuugauugacgggccggaaacagcagagugccccaauaccaacagggcguggaacucucuggagguugaagauuauggauuuggcguguucacaacuaacaucuggcucaagcugaaagagaagcaggacgcuuuuugugacagcaaauuaauguccgccgcaauuaaggauaaucgugccgugcacgcugacauggguuacuggaucgaaucagcccugaacgauaccuggaagauagagaaagccagcuucauugagguaaagaauugccauuggccuaaaucucacacgcuuugguccaacggggucuuggaaagugagaugaucaucccaaagaaccucgcuggacccgugagccaacacaauuaucggccuggcuaccauacacagauugccgguccauggcaccugggcaaacuagaaauggacuucgauuuuugugacgggaccacuguuguggucaccgaggauugcggaaaccgaggccccucucugagaacaacuaccgcguccgggaagcucaucacagaauggugcuguaggucaugcacgcugccgccucuucgcuaccggggagaggacggcuguugguaugguauggagauuagaccauugaaggaaaaagaggaaaaucuggugaacaguuuaguuaccgccgggcauggacagguggauaauuucagccucggcguacuggguauggcucuuuuucuggaggaaauguugaggacucgcgucggcacaaagcacgcaauacuccugguggccgugucguucgucacccuaaucacugggaacauguccuuuaaagaccugggacgaguugugguaauggugggcgcuacaaugaccgaugacauugggaugggagucacguaccucgcccugcuugcagcguucaaggugcggcccacuuuugccgcuggcuugcuguuacguaaacucaccucuaaggagcugaugaugacaaccaucgguauuguucuucugagccaaucaacuaucccugagacaauacuagaacucaccgaugcccuggcauuggggaugauggugcugaagaucgucagaaauauggagaaauaucaguuagcugugacaauuauggccauccucugcguucccaacgcagugauucugcagaaugccuggaaggucaguuguacuauccuugcuguaguguccguuucuccacugauauugaccagcucccagcagaagacggacuggauuccucucgcgcugacaaucaagggacuaaaccccaccgccaucuuccugacuacccuuucaaggacaaauaaaaagcgcagcuggccacucaacgaagcaauuauggcugugggcauggucaguauacuggccucuuccuugcugaaaaaugacaucccgaugacuggcccuuuaguggccgggggacuccugaccguaugcuacgugcuuacgggucggagcgcugaucuggaguuggaaagagcaacagacgucaagugggaggaucaggccgagauuucgggcucaucucccauccucaguauuaccaucuccgaagacgggagcaugucuauaaagaacgaggaagaggagcagacucugacaauccuaauuaggaccggacugcuuguuaucagcggccucuuuccaguguccauucccaucacugcggcugccugguaucugugggaagugaaaaagcagcgagccggugucuugugggaugugccuucaccacccccuauggggaaagccgaguuagaagacggagcuuaccgcauaaagcaaaaaggcauucugggcuauagucagaucggggcaggaguuuacaaggaggguacauuccauaccauguggcacguaacgcggggcgccgugcucaugcacaaggggaaaagaaucgaaccgagcugggcggaugucaagaaagaccugauuucuuacggaggcgguuggaaacuugagggggaguggaaagaaggagaggaagugcagguucuggcuuuggagccaggcaagaaucccagggccgugcagacuaagccuggccuauuuaaaaccaacacagggaccaucggagcagucucccuggauuucucaccagguacaaguggcagccccauaauugacaagaaagggaaggugguaggacucuauggcaacggugucgugacucguuccggggccuacguuucugcuaucgcccaaaccgaaaaaucgauugaggauaauccugagaucgaagacgauauauuucgcaagcggagacugacgauuauggaccuucauccgggagcaggcaagacaaaaagguauuuacccgcuaucgugcgagaggccaucaagcggggccugcgcacucucauuuuggcgccaaccagagucguggccgcagaaauggaggaagcucugagggggcucccuauccgguaccagacacccgccauucgagcugagcacaccggaagagagauaguugaccugaugugucaugcaacuuucaccaugcgccuucugagcccagugagggucccuaacuauaauuugaucauuauggaugaagcccacuucacagaccccgccucaaucgcugcgcgugguuacaucuccacgcggguggagaugggcgaagcagccgggauuuuuaugacugcuaccccaccgggaaguagagauccuuucccccagucuaacgccccaauaaucgacgaggagagggaaauucccgagcgcagcuggaacuccggccaugaauggguaacagauuuuaaagguaagaccgugugguucguuccuucaaucaaagcagggaacgacauugccgcuugccuacgaaagaauggaaagaaagucauccaacugucuagaaagacuuuugauagcgaguaugugaaaacacggaccaacgacugggauuucguggucacgacugacauaagugaaaugggcgcgaauuuuaaggccgagaggguaaucgauccacgccguuguaugaaacccgugauucucacagacggcgaggaaagaguuaucuuagcagggccuaugccggugacccacuucuccgcugcccagcggaggggacgcauuggucgaaacccaaagaaugagaacgaccaguacaucuacaugggcgaaccccuggagaaugaugaagacugcgcacacuggaaagaggccaagaugcuucuggauaacauaaauaccccugaggggauuauccccagcauguuugaaccagagagagaaaaggucgacgcuauugauggagaguaucggcucaggggcgaagcccgcaaaacuuucguggacuugaugagaaggggugaucugccuguuuggcucgcguacaagguggcagccgaggggaucaacuaugcugaccggcguugguguuuugauggcaucaagaauaaucagauccuggaggaaaacgucgagguggaaauuuggacaaaggagggagagcgcaagaaacuuaaaccccgauggcuagacgccagaaucuacucugauccacuggcuuugaaagaguucaaggaguucgcagccggcaggaaaucauuagcucugaaucucauuaccgaaauggggcggcugccuacauuuaugacucaaaagacgcgcgacgcccuugauaaccuggcaguacuccauaccgcggaggccggagguagagcuuauaaucacgccuuguccgaacugccggagacacuagagacucugcuccuucugaccuuauuggcaacagugaccggcgggaucuuccuguuucucaugaguggaaggggcauagguaaaaugacucuggggaugugcugcauuaucacggcuagcauccuucugugguacgcccagauucagccccauuggaucgcagccucgauaauucucguuuucuuuuugaucguccuguuaauuccagaaccugagaagcagcggacaccccaagacaaccagcuaacauauguggugaucgcuauacugacugucguugcggccaccauggcaaaugaaaugggcuuccucgagaagaccaagaaggaccuuggauuuggcucuaucgcuacccagcagccagaauccaacauucuggauaucgacuugcgaccugccagcgccuggacucuguacgcaguggcuacaacguucguaacccccaugcucagacacucaauugagaauaguucugugaacgucucccugacugccaucgcgaaucaagcuacagugcuuauggggcucggaaaagguuggccgcugagcaagauggauauuggcguuccauugcuggccaucggguguuacucacaggugaacccuauaaccuuaaccgcagcccuacugcuccuugucgcucacuaugcaauuaucggacccggccugcaggccaaagcgacacgcgaggcucagaagagggccgcagccgguaucaugaagaauccaacuguagacgggauuacggugauagauuuggaccccaucccuuacgauccgaaauuugaaaagcaacugggccagguuaugcuccuggugcuuugcgucacccagguguuaaugaugcggacaacuugggcucugugugaggcccucaccuuggcaacaggacccauuaguacccugugggaaggcaacccagggcguuucuggaauacuacgaucgcugucagcauggccaacauuuuuagaggauccuaucuagcgggcgccggucuacucuucucuaucaugaaaaauacaaccaacacuaggcgcgggaccggaaacauaggcgagacacuuggugaaaaguggaaaagccggcugaaugcauugggcaaguccgaguuucaaaucuacaaaaagucagggauucaggagguggaccgaacucuggcuaaggaaggaaucaaaagaggcgagaccgaucaucacgccguuucuagggggagugcaaagcuccgcugguucguggaacggaacaugguaacaccugagggaaaaguggucgaccugggcugcgguagagggggauggucguauuacuguggcgguuuaaagaauguucgugaggugaaaggccuuacgaaagggggacccggccaugaggaaccuauuccaaugagcaccuauggguggaaccuggucaggcuccaguccggaguggauguauucuuuauacccccugaaaagugcgacacucuacugugugauauaggcgagucuucaccaaaucccacaguggaagcuggucggaccuugcgcguucugaaccucguggagaauuggcuuaacaauaacacucaguucugcauuaaaguccugaauccguacaugccuagcgugaucgagaagauggaagccuugcaacgaagauacgggggagcccuggucaggaacccacucucccggaauaguacacacgagauguauugggugucuaacgcgagcggcaauaucguuucauccguaaacaugauuagucgcauguuaauaaacagauuuaccaugaggcauaaaaaggcuacguacgaacccgacguggaccugggcagcgggacccgaaauaucggaauugagucugaagucccuaaccuugauaucauugguaaacggaucgagaagauaaagcaggagcacgaaacauccuggcacuaugaccaggaucauccauacaaaacuugggcauaucacggcucauacgagaccaagcagacagggagcgccucgucuauggugaauggaguugugcgucugcuaacuaaacccugggacguccucccgaccgugacacaaauggcuaugaccgauacuacgccuuucggccagcagagaguauuuaaggaaaaaguggacacacgcacccaggagcccaaggaagguacuaagaaacugaugaagaucaccgccgagugguuguggaaagagcuggggaagaaaaagacaccaaggauguguacgcgggaagaguucaccagaaaaguucgcaguaacgcagcccucggagcuauuuuuacugaugaaaauaaguggaaguccgcgagggaggccgucgaggacagccgauucugggaacuuguggauaaagagcggaaccugcauuuagaaggcaagugcgagacauguguguauaauaugaugggcaaaagagaaaagaaacugggggaguuuggaaaggcaaaggguucaagggcuaucugguacaugugguugggcgcccgcuuccucgaguuugaagcacugggguuccuaaacgaggaccacugguuuucccgugaaaauucucuuagcggagucgagggcgaaggucugcacaaacucggguacauucugcgggauguuaguaagaaagagggaggcgccauguaugcugacgacaccgccggcugggauacuagaaucacauuggaggaccugaagaacgaagagauggugaccaaucauauggaaggggagcacaaaaagcucgcggaagcaauuuucaaacuuacauaccaaaacaaaguagugaggguccagcgcccuacuccccgaggaaccgugauggauauaaucucccggagagaccagagggguagcggccaaguugggacguauggacugaauaccuucacaaacauggaggcccaguuaauucgccagauggagggcgaagguguguuuaagaauauccagcaucugacugcuaccgaggaaaucgccguccaaaacugguuggcaagaguggggcgggagaggcucucucguauggcuauuucaggagaugacugcguaguuaaaccacuggaugaccgauucgccagugcucuaacagcccuuaacgauaugggcaagauacgcaaagacauccagcagugggagcccuccagaggcuggaaugauuggacucaggugccuuuuugcagccaccauuuccacgaacugauuaugaaggacgggcggguccucguggugccauguaggaaccaagaugagcugaucggacgcgcaagaauuucucagggugcgggcuggucguugcgggaaaccgccugcuuagggaagucauacgcucagauguggagccugauguauuuucacaggcgagaccuccgucuugccgcaaaugcuaucuguuccgccgucccgagucauuggguucccacgucuagaacaaccuggagcauacacgcaaaacaugaguggaugacuacagaagacaugcugaccguguggaaccgcguauggauccaggagaauccuuggauggaggauaagacuccaguggaauccugggaggaaauucccuaccuaggaaaacgggaggaccaauggugcggcucacugaucggucucaccaguagggccacaugggcgaagaacauucaggcugccaucaaucaggucagaucuuugauagggaacgaagaguauacggauuacaugccuagcaugaaacgcuuccggagggaggaagaggaagcaggagugcugugguga

SEQ ID NO: 15077 - RNA, 9876 nt, Artificial Sequence
  derived and/or modified CDS sequence (opt3) from DENV-2__AF169686__SS-prME
agcgcaggaaugaucauuaugcugauacccaccgugauggcuuuccaccucacaacuagaaauggggagccucauaugaucgucuccauucaagaaaagggaaaaucucuucuguuuaagacggaggacgguguuaauaugugcaccuugauggcaauggauuuaggcgaacugugugaggacacaaucacuuacaaaugcccacuacucaggcaaaaugaaccggaggauauugacuguuggugcaauucaaccaguacaugggugaccuaugggacuuguacaaccacgggagagcaccggcgcgaaaagcgaagcguagcacuggugccccaugucggcaugggucuugagacucguaccgaaacauggauguccucugagggggcguggaaacacgcucagagaaucgagacuuggauacugaggcauccuggauucaccaucauggccgcaauuuuggccuacacaaucggcaccacgcacuuucagcgggcucucauuuucauccugcugacugcaguggccccaucgaugacaaugcgcugcauaggcauuucaaacagagauuuuguugaaggggugagcggagguaguugggucgacaucgugcucgagcacggcuccuguguaaccacuauggcuaagaauaagcccacauuagauuucgaacugauuaaaaccgaggccaagcagccugcgacgcuuaggaaauauugcaucgaagcaaaguugaccaacacaacuaccgagucucgguguccaacacaaggggagcccagccugaaagaagaacaagacaagcgcuuuguuugcaagcauuccaugguggaucgaggauggggcaaugguugugggcuauucggaaaaggcggcaucgucacuugcgccauguuuaccugcaagaaaaacauggaagggaagauugugcagccugagaaucucgaauacacaauaguggucaccccacacucaggagaggagcaugcuguugguaacgacacuggcaaacacgggaaggaaaucaaagugacgccgcagaguagcauuacagaggccgaacugaccggauauggcacuguaaccauggaguguucucccagaacaggucuugauuucaaugaaauggugcuguugcaaauggagaacaaggcauggcucguccacaggcagugguuucuggacuuaccucugccauggcuccccggggcugauacccagggcuccaauuggauccagaaggagacucuugugacauucaaaaacccucaugccaagaaacaagacguugugguccugggaucacaggaaggcgcgaugcacacggccuugaccggggcaacugagauacagaugagcaguggaaaucuacuguuuacaggucaucucaagugccggcugcguauggacaaacuucaacugaagggcaugucuuacuccauguguaccgggaaguucaaagugguaaaggaaauugcugagacacagcacggaacuaucguuauccgcgugcaguaugagggcgaugguagcccaugccggauuccauucgaaaucauggacuuggagaaaagguacguccucgggcggcugauuaccgugaacccgauagucacggaaaaggauucgccugugaacaucgaggccgaacccccauuuggcgacucuuacauuaucaucggaguugagccuggccaguuaaaacugaauugguucaagaagggguccucaauuggacaaauguuugagaccacaaugcgaggugcuaaacgcauggccauacuaggcgauacugcaugggacuucgggagucucggaggcguguuuaccagcaucgguaaggcccugcaucagguauucggggcuauuuauggcgcggcauuuuccggagucucuuggacaaugaaaaucuucauuggcgugaucauaacuuggaucgggaugaacagcagaucaaccagucuuuccguuagcuuggugcuggucggaauugugacgcucuaccugggcguaauggugcaggccgauucugguuguguugucucauggaagaauaaagaacuuaagugcgggaguggaaucuuuauuacagacaacgugcacaccuggacugagcaguauaaguuccaacccgaaagcccauccaaacuggcuucugccauccagaaggcacaggaggaaggcauaugugguauuaggucggugacacgguuggagaaucucauguggaaacagaucacccccgagcugaaccacauuuuagccgaaaaugaggucaagcugacuaucaugaccggcgauauaaaagggaucaugcaagcuggaaagcgcagccuaagaccucagccaacagaacucaaauacuccuggaagacguggggcaaggccaaaaugcugucaaccgagagucauaaccagacuuuucuuauugacgggccggaaacagcagagugccccaauaccaacagggcguggaacucuuuggagguugaagauuauggauucggcguguuuacaacuaacaucuggcugaagcucaaagagaagcaggacgcuuucugugacagcaaacugauguccgccgcaauuaaggauaaucgugccgugcacgcugacauggguuacuggaucgaaucagccuuaaacgauaccuggaagauagagaaagccagcuucauugagguaaagaauugccauuggccuaaaucucacacgcugugguccaacgggguccuugaaagugagaugaucaucccaaagaacuuggcuggacccgugagccaacacaauuaucggccuggcuaccauacacagauugccgguccauggcaccucggcaaacuggaaauggacuuugauuucugugacgggaccacuguuguggucaccgaggauugcggaaaccgaggccccucucuaagaacaacuaccgcguccgggaagcugaucacagaauggugcuguaggucaugcacgcucccgccucugcgcuaccggggagaggacggcuguugguaugguauggagauuagaccacuuaaggaaaaagaggaaaauuuggugaacagucugguuaccgccgggcauggacagguggauaauuuuagcuuaggcguacucgguauggcucuguuccuugaggaaaugcugaggacucgcgucggcacaaagcacgcaauauugcucguggccgugucguuugucacccugaucacugggaacauguccuucaaagaccuaggacgaguugugguaauggugggcgcuacaaugaccgaugacauugggaugggagucacguaccuggcccuccuggcagcguuuaaggugcggcccacuuucgccgcuggccuuuugcugcguaaauuaaccucuaaggagcucaugaugacaaccaucgguauuguucugcuuagccaaucaacuaucccugagacaauacuggaacuaaccgaugcccucgcacuggggaugaugguguugaagaucgucagaaauauggagaaauaucagcuggcugugacaauuauggccaucuuaugcguucccaacgcagugauucuccagaaugccuggaaggucaguuguacuauccuggcuguaguguccguuucuccacuuauacugaccagcucccagcagaagacggacuggauuccuuuggcgcucacaaucaagggacugaaccccaccgccaucuuucuaacuacccugucaaggacaaauaaaaagcgcagcuggccagugaacgaagcaauuauggcugucggcauggugaguauacuugccucuucccuccugaaaaaugacaucccgaugacuggcccuuugguagccgggggacuguuaaccgugugcuacguccucacgggucggagcgcugaucuggagcuugaaagagcaacagacguuaagugggaggaucaggccgagauuucgggcucaucucccauccugaguauuaccaucuccgaagacgggagcaugucuauaaagaacgaggaagaggagcagacuuugacaauccucauuaggaccggacugcuagugaucagcggccuguucccaguguccauucccaucacugcggcugccugguaucuuugggaagucaaaaagcagcgagccggugugcucugggauguuccuucaccacccccuauggggaaagccgagcuggaagacggagcuuaccgcauaaagcaaaaaggcauuuugggcuauagucagaucggggcaggaguauacaaggaggguacauuucauaccauguggcacgugacgcggggcgccgucuuaaugcacaaggggaaaagaaucgaaccgagcugggcggaugugaagaaagaccugauuucuuacggaggcgguuggaagcucgagggggaguggaaagaaggagaggaaguucaggugcuggcucuugagccaggcaagaaucccagggccguccagacuaagccuggccuguucaaaaccaacacagggaccaucggagcaguguccuuggauuuuucaccagguacaaguggcagccccauaauugacaagaaagggaagguagucggacuauauggcaacggugugguuacucguuccggggccuacgugucugcuaucgcccaaaccgaaaaaucgauugaggauaauccugagaucgaagacgauauauuccgcaagcggagacugacgauuauggaccuccauccgggagcaggcaagaccaagaaguaucugcccgcuaucgucagggaggccaucaaacgaggccuucggacuuuaauucuggcgccaacccgcgugguugccgcagaaauggaggaagcucucagaggguugccuaucagguaccagacacccgccauucgggcugagcacaccggacgagagauaguggaccugaugugucaugcaacuuucaccaugagacuccugagcccaguccgcgugccuaacuauaaucuuaucauuauggaugaagcccacuuuacagaccccgccucaaucgcugcgagggguuacaucuccacgcguguagagaugggcgaagcagccgggauuuucaugacugcuaccccaccgggaagucgggauccuuuuccccagucuaacgccccaauaaucgacgaggagagagaaauucccgagaggagcuggaacuccggccaugaaugggugacagauuucaaggguaaaaccguuugguuugucccuucaaucaaggcagggaacgacauugccgcuugccugcgcaagaauggcaaaaaggugauccaauugucucgaaaaacuuucgauagcgaguaugugaagacaagaaccaacgacugggauuuugucguaacgacugacauaagugaaaugggcgcgaauuucaaagccgagcgggugaucgauccaaggcgcuguaugaagcccguuauucuaacagacggcgaggaacgugugauccuggcagggccuaugccggucacccacuuuuccgcugcccagagacggggaaggauuggucgcaaccccaaaaaugagaacgaccaguacaucuacaugggcgaaccccucgagaaugaugaagacugcgcacacuggaaggaggccaagauguuacuggauaacauaaauaccccugaggggauuauccccagcauguucgaaccagagcgagaaaaaguggacgcuauugauggagaguauagacuucggggcgaagccaggaagacuuuuguugaccugaugcgcagaggugaucucccugugugguuggcguacaaagucgcagccgaggggaucaacuaugcugacaggcggugguguuucgauggcauaaagaacaaucagauccuggaggaaaacguggagguagaaauuuggacaaaagagggagagcguaagaagcucaaaccccgcuggcuggacgcccgaaucuacucugauccacuugcucuaaaggaguucaaagaguuugcagccggcagaaagucacuggcuuugaauuuaauuaccgaaauggggaggcugccuacauucaugacucagaaaacgcgggacgcccucgauaaccuggcagugcuucauaccgcggaggccggaggucgcgcuuauaaucacgcccuguccgaacucccggagacauuggagacucugcuacugcucacccuucuggcaacaguuaccggcgggaucuuuuuauucuugaugaguggaagaggcauagguaagaugacucuggggaugugcugcauuaucacggcuagcauccuccugugguacgcccagauucagccccauuggaucgcagccucgauaauucuugucuuuuuccugaucgugcucuugauuccagaaccugagaagcagaggacaccccaagacaaccagcugacauauguggucaucgcuauauuaacuguuguggcggccaccauggcaaaugaaaugggcuuucuagagaaaacaaagaaagaccugggauucggcucuaucgcuacccagcagccagaauccaacauucucgauaucgaccuucggccugccagcgccuggacucuguacgcaguagcuacaacguuugugacccccauguugcgacacucaauugagaauaguucugucaacgugucccugacugccaucgcgaaucaagcuacaguucucauggggcugggaaaggguuggccgcuuagcaaaauggauauuggcgugccacuccuggccaucggguguuacucacaggucaacccuauaaccuugaccgcagcccuguuacuacugguagcucacuaugcaauuaucggacccggccuccaggccaaggcgacaagagaggcucagaagcgcgccgcagccgguaucaugaaaaauccaacuguggacgggauuacgguuauagaucuugaccccaucccuuacgauccgaaguucgaaaaacaacugggccaggugauguugcugguccucugcgugacccagguccugaugaugaggacaacuugggcucuuugugaggccuuaacccuggcaacaggacccauuaguacccucugggaaggcaacccagggcgguuuuggaauacuacgaucgcugugagcauggccaacauuuuccguggauccuauuuggcgggcgccggucugcuauuuucuaucaugaagaauacaaccaacacuagaagggggaccggaaacauaggcgagacacugggugaaaaauggaaaagccgccucaaugcacuuggcaaauccgaguuccaaaucuacaagaagucagggauucaggagguugaccggacucuggcuaaagaaggaaucaagcgaggcgagaccgaucaucacgccgugucuagagggagugcaaaauugaggugguucguagaacgcaacauggugacaccugagggaaaggucguugaccugggcugcgguagagggggauggucguauuacuguggcggucucaaaaaugugagagaggucaagggccugacgaaagggggacccggccaugaggaaccuauuccaaugagcaccuauggguggaacuuagugcgucuucaguccggaguagauguguuuuucacucccccugaaaaaugcgacacacugcucugugauaucggcgagucuucaccaaaucccaccguugaagcugguaggacucuacgggugcugaacuuggucgagaauuggcugaacaauaacacacaguuuugcauaaaggugcucaauccguacaugccuagcgucauugagaaaauggaagcccuucaacgccgauacgggggagcccuggugagaaacccauuguccaggaauaguacccacgagauguauuggguuucuaacgcgagcggcaauaucguaucauccgugaacaugaucagucggaugcugauuaaccgcuucacgaugaagcauaaaaaggcuaccuacgaacccgacgucgaccucggcagcgggacaagaaauauaggaaucgagucugaagugccuaacuuagauauuaucgguaagaggauugagaaaaucaagcaggagcacgaaacuuccuggcacuaugaccaggaucauccauacaaaaccugggcauaucacggcucauacgagacaaagcagacugggagcgccucgucuaugguuaauggagugguccgacugcuuaccaaacccugggacgugcugccgacaguaacccaaauggcuaugacugauacgacaccuuuuggccagcagcggguguucaaggaaaagguugacacccguacucaggagcccaaagaagguaccaagaaacuaaugaagauaacagccgaguggcucuggaaagagcuggggaagaaaaagacgccaagaauguguacccgcgaagaguuuacuaggaagguccggaguaacgcagccuugggagcuaucuucacagaugaaaauaaauggaaguccgcgagagaggccguggaggacagccgcuuuugggaacugguggauaaagagaggaaccuccaucuugaaggcaagugcgagaccugugucuauaauaugaugggcaaacgagaaaagaagcugggggaguucggaaaagcaaaggguucacgggcuauuugguacaugugguuaggcgccagauuucuggaguucgaaacuuugggguuucucaacgaggaccacugguucuccagggaaaauucucugagcggaguugagggcgaaggucuacacaaacuuggguacauccugcgcgaugugaguaagaaagagggaggcgcaauguaugccgacgacacagcuggcugggauacccguauuacacucgaggaccugaagaacgaagagaugguaacuaaucauauggaaggggagcacaagaaauuggccgaagcgaucuucaagcugaccuaccaaaacaaagugguccgggugcagagaccuacgcccaggggaaccguuauggauauuauaucccgccgagaccagcgggguagcggccaaguggggacauauggacucaauacuuuuaccaacauggaggcacagcuuaucagacagauggagggcgaaggugucuucaagaauauucagcaucugacagccacugaggaaaucgcugugcaaaacugguuagccaggguagggcgcgagagacugucucggauggcaaucucaggagaugacugcguugugaaaccauuggaugacagguuugcuagugcccucaccgcucugaacgauaugggcaagauucguaaggacauacagcagugggagcccucccgaggcuggaaugauuggacgcaggucccuuucugcagccaccauuuucacgaacuaaucaugaaagacgggcgcgugcuuguggucccauguagaaaccaagaugagcugauuggacgggccaggaucucucagggugcaggcuggucgcuccgcgaaacagcgugccuggggaagucauacgcccagauguggagcuugauguauuuccacagacgggacuuaaggcuggcugccaaugcaauuuguuccgcuguuccgagucauugggugcccaccucucgaacuacauggagcauccacgccaaacaugaguggaugaccacugaagacaugcucgcaguauggaaccguguguggauacaggagaauccuuggauggaggauaagaccccagucgaauccugggaggaaauccccuaccuuggaaaaagagaggaccaauggugcggcucacugauuggucuaacaagucgcgccacgugggcgaagaacauccaggcugccauuaaucaggugcggucucugaucgggaacgaagaguauaccgauuacaugccuagcaugaagagguuuagacgcgaggaagaggaagcaggaguucucugguga

SEQ ID NO: 15078 - RNA, 9876 nt, Artificial Sequence
  derived and/or modified CDS sequence (opt3) from DENV-2__AF169687__SS-prME
agcgccggcaugaucauuaugcugauacccaccgugauggcuuuccaccucacaacuagaaacggggagccucauaugaucguauccauucaggaaaagggaaaaucucuucuguuuaagacggaggacgguguuaauaugugcaccuugauggcaauggauuuaggcgaacugugugaggacacaaucacuuacaaaugcccauuacucaggcaaaacgaaccggaggauauugacuguuggugcaauucaaccaguacaugggugaccuaugggacuuguacaaccacgggagagcaccggcgcgaaaagcgaagcguagcccuggugccccaugucggcaugggucuugagacucguaccgaaacauggauguccucugagggggcguggaaacacgcucagagaaucgagacuuggauacugaggcauccuggauucaccaucauggccgcaauuuuggccuacacaaucggcaccacgcacuuucagcgggcucucauuuucauccugcugacugcaguggccccaucgaugacaaugcgcugcauaggcauuucaaacagagauuuuguugaaggggugagcggagguaguugggucgacaucgugcucgagcacggcuccuguguaaccacuauggcuaagaauaagcccacauuagauuucgaacugauuaaaaccgaggccaagcagccugcgacgcuuaggaaauauugcaucgaagcaaaguugaccaacacaacuaccgagucucgguguccaacacaaggggagcccagccugaaagaagaacaggacaagcgcuuuguuugcaagcauuccaugguggaucgaggauggggcaaugguugugggcuguucggaaaaggcggcaucgucacuugcgccauguuuaccugcaagaaaaacauggaagggaagauugugcagccugagaaucucgaauacacaauaguggucaccccacacucaggagaggagcaugcuguugguaacgacacuggcaaacacgggaaggaaaucaaagugacgccgcagaguagcauuacagaggccgaacugaccggauauggcacuguaaccauggaguguucucccagaacaggucuugauuucaaugaaauggugcuguugcaaauggagaacaaggcauggcucguccacaggcagugguuucuggacuuaccucugccauggcuccccggggcugauacccagggcuccaauuggauccagaaggagacucuugugacauucaaaaacccucaugccaagaaacaagacguugugguccugggaucacaggaaggcgcgaugcacacggccuugaccggggcaacugagauacagaugagcaguggaaaucuacuguuuacaggucaucucaagugccggcugcguauggacaaacuucaacugaagggcaugucuuacuccauguguaccgggaaguucaaagugguaaaggaaauugcugagacacagcacggaacuaucguuauccgcgugcaguaugagggcgaugguagcccaugccgaaucccauucgaaauuauggacuuggagaaaagguacguccucgggcggcugauuaccgugaacccgauagucacggaaaaggauucgccugugaacaucgaggccgaacccccauuuggcgacucuuacauuaucaucggaguugagccuggccaguuaaaacugaauugguucaagaagggguccucaauuggacaaauguuugagaccacaaugcgaggugcuaaacgcauggccauacuaggcgauacugcaugggacuucgggagucucggaggcguguuuaccagcaucgguaaggcccugcaucagguauucggggcuauuuauggcgcggcauuuuccggagucucuuggacaaugaaaauccuuauuggcgugaucauaacuuggaucgggaugaacagcagaucaaccaguuuguccguuagccuggugcucgucggaauugugacgcuguaccuuggcguaauggugcaggccgauucugguuguguugucucauggaagaauaaagaacugaagugcgggaguggaaucuucauuacagacaacgugcacaccuggacugagcaguauaaguuucaacccgaaagcccauccaaauuggcuucugccauccagaaggcacaggaggaaggcauaugugguauuaggucggugacacggcucgagaaucugauguggaaacagaucacccccgaguuaaaccacauucugagcgaaaaugaggucaagcuaacuaucaugaccggcgauauaaaagggaucaugcaugccggaaagcgcucccucagaccucaaccaacagaacugaaauacucauggaagacguggggcauugcuaagaugcuuaguaccgagucucacaaccagacuuucuugaucgacgggccggaaacagccgagugccccaauaccaacagggcauggaauagccuggagguugaagauuauggauuuggcguguucacaacuaacauuuggcucaaacugaaggagaaacaggacgcguuuugugacuccaaguuaaugucagcugccaucaaagauaaucgugcagugcaugccgacauggguuacuggauagaaagcgcucugaacgauaccuggaagauugagaaggccucuuucaucgaggucaaaaauugccacuggccuaagucccacacgcuuuggaguaacggggucuuggaaagcgagaugaucauucccaaaaaucucgcaggacccgugucucagcauaauuaucggccuggcuaccacacacaaaucgcugguccauggcaucugggcaagcuagaaauggacuucgauuuuugugacgggaccacuguuguggucaccgaggauugcggaaaccgaggccccucccugagaacaacuaccgccucagggaaacucauuacagaauggugcuguaggaguugcacgcugccgccucuucgcuaccggggagaggacggcuguugguaugguauggagauaagaccauugaaggaaaaggaggaaaaucuggugaacagcuuaguuaccgcggggcacggacagguggauaauuucucgcucggcguacuggguauggcccuuuuucuggaggaaauguugaggacucgcgucggcacaaaacaugcuauccuccugguggcaguguccuucgucacccuaauuacugggaacaugucuuuuaaggaccugggacgaguugugguaacagugggcgccaccaugacggaugacaucgggaugggagucacuuaccucgcucugcuugccgcauucaaagugcggcccaccuuugcggccggcuugcuguuacguaagcucacaagcaaagagcugaugaugaccacuauugguaucguucuucugucacagaguacaauaccugagaccauccuagaacucacagaugcucuggccuuggggaugauggugcugaagauugucagaaauauggagaaguaucaauuagcagugacuaucauggcuauucucugcguucccaacgccgugauccugcagaaugcauggaaagucuccuguaccauacuugccguagugucuguuagcccacugauuuugacguccucacagcagaagacagacuggaucccucucgcucugaccaucaaaggacuaaaccccacugcgauuuuccugaccacacuuagcaggacuaauaagaaacgcaguuggccacucaacgaagccauaauggcagugggcauggucucuauccuggcuuccagcuugcugaagaaugacauuccgaugaccggcccuuuaguggccgggggacuccugacgguaugcuacgugcuuacaggucggucggccgaucuggaguuggaaagagcuaccgacgucaaaugggaggaucaagcagagaucucaggcucuagucccauucucuccaucacuauaagcgaagacgggucuaugagcaucaagaacgaggaagaggagcagacacugaccauucuaaucaggacuggacugcuuguuauuuccggccucuuuccagugucaauccccauaacagccgcggcuugguaucugugggaagugaagaaacagcgagccggugucuugugggaugugccuaguccacccccuauggggaaggcagaguuagaagacggagccuaccgcauuaaacagaagggcauccugggcuauagccaaaucggggcuggaguuuacaaagaggguaccuuccacacgauguggcacguaacucggggcgcagugcucaugcauaaggggaagagaauugaaccgucuugggccgaugucaaaaaggaccugaucuccuacggaggcgguuggaaacuugagggggaguggaaggaaggagaggaagugcagguucuggcguuggagccaggcaaaaaucccagggcugugcagaccaagccuggccuauuuaagacaaacaccgggacaauaggagccgucucacuggauuucaguccagguacuagcggcucccccauuaucgacaaaaaggggaaagugguaggacucuauggcaacggugucgugacccguucuggggcauacguuucggccauugcucagacggaaaagagcaucgaggauaauccugagauagaagacgauauuuuucgcaaacggagacugacaaucauggaccuucacccgggagccggcaagacuaagagguauuuacccgcaaucgugcgagaggcuauuaaacggggccugcgcacccucaucuuggccccaacaagagucguggcggccgaaauggaggaagcacugagggggcucccuauucgguaccaaacccccgcuauacgagccgagcauacuggaagagagaucguugaccugaugugucacgcuaccuucacaaugcgccuucugucaccagugagggucccuaacuauaauuugauuaucauggaugaagcacauuucacggaccccgccuccaucgccgcucgugguuacauuaguacucggguggagaugggcgaagcggcagggauauuuaugaccgccacaccaccgggaucuagagauccuuucccccagagcaacgcuccaaucauugacgaggagagggaaauccccgagcgcuccuggaacucaggccacgaauggguaaccgauuuuaaggguaaaacugugugguucguuccuucuauuaaggccgggaacgacaucgcagccugccuacggaaaaauggaaagaaggucauacagcugagcagaaaaacauuugauagugaguaugugaagaccagaacgaacgacugggauuucguggucacuacagacaucuccgaaaugggcgcuaauuuuaaagcggagaggguaauugauccacgccguuguaugaagcccgugauccucaccgacggcgaggaaagaguuauuuuagccgggccuaugccggugacccacuucagcgcagcucaacggaggggacgcaucggucgaaaccccaaaaaugagaacgaccaguacauauacaugggcgaaccccuggagaaugaugaagacugcgcccauuggaaggaggcaaaaaugcuucuggauaacauuaauacuccugaggggaucauucccucuauguuugaaccagagagagaaaaggucgacgccaucgauggagaguaucggcucaggggcgaagcucgcaagacauucguggacuugaugagaaggggugaucugccuguuuggcucgccuacaaaguggcggcagaggggauaaacuaugccgaccggcguugguguuuugauggcaucaagaacaaucagauucuggaggaaaacgucgagguggaaaucuggaccaaagagggagagcgcaagaaacuuaagccccgauggcuagacgcuagaauuuacucagauccacuggccuugaaggaguucaaagaguucgcugcaggcaggaaguccuuagcccugaaucucaucacagaaauggggcggcugccuacuuuuaugacgcagaaaacccgcgacgcucuugauaaccuggccguacuccacacagcagaggcgggagguagagccuauaaucaugcuuugagugaacugccggagacucuagagacccugcuccuucugacauuauuggccaccgugacuggcgggauauuccuguuucucaugagcggaaggggcauugguaagaugacgcuggggaugugcugcaucaucaccgcaucgauucuucugugguacgcucaaauccagccccacuggauagccgcaucuauuauccucguuuucuuuuugauuguccuguuaaucccagaaccugagaaacagcggacaccccaggacaaccaacuaacuuauguggugauagccauccugaccgucguugcugcgacaauggccaaugaaaugggcuuccucgagaagaccaagaaagaccuuggauuuggcuccauugcaacucagcagccagaaagcaacauccuggauauugacuugcgaccugcuucagccuggacacuguacgccguggcaacgaccuucguaacucccaugcucagacacaguaucgaaaauucuuccgugaacgucagccugacagcuauugccaaucaggcgaccgugcuuauggggcucggaaaggguuggccgcugucaaaaauggauaucggcguuccauugcuggcuauaggguguuacagucaagugaacccuauuaccuuaacagccgcacuacugcuccuugucgcccauuaugcuaucaucggacccggccugcaggcaaaggccacucgcgaggcgcagaaaagggcugccgcagguauuaugaagaauccaacgguagacgggauaaccgugaucgauuuggaccccauuccuuacgauccgaaguuugaaaaacagcugggccaaguuaugcuccuggugcuuugcgucacacagguguuaaugaugcggacuaccugggcccugugugaggcucucacauuggccaccggacccaucagcacucugugggaaggcaacccagggcguuucuggaauacgacaauugcagucuccauggcuaacaucuuuagaggaucuuaucuagccggcgcgggucuacucuucagcauaaugaagaauaccacuaacaccaggcgcgggacaggaaacaucggcgagacucuuggugaaaaauggaagucccggcugaaugccuugggcaaaucagaguuucagauuuacaagaaaucugggauccaagagguggaccgaacccuggcaaaggaaggaauuaagagaggcgagacagaucaccaugcuguuaguagggggucggccaaacuccgcugguucguggaacggaacaugguaacgccugagggaaagguggucgaccugggcagcgguagagggggaugguccuauuacugcggcggucuuaaaaauguucgugaggugaagggccuaaccaaagggggacccggccacgaggaaccuaucccaaugucuacuuauggguggaaccuggucaggcuccagucaggaguggauguauucuuuauacccccugaaaagugugacacacuacugugcgauauuggcgagagcuccccaaaucccaccguggaagcaggucggacuuugcgcguucugaaccucguggagaauuggcuuaacaauaacacacaguucuguaucaagguccugaauccguacaugccuagugugaucgagaaaauggaggcuuugcagcgaaaguacgggggagcccuggucagaaacccacucucuaggaauagcacccaugagauguauugggugucaaacgccuccggcaauauuguuaguagcguaaacaugauaucucggauguuaaucaaccgcuuuacgaugagacacaaaaaggcgaccuacgaacccgacguggaccugggcuccgggacaaggaauauuggaaucgagucagaaauuccuaaccuugauaucauagguaaacgaaucgagaagauuaagcaagagcacgaaacuagcuggcauuaugaccaggaucacccauacaaaaccugggcuuaucauggcucguacgagacaaagcagacugggucugcaaguuccauggucaauggagugguucggcugcuaaccaaacccugggacgugcucccgacagucacccagauggccaugacugauacgacaccuuucggccaacagcguguguuuaaggaaaaaguagacaccagaacucaggagcccaaggaagguaccaagaaacugaugaagaucacagcugagugguuguggaaagagcuggggaagaaaaagacgccacgcaugugcaccagggaagaguucacucggaaagugagaagcaacgccgcacucggagccauuuuuacagaugaaaauaaguggaagucagcucgcgaggcgguugaggacuccagguucugggaacuugucgauaaagagcgaaaccugcacuuagaaggcaagugugagaccugcguguauaauaugaugggcaaacgggaaaagaaacugggggaguuuggaaaggccaaggguucuagagcaaucugguacaugugguugggcgcuagguuccucgaguuugaagcccugggguuccuaaacgaggaccacugguuuagccgcgaaaauagucuuuccggaguggagggcgaagguagccauaaacugggguacauucuccgugaugucucuaagaaagagggaggcgcaauguaugccgacgacacugcuggcugggauacacggauaacccuggaggacuugaagaacgaagagaugguuacaaaucacauggaaggggagcauaaaaagcuggccgaagcgaucuucaagcucacuuaccagaacaaagugguaagagugcaaaggccuaccccacgcggaacggucauggauauuaucucacgacgggaccagagagguaguggccagguggggaccuauggacuuaauacauucacuaacauggaggcacaacugaucaggcagauggagggcgaagguguuuuuaagaauauucagcacuuaaccgccacagaggaaauagcugugcagaacuggcuggcccgcgucgggagagagcgguuguccaggauggcaaucagcggagaugacugugugguaaaaccacucgaugaccguuucgcuucugcccugacugcucuaaacgauaugggcaagauucgaaaagacauccaacagugggagcccucgcgcggcuggaaugauuggacccagguuccuuuuugcucacaucacuuccacgaacuuauuaugaaggacgggagagugcuggucgugccaugccggaaccaggaugagcucaucggaagggcccgcauaagccaaggugcaggcuggucccugagagaaacggcguguuuggggaagaguuacgcccagauguggucuuuaauguauuuucaucggagggaccugcgacucgcugccaaugcaaucugcagcgcugugccgucccacuggguccccacaucacguaccacuuggaguauucaugccaaacacgaguggaugacaaccgaagacaugcuuacuguuuggaacagaguguggauccaggagaauccuuggauggaggauaagaccccaguagaaucuugggaggaaauucccuaccugggaaaacgcgaggaccagugguguggcagccuaaucggucugacaucccgggcaacgugggccaagaacauacaagcggcuauuaaucaggugaggucacucaucgggaacgaagaguauaccgauuacaugccuagcaugaaaagauuccgccgggaggaagaggaagccggagucuugugguga

SEQ ID NO: 15079 - RNA, 9876 nt, Artificial Sequence
  derived and/or modified CDS sequence (opt3) from DENV-2__AF169688__SS-prME
agcgcaggcaugauaauuaugcugauacccaccgugauggcuuuccaccucacuacuagaaauggggagccucauaugaucgucuccauucaggaaaagggaaagucucuucuguuuaagacggaggacgguguuaauaugugcaccuugauggcaauggauuuaggcgaacugugugaggacaccaucacuuacaagugcccauuacucaggcaaaacgaaccggaggauauugacuguuggugcaauucaaccaguacaugggugaccuaugggacuuguacaaccacgggagagcaccggcgcgaaaagcgaagcguagcacuggugccccaugucggcaugggucuugagacucguaccgaaacauggauguccucugagggggcguggaagcacgcucagagaaucgagacuuggauacugaggcauccuggauucaccaucauggccgcaauuuuggccuacacaaucggcaccacgcacuuucagcgggcucucauuuucauccugcugacugcaguggccccaucgaugacaaugcgcugcauaggcauuucaaacagagauuuuguugaaggggugagcggagguaguugggucgacaucgugcucgagcacggcuccuguguaaccacuauggcuaagaauaagcccacauuagauuucgaacugauuaaaaccgaggccaagcagccugcgacgcuuaggaaauauugcaucgaagcaaaguugaccaacacaacuaccgagucucgguguccaacacaaggggagcccagccugaaagaagaacaggacaagcgcuuuguuugcaagcauuccaugguggaucgaggauggggcaaugguugugggcuguucggaaaaggcggcaucgucacuugcgccauguuuaccugcaagaaaaacauggaagggaagauugugcagccugagaaucucgaauacacaauaguggucaccccacacucaggagaggagcaugcuguugguaacgacacuggcaaacacgggaaggaaaucaaagugacgccgcagaguagcauuacagaggccgaacugaccggauauggcacuguaaccauggaguguucucccagaacaggucuugauuucaaugaaauggugcuguugcaaauggagaacaaggcauggcucguccacaggcagugguuucuggacuuaccucugccauggcuccccggggcugauacccagggcuccaauuggauccagaaggagacucuugugacauucaaaaacccucaugccaagaaacaagacguugugguccugggaucacaggaaggcgcgaugcacacggccuugaccggggcaacugagauacagacaagcaguggaaaucuacuguuuaccggucaucucaagugccggcugcguauggacaaacuucaacugaagggcaugucuuacuccauguguacagggaaguucaaagugguaaaggaaauugcugagacucagcacggaaccaucguuauccgcgugcaguaugagggcgaugguagcccaugcaggauucccuucgaaaucauggacuuggagaaaagguacguccucgggcggcugauuacggugaacccgauagucaccgaaaaggauucgccugugaacaucgaggccgaacccccauuuggcgacucuuacauuaucaucggaguugagccuggccaguuaaaacugaauugguucaagaagggguccucaauuggacaaauguuugagacaacuaugcgaggugcuaaacgcauggccauacuaggcgauaccgcaugggacuucgggagucucggaggcguguuuacaagcaucgguaaggcccugcaucagguauucggggcuauuuauggcgcggcauuuuccggagucucuuggacuaugaaaauccuuauuggcgugaucauaaccuggaucgggaugaacagcagaucaacgaguuuguccguuagccuggugcucgucggaauugugacacuguaccuuggcguaauggugcaggccgauucugguuguguugucucauggaagaauaaagaacugaagugcgggaguggaaucuucauuaccgacaacgugcacacuuggacagagcaguauaaguuucaacccgaaagcccauccaaauuggcuucugccauccagaaggcacaggaggaaggcauaugugguauuaggucggugacccggcucgagaaucugauguggaaacagaucacucccgaguuaaaccacauucuggccgaaaaugaggucaagcuaaccaucaugacaggcgauauaaaagggaucaugcaugcuggaaagcgcagccucagaccucaaccaacggaacugaaauacuccuggaagaccuggggcaaggccaaaaugcuuucaacugagagucacaaccagacauucuugauugacgggccggaaaccgcagagugccccaauacaaacagggcguggaacucucuggagguugaagauuauggauuuggcguguucacuaccaacaucuggcucaagcugaaagagaagcaggacgcuuuuugugacagcaaauuaauguccgccgcaauuaaggauaaucgugccgugcaugcugacauggguuacuggaucgaaucagcccugaacgauacguggaagauagagaaagccagcuucauugagguaaagaauugccacuggccuaaaucucacacacuuugguccaacggggucuuggaaagugagaugaucaucccaaagaaccucgcuggacccgugagccagcauaauuaucggccuggcuaccacacccaaauugccgguccauggcaucugggcaaacuagaaauggacuucgauuuuugugacgggacuaccguuguggucacagaggauugcggaaaccgaggccccucucugagaacuaccacagcguccgggaagcucaucacggaauggugcuguaggucaugcacccugccgccucuucgcuaccggggagaggacggcuguugguaugguauggagauuagaccauugaaggaaaaagaggaaaaucuggugaacaguuuaguuacugccgggcacggacagguggauaauuucagccucggcguacuggguauggcucuuuuucuggaggaaauguugaggacacgcgucggcaccaagcaugcaauacuccugguggccgugucguucgucacucuaaucacagggaacauguccuuuaaagaccugggacgaguugugguaauggugggcgcuaccaugacggaugacauugggaugggagucacuuaccucgcccugcuugcagcguucaaggugcggcccaccuuugccgcuggcuugcuguuacguaaacucacaucuaaggagcugaugaugaccacuaucgguauuguucuucugagccagucaacaaucccugagaccauacuagaacucacagaugcccuggcauuggggaugauggugcugaagaucgucagaaauauggagaaauaucaauuagcugugacuauuauggccauccucugcguucccaacgcagugauucugcagaaugccuggaaggucaguuguaccauccuugcuguaguguccguuucuccacugauauugacgagcucccagcagaaaacagacuggauuccucucgcgcugaccaucaagggacuaaaccccacugccaucuuccugaccacacuuucaaggacuaauaaaaagcgcagcuggccacucaacgaagcaauuauggcugugggcauggucaguauacuggccucuuccuugcugaaaaaugacaucccgaugaccggcccuuuaguggccgggggacuccugacgguaugcuacgugcuuacaggucggagcgcugaucuggaguuggaaagagcaaccgacgucaagugggaggaucaagccgagauuucgggcucaucucccauccucaguauuacuaucuccgaagacgggagcaugucuauaaagaacgaggaagaggagcagacacugaccauccuaauuaggacuggacugcuuguuaucagcggccucuuuccaguguccauucccaucacagcggcugccugguaucugugggaagugaaaaagcagcgagccggugucuugugggaugugccuucaccacccccuauggggaaagccgaguuagaagacggagcuuaccgcauaaagcagaaaggcauucugggcuauagucaaaucggggcaggaguuuacaaggaggguaccuuccacacgauguggcacguaacucggggcgccgugcucaugcauaaggggaaaagaaucgaaccgagcugggcggaugucaagaaagaccugauuucuuacggaggcgguuggaaacuugagggggaguggaaagaaggagaggaagugcagguucuggcuuuggagccaggcaagaaucccagggccgugcagaccaagccuggccuauuuaaaacaaacaccgggacaaucggagcagucucccuggauuucucaccagguacaaguggcagccccauaauugacaagaaagggaaggugguaggacucuauggcaacggugucgugacccguuccggggccuacguuucugcuaucgcccagacggaaaaaucgauugaggauaauccugagaucgaagacgauauauuucgcaagcggagacugacaauuauggaccuucacccgggagcaggcaagacuaaaagguauuuacccgcuaucgugcgagaggccaucaagcggggccugcgcacccucauuuuggcgccaacaagagucguggccgcagaaauggaggaagcucugagggggcucccuauccgguaccaaacccccgccauucgagcugagcauacuggaagagagauaguugaccugaugugucacgcaaccuucacaaugcgccuucugagcccagugagggucccuaacuauaauuugaucauuauggaugaagcccauuucacggaccccgccucaaucgcugcgcgugguuacaucuccacucggguggagaugggcgaagcagccgggauuuuuaugaccgcuacaccaccgggaaguagagauccuuucccccagucuaacgccccaauaaucgacgaggagagggaaauucccgagcgcagcuggaacuccggccacgaauggguaaccgauuuuaaagguaagacugugugguucguuccuucaaucaaagcagggaacgacauugccgcuugccuacgaaagaauggaaagaaagucauccagcugucuagaaagacauuugauagcgaguaugugaaaacccggacgaacgacugggauuucguggucacuacagacauaagugaaaugggcgcgaauuuuaaggccgagaggguaaucgauccacgccguuguaugaaacccgugauucucaccgacggcgaggaaagaguuaucuuagcagggccuaugccggugacccacuucuccgcugcccaacggaggggacgcauuggucgaaacccaaagaaugagaacgaccaguacaucuacaugggcgaaccccuggagaaugaugaagacugcgcacauuggaaagaggccaagaugcuucuggauaacauaaauacuccugaggggauuauccccagcauguuugaaccagagagagaaaaggucgacgcuauugauggagaguaucggcucaggggcgaagcccgcaaaacauucguggacuugaugagaaggggugaucugccuguuuggcucgcguacaagguggcagccgaggggaucaacuaugcugaccggcguugguguuuugauggcaucaagaauaaucagauccuggaggaaaacgucgagguggaaauuuggaccaaggagggagagcgcaagaaacuuaaaccccgauggcuagacgccagaaucuacucugauccacuggcuuugaaagaguucaaggaguucgcagccggcaggaaaucauuagcucugaaucucauuacagaaauggggcggcugccuacuuuuaugacgcagaagacccgcgacgcccuugauaaccuggcaguacuccacacagcggaggccggagguagagcuuauaaucaugccuuguccgaacugccggagacucuagagacccugcuccuucugacauuauuggcaaccgugacuggcgggaucuuccuguuucucaugaguggaaggggcauagguaaaaugacgcuggggaugugcugcauuaucaccgcuagcauccuucugugguacgcccaaauucagccccacuggaucgcagccucgauaauucucguuuucuuuuugaucguccuguuaauuccagaaccugagaagcagcggacaccccaggacaaccaacuaacuuauguggugaucgcuauacugaccgucguugcggccacaauggcaaaugaaaugggcuuccucgagaagaccaaaaaggaccuuggauuuggcucuaucgcuacucagcagccagaauccaacauucuggauaucgacuugcgaccugccagcgccuggacacuguacgcaguggcuacgaccuucguaacucccaugcucagacacucaauugagaauaguucugugaacgucucccugacagccaucgcgaaucaggcuaccgugcuuauggggcucggaaaagguuggccgcugagcaagauggauauuggcguuccauugcuggccaucggguguuacucacaagugaacccuauaaccuuaacagcagcccuacugcuccuugucgcucauuaugcaauuaucggacccggccugcaggccaaagcgacucgcgaggcucagaagagggccgcagccgguaucaugaagaauccaacgguagacgggauuaccgugauagauuuggaccccaucccuuacgauccgaaauuugaaaagcagcugggccaaguuaugcuccuggugcuuugcgucacacagguguuaaugaugcggacuaccugggcucugugugaggcccucacauuggcaaccggacccauuaguacucugugggaaggcaacccagggcguuucuggaauacgacaaucgcugucagcauggccaacauuuuuagaggauccuaucuagcgggcgccggucuacucuucucuaucaugaaaaauaccacuaacaccaggcgcgggacaggaaacauaggcaagacucuuggugagaaauggaaaagccggcugaaugcauugggcaaaaucgaauuucagauuuacaagaaguccgggauccaagagguggaccgaacccuggcuaaagagggaauuaagagaggcgaaacagaucaccaugccguuucaagggggucugcaaaacuccgcugguucguggagcggaacaugguaacgccugaaggaaagguggucgaccugggcugcgguagagggggauggaguuauuacuguggcggucuaaagaauguucgugaggugaagggccuuaccaaagggggacccggccacgaggaaccuaucccaaugucgacuuauggguggaaccuggucaggcuccagagcggaguggauguauucuuuauacccccugagaaaugcgacacacuacugugugauauuggcgaauccucuccaaaucccaccguggaggcuggucggacuuugcgcguucugaaccucguggaaaauuggcuuaacaauaacacacaguucugcaucaagguccugaauccguacaugccuucagugaucgagaaaauggaggccuugcagcgaaaguacgggggagcccuggucagaaacccacucagcagaaauuccacccaugaaauguauugggugaguaacgcgucuggcaauauuguuagcucaguaaacaugauaucccggauguuaaucaaccgcuuuacgaugagacacaaaaaggcuaccuacgagcccgacguggaccugggcagugggacaaggaauauuggaaucgaaagcgagauuccuaaccuugauaucauagguaagcgaaucgagaaaauuaagcaagaacacgagacuucuuggcauuaugaccaggaucacccauacaaaaccugggcauaucauggcuccuacgaaacaaagcagacugggucagccagcucgauggucaauggagugguucggcugcuaaccaaacccugggacgugcucccgacagucacccagauggcuaugacugauacgacaccuuucggccaacagcguguguuuaaggagaagguagacaccagaacucaggaacccaaagaggguaccaagaaacugaugaagaucacagccgaaugguuguggaaagagcuggggaagaaaaagacgccacgcauguguaccagggaggaguucacucggaaggugagaucuaacgcagcccucggagcuauuuuuacagaugagaauaaauggaagagugcgcgcgaagccguugaggacuccagguucugggagcuugucgauaaagaacgaaaccugcacuuagagggcaagugcgaaaccuguguguauaauaugaugggcaaacgggagaagaagcugggggaauuuggaaaagcaaaggguagcagagcuaucugguacaugugguugggcgccagguuccucgaguuugaggcacugggguuccuaaacgaagaccacugguuuucacgcgaaaauucccuuucuggaguggaaggcgagggucugcauaaacucggguacauucugcgugaugucagcaagaaagaaggaggcgccauguaugcugacgacacugccggcugggauacacggauaaccuuggaggaccugaagaacgaggaaaugguuacaaaucacauggagggggaacauaagaaacucgcggaggcaaucuucaaacuuacuuaccagaacaaagugguaagagugcaaaggccuacaccccgcggaacggucauggauauuaucagucgacgggaccagagagguuccggccagguggggaccuauggacugaauacauucacuaacauggaagcccaauuaaucaggcagauggagggcgaggguguuuuuaagaauauucagcaccugaccgcuacagaagagauagccgugcagaacugguuggcacgcgucgggagagaacggcucagcaggauggcuaucucuggagaugacugcgugguaaaaccacuggaugaccguuucgccucagcucuaacugcccuuaacgauaugggcaagauucgaaaggacauccaacagugggagcccagucgcggcuggaaugauuggacccagguuccuuuuugcucccaucacuuccacgagcugauuaugaaagacgggagagugcucgucgugccaugucggaaccaggaugaacugaucggaagggcacgcauaagccaaggugcgggcuggucuuugagagagacggccugcuuagggaagucguacgcucagauguggucacugauguauuuucaucggagggaccuccgacuugccgcaaaugcuaucuguagcgccgugccgucccacuggguccccacaagucguaccacuuggucuauucaugcaaaacacgaauggaugacaaccgaggacaugcugacuguuuggaacagaguguggauccaggaaaauccuuggauggaggauaagaccccaguagagagcugggaagagauucccuaccuaggaaaacgcgaagaccaguggugcggcucccugaucggucucacaucacgggccacgugggcgaagaacauacaagcugccauuaaucaggugaggaguuugaucgggaacgaggaauauaccgauuacaugccuucuaugaagagauuccgccgggaggaggaagaggcaggaguccugugguga

SEQ ID NO: 15080 - RNA, 9873 nt, Artificial Sequence
  derived and/or modified CDS sequence (opt3) from DENV-3__AB189125__SS-prME
accagccugugccucaugaugaugcuucccgcaacucuggcuuuccacuugacuuccagagacggagaaccuaggaugaucguggggaagaacgaacggggaaagucuuuacuguuuaagacggcaucagguauuaauauguguacccugauagccauggaucucggcgagaugugcgacgauacagucacuuacaaguguccacugaucaccgaaguugagccggaagacauugauugcugguguaaccuuacaaguaccugggugacuuaugggacaugcaaucaggcgggagagcaucgccgagacaagcguagcguagcucuggcaccccacgugggcauggguuuggauaccagagcacagacguggauguccgccgagggggcuuggaggcaggucgaaaaaguggagacuugggcauuccggcauccuggauuuaccauccucgcccuguuccuggcucacuacauuggcacaucucucacucagaagguugugaucuuuauauuacugaugcuugucaccccaucgaugacaaugcgcugugugggcguagggaacagagacuucguugaaggauugucaggugccaccuggguggaugucgugcuggagcauggcgggugcgugacgacuauggcgaagaauaaacccacacuagacaucgagcuccagaagaccgaagcaacucaacuggccacacuuaggaaacuguguauugagggaaagaucaccaacgucacgaccgauagccggugcccuacacagggcgaagcuauuuugccagaggaacaggaccagaauuauguuuguaaacacacuuacguggaucgcgguugggggaacggaugcggccucuuuggcaaggggagucugguaaccugcgccaaguuccaauguuuagagcugaucgagggaaaagugguccagcacgaaaaucucaaguauacagugauaauuacuguucauaccggugaccagcaccaggugggcaacgagacacaaggggucaccgcagaaaucacuccccaggcuuccacgguggaggccauucuuccugaauacggaacacugggcuuggagugcucuccacgaaccggucuagacuuuaaugagaugauccugcucacuaugaaaaacaaggcguggaugguacauagacagugguucuuugaucugccgcuucccuggaccagcggggccacaaccgaaacuccuacauggaauaaaaaggagcuguugguuacguucaaaaacgcacacgcuaagaagcaagaaguggucgugcucggcucccaggagggagccaugcacaccgcucugacuggcgccacagaaauccagaccucagggggaacaaguauuuuugcaggucauuuaaaauguaggcugaagauggacaaacuagagcucaagggcaugagcuaugccaugugcucuaaugcuuucguccugaaaaaggagguguccgaaacucagcacgggaccauacuuaucaagguugaguacaaaggagaagaugcgccauguaagauucccuucucaacggaggacggccaagguaaagcacauaacgggcgguugaucaccgccaacccugugguaacaaagaaagaggaaccagucaauauagaggcugaacccccguuuggcgagagcaacauuaucaucggaauuggcgauaaggcccugaagaucaauugguacaaaaaggggaguucuauuggaaaaauguucgaagcaacugcccguggugcucgcagaauggccauacucggcgacaccgcaugggauuuuggguccgugggaggcguucugaacagccuugguaagauggugcaccagaucuucgggucggcguauacagcucuguuuucuggcgucuccuggauuaugaaaaucggaaucggcguguugcucacuuggauugggcuaaauucaaagaacaccaguaugagcuucuccugcauaguaaucggaauuaucacguuauaccugggcgccgugguucaggcagacauggguugugucauuaauuggaaggggaaagagcuaaagugcggaucuggcaucuuugugacaaacgaggugcauaccuggacugaacaguauaaauuccaagccgauagcccuaagaggcucgcuacagccauagccggugcuugggagaauggcgucugugggauccggucaaccacucgaauggaaaaccugcuuuggaaacagauugccaaugaguugaacuacauccugugggaaaauaacauuaagcucaccguuguggugggagacaucauaggcauucuggagcaggggaaacgcacauuaacgccccagccaauggagcugaaguauaguuggaagaccuggggaaaagcgaagaucguaacugccgaaauucaaaauuccagcuuuaucauagauggcccuaacacacccgagugcccaaacgcuucuagagcauggaaugucugggaaguggaggacuacgguuucgggguuuuuaccacaaacaucuggcuuaaauugagggaaauguauacucagcucugugaccaccggcugaugucagccgcugugaaggaugagcgcgccguccacgcagacaugggauacuggauugagagucagaaaaauggcagcuggaagcuagaaaaggcgucccugaucgaggugaaaaccugcacguggcccaagucucauacacucuggucgaacgguguucuggaaagcgauaugauuaucccuaaaucccuugccggcccaauaucacagcacaauuacagaccgggguaucauacccaaacugcuggacccuggcacuugggcaagcuggaguuagacuucaacuacugcgaggggaccacagugguaauuacugaaaauuguggaaccaggggcccuagucuccguacaacgaccgucucugguaaacugauccacgaguggugcugucggagcugcacucuuccaccccugcgauauaugggggaagauggauguugguacggcauggagaucagaccuauuaacgaaaaggaggagaauauggugaaguccuuggugucagccgguagcggcaaagucgacaacuuuacaauggggguucucugccuggcaauccuauucgaagaggugaugaggggaaaguucggcaaaaagcauaugauugcugggguacuguuuaccuucgugcuccugcuuucuggacagauaacuuggcgcgauauggcccggacauugaucaugauuggcuccaaugcaagugacagaauggguaugggggucaccuaucuggccuuaaucgcuacguuuaaaauucagccauuccucgcgcugggauuuuuccuuaggaagcugacuagccgcgaaaaccuacuccugggcgugggcuuggccauggcaaccacacugcaauuacccgaggauaucgaacagauggcuaaugggauagcccucggacugauggcccuuaagcugaucacccaguuugagacuuaccaguuguggacagcucucguuucucugauguguuccaacaccauuuucacacuaacuguggcauggcgaaccgccacgcugauccuugcggguauuucacuccugccggucugccaaaguagcucgaugcggaaaacagacugguugccuaugaccguggcugccaugggcguuccaccccugccuuuauuuaucuucucccucaaggauacucugaaacguagaucuuggccccuuaaugagggggugauggcagucggacugguaagcauauuggccucaagucuccugaggaacgacgugccaauggcuggcccucuaguugccggugggcugcuuauugccuguuaugugaucaccggaacauccgcggaucucacugucgaaaaggcugccgacgugaccugggaggaagaggcagaacagacgggcguaucucacaaccugaugaucacaguggacgaugacggcaccaugcgcauuaaagaugacgagacugagaauauauugacagucuuacugaagaccgcccuccugaucguuagcgggauuuuucccuacuccaucccagcuacucuucugguguggcauacauggcagaaacagacccaacggucaggaguguugugggaugucccgagcccucccgaaacgcagaaggccgagcuagaagaggguguguacagaauuaagcagcagggcaucuucgggaaaacucaaguuggaguaggcgugcagaaggagggugucuuucacaccauguggcaugugacaagaggggcaguucugaccuauaacggaaaacgacucgaaccaaguugggcuucugugaagaaagaccugauauccuacggcggcggguggcgccuuagcgcccaguggcaaaagggagaggaaguccaggugaucgcgguagagcccgguaagaauccuaaaaacuuccagacaaugccaggcauuuuccagacuaccacgggggaaaucggagccauugcauuagauuuuaagcccggcacaucggguucaccuaucauaaaucgggaggggaaagucgugggacuguauggcaacggcguugugacuaagaaugggggauacgucucugguauugcucaaaccaacgccgagccggacggcccaacacccgaacucgaggaagagauguucaaaaagagaaauuugaccaucauggaucugcacccugggaguggaaagacuaggaaauaucucccagcuaucgugcgugaagcaauuaagcgccggcugagaacccuuauccuggcccccacaaggguuguggccgcugagauggaggaagcguugaaaggccuaccuauacgauaccagacgacugcaaccaaguccgagcacacagguaaagaaauugucgaccugaugugccaugccaccuuuacuaugcggcucuuaagcccggugcgcguacccaacuauaaucugaucauuauggaugaggcucacuucacagacccagccucuaucgcagccagaggguacauaagcaccagggugggaaugggcgaagcugcggccauuuuuaugacggcaacuccucccggcacagcugaugccuucccacaguccaacgcaccuauccaggacgaggagcgggacauccccgaacgaucauggaauagugggaacgauuggauuaccgacuuugccggaaagaccguuugguucgucccaagcaucaaggcugguaaugauauugccaacugucuuaggaagaacggcaagaaagugauacaacugucucgcaagacuuuugacacagaguaccagaaaaccaagcucaaugauugggacuucguggucacaacugauaucuccgaaaugggggcgaacuuuaaggcagacaggguaauugauccgcgucggugcuugaaaccugugauccugacggacggacccgagagaguuauccucgccggcccaaugcccgugaccgucgcuucagccgcucagaggcgcggucgaguggggagaaauccucagaaggagaacgaucaauauauuuucacaggccagccacugaauaacgacgaagaccaugcacacuggacugaggccaaaaugcuucuagauaauauaaacacccccgaaggaaucauuccugcucuguucgagccggaacgggagaagagugccgcaaucgacggcgaguacagguugaaaggggaaagccgcaagacauuuguugaguuaaugcguagaggagaucugccaguguggcucgcgcauaaagucgccuccgaagguauuaaguauaccgaccggaaguggugcuucgauggcgagaggaauaaccagauccuggaagagaauguggacguagagauauggacuaaagaaggggagaagaagaaacuucgcccccgauggcuggaugcuagaacguacucugacccucucgccuugaaagaauuuaaagauuucgcagcuggacggaagucgaucgcccuggaccuagugaccgagauuggcaggguucccagccaccuggcacaccgcacaagaaacgcccucgauaaucuugucaugcugcauacuucagaacacggugggagggcuuaucggcaugcgguggaggaguuaccagaaaccauggagacauugcugcuccugggccuuaugauccugcucaccggaggcgugauguuguuucugauuuccgggaaaggagucgguaagacaaguaucggcuuaauauguguuguggccucuagcgggaugcuauggauggcagacauuccucugcaguggaucgcuuccgccauuguacucgaguucuuuaugauggugcuucugauccccgagccagagaaacaacguacaccucaggauaaccaguuggccuacgucgugauaggaauccugacgcucgcagcuauuguugccgcgaaugaaaugggccugcuugagaccacuaagcgcgaccucgguaugucaaaagaaccggggguggucucucccacaagcuaucuggacguagauuugcacccagcuagugccuggacccuguacgcaguggccaccacaguuaucacuccuauguuacgacacacgauugagaacuccaccgcuaaugugagccuagcagccaucgcgaaccaagcugucgugcugaugggccucgacaagggauggcccauaucuaagauggaucuuggcgucccacuguuggcccuggggugcuacucacaggugaacccucucacacugacugcagccguucuuuuacuggugacccauuaugcuauuaucggacccggccuccaggccaaagcaacaagagaagcucagaagaggaccgccgcggguaucaugaaaaauccgacuguagacgggauuaugacgaucgauuuggacccagugauauacgauuccaaguucgagaaacaacugggacaggucaugcuacugguucucugugccgugcagcuucuguugaugcggacaaguugggcauuuugcgaggcucugacccucgccacuggcccuauuaccacacugugggaagguagccccggcaaguucuggaacacuaccaucgcagucucgauggcuaauauuuuucgcgggucuuauuuagccggagccggccuugcguucuccaucaugaaaagcguggggacaggaaaaagaggcacggguucacagggggagacccugggagaaaaguggaaaaagaaacucaaccaacuaaguaggaaggaguuugaccuguacaaaaagucuggcauaacugaaguagaucggacagaggcuaaggaggguuugaaacgaggcgaaaucacccaccaugcaguguccagagggagcgccaagcugcagugguucguugagcgcaauauggugauuccagaaggaagggucaucgaccucggcugugggcggggaggcuggucauauuacugcgcuggucuuaaaaaggugacugagguccguggguauacaaaaggaggccccggccacgaagaaccugugccgaugaguaccuacggguggaacauuguuaagcugaugagcggaaaggauguauucuacuugcccccagagaaaugugacacgcugcucugcgauaucggugaauccucuccuagccccaccguggaggaauccagaacaauuagggucuuaaagaugguggagccuuggcugaaaaauaaccaguuuuguaucaagguucuuaauccauauaugcccgccgugauagagcaucuggaacgccuacagcggaaacacggcgggaugcucguccgaaacccucugucaagaaauucuacucacgagauguacuggauuaguaacggaaccggcaauaucgugucgagcguaaacaugguguccagguugcugcucaaucgcuucacaaugacuuaucggagaccaaccaucgaaaaggacguugaccuuggugcagggacacgucaugucaacgccgagcccgaaaccccgaacauggaugugauuggagagaggauacggcgcaucaaggaggaacacucuucaacuuggcauuacgacgaugagaauccuuauaaaacgugggcuuaccacggcagcuaugaagugaaggcgacaggcuccgccaguucuaugauuaacggggucguuaaacuguuaaccaagccaugggacgugguacccacugugacccaaauggcaaugacagauacgaccccuuuuggacagcagcgagucuucaaagagaagguggacacuagaacaccaaagcccaugccggguaccaggaaaguuauggaaaucacugcugaguggcuguggcggacauugggccgcaauaagagaccuaggcucugcacccgagaggaauuuacuaagaaggugcggacuaacgccgcaaugggggccgucuucaccgaggaaaaucaaugggauagcgcucgugccgcgguggaggacgaagaguuuuggaaacugguagauagagagcgcgaacuacacaaacuuggaaaauguggcucaugcguuuacaacaugauggguaagagggagaagaaacugggggaguucggaaaggcaaaaggcucccgggccauuugguacauguggcucggcgcuagauaucuggaguuugaggccuugggguuccugaaugaagaccauugguuuagucgcgagaacagcuacucuggaguggaaggugagggccuccacaaacuuggguauauccugagggauauauccaaaauccccggaggcgcaauguacgcugacgacacggccgguugggauacccgaauuacagaagacgauuuacauaaugaggagaagaucacucagcagauggacccagaacaccggcagcuggcuaacgccauuuucaaguugaccuaucaaaauaaagucgugaaggugcagagaccuacacccaaagggacugucauggauaucauaucaaggaaggaccagcgcggaagcggccagguuggcaccuacgggcucaacacguuuacaaauauggaggcacaacugauucgucagauggaaggagagggugugcuaucgaaaaccgaucuugaaaacccacaucugcucgagaagaagaucacucaguggcuggagacaaaaggcguagaacgguugaagagaauggcgaucucuggggacgauugcguggucaaacccauugacgauagguucgccaaugcuuuacuggcccucaacgacaugggaaaggugcgcaaagauauaccucaguggcaaccaaguaagggcuggcacgacuggcagcagguuccguucuguucccaccauuuucacgagcuuaucaugaaggacggucgaaaacuggugguccccugccggagccaggaugaacuaauugggagagcaaggaucucacaaggagcuggcuggucccugaaggagaccgccugucucggcaaagcauaugcccagaugugggcguugauguacuuccaucgcagagaccugcggcuugcuucuaacgccauuugcagcgcagugccuguacacuggguuccaacaaguaggaccacaugguccauccacgcccaucaccaguggaugacgaccgaagauaugcugacuguguggaaucgugucuggauagaggacaaccccuggauggaggauaagacaccugugaccacuugggaagacguuccauaccucgggaaacgagaggaucaaugguguggcagcuuaaucggucugacaucucgcgcuaccugggcccagaauauuuugacggcaauccaacaggugagaucacugauuggcaacgaagaguuucucgacuauaugcccaguaugaagcgguucaggaaggaggaagaguccgaaggggcuaucugguga

SEQ ID NO: 15081 - RNA, 9873 nt, Artificial Sequence
  derived and/or modified CDS sequence (opt3) from DENV-3__AB189126__SS-prME
accagccugugccucaugaugaugcuucccgcaacacuggcuuuccacuugacuuccagagacggagagccuaggaugaucguggggaagaacgaacggggaaagucuuuacuguuuaagacggcaucagguauuaauauguguacccugauagccauggaucucggcgagaugugcgacgauacagucacuuacaaguguccacugaucaccgaaguugagccggaagacauugauugcugguguaaccuuacaaguaccugggugacuuaugggacaugcaaucaggcgggagagcaccgccgagacaagcguagcguagcucuggcaccccacgugggcauggguuuggauaccagagcacagacguggauguccgccgagggggcuuggaggcaggucgaaaaaguggagacuugggcauuccggcauccuggauuuaccauccucgcccuguuccuggcucacuacauuggcacaucucucacucagaagguugugaucuuuauauuacugaugcuugucaccccaucgaugacaaugcgcugugugggcguagggaacagagacuucguugaaggauugucaggugccaccuggguggaugucgugcuggagcauggcgggugcgugacgacuauggcgaagaauaaacccacacuagacaucgagcuccagaagaccgaagcaacucaacuggccacacuuaggaaacuguguauugagggaaagaucaccaacgucacgaccgauagccggugcccuacacagggcgaagcuauuuugccagaggaacaggaccagaauuauguuuguaaacacacuuacguggaucgcgguugggggaacggaugcggccucuuuggcaaggggagucugguaaccugcgccaaguuccaauguuuagagcugaucgagggaaaagugguccagcacgaaaaucucaaguauacagugauaauuacuguucauaccggugaccagcaccaggugggcaacgagacacaaggggucaccgcagaaaucacuccccaggcuuccacgguggaggccauucuuccugaauacggaacacugggcuuggagugcucuccacgaaccggucuagacuuuaaugagaugauccugcucacuaugaaaaacaaggcguggaugguacauagacagugguucuuugaucugccgcuucccuggaccagcggggccacaaccgaaacuccuacauggaauaaaaaggagcuguugguuacguucaaaaacgcacacgcuaagaagcaagaaguggucgugcucggcucccaggagggagccaugcacaccgcucugacuggcgccacagaaauccagaccucagggggaacaaguauuuuugcaggucauuuaaaauguaggcugaagauggacaaacuagagcucaagggcaugagcuaugccaugugcucuaaugcuuucguccugaaaaaggagguguccgaaacucagcacgggaccauacuuaucaagguugaguacaaaggagaagaugcgccauguaagauucccuucucaacggaggacggccaagguaaagcacauaacgggcgguugaucaccgccaacccugugguaacaaagaaagaggaaccagucaauauagaggcugaacccccguuuggcgagagcaacauuaucaucggaauuggcgauaaggcccugaagaucaauugguacaaaaaggggaguucuauuggaaaaauguucgaagcaacugcccguggugcucgcagaauggccauacucggcgacaccgcaugggauuuuggguccgugggaggcguucugaacagccuugguaagauggugcaccagaucuucgggucggcguauacagcucuguuuucuggcgucuccuggauuaugaaaaucggaaucggcguguugcucacuuggauugggcuaaauucaaagaacaccaguaugagcuucuccugcauaguaaucggaauuaucacguuauaccugggcgccgugguucaggcagacauggguugugucauuaauuggaaggggaaagagcuaaagugcggaucuggcaucuuugugacaaacgaggugcauaccuggacugaacaguauaaauuccaagccgauagcccuaagaggcucgcuacagccauagccggugcuugggagaauggcgucugugggauccggucaaccacucgaauggaaaaccugcuuuggaaacagauugccaaugaguugaacuacauccugugggaaaauaacauuaagcucaccguuguggugggagacaucauaggcguacuggagcaggggaaacgcacauuaacgccccagccaauggagcugaaguauaguuggaagaccuggggaaaagcgaaggucgugacugccgaaauucaaaauuccagcuuuaucauugauggcccuaacacacccgagugcccaaacgcuucuagagcauggaauguuugggaaguggaggacuacgguuucggggucuuuaccacaaacaucuggcuuaaauugagggaaauguauacucagcucugugaccaccggcugaugucagccgcugugaaggaugagcgcgccguucacgcagacaugggauacuggauagagagucagaaaaauggcagcuggaagcuagaaaaggcgucccugaucgaggugaaaaccugcacguggcccaagucucauacacucuggucgaacgguguacuggaaagcgauaugauuaucccuaaaucccuugccggcccaauuucacagcacaauuacagaccgggguaucauacccaaacugcuggacccuggcacuugggcaagcuggaguuagacuucaacuacugcgaggggaccacagucgugaucacugaaaauuguggaaccaggggcccuagucuccguacaacgaccgugucugguaaacugauacacgaguggugcugucggagcugcacucuuccaccccugcgauauaugggggaagauggauguugguacggcauggagauuagaccuaucaacgaaaaggaggagaauauggucaaguccuugguuucagccgguagcggcaaaguggacaacuuuacaauggggguacucugccuggcaauccuauucgaagaggugaugaggggaaaguucggcaaaaagcauaugauugcugggauccuguuuauuuucguccuccugcuuucuggacagauaaccuggcgcgauauggcccggacuuugaucaugauuggcuccaaugcaagugacagaauggguaugggggugacauaucuggccuuaaucgcuaccuuuaaaauucagccauuccucgcgcugggauuuuuccuuaggaagcugacgagccgcgaaaaccuacuccugggcguuggcuuggccauggcaacuacccugcaauuacccgaggauaucgaacagauggcuaaugggauagcccucggacugauggcccuuaagcugaucacacaguuugagaccuaccaguuguggacugcucucgugucucugacauguuccaacaccauuuucacacuaacugucgcauggcgaaccgccacgcugauccuugcggguauuucacuccugccggugugccaaaguagcucgaugcggaaaacagacugguugccuaugaccguugcugccaugggcgugccaccccugccuuuauuuaucuucucccucaaggauacucugaaacguagaucuuggccccuuaaugagggggucauggcaguaggacuggugagcauauuggccucaagucuccugaggaacgacguuccaauggcuggcccucuaguggccggugggcugcuuauugccuguuaugucaucaccggaacauccgcggaucucacuguggaaaaggcugccgacguaaccugggaggaagaggcagaacagacgggcgugucucacaaccugaugaucacagucgacgaugacggcaccaugcgcauuaaagaugacgagacugagaauauauugacaguuuuacugaagaccgcccuccugaucgugagcgggauuuuucccuacuccaucccagcuacucuucugguguggcauacauggcagaaacagacccaacggucaggagucuugugggaugugccgagcccucccgaaacgcagaaggccgagcuagaagaggguguuuacagaauuaagcagcagggcaucuucgggaaaacucaaguaggagugggcguccagaaggaggguguguuucacaccauguggcauguuacaagaggggcagugcugaccuauaacggaaaacgacucgaaccaaauugggcuagugucaagaaagaccugauaucuuacggcggcggguggcgccuuuccgcccaguggcaaaagggagaggaagugcagguaaucgcggucgagcccgguaagaacccuaaaaauuuccagacaaugccaggcauuuuccagacuaccacgggggaaaucggagccauugcauuagauuuuaagcccggcacaagcgguucgccuaucauaaaccgggaggggaaagugguuggacuguauggcaauggcguggucacuaagaacgggggauacgugucagguauugcucaaaccaaugccgagccggacggcccaacacccgaacucgaggaagagauguucaaaaagagaaacuugaccaucauggaucugcacccugggucuggaaagacuaggaaauaucucccagcuaucguucgugaagcaauuaagcgccggcugagaacccuuauccuggcccccacaaggguggucgccgcugagauggaggaagcguugaaaggccuaccuauacgauaccagacgacugcaaccaagagugagcacacagguaaagaaauuguggaccugaugugccaugccaccuuuacuaugcggcucuuauccccgguacgcgugcccaauuauaaccugaucauuauggaugaggcucacuucacagacccagccagcaucgcagccagaggguacauaucuaccaggguuggaaugggcgaagcugcggccauuuuuaugacggcaacuccucccggcacagcugaugccuucccacagagcaaugcaccuauccaggacgaggagcgggacauccccgaacgauccuggaacucagggaaugauuggauuaccgacuuugccggaaagaccgucugguucgugccaaguaucaaggcugguaacgauauugccaacugucuuaggaagaauggcaagaaagugauacaacugagccgcaagacuuuugacacagaguaccagaaaaccaagcucaacgauugggacuucgucguaacaacugauaucucugaaaugggggcgaauuuuaaggcagacagggugauugauccgcgucggugcuugaaaccuguuauccugacggacggacccgagagagugauccucgccggcccaaugcccgucaccguggcuuccgccgcucagaggcgcggucgaguugggagaaacccucagaaggagaaugaucaauauauuuucacaggccagccacugaacaaugacgaagaccaugcacacuggacugaggccaaaaugcuucuagauaacauaaauacccccgaaggaaucauuccugcucuguucgagccggaacgggagaagucagccgcaaucgacggcgaguacagguugaaaggggaaagucgcaagacauuuguggaguuaaugcguagaggagaucugccagucuggcucgcgcauaaaguggccagcgaagguauuaaguauaccgaccggaaguggugcuucgauggcgagaggaacaaucagauccuggaagagaacauggacguagagauauggacuaaagaaggggagaagaagaaacuucgcccccgauggcuggaugcuagaacguacuccgacccucucgccuugaaagaauuuaaagauuucgcagcuggacggaagucuaucgcccuggaccuagugaccgagauuggcaggguucccucgcaccuggcacaccgcacaagaaaugcccucgauaaccuugucaugcugcauacuagcgaacacggugggagggcuuaucggcaugcgguggaggaguuaccagaaaccauggagacauugcugcuccugggccuuaugauccugcucaccggaggcgccauguuguuucugauuucagggaaaggaguggguaagacuuccaucggcuuaauaugugucguugcaaguucugggaugcuauggauggcugacauuccucugcaguggaucgccagcgccauugugcucgaguucuuuaugaugguacuucugauccccgagccagagaaacaacguacaccucaggauaaucaguuggcauacguggucauaggaauccugacgcucgcugccauuguggcggcuaacgaaaugggccugcuugagaccacuaagcgcgaccucgguauguccaaagaaccggggguugugcccccaacaucauaucuggacgucgauuugcacccugccucugcauggacccuguacgccguagcuaccacagugaucacucccauguuacgacacacgauugagaauagcaccgcaaacguuagucuagccgcgaucgcuaaccaagccgugguccugaugggccucgacaagggauggccaauauccaagauggaucuuggcgugccucuguuggcacuggggugcuacagccaggucaauccccucacacugacugccgcugugcuuuuacugguuacccauuaugccauuaucggaccgggccuccaggcaaaagcuacaagagaagcccagaagaggaccgcggccgguaucaugaaaaacccaacuguggacgggauuaugacgaucgauuuggacccuguaauauacgauucuaaguucgagaaacaacugggacaggugaugcuacugguccucugugcaguucagcuucuguugaugcggacaucaugggcuuuuugcgaggcccugacccucgcaacuggccccauuaccacacugugggaagguuccccaggcaaguucuggaauacuaccaucgcugugaguauggccaacauuuuucgcgggagcuauuuagccggagcgggccuugcuuucucgaucaugaagucugucgggacaggaaaaagaggcacggguucccagggggagacccugggagaaaaguggaaaaagaaacucaaucaacuaagcaggaaggaguuugaccuguacaaaaagucaggcauaacugaaguggaucggacagaggcaaaggaggguuugaaacgaggcgaaaucacccaccaugccguaaguagagggucugcuaagcugcagugguucguggagcgcaacaugguuauucccgaaggaagggugaucgaccucggcugugggcggggaggcugguccuauuacugcgccggucuuaaaaaggucacugaggugcguggguauacaaaaggaggcccuggccacgaagaaccgguccccaugagcaccuacggguggaauauugugaagcugaugucaggaaaggauguuuucuacuugccaccugagaaaugugacacgcugcucugcgauaucggugaaaguagccccuccccuaccguagaggaaucuagaacaauuaggguguuaaagauggucgagccauggcugaaaaacaaucaguuuuguaucaaggugcuuaaccccuauaugccuacuguuauagagcaucuggaacgccuacagcggaaacacggcgggaugcucgugcgaaauccacugagcagaaacuccacccacgagauguacuggauuucaaauggaacaggcaacaucgucucuagugugaauaugguaucgagguugcugcucaaccgcuucacuaugacccaucggagacccacaaucgaaaaggacguggaccuuggugcagggacccgucacguuaacgccgagccggaaacuccuaauauggaugucauuggagagaggauacggcgcaucaaggaggaacauagcuccacguggcacuaugacgaugagaacccauacaaaacaugggcuuaucacggcucuuacgaagugaaggcgaccggcucagccagcuccaugauuaaugggguggucaaacuguuaacuaagcccugggacguugugccuaccguaacacaaauggcaaugacggauaccacuccauuuggacagcagcgaguguucaaagagaaggucgacacaagaacccccaagccgaugccugguacuaggaaagugauggaaaucacagcugaguggcuguggcggaccuugggccgcaacaagagacccaggcucugcacacgagaggaauuuacuaaaaagguucggaccaaugccgcaaugggggccguguucacggaggaaaaccaaugggauagugcucgugccgcggucgaggacgaagaguuuuggaaacugguggauagagagcgcgaacuacauaaacuuggaaaauguggcucuugcguauauaauaugauggguaagagggagaagaaacugggggaguucggaaaggcaaaaggcagccgggccauuugguacauguggcucggcgcuagauaccuggaguuugaggccuugggguuccugaacgaagaccacugguuuucacgcgaaaauuccuauaguggaguugaaggugagggccuccauaaacuuggguacauccugagggauauaagcaaaaucccaggaggcgcaauguaugcugacgacaccgccgguugggauacacgaauuacugaagacgauuuacacaacgaggagaagaucacccagcagauggacccugaacaucggcagcuggcuaaugccauuuucaaguugacauaccaaaacaaaguggucaaggugcagagacccacuccaaaagggaccgugauggauaucauaucuaggaaggaccagcgcggauccggccaggucggcacguaugggcucaauacauuuaccaacauggaggcacaacugauucgucagauggaaggagaggguguucuaucaaaaacugaucuugaaaauccccaucugcucgagaagaagaucacacaguggcuggagaccaaaggcguggaacgguugaagagaauggcgaucagcggggacgauugcguagugaaaccuauugacgauagguucgccaacgcuuuacuggcccucaacgacaugggaaagguccgcaaagauauaccacaguggcaaccgucgaagggcuggcacgacuggcaacaggugcccuucuguucucaucacuuucaugagcuuaucaugaaggacggucgaaaacugguugugccuugccggccacaggaugaacuaauugggagagcaaggaucagucaaggagcuggcuggucccugaaggagacugccugucucggcaaagcauacgcccagaugugggcguugauguauuuccaccgcagagaccugcggcuugcuagcaaugccauuugcucagcaguccccgugcacuggguaccuaccuccaggacaacguggucuauccaugcccaccaucaguggaugaccacugaagauaugcugacaguuuggaaccguguguggauagaggacaauccauggauggaggauaagacccccgucacuacaugggaagacgugccuuaccucgggaaacgagaggaucaaugguguggcagcuuaaucggucugaccagucgcgcuacgugggcccagaacauuuugacagcaauccagcagguuagaucccugauuggcaaugaagaguuucucgacuacaugccgagcaugaagcgguucaggaaggaggaggaacuugaaggggcuaucugguga

SEQ ID NO: 15082 - RNA, 9873 nt, Artificial Sequence
  derived and/or modified CDS sequence (opt3) from DENV-3__AB189127__SS-prME
accagccugugccucaugaugaugcuucccgcaacucuggcuuuccacuugacuuccagagacggcgagccuaggaugaucguggggaagaacgaacggggaaagucuuuacuguuuaagacggcaucagguauuaauauguguacccugauagccauggaucucggcgagaugugcgacgauacagucacuuacaaguguccacugaucaccgaaguugagccggaagacauugauugcugguguaaccuuacaaguaccugggugacuuaugggacaugcaaucaggcgggagagcaccgccgagacaagcguagcguagcucuggcaccccacgugggcauggguuuggauaccagagcacagacguggauguccgccgagggggcuuggaggcaggucgaaaaaguggagacuugggcauuccggcauccuggauuuaccauccucgcccuguuccuggcucacuacauuggcacaucucucacucagaagguugugaucuuuauauuacugaugcuugucaccccaucgaugacaaugcgcugugugggcguagggaacagagacuucguugaaggauugucaggugccaccuggguggaugucgugcuggagcauggcgggugcgugacgacuauggcgaagaauaaacccacacuagacaucgagcuccagaagaccgaagcaacucaacuggccacacuuaggaaacuguguauugagggaaagaucaccaacgucacgaccgauagccggugcccuacacagggcgaagcuauuuugccagaggaacaggaccagaauuauguuuguaaacacacuuacguggaucgcgguugggggaacggaugcggccucuuuggcaaggggagucugguaaccugcgccaaguuccaauguuuagagcugaucgagggaaaagugguccagcacgaaaaucucaaguauacagugauaauuacuguucauaccggugaccagcaccaggugggcaacgagacacaaggggucaccgcagaaaucacuccccaggcuuccacgguggaggccauucuuccugaauacggaacacugggcuuggagugcucuccacgaaccggucuagacuuuaaugagaugauccugcucacuaugaaaaacaaggcguggaugguacauagacagugguucuuugaucugccgcuucccuggaccagcggggccacaaccgaaacuccuacauggaauaaaaaggagcuguugguuacguucaaaaacgcacacgcuaagaagcaagaaguggucgugcucggcucccaggagggagccaugcacaccgcucugacuggcgccacagaaauccagaccucagggggaacaaguauuuuugcaggucauuuaaaauguaggcugaagauggacaaacuagagcucaagggcaugagcuaugccaugugcucuaaugcuuucguccugaaaaaggagguguccgaaacucagcacgggaccauacuuaucaagguugaguacaaaggagaagaugcgccauguaagauucccuucucaacggaggacggccaagguaaagcacauaacgggcgguugaucaccgccaacccugugguaacaaagaaagaggaaccagucaauauagaggcugaacccccguuuggcgagagcaacauuaucaucggaauuggcgauaaggcccugaagaucaauugguacaaaaaggggaguucuauuggaaaaauguucgaagcaacugcccguggugcucgcagaauggccauacucggcgacaccgcaugggauuuuggguccgugggaggcguucugaacagccuugguaagauggugcaccagaucuucgggucggcguauacagcucuguuuucuggcgucuccuggauuaugaaaaucggaaucggcguguugcucacuuggauugggcuaaauucaaagaacaccaguaugagcuucuccugcauaguaaucggaauuaucacguuauaccugggcgccgugguucaggcagacauggguugugucauuaauuggaaggggaaagagcuaaagugcggaucuggcaucuuugugacaaacgaggugcauaccuggacugaacaguauaaauuccaagccgauagcccuaagaggcucgcuacagccauagccggugcuugggagaauggcgucugugggauccggucaaccacucgaauggaaaaccugcuuuggaaacagauugccaaugaguugaacuacauccugugggaaaauaacauuaagcucaccguuguggugggagacaucauaggcguacuggagcaggggaaacgcacauuaacgccccagccaauggagcugaaguauaguuggaagaccuggggaaaagcgaaggucgugacugccgaaauucaaaauuccagcuuuaucauugauggcccuaacacacccgagugcccaaacgcuucuagagcauggaauguuugggaaguggaggacuacgguuucggggucuuuaccacaaacaucuggcuuaaauugagggaaauguauacucagcucugugaccaccggcugaugucagccgcugugaaggaugagcgcgccauacacgcagacaugggauacuggaucgagagucagaaaaauggcagcuggaagcuagaaaaggcgucccugauugagguuaaaaccugcacguggcccaagucucauacacucuggucgaacggugugcuggaaagcgauaugaucauuccuaaaucccuugccggcccaaucucacagcacaauuacagaccgggguaucauacccaaacugcuggacccuggcacuugggcaagcuggaguuagacuucaacuacugcgaggggaccacaguagucauaacugaaaauuguggaaccaggggcccuagucuccguacaacgaccgugucugguaaacugauucacgaguggugcugucggagcugcacucuuccaccccugcgauauaugggggaagauggauguugguacggcauggagaucagaccuaucaacgaaaaggaggagaauauggugaaguccuuggucucagccgguagcggcaaaguugacaacuuuacaaugggggugcucugccuggcaauucuauucgaagagguaaugaggggaaaguucggcaaaaagcauaugaucgcugggauucuguuuauguucgugcuccugcuuucuggacagauaaccuggcgcgauauggcccggacuuugaucaugauuggcuccaaugcaagugacagaauggguaugggggucacauaucuggccuuaaucgcuaccuuuaaaauucagccauuccucgcgcugggauuuuuccuuaggaagcugacgagccgcgaaaaccuacuccugggcgugggcuuggccauggcaacuacccugcaauuacccgaggauaucgaacagauggcuaaugggauagcccucggacugauggcccuuaagcugaucacacaguuugagaccuaccaguuguggacugcucucguuucucugacauguuccaacaccauuuucacacuaacuguggcauggcgaaccgccacgcugauccuugcggguauuucacuccugccggucugccaaaguagcucgaugcggaaaacagacugguugccuaugaccguggcugccaugggcguuccaccccugccuuuauuuaucuucucccucaaggauacucugaaacguagaucuuggccccuuaaugagggggugauggcagucggacugguaagcauauuggccucaagucuccugaggaacgacgugccaauggcuggcccucuaguugccggugggcugcuuauugccuguuaugugaucaccggaacauccgcggaucucacugucgaaaaggcugccgacgugaccugggaggaagaggcagaacagacgggcguaucucacaaccugaugaucacaguggacgaugacggcaccaugcgcauuaaagaugacgagacugagaauauauugacagucuuacugaagaccgcccuccugaucguuagcgggauuuuucccuacuccaucccagcuacucuucugguguggcauacauggcagaaacagacccaacggucaggaguguugugggaugucccgagcccucccgaaacgcagaaggccgagcuagaagaggguguguacagaauuaagcagcagggcaucuucgggaaaacucaaguuggaguaggcgugcagaaggagggugucuuucacaccauguggcaugugacaagaggggcaguucugaccuauaacggaaaacgacucgaaccaaguugggcuucugugaagaaagaccugauauccuacggcggcggguggcgccuuagcgcccaguggcaaaagggagaggaaguccaggugaucgcgguagagcccgguaagaauccuaaaaacuuccagacaaugccaggcauuuuccagacuaccacgggggaaaucggagccauugcauuagauuuuaagcccggcacaucggguucaccuaucauaaaucgggaggggaaagucgugggacuguauggcaacggcguugugacuaagaaugggggauacgucucugguauugcucaaaccaacgccgagccggacggcccaacacccgaacucgaggaagagauguucaaaaagagaaauuugaccaucauggaucugcacccugggaguggaaagacuaggaaauaucucccagcuaucgugcgugaagcaauuaagcgccggcugagaacccuuauccuggcccccacaaggguuguggccgcugagauggaggaagcguugaaaggccuaccuauacgauaccagacgacugcaaccaaguccgagcacacagguaaagaaauugucgaccugaugugccaugccaccuuuacuaugcggcucuuaagcccggugcgcguacccaacuauaaucugaucauuauggaugaggcucacuucacagacccagccucuaucgcagccagaggguacauaagcaccagggugggaaugggcgaagcugcggccauuuuuaugacggcaacuccucccggcacagcugaugccuucccacaguccaacgcaccuauccaggacgaggagcgggacauccccgaacgaucauggaauagugggaacgauuggauuaccgacuuugccggaaagaccguuugguucgucccaagcaucaaggcugguaaugauauugccaacugucuuaggaagaacggcaagaaagugauacaacugucucgcaagacuuuugacacagaguaccagaaaaccaagcucaaugauugggacuucguggucacaacugauaucuccgaaaugggggcgaacuuuaaggcagacaggguaauugauccgcgucggugcuugaaaccugugauccugacggacggacccgagagaguuauccucgccggcccaaugcccgugaccgucgcuucagccgcucagaggcgcggucgaguggggagaaauccucagaaggagaacgaucaauauauuuucacaggccagccacugaauaacgacgaagaccaugcacacuggacugaggccaaaaugcuucuagauaauauaaacacccccgaaggaaucauuccugcucuguucgagccggaacgggagaagagugccgcaaucgacggcgaguacagguugaaaggggaaagccgcaagacauuuguugaguuaaugcguagaggagaucugccaguguggcucgcgcauaaagucgccuccgaagguauuaaguauaccgaccggaaguggugcuucgauggcgagaggaauaaccagauccuggaagagaauauggacguggagauauggacuaaagaaggggagaagaagaaacuucgcccccgauggcuggaugcuagaacguacucugacccucucgccuugaaagaauuuaaagauuucgcagcuggacggaagucgaucgcccuggaccuaguaaccgagauuggcagggugcccagccaccuggcacaccgcacaagaaacgcccucgauaaucuuguuaugcugcauacuucagaacacggugggagggcuuaucggcaugcggucgaggaguuaccagaaaccauggagacauugcugcuccugggccuuaugauccugcucaccggaggcgccauguuguuucugauuuccgggaaaggaguggguaagacaaguaucggcuuaauauguguggucgcaucuagcgggaugcuauggauggcugacauuccucugcaguggaucgccuccgccauuguucucgaguucuuuaugauggugcuucugauccccgagccagagaaacaacguacaccucaggauaaccaguuggcauacguagugauaggaauccugacgcucgcugccauugucgcggcuaaugaaaugggccugcuugagaccacuaagcgcgaccucgguaugucaaaagaaccgggggugguucccccaacaucuuaucuggacguggauuugcacccugccagcgcauggacccuguacgccgucgcuaccacaguaaucacucccauguuacgacacacgauugagaacaguaccgcaaaugugucccuagccgcgaucgcuaaccaagccguugugcugaugggccucgacaagggauggccaauaagcaagauggaucuuggcgucccucuguuggcacuggggugcuacucucaggugaacccccucacacugacugccgcuguccuuuuacuggugacccauuaugccauuaucggaccgggccuccaggcaaaagcuacaagagaagcccagaagaggaccgcggccgguaucaugaaaaauccaacuguugacgggauuaugacgaucgauuuggacccugugauauacgauucaaaguucgagaaacaacugggacagguaaugcuacuggugcucugugcaguccagcuucuguugaugcggacauccugggcuuuuugcgaggcccugacccucgcaacuggccccauuaccacacugugggaagguaguccaggcaaguucuggaacacuaccaucgcuguuagcauggccaauauuuuucgcgggucguauuuagccggagcgggccuugcuuucucuaucaugaaguccguggggacaggaaaaagaggcacggguagccagggggagacccugggagaaaaguggaaaaagaaacucaaccaacuaucaaggaaggaguuugaccuguacaaaaagaguggcauaacugaagucgaucggacagaggcaaaggaggguuugaaacgaggcgaaaucacccaccaugccgugucuagaggguccgcuaagcugcagugguucguagagcgcaauauggugauucccgaaggaaggguuaucgaccucggcugugggcggggaggcuggagcuauuacugcgccggucuuaaaaaggugacugagguccguggguauacaaaaggaggcccuggccacgaagaaccggugcccaugucaaccuacggguggaacauugucaagcugaugaguggaaaggauguguucuacuugccaccugagaaaugugacacgcugcucugcgauaucggugaaagcucccccucuccuaccguugaggaaagcagaacaauuaggguauuaaagaugguggagccauggcugaaaaauaaccaguuuuguaucaagguccuuaaucccuauaugccuacugugauagagcaucuggaacgccuacagcggaaacacggcgggaugcucguucgaaacccacuguccagaaauucaacccacgagauguacuggauuucuaacggaacaggcaauaucgugaguucggucaacauggugagcagguugcugcucaaucgcuucacuaugacccaucggagacccacaaucgaaaaggacguagaccuuggugcagggacccgucacgugaacgccgagccggaaacuccuaacauggauguuauuggagagaggauacggcgcaucaaggaggaacauuccucuacguggcacuaugacgaugagaauccauacaaaacaugggcuuaucacggcucauacgaagucaaggcgaccggcagcgccuccaguaugauuaacgggguggugaaacuguuaacuaagcccugggacgucguuccuaccgugacacaaauggcaaugacggauaccacuccauuuggacagcagcgaguauucaaagagaagguggacacaagaacccccaagccgaugccugguacuaggaaagucauggaaaucacagcugaguggcuguggcggaccuugggccgcaauaagagacccaggcucugcacacgagaggaauuuacuaaaaaggugcggaccaacgccgcaaugggggccguuuucacggaggaaaaucaaugggauucugcucgugccgcgguggaggacgaagaguuuuggaaacuggucgauagagagcgcgaacuacauaaacuuggaaaauguggcagcugcguguauaacaugauggguaagagggagaagaaacugggggaguucggaaaggcaaaaggcucacgggccauuugguacauguggcucggcgcuagauaccuggaguuugaggccuugggguuccugaaugaagaccacugguuuucccgcgagaacaguuauagcggaguagaaggugagggccuccauaaacuuggguacauccugagggauauaucuaaaaucccaggaggcgcaauguaugcugacgacaccgccgguugggauacacgaauuacugaagacgauuuacacaaugaggagaagaucacccagcagauggacccugaacaucggcagcuggcuaacgccauuuucaaguugacauaccaaaauaaaguugugaagguccagagacccacuccaaaagggaccgugauggauaucauauccaggaaggaccagcgcggaucaggccaggugggcacguaugggcucaacacauuuaccaauauggaggcacaacugauucgucagauggaaggagaggguguccuaagcaaaacugaucuugaaaacccccaucugcucgagaagaagaucacacaguggcuggagaccaaaggcguugaacgguugaagagaauggcgaucucgggggacgauugcgugguaaaaccuauugacgauagguucgccaaugcuuuacuggcccucaacgacaugggaaaggugcgcaaagauauaccacaguggcaaccgucuaagggcuggcacgacuggcagcagguccccuucuguagucaucacuuucaugagcuuaucaugaaggacggucgaaaacuggugguuccuugccggccacaggaugaacuaauugggagagcaaggaucucccaaggagcuggcuggagccugaaggagacugccugucucggcaaagcauacgcccagaugugggcguugauguauuuccaccgcagagaccugcggcuugcuucaaacgccauuugcuccgcagugcccguccacugggugccuaccucuaggacaacguggagcauccaugcccaccaucaguggaugaccacugaagauaugcugacaguauggaaucguguuuggauagaggacaacccauggauggaggauaagacccccgugacuacaugggaagacgucccuuaccucgggaaacgagaggaucaaugguguggaaguuuaaucggucugaccucccgcgcuacgugggcccagaauauuuugacagcaauccaacaggugagaagccugauuggcaacgaagaguuucucgacuacaugccgucuaugaagcgguucaggaaggaggaagaacuugaaggggcuaucugguga

SEQ ID NO: 15083 - RNA, 9873 nt, Artificial Sequence
  derived and/or modified CDS sequence (opt3) from DENV-3__AB189128__SS-prME
accagccugugccucaugaugauccuucccgccacucuggcuuuccacuugacuuccagagacggagaaccuaggaugauuguggggaagaacgaacggggaaaaucuuuacuguuuaagacggccucagguauuaauauguguacccugaucgccauggaucucggcgaaaugugcgacgauacagucacuuacaaauguccacugauuaccgaaguugaaccggaagacaucgauugcugguguaaccuuacaaguaccugggugacuuaugggacaugcaaucaggcgggagaacaccgccgagacaagcguagcguagcucuggcaccccacgugggcauggguuuggauaccagaacgcagacuuggauguccgcagagggggccuggaggcaggucgaaaaaguggagaccugggcuuuccggcauccuggauuuacaguucucgcacuguuccuggcccacuuuauuggcacuucucucacccagaagguggucaucuucauauuacugaugcuugugacaccaucgaugaccaugcgcuguguaggcguugggaacagagacuuuguggaaggauugucaggugcuacgugggucgauguggugcuggagcauggcgggugcgucacuacaauggccaagaauaaacccacccuagacaucgagcuccagaagacugaagcgacacaacuggcaacccuuaggaaacuguguauugagggaaagaucacgaacguuaccacagauagccggugcccuacucagggcgaagccauuuugccagaggaacaggaccagaauuacguguguaaacacaccuauguagaucgcgguugggggaacggaugcggccucuucggcaaggggagucuggugacaugcgcuaaguuucaauguuuagaguccaucgagggaaaagucgugcagcacgaaaaucugaaguacacuguuauaauuaccgugcauacaggugaccagcaccaggucggcaacgagacccaaggggugacugccgaaaucacgccccaggcaucuacaguagaggcuauucucccugaauauggaacccuuggccuggagugcagcccacgaacugguuuggacuucaaugagaugauccuacugaccaugaaaaacaaggccuggaugguucauagacagugguuuuucgaucucccgcugcccuggacauccggggcgaccacugaaacaccuacguggaauaaaaaggagcuucuggugaccuuuaaaaacgcccacgcaaagaagcaagaagucguggucuugggcucacaggagggagcuaugcacacugcccucacaggcgcuaccgaaauccagacaagugggggaacuagcauuuucgccggucaucugaaauguagguuaaagauggacaaacuggagcuaaagggcaugucuuacgcaaugugccucaaugccuucgugcugaaaaaggagguuuccgaaacccagcacgggacgauacuuaucaagguggaguauaaaggagaagaugcuccauguaagauucccuuuucaaccgaggacggccaagguaaagcgcauaacgggcgguugaucacagcaaacccuguagucacuaagaaagaggaaccagugaauauagaggccgaacccccguucggcgagagcaacauuguuaucggaaucggcgauaaggcucugaagauuaauugguacaaaaaggggaguucuaucggaaaaauguuugaagccaccgcacguggugcccgcagaauggcuauucucggcgacacagccugggauuucggguccgugggaggcguccugaacagccuugguaagauggugcaccagauauuugggucggcauacacugcgcuguucucuggcguauccuggaucaugaaaauuggaaucggcguguugcucaccuggaucgggcuaaauucaaagaacacgaguaugagcuuuuccugcauuguuauaggaaucauuacauuauaucugggcgcugucgugcaggccgacaccgguugugugaucaauuggaaggggaaagagcuaaagugcggaucuggcauuuucgucacuaacgagguucauacauggaccgaacaguacaaauuucaagcagauagcccuaagaggcucgccacugcuaucgccggugcaugggagaauggcgugugugggauacggucaaccacacgaauggaaaaccugcuuuggaaacagaucgcuaaugaguugaacuauauucugugggaaaauaacaucaagcucacggugguagucggagacauuaucggcgugcuggagcaggggaaacgcaccuuaacuccccagccaacagagcugaaguacaguuggaagaccuggggaaaagccaagauaguuacagcggaaacucaaaauuccagcuucauuaucgauggcccuaacacccccgagugcccaucugccucaagagcuuggaacgugugggaagucgaggaauaugguuuugggguguucacgacaaauauuuggcuuaaauugagggagauguacacccagcucugugaccaccggcugaugagugcagccguuaaggacgagcgcgcugugcacgccgauaugggauauuggaucgaaagccagaaaaacggcuccuggaagcuagagaaggcaucucugauagaaguaaaaacuugcaccuggcccaagucgcauacacucuggagcaaugguguccuggaguccgacaugaucauuccuaaaucacuugcgggcccaaucagucagcacaacuacagaccgggguaccauacucaaaccgccggacccuggcacuugggcaagcuggaguuagauuuuaauuauugcgaagggacaacgguggugauuaccgagaacuguggaacuaggggcccuucucuccguacaaccacugucagcgguaaacugauccacgaauggugcugucgguccugcacacuuccaccccugcgauacaugggggaggacggauguugguauggcauggaaauaagaccuauuaaugagaaggaggaaaacaugguuaagucauuggugagcgcugguucuggcaaaguagauaauuucaccaugggggugcucugccuggccauccuauucgaggaagucaugaggggaaaguuuggcaaaaagcauaugaucgcaggggugcuguucacguuuguucuccugcuuuccggacagauuacuuggcgcgacauggcucggaccuugaucaugauuggcaguaacgccagcgauagaauggguaugggggugacauaccuggcauuaauagccaccuucaaaauccagccauuucucgcucugggauucuuucuuaggaagcugacuucucgcgagaaucuacuccugggcgucggcuuggcgauggccacaacccugcaauuacccgaagacauugagcagauggcaaacgggaucgcucucggacugauggcccuuaagcugauuacacaguucgagacuuaucaguuguggaccgcccucgugucccugauguguucaaauacgaucuuuacacuaaccguugcuuggcgaacugcaacccugauacuugccgguaucagucuccugccggugugccaaagcucguccaugcggaaaacagauugguugccuaugacugucgcggcuaugggcguaccaccccugccuuuauucauauuuucucucaaggacacccugaaacguagaagcuggccccuuaacgaaggggugauggccguuggacuggugucaaucuuggcaaguucccuccugaggaaugaugucccaauggccggcccucuaguggcuggugggcugcuuauugcauguuacguaaucacgggaacaucugccgaccucaccguggagaaggcggcuaacgucacuugggaagaggaagccgagcagacaggcguuagccacaaccugaugauaaccguggaugacgacggcacuaugcgcauuaaagaugacgagacagaaaauaucuugaccguguuacugaagacggcacuccugaucgucuccgggauuuuccccuauucaauaccagccacucuucugguguggcauaccuggcagaaacagacacaacggagcggaguuuugugggauguaccgaguccucccgagacccagaaggcugaacuagaggacgguguguacagaaucaagcagcagggcauuuuugggaaaacacaagucggagugggcguucagaaggaggguguguuccacacuauguggcaugucaccagaggggccgugcugacgcacaacggaaaacgacucgaaccaaauugggcaucuguaaagaaagaucugaucuccuacggcggcggguggcgccuuagcgcucaguggcaaaagggagaggaaguccaggugauugccguugagcccgguaagaacccuaaaaauuuccagacaaugccaggcaucuuucagacuaccacaggggaaauaggagcgaucgccuuagacuucaagcccggcaccucggguucaccuauuaucaaccgggaggggaaaguggucggacuguauggcaauggcgugguuacuaagaacgggggauacgugucugguauugcacaaaccaaugcugagccggauggcccaacacccgaacucgaggaagagauguuuaaaaagagaaacuugacgaucauggaccugcacccugggaguggaaagacuaggaaauaucucccagccauaguccgugaagcuauuaagcgccggcugagaacccuuauccuggcacccacaagggugguagccgccgagauggaggaggcuuugaaaggccuaccuauccgauaccagaccacugcgacaaaguccgagcauaccgguaaagaaauuguggaucugaugugccacgcaacguucacuaugcggcucuuaagcccgguucgcguccccaauuauaaccugaucauaauggacgaggcccauuuuacagauccagcuucuauugccgcaagaggguacaucagcaccagggugggaaugggcgaagccgcugcgauuuucaugaccgccacuccucccggcacagcagacgcuuuuccacaguccaaugccccuauccaggaugaggagcgggacauacccgaacgaucauggaacagugggaaugaguggauuaccgacuucgcaggaaagacagugugguuugucccaagcaucaaggccgguaacgauaucgcuaacugucuuaggaagaauggcaagaaaguaauucaacugucucgcaagacuuucgacacggaauaucagaaaaccaagcucaacgauugggacuuugugguuacaacugauaucuccgagaugggggccaauuucaaggcggacagggugauugauccgcgucggugcuugaaaccugucauacugaccgacggacccgagagagugauccucgcaggcccaaugcccguuacaguggccucagcugcccagaggcgcggucgagucgggagaaacccucagaaggaaaaugaucaauacauuuucaccggccagccacugaacaaugacgaggaucacgcucauuggacugaagcaaaaaugcuucuagacaacaucaauacgcccgagggaaucauuccugcccuguuugaaccggagcgggagaagagugcugccauagacggcgaauacagguugaaaggggagagccgcaagaccuucguggaauuaaugcguagaggagaucugccaguauggcucgcacacaaaguggcguccgaggguaucaaguauacagaccggaaguggugcuuugauggcgaaaggaacaaucagauucuggaggagaacauggacguugaaaucuggacuaaagagggggaaaagaagaaacuucgcccccgauggcuggaugccagaaccuacucugacccucucgcuuugaaagaguucaaagauuuugccgcaggacggaagucgauugcucuggaccuagucacagaaaucggcagggugcccagccaccuggcccaucgcaccagaaaugcacucgauaaccuugugaugcugcacacuucagagcauggugggagggccuaucggcacgcugucgaggaauuaccagagacaauggaaacguugcugcuccugggccuuaugauacugcucaccggaggcgcgauguuguuccugaucuccgggaaaggaauugguaagacaaguaucggcuuaauuuguguuguggccucuagcgggaugcuauggauggcagacguaccucugcaguggaucgcuuccgccauagugcucgaguuuuucaugaugguccuucugauucccgagccagaaaaacaacguacaccucaggauaaucaguuggccuacgugguuaucggcauucugacccucgcagcuaucguggccgcgaacgagaugggccugcuugaaaccacaaagcgcgaccucgguaugucaaaagagccgggggucguaucucccauaagcuaucuggauguggacuugcacccagcuagugccuggacucuguacgcaguugccacgaccgugaucacaccuauguuacgacauacuauugaaaauuccaccgcuaacgucagccuagcagccaucgcgaaccaagcugugguccugaugggccucgacaagggauggcccauuucuaagauggaucuuggcgugccacuguuggcccuggggugcuauucacagguuaauccucucacacugaccgcagccgugcuuuuacugguaacucacuacgcuaucauaggacccggccuccaggccaaagcaacgagagaggcucagaagaggacagccgcggguauuaugaaaaacccgaccguggacgggaucaugacuaucgauuuggacccagucauuuacgauuccaaguuugagaaacaacugggacagguuaugcuacugauccucugugccgugcagcuucuguugaugcggaccaguugggcauucugcgaagcucugacacucgccacuggcccuauaaccacacugugggaggguagccccggcaaguuuuggaauacgaccauugcagucucgauggcuaacaucuuccgcgggucuuauuuagccggagccggccuugcguuuuccauuaugaaaagcguggggacuggaaaaagaggcacagguucacagggggaaacccugggagagaaguggaaaaagaaacucaaucaacuaaguaggaaggaguucgaccuguacaaaaagucuggcaucacugagguagaucggacagaggcuaaggaagguuugaaacgaggcgagauaacccaucacgcaguguccagagggagcgccaagcugcagugguucguugaacgcaacauggugaucccagagggaagggucauugaccucggcugugggcggggaggcuggucauauuacugcgcuggucuuaaaaaggugacggaaguccguggguauaccaaaggaggccccggccaugaggagccugugccgaugaguacauacggguggaauaucguuaagcugaugagcggaaaggauguauuuuauuugcccccagaaaaaugugacacucugcucugcgauauuggugaguccucuccuagccccaccguggaagaguccagaacaaucagggucuuaaagaugguggagccuuggcugaaaaacaaucaguucuguauuaagguucuuaacccauacaugcccacugugaucgaacaccuggagcgccuacagcggaaacacggcgggaugcucguccgaaauccucugucaagaaacucuacccaugaaauguacuggauaaguaauggaacaggcaacauugugucgagcguaaauaugguguccagguugcugcucaaccgcuuuaccaugacucaccggagaccaacgaucgagaaggacguugaucuuggugccgggacacgucaugucaacgcagaacccgagaccccgaauauggacgugaucggagagaggauucggcgcauaaaggaagaacacucuucaacuuggcacuaugacgaugaaaacccuuacaaaaccugggccuaucauggcagcuacgaggugaaggcuacaggcuccgcgaguucuaugaucaauggggucguuaaacuguuaacgaagccaugggacgugguacccaccgugacucaaauggccaugacagauaccacuccuuucggacagcagcgagucuuuaaagaaaagguggacacaagaaccccaaggcccaugccggguacacggaagguuauggagauuacugcagaguggcuguggcgcaccuugggcagaaacaaaaggccucgacucugcacgcgggaagaguucaccaagaaagugcguacaaaugcugccaugggggcagucuuuacugaagagaaccaaugggauagcgccagagcugccguggaagacgaggaguucuggaagcugguagaucgcgaaagggagcuacacaaacuuggaaaguguggcucaugcguuuauaauaugauggguaaacgggaaaagaagcugggggaguuuggaaaagcgaagggcuccagagcaaucugguacauguggcucggcgcccgcuaucuggaguucgaggcuuugggguuucugaacgaggaccauugguucaguagggaaaauagcuacucuggaguggagggugaaggccuccacaaacuuggguacauucugcgagauaucuccaagauacccggaggcgccauguaugcagacgauaccgcugguugggacacacggaucacugaggacgauuuacauaacgaggagaagauuacccagcagauggacccagagcacagacagcuggccaaugcuaucuuuaaguugacguaccaaaacaaggucgugaaagugcagaggccuacacccaaggggaccgucauggauauuaucucacgcaaagaccagcguggaagcggccagguuggcacuuaugggcucaauacauucaccaacauggaagcccaacugauacggcagauggagggagaaggugugcuaucgaaggcagaucuugagaauccacaucugcucgagaaaaagauuacucaguggcuggaagcggagggcguagaaagauugaagaggauggccaucucuggggacgauugcguggucaaacccaucgacgaucgcuucgcuaacgccuuacuggcacucaacgacaugggaaaggugcgaaaagauauuccucaguggcaaccaaguaagggcuggcaugacuggcagcagguuccguuuuguucccaccauuuccacgagcuuauaaugaaagauggucggaagcuggugguccccugcagaccucaggacgaacuaaucgggagggcucgcauuagccaaggagccggcuggucacugaaggagaccgcaugucucggcaaagccuacgcgcagaugugggcuuugauguauuuucacagacgggaccugaggcuugccuccaaugcaaucugcucugccgugccaguacauuggguucccacaagccguacgaccuggaguauucacgcucaucaccaguggaugacuacagaggauaugcugaccguguggaaccgagucuggaucgaagacaauccuuggauggaggauaagacuccagugacaaccugggaagacguucccuaccucgggaaacgcgaggaucaaugguguggauccuuaauaggucauacgagcagagccacaugggcacagaacauccugaccgcuauucaacaggugcggucuuugaucggcaaugaggaguuccuggacuauaugccuucaaugaagagguuucgcaaagaggaagagagugaaggggccauuugguga

SEQ ID NO: 15084 - RNA, 9873 nt, Artificial Sequence
  derived and/or modified CDS sequence (opt3) from DENV-3__AB214879__SS-prME
accagccugugccucaugaugaugcuucccgccacacuggcuuuccacuugacuuccagagacggcgagccuaggaugaucguggggaagaacgaacggggaaaaucuuuacuguuuaagacggcaucagguauuaauauguguacccuaauagccauggaucucggcgagaugugcgacgauacagucacuuacaaauguccacugaucaccgaaguugagccggaagacauugauugcugguguaaccuuacaaguaccugggugacuuaugggacaugcaaucaggcgggagagcaucgccgagacaagcguagcguagcucuggccccccacgugggcauggguuuggauaccagaacgcaaacuuggauguccgcagagggggccuggaggcaggucgaaaaaguggagaccugggcuuuccggcauccuggauuuacaauccucgcacuguuccuggcccacuacauuggcacuucucucacccagaagguugugaucuuuauauuacugaugcuugucacaccaucgaugaccaugcgcugugugggcguagggaacagagacuucguugaaggauugucaggugcuacguggguggaugucgugcuggagcauggcgggugcgugacuacaauggccaagaauaaacccacccuagacaucgagcuccagaagacugaagcgacacaacuggcaacccuuaggaaacuguguauugagggaaagaucacgaacgucaccacagauagccggugcccuacucagggcgaagccauuuugccagaggaacaggaccagaauuauguuuguaaacacaccuacguggaucgcgguugggggaacggaugcggccucuuuggcaaggggagucugguaacaugcgcuaaguuccaauguuuagaguccaucgagggaaaagugguccagcacgaaaaucugaaguauacugugauaauuaccguucauacaggugaccagcaccaggugggcaacgagacccaaggggucacugccgaaaucacgccccaggcaucuacaguggaggcuguacucccugaauacggaacccuuggccuggagugcagcccacgaacugguuuggacuuuaaugagaugauucuacugaccaugaaaaacaaggccuggaugguucauagacagugguucuuugaucucccgcugcccuggacauccggggcgaccacugaaacaccuacguggaauaaaaaggagcuucuggugaccuucaaaaacgcccacgcaaagaagcaagaagucguggucuugggcucacaggagggagcuaugcacacugcccucacaggcgcuaccgaaauccagacaagugggggaacuagcguguuugccggucaucugaaauguagguuaaagauggacaaacuggagcuaaagggcaugucuuaugcaaugugcuccaaugccuucguucucaaaaaggaggugucagaaacccagcacgggacgauccugauuaagguagaguacaaaggagaagaugcuccauguaagauacccuucagcaccgaggacggccaagguaaagcgcauaacgggcggcuuaucacagcaaacccugucgugacuaagaaagaggaaccaguuaauauugaggccgaacccccguuuggcgagaguaacaucauaauuggaaucggcgauaaggcuuugaagaucaauugguacaaaaaggggucuuccauuggaaaaauguucgaagccaccgcacguggugcccgcagaauggcuauccugggcgacacagccugggauuuugggagcgugggaggcguccucaacucgcuggguaagauggugcaccagauuuucgggucugcauauacugcgcuuuuuuccggcguaucauggauaaugaaaaucggaauuggcgugcuguugaccuggaucgggcucaauaguaagaacacgagcauguccuucucuugcaucguuauuggaauaaucacacuguacuuaggcgcugucgugcaggccgacauggguugugugauuaauuggaaggggaaagagcugaagugcggaagcggcaucuuugucaccaacgagguucauacuuggacagaacaguauaaauuccaagcagauucaccuaagaggcuagccaccgcuauugccggugcaugggagaauggcgugugugggauccggaguacuacccgaauggaaaaccuccuguggaaacagauagcuaaugagcuuaacuacaucuugugggaaaauaacauuaagcugacagugguagucggagacaucauuggcgugcucgagcaggggaaacgcacgcugaccccccagccaauggaguuaaaguauuccuggaagacuuggggaaaagccaagaucguuacagcggaaacccaaaauagcucuuuuauaauugauggcccuaacacacccgagugcccaucagccaguagagcuuggaacgugugggaagucgaggacuacgguuucgggguguuuacuaccaauaucuggcugaaacuuagggaaauguauacgcaguugugugaccaccggcucaugagcgcagccguuaaggaugagcgcgcugugcacgccgacaugggauacuggauugagucccagaaaaacggcucuuggaagcuggaaaaggcaucgcuaaucgagguaaaaacaugcaccuggcccaagagccauacucugugguccaaugguguccucgaaucagauaugauaaucccuaaaagucuggcgggcccaauuucucagcacaacuacagaccgggguaucauacccaaacagccggacccuggcaccuuggcaaguuggagcuggacuucaauuacugcgaggggacuaccguggugaucacagaaaacuguggaacgaggggcccuagcuuacguaccacuacagucuccgguaaacucauucacgaguggugcugucggucaugcacccugccaccccuucgauauaugggggaagauggauguugguacggcauggagaucagaccuauaaaugaaaaggaggagaacaugguuaagagccuggugucugcugguuccggcaaaguagacaauuuuacuauggggguguugugccucgccauucuguucgaagaggucaugaggggaaaguucggcaaaaagcauaugaucgcaggggugcuauuuacauucguucugcuccugaguggacagaucaccuggcgcgauauggcucggacgcuuauuaugaucggcagcaacgccucugacagaauggguaugggggugacuuauuuggcacugauugccaccuuuaaaauacagccauucuuagcucucggauuuuuccugaggaagcuuacaucccgcgaaaaucugcuacucggcgucggccuggcgauggccaccacuuugcaacugcccgaggauaucgaacagauggcaaacgggauugcuuuaggacucauggcccugaagcuuaucacacaguuugagaccuaccagcuguggacagccuugacuucacucauguguaguaauaccauuuucacgcugacaguggcuuggcgaaccgcaacucuaauccuggccgguauaagccuucucccgguuugccaaucguccucuaugcggaaaaccgacuggcugccuaugacaguggcggcuaugggcgucccacccuugccucuguuuaucuucagcuuaaaggauacucucaaacguagaucauggccccugaacgaggggguaauggccgugggacuuguuaguauucuggcauccucuuugcucaggaaugacgugccaauggccggcccucuggucgcuggugggcuacugaucgcauguuaugugauuaccggaacgagcgccgaucuuacaguagaaaaggcggcugacgugaccugggaggaagaggccgaacagacuggcgucucccacaaccucaugaucacaguugacgaugacggcaccaugcgcauaaaagaugacgagacugagaacauucugacaguguuguuaaagaccgcacugcucaucgugucagggaucuuucccuacagcauuccagccacgcugcuugucuggcauacuuggcagaaacagacccaacggaguggagugcugugggauguuccgucuccucccgaaacacagaaggcugaguuggaagaggguguauacagaauaaagcagcagggcaucuucgggaaaacccaagugggagucggcgugcagaaggaggguguuuuucacacaauguggcaugugacuaggggggccguccuaacccacaauggaaaacgacuggaaccaaacugggcauccgugaagaaagaccucauuagcuauggcggcggguggcgccugucggcucaguggcaaaagggagaggaaguacaggucaucgccguggagcccgguaagaauccuaaaaacuuccagacgaugccaggcauuuuccagacaacuaccggggaaaucggagcgauagcccuugauuuuaagcccggcacaucagguucuccuaucauuaaucgggaggggaaaguugugggauuauacggcaacggcgucgugaccaagagugggggauauguuuccgguaucgcacaaacuaaugcugagccggacggcccaacccccgaacuggaggaagagauguucaaaaagagaaaccucacaauuauggauuugcacccugggagcggaaagacgaggaaauaccugccagccaucgugcgugaagcuauaaagcgccggcucagaacucugauucuugcacccaccagggucguggccgccgagauggaggaagcucugaaaggcuugccuauccgauaucagacaaccgcgacuaagucugagcauacagguaaagaaaucguagaccuaaugugccacgcaaccuuuacgaugcggcugcucagcccggugcgcguucccaauuacaacuuaauuaucauggaugaggcccauuucacugacccagcuuccauagccgcaagaggguauauuucaacaagggucggaaugggcgaagccgcugcgaucuuuaugaccgccaccccucccggcacugcagaugcuuucccacagaguaaugccccuauucaggacgaggagcgggacauccccgaacgaagcuggaacucugggaaugauuggauaacagacuuugcaggaaagaccgugugguucgugccauccauuaaggccgguaacgauaucgcuaauugucugagaaaaaacggcaagaaagucauccaacuuucacgcaagacauuugacacugaguaccagaaaacgaagcugaacgauugggacuucguagugaccacagauauuagugaaaugggggccaauuuuaaggcggacaggguuaucgauccgcgucggugccucaaaccugugauuuugacugacggacccgagagagucauacuggcaggcccaaugcccgugaccguugccagcgcugcccagaggcgcggucgaguggggagaaacccucagaaggagaaugaucaauacaucuucacaggccagccacucaacaaugacgaagaccacgcucauuggaccgaggcaaaaaugcugcuugauaacauuaauacucccgaaggaaucaucccugcccuauucgagccggaacgggagaaguccgcugccauugacggcgaguauaggcugaaaggggaaucucgcaagacguuugucgaguugaugcguagaggagauuuaccaguguggcuggcacacaaaguagcgucggaagguauaaaguacaccgaccggaaguggugcuucgauggcgagaggaacaaucagauccucgaagagaacauggacguggagauuuggacaaaagaaggggagaagaaaaagcugcgcccccgauggcuugaugccagaacuuauagcgacccucuggcucucaaagaauuuaaggauuucgccgcaggacggaagucaaucgcuuuugacuugguuaccgagauuggcaggguccccucccaccuggcccaucgcacaagaaaugcacuagauaaccuggugaugcuccacaccagugaacauggugggagggccuaccggcacgcuguggaggagcuuccagaaacuauggagacacuguuauugcugggccucaugauccugcuuacgggaggcgcgaugcuguuccucauaucugggaaaggaaucgguaagaccagcauuggcuugaucugugucguugccuccucagggaugcuguggauggcagacauuccuuuacaguggaucgcuucugccauagugcuagaauuuuucaugaugguacugcucauucccgagccagagaaacaacguacuccucaggauaaucagcuugccuauguggucaucggaauucugacauuggcagcuaucguggccgcgaacgaaaugggccugcucgagaccaccaagcgcgaccuggguaugagcaaagaaccggggguugugagucccacauccuaccuugacgucgaucuccacccagcuagcgccuggacucuguaugcaguagccacgaccgugauaacaccuauguugcgacauacuaucgagaauucuaccgcuaacguuucacuggcagccauugcgaaucaagcuguggucuuaaugggccuagacaagggauggcccaucuccaagauggaucugggcgugccacuccuugcccuggggugcuacagucaggucaacccuuugacacugaccgcagccgugcuccugcuuguuacucacuacgcuauuaucggacccggcuuacaggccaaagcaacgagagaagcucagaagaggacagccgcggguauaaugaaaaacccgaccguggacgggauuaugacuaucgaucuggacccaguaaucuaugauagcaaguuugagaaacaacucggacaggugauguugcugguccuaugugccguucagcugcuccuuaugcggaccucgugggcauucugcgaggcucugacauuggccacuggcccuauuaccacacugugggaagguucucccggcaaguuuuggaauacgaccaucgcaguguccauggcuaacauauuccgcgggagcuaccucgccggagccggccuggcguuuucaauuaugaagagugucgggacuggaaaaagaggcacagguucucagggggagaccuuaggagaaaaguggaaaaagaaacuuaaucaacuguccaggaaggaguucgaccucuauaaaaagagcggcaucacugaaguggaucggacagaggcuaaggagggucuaaaacgaggcgaaauuacccaucacgcaguaucaagagggagugccaagcugcagugguucguggagcgcaacaugguuaucccagaaggaagggugauagacuugggcugugggcggggaggcuggagcuacuauugcgcuggucugaaaaaggucacggaggugcguggguacaccaaaggaggccccggccaugaagagccugucccgauguccacauauggguggaauaucgugaagcucaugucuggaaaggauguuuuuuaccuucccccagagaaaugugacacucuguugugcgauauuggugaaagcuccccuucacccaccguagaggaaucuagaacaaucagggugcugaagauggucgagccuuggcucaaaaacaaucaguucuguauuaagguguuaaacccauacaugcccacuguuaucgagcaccuggaacgccuucagcggaaacacggcgggaugcuggugcgaaauccucuaaguagaaacucgacccaugagauguauuggauuagcaauggaacaggcaacaucgucuccucugugaauaugguaucaaggcuccuguugaaccgcuuuaccaugacuuaccggagaccaacgauagaaaaggacguggaccugggugccgggacacgucacguuaaugcagagcccgaaaccccgaacauggaugucauuggagagaggauccggcgcaucaaggaggaacauagcuccacuuggcacuaugacgaugagaacccuuacaaaaccugggccuaucacggcaguuacgaagugaaggcuacaggcucugcgagcucaaugauuaaugggguggucaaacuccuuacgaagccaugggacguugugcccaccguaacucaaauggccaugacagauaccacuccuuucggacagcagcgaguguuuaaagagaaggucgacacaagaaccccaaagcccaugccggguacaaggaaagugauggaaauaacugcagaguggcuguggcggaccuuaggccgcaacaagagaccuaggcugugcacgcgagaggaauucaccaaaaagguucggacaaaugcugccaugggggcaguguuuacugaggaaaaccaaugggauuccgcccgugcugccgucgaggacgaagaguucuggaaauugguggauagagagcgcgaacuccauaagcugggaaaauguggcaguugcguauauaauaugauggguaagagggagaagaaacuaggggaauuuggaaaggcgaaaggcagccgggcaaucugguacauguggcuuggcgccagauaccuggaguucgaggcucucggguuucugaacgaagaccacugguucucucgcgagaauuccuauucaggaguugaaggugagggcuugcauaagcugggguacauucucagggauaucagcaaaauucccggaggcgccauguaugcagacgacaccgcugguugggauacacgaaucacugaagacgaucuucacaacgaggagaagauaacccagcagauggacccagaacaucggcagcuggccaaugcuaucuuuaaguuaacguaccaaaacaaaguggucaaggugcagagaccuacacccaaagggaccgugauggauauuaucucgaggaaggaccagcgcggaucuggccaggucggcacuuaugggcugaauacauucaccaacauggaggcccaauugauucgucagauggaaggagaggguguucucaguaaaacugaucuggaaaauccacaccuacuugagaagcggaucacccaguggcuggagacaaagggcguggaaagacucaaaaggauggcaauauccggggacgauugcguagugaagcccauugacgaucgcuucgcgaacgcccuguuggcuuuaaaugacaugggaaaaguccgaaaggauaucccucaguggcaaccaagcaaaggcuggcacgacuggcagcaggugccguuuuguucacaucacuuccaugagcugaucaugaaggacggucggaagcucguugugcccugcagaccucaggaugaacuuauugggagggcccgcauaucccaaggagcaggcuggucucugaaagagacggcuugucuaggcaaggccuacgcacagaugugggcccugauguauuuucacagacgggaccucagguuggcgagcaacgcuaucugcagugccgucccagugcacuggguacccaccucccguacuacauggagcauucaugcacaccaucaguggaugaccacugaagauaugcugacaguuuggaaccgaguguggaucgaggacaauccuuggauggaggauaaaaccccagucacgacaugggaagacgugcccuaccuugggaagcgcgaggaucaaugguguggaucucugauuggucucaccucaagagccacuugggcucagaacaucuuaaccgccauacagcagguucggagucugaucggcaaugaagaguucuuggacuacaugccuuccaugaaaagguuucgcaaggaggaagagagcgaaggggcaauuugguga

SEQ ID NO: 15085 - RNA, 9873 nt, Artificial Sequence
  derived and/or modified CDS sequence (opt3) from DENV-3__AB214880__SS-prME
accagccugugccucaugaugaugcuucccgccacacuggcuuuccacuugacuuccagagacggcgagccuaggaugaucguggggaagaacgaacggggaaaaucuuuacuguuuaagacggcaucagguauuaauauguguacccuaauagccauggaucucggcgagaugugcgacgauacagucacuuacaaauguccacugaucaccgaaguugagccggaagacauugauugcugguguaaccuuacaaguaccugggugacuuaugggacaugcaaucaggcgggagagcaucgccgagacaagcguagcguagcucuggccccccacgugggcauggguuuggauaccagaacgcaaacuuggauguccgcagagggggccuggaggcaggucgaaaaaguggagaccugggcuuuccggcauccuggauuuacaauccucgcacuguuccuggcccacuacauuggcacuucucucacccagaagguugugaucuuuauauuacugaugcuugucacaccaucgaugaccaugcgcugugugggcguagggaacagagacuucguugaaggauugucaggugcuacguggguggaugucgugcuggagcauggcgggugcgugacuacaauggccaagaauaaacccacccuagacaucgagcuccagaagacugaagcgacacaacuggcaacccuuaggaaacuguguauugagggaaagaucacgaacgucaccacagauagccggugcccuacucagggcgaagccauuuugccagaggaacaggaccagaauuauguuuguaaacacaccuacguggaucgcgguugggggaacggaugcggccucuuuggcaaggggagucugguaacaugcgcuaaguuccaauguuuagaguccaucgagggaaaagugguccagcacgaaaaucugaaguauacugugauaauuaccguucauacaggugaccagcaccaggugggcaacgagacccaaggggucacugccgaaaucacgccccaggcaucuacaguggaggcuguacucccugaauacggaacccuuggccuggagugcagcccacgaacugguuuggacuuuaaugagaugauucuacugaccaugaaaaacaaggccuggaugguucauagacagugguucuuugaucucccgcugcccuggacauccggggcgaccacugaaacaccuacguggaauaaaaaggagcuucuggugaccuucaaaaacgcccacgcaaagaagcaagaagucguggucuugggcucacaggagggagcuaugcacacugcccucacaggcgcuaccgaaauccagacaagugggggaacuagcaucuuugccggucaucugaaauguagguuaaagauggacaaacuggagcuaaagggcaugucuuaugcaaugugcuccaaugccuucgugcucaaaaaggagguuucagaaacccagcacgggacgauucugauaaagguggaguacaaaggagaagaugcuccauguaagauccccuucagcaccgaggacggccaagguaaagcgcauaacgggcggcuuauuacagcaaacccuguagucacuaagaaagaggaaccagugaauaucgaggccgaacccccguuuggcgagaguaacauaauuaucggaaucggcgauaaggcuuugaagauuaauugguacaaaaaggggucuuccaucggaaaaauguucgaagccaccgcacguggugcccgcagaauggcuauucugggcgacacagccugggauuuugggagcguuggaggcgugcucaacucgcuggguaagaugguccaccagauauucgggucugcauauacugcgcuuuuuuccggcgugucauggaucaugaaaauuggaaucggcguacuguugaccuggaucgggcucaauaguaagaacacgagcauguccuucucuugcauugugauaggaaucauuacacuguacuuaggcgcuguuguccaggccgacauggguugugugaucaauuggaaggggaaagagcugaagugcggaagcggcauuuuugugaccaacgagguccauacuuggacagaacaguauaaauuccaagcagauucaccuaagaggcuagccaccgcuaucgccggugcaugggagaauggcguuugugggauacggaguacuacccgaauggaaaaccuccuguggaaacagaucgcuaaugagcuuaacuacauuuugugggaaaauaacaucaagcugacaguggugguaggagacauuaucggcguccucgagcaggggaaacgcacgcugaccccccagccaauggaguuaaaguauuccuggaagacuuggggaaaagccaagauagugacagcggaaacccaaaauagcucuuuuauuaucgauggcccuaacacacccgagugcccaucagccaguagagcuuggaacguuugggaaguggaggacuacgguuucggggucuuuacuaccaauauuuggcugaaacuuagggaaauguauacgcaguugugugaccaccggcucaugagcgcagccgugaaggaugagcgcgcuguucacgccgacaugggauacuggaucgagucccagaaaaacggcucuuggaagcuggaaaaggcaucgcuaauagaggugaaaacaugcaccuggcccaagagccauacucugugguccaaugguguacucgaaucagauaugaucauuccuaaaagucuggcgggcccaaucucucagcacaacuacagaccgggguaucauacccaaacagccggacccuggcaccuuggcaaguuggagcuggacuucaauuacugcgaggggacuaccgucgugauuacagaaaacuguggaacgaggggcccuagcuuacguaccacuacaguguccgguaaacucauccacgaguggugcugucggucaugcacccugccaccccuucgauauaugggggaagauggauguugguacggcauggagauaagaccuauuaaugaaaaggaggagaacauggucaagagccugguuucugcugguuccggcaaaguggacaauuuuacuauggggguauugugccucgccauccuguucgaagaggugaugaggggaaaguucggcaaaaagcauaugaucgcagggguccuauuuacauucgugcugcuccugaguggacagauuaccuggcgcgauauggcucggacgcuuaucaugauuggcagcaacgccucugacagaauggguauggggguuacuuauuuggcacugauagccaccuuuaaaauccagccauucuuagcucucggauuuuuccugaggaagcuuacaucccgcgaaaaucugcuacucggcgugggccuggcgauggccaccacuuugcaacugcccgaggauauugaacagauggcaaacgggaucgcuuuaggacucauggcccugaagcuuauuacacaguuugagaccuaccagcuguggacagccuuggcuucacucauguguaguaauacuaucuucacccugacggucgcauggcgaacagccacccuaauacuggcggguaucagccuucucccggugugccaaucguccucuaugcggaaaacugacuggcugccuaugaccguugcugccaugggcgugccacccuugccucuguuuauuuucagcuuaaaggauacacucaaacguagaucauggccccugaacgagggggucauggcaguaggacuugugaguauccuggccuccucuuugcucaggaaugacguuccaauggcuggcccucugguggcaggugggcuacugauugccuguuaugucaucacuggaaccagcgcggaucuuacgguggaaaaggcugccgacguaacaugggaggaagaggcagaacagaccggcgugucccacaaccucaugauaacugucgacgaugacggcacaaugcgcauuaaagaugacgagaccgagaacauccugacuguuuuguuaaagacagcccugcucaucgugucagggauuuuucccuacagcauaccagcuacccugcuuguguggcauacguggcagaaacagacucaacggaguggaguccugugggaugugccgucuccucccgaaacccagaaggccgaguuggaagaggguguuuacagaaucaagcagcagggcauuuucgggaaaacacaaguaggagugggcguccagaaggaggguguguuucacaccauguggcauguuacaaggggggcagugcuaacucacaauggaaaacgacuggaaccaaacugggcuuccgucaagaaagaccucaucagcuauggcggcggguggcgccugucggcccaguggcaaaagggagaggaagugcagguaauugcggucgagcccgguaagaauccuaaaaacuuccagaccaugccaggcaucuuccagacgacaacuggggaaauaggagccaucgcacuugauuuuaagcccggcaccucagguucuccuauuaucaaucgggaggggaaagugguuggauuauacggcaacggcguggucacaaagagugggggauauguguccgguauugcucaaaccaaugccgagccggacggcccaacucccgaacuggaggaagagauguucaaaaagagaaaccucaccaucauggauuugcacccugggagcggaaagacaaggaaauaccugccagcuauaguucgugaagcaauuaagcgccggcucagaacgcugauccuugcccccacuaggguggucgccgcugagauggaggaagcgcugaaaggcuugccuauccgauaucagaccacagcaaccaagucugagcauacugguaaagaaauuguggaccuaaugugccacgccacauuuaccaugcggcugcucagcccgguacgcgugcccaauuacaacuuaaucauaauggaugaggcucauuucacggacccagccuccauugcagccagaggguauaucucaacuaggguuggaaugggcgaagcugcggccauuuuuaugacagcaaccccucccggcaccgcugaugccuucccacagaguaaugcaccuauccaggacgaggagcgggacauacccgaacgaagcuggaacucugggaaugauuggauuacugacuuugccggaaagacagucugguucgugccauccaucaaggcugguaacgauaucgccaauugucugagaaaaaacggcaagaaagugauucaacuuucacgcaagaccuuugacacagaguaccagaaaacuaagcugaacgauugggacuucgucguaacgaccgauaucagugaaaugggggcgaauuuuaaggcagacagggugauugauccgcgucggugccucaaaccuguuauauugacagacggacccgagagagugauccuggccggcccaaugcccgucacuguggcuagcgccgcucagaggcgcggucgaguugggagaaacccucagaaggagaaugaucaauacauuuucaccggccagccacucaacaaugacgaagaccacgcacauuggacagaggccaaaaugcugcuugauaacaucaauacccccgaaggaaucauuccugcucuauucgagccggaacgggagaaguccgccgcaauagacggcgaguauaggcugaaaggggaaucucgcaagacuuuuguggaguugaugcguagaggagauuuaccagucuggcuggcgcacaaaguggccucggaagguaucaaguacacggaccggaaguggugcuucgauggcgagaggaacaaucagauucucgaagagaacauggacguagagaucuggaccaaagaaggggagaagaaaaagcugcgcccccgauggcuugaugcuagaacauauagcgacccucuggcccucaaagaauuuaaggauuucgcagcuggacggaagucaauugccuuugacuuggugacugagaucggcaggguucccucccaccuggcacaucgcaccagaaaugcccuagauaaccuggucaugcuccacacaagugaacauggugggagggcuuaccggcacgcgguggaggagcuuccagaaaccauggagacucuguuauugcugggccucaugauacugcuuacaggaggcgccaugcuguuccucaucucugggaaaggaauugguaagacgagcaucggcuugauuuguguggucgcauccucagggaugcuguggauggcugacaucccuuuacaguggauagccucugccauuguucuagaauuuuucaugauggugcugcucauccccgagccagagaaacaacguaccccucaggauaaucagcuugcauauguagugauuggaauccugacuuuggcugccauagucgcggcuaacgaaaugggccugcucgagacaaccaagcgcgaccuggguaugagcaaagaaccgggggugguuagucccaccuccuaccuugacguggaucuccacccagccagcgcauggacacuguaugccgucgcuacuacgguaaucaccccuauguugcgacauacaauugagaauucuacugcaaacgugucacuggccgcgaucgcuaaucaagccguuguguuaaugggccuagacaagggauggcccauuuccaagauggaucugggcgucccacuccuugcacuggggugcuacagucaggugaacccuuugacccugacagccgcuguccuccugcuugugacccacuacgccaucauaggacccggcuuacaggcaaaagcuacuagagaagcccagaagaggacggcggccgguauuaugaaaaacccgacaguugacgggaucaugaccaucgaucuggacccagugauuuaugauagcaaguuugagaaacaacucggacagguaauguugcuggugcuaugugcaguccagcugcuccuuaugcggacuucgugggcuuucugcgaggcccugaccuuggcaacaggcccuaucacuacccugugggaagguucucccggcaaguuuuggaauacaacgauagcuguuuccauggccaacauuuuccgcgggagcuaccucgccggagcgggccuggcuuuuucaaucaugaagaguguggggaccggaaaaagaggcacugguucucagggggagacauuaggagaaaaguggaaaaagaaacuuaaucaacuguccaggaaggaguucgaccucuauaaaaagagcggcauuaccgaagucgaucggacugaggcaaaggagggucuaaaacgaggcgaaaucacacaucacgccgugucaagagggagugcuaagcugcagugguucguagagcgcaacauggugauaccagaaggaaggguuaucgacuugggcugugggcggggaggcuggagcuacuauugcgccggucugaaaaaggugaccgagguccguggguacacgaaaggaggccccggccaugaagagccugugccgauguccaccuauggguggaauauugucaagcucaugucuggaaaggauguguuuuaccuucccccagagaaaugugacacacuguugugcgauaucggugaaagcuccccuucacccacuguugaggaaucuagaaccauuaggguacugaagaugguggagccuuggcucaaaaacaaucaguucuguaucaaggucuuaaacccauacaugcccacagugauugagcaccuggaacgccuucagcggaaacacggcgggaugcugguucgaaauccucuaaguagaaacucgacucaugagauguauuggaucagcaauggaaccggcaacauaguguccucugucaauauggugucaaggcuccuguugaaccgcuuuacaaugaccuaccggagaccaacuauugaaaaggacguagaccugggugcagggacgcgucacgugaaugccgagcccgaaacaccgaacauggauguuaucggagagaggauccggcgcauuaaggaggaacauagcuccaccuggcacuaugacgaugagaacccuuacaaaacuugggcuuaucacggcaguuacgaagucaaggcgaccggcucugccagcucaaugauaaaugggguggugaaacuccuuacaaagccaugggacgucguucccacggugacccaaauggcaaugacugauacaaccccuuucggacagcagcgaguauuuaaagagaagguggacacuagaacaccaaagcccaugccggguaccaggaaagucauggaaaucacagcugaguggcuguggcggacuuuaggccgcaacaagagaccuaggcugugcacccgagaggaauucacgaaaaaggugcggaccaaugccgcaaugggggccguuuuuacagaggaaaaccaaugggauuccgcucgugccgcgguggaggacgaagaguucuggaaauuggucgauagagagcgcgaacuccauaagcugggaaaauguggcaguugcguguauaauaugauggguaagagggagaagaaacuaggggaauuuggaaaggcaaaaggcagccgggccauuugguacauguggcuuggcgcuagauaccuggaguucgaggcccucggguuucugaacgaagaccacugguucucucgcgagaauuccuauucaggaguagaaggugagggcuugcauaagcugggguacauccucagggauauuagcaaaauccccggaggcgcaauguaugcugacgacacugccgguugggauacccgaauaacagaagacgaucuucacaacgaggagaagaucacucagcagauggacccagaacaucggcagcuggcuaaugccauuuuuaaguuaaccuaccaaaacaaaguugugaagguccagagaccuacgcccaaagggacagugauggauaucauuucgaggaaggaccagcgcggaucuggccaggugggcaccuaugggcugaauacuuucacaaacauggaggcacaauugauccgucagauggaaggagaggguguccucaguaaaaccgaucuggaaaauccacaccuacuugagaagcggauaacucaguggcuggagaccaagggcguugaaagacucaaaaggauggcgauuuccggggacgauugcgugguaaagcccaucgacgaucgcuucgccaacgcucuguuggccuuaaaugacaugggaaaagugcgaaaggauaucccucaguggcaaccaagcaaaggcuggcacgacuggcagcaggucccguuuuguucacaucacuuccaugagcugauuaugaaggacggucggaagcucgugguucccugcagaccucaggaugaacuuauagggagggcacgcaucucccaaggagcuggcuggucucugaaagagacagccugucuaggcaaggcauacgcccagaugugggcgcugauguauuuucacagacgggaccucagguuggcuagcaacgccauuugcagugcagugccaguccacugggugcccacgucccguaccacuuggagcauccaugcccaccaucaguggaugacaaccgaagauaugcugacuguauggaaccgaguuuggauugaggacaauccuuggauggaggauaaaacaccagugaccacgugggaagacguccccuaccuugggaagcgcgaggaucaaugguguggaucucugaucggucucacaucaagagcuaccugggcccagaacauauuaacugcaauccagcaggugcggagucugauuggcaaugaagaguucuuggacuacaugccuuccaugaaaagguuucgcaaggaggaagagagcgaaggggcuaucugguga

SEQ ID NO: 15086 - RNA, 9873 nt, Artificial Sequence
  derived and/or modified CDS sequence (opt3) from DENV-3__AB214881__SS-prME
accagccugugccucaugaugaugcuucccgccacacuggcuuuccacuugacuuccagagacggcgagccuaggaugaucguggggaagaacgaacggggaaaaucuuuacuguuuaagacggcaucagguauuaauauguguacccuaauagccauggaucucggcgagaugugcgacgauacagucacuuacaaauguccacugaucaccgaaguugagccggaagacauugauugcugguguaaccuuacaaguaccugggugacuuaugggacaugcaaucaggcgggagagcaucgccgagacaagcguagcguagcucuggccccccacgugggcauggguuuggauaccagaacgcaaacuuggauguccgcagagggggccuggaggcaggucgaaaaaguggagaccugggcuuuccggcauccuggauuuacaauccucgcacuguuccuggcccacuacauuggcacuucucucacccagaagguugugaucuuuauauuacugaugcuugucacaccaucgaugaccaugcgcugugugggcguagggaacagagacuucguugaaggauugucaggugcuacguggguggaugucgugcuggagcauggcgggugcgugacuacaauggccaagaauaaacccacccuagacaucgagcuccagaagacugaagcgacacaacuggcaacccuuaggaaacuguguauugagggaaagaucacgaacgucaccacagauagccggugcccuacucagggcgaagccauuuugccagaggaacaggaccagaauuauguuuguaaacacaccuacguggaucgcgguugggggaacggaugcggccucuuuggcaaggggagucugguaacaugcgcuaaguuccaauguuuagaguccaucgagggaaaagugguccagcacgaaaaucugaaguauacugugauaauuaccguucauacaggugaccagcaccaggugggcaacgagacccaaggggucacugccgaaaucacgccccaggcaucuacaguggaggcuguacucccugaauacggaacccuuggccuggagugcagcccacgaacugguuuggacuuuaaugagaugauucuacugaccaugaaaaacaaggccuggaugguucauagacagugguucuuugaucucccgcugcccuggacauccggggcgaccacugaaacaccuacguggaauaaaaaggagcuucuggugaccuucaaaaacgcccacgcaaagaagcaagaagucguggucuugggcucacaggagggagcuaugcacacugcccucacaggcgcuaccgaaauccagacaagugggggaacuagcaucuuugccggucaucugaaauguagguuaaagauggacaaacuggagcuaaagggcaugucuuaugcaaugugcuccaaugccuucgugcucaaaaaggagguuucagaaacccagcacgggacgauucugauaaagguggaguacaaaggagaagaugcuccauguaagauccccuucagcaccgaggacggccaagguaaagcgcauaacgggcggcuuauuacagcaaacccuguagucacuaagaaagaggaaccagugaauaucgaggccgaacccccguuuggcgagaguaacauaauuaucggaaucggcgauaaggcuuugaagauuaauugguacaaaaaggggucuuccaucggaaaaauguucgaagccaccgcacguggugcccgcagaauggcuauucugggcgacacagccugggauuuugggagcguuggaggcgugcucaacucgcuggguaagaugguccaccagauauucgggucugcauauacugcgcuuuuuuccggcgugucauggaucaugaaaauuggaaucggcguacuguugaccuggaucgggcucaauaguaagaacacgagcauguccuucucuugcauugugauaggaaucauuacacuguacuuaggcgcuguuguccaggccgacauggguugugugaucaauuggaaggggaaagagcugaagugcggaagcggcauuuuugugaccaacgagguccauacuuggacagaacaguauaaauuccaagcagauucaccuaagaggcuagccaccgcuaucgccggugcaugggagaauggcguuugugggauacggaguacuacccgaauggaaaaccuccuguggaaacagaucgcuaaugagcuuaacuacauuuugugggaaaauaacaucaagcugacaguggugguaggagacauuaucggcauacucgagcaggggaaacgcacgcugaccccccagccaauggaguuaaaguauuccuggaagacuuggggaaaagccaagauugucacagcggaaacccaaaauagcucuuuuaucauugauggcccuaacacacccgagugcccaucagccaguagagcuuggaacgugugggaaguugaggacuacgguuucgggguguuuacuaccaauaucuggcugaaacuuagggaaauguauacgcaguugugugaccaccggcucaugagcgcagccgucaaggaugagcgcgcugugcacgccgacaugggauacuggauagagucccagaaaaacggcucuuggaagcuggaaaaggcaucgcuaaucgagguuaaaacaugcaccuggcccaagagccauacucugugguccaauggugugcucgaaucagauaugauuaucccuaaaagucuggcgggcccaauuucucagcacaacuacagaccgggguaucauacccaaacagccggacccuggcaccuuggcaaguuggagcuggacuucaauuacugcgaggggacuaccguagucaucacagaaaacuguggaacgaggggcccuagcuuacguaccacuacaguguccgguaaacucauacacgaguggugcugucggucaugcacccugccaccccuucgauauaugggggaagauggauguugguacggcauggagauuagaccuaucaaugaaaaggaggagaacauggugaagagccuggucucugcugguuccggcaaaguugacaauuuuacuauggggguguugugccucgccauccuguucgaagagguaaugaggggaaaguucggcaaaaagcauaugauugcaggggugcuauuuacauucguccugcuccugaguggacagaucaccuggcgcgauauggcucggacgcuuauuaugauaggcagcaacgccucugacagaauggguaugggggugacuuauuuggcacugaucgccaccuuuaaaauucagccauucuuagcucucggauuuuuccugaggaagcuuacaucccgcgaaaaucugcuacucggcguuggccuggcgauggccaccacuuugcaacugcccgaggauaucgaacagauggcaaacgggauugcuuuaggacucauggcccugaagcuuaucacacaguuugagaccuaccagcuguggacagccuuggcuucacucauguguaguaauacuauauucacccugacgguggcauggcgaacagccacccuaauccuggcggguauuagccuucucccggucugccaaucguccucuaugcggaaaacugacuggcugccuaugaccguggcugccaugggcguuccacccuugccucuguuuaucuucagcuuaaaggauacacucaaacguagaucauggccccugaacgagggggugauggcagucggacuuguaaguauucuggccuccucuuugcucaggaaugacgugccaauggcuggcccucugguugcaggugggcuacugaucgccuguuaugugauaacuggaaccagcgcggaucuuacggucgaaaaggcugccgacgugacaugggaggaagaggcagaacagaccggcguaucccacaaccucaugauuacuguggacgaugacggcacaaugcgcaucaaagaugacgagaccgagaacauccugacugucuuguuaaagacagcccugcucauuguuucagggauauuucccuacagcaucccagcuacccugcuuguguggcauacguggcagaaacagacucaacggaguggagugcugugggaugucccgucuccucccgaaacccagaaggccgaguuggaagaggguguguacagaauuaagcagcagggcaucuucgggaaaacacaaguuggaguaggcgugcagaaggagggugucuuucacaccauguggcaugugacaaggggggcaguucuaacucacaauggaaaacgacuggaaccaaacugggcuuccgugaagaaagaccucauuagcuauggcggcggguggcgccugucggcccaguggcaaaagggagaggaaguccaggugaucgcgguagagcccgguaagaauccuaaaaacuuccagaccaugccaggcauauuccagacgacaacuggggaaaucggagccauugcacuugauuuuaagcccggcaccucagguucuccuaucauuaaucgggaggggaaagucgugggauuauacggcaacggcguugugacaaagagugggggauaugucuccgguaucgcucaaaccaaugccgagccggacggcccaacucccgaacuggaggaagagauguucaaaaagagaaaccucaccauaauggauuugcacccugggagcggaaagacaaggaaauaccugccagcuauugugcgugaagcaaucaagcgccggcucagaacgcugauccuugcccccacuaggguuguggccgcugagauggaggaagcgcugaaaggcuugccuauucgauaucagaccacagcaaccaagucugagcauacugguaaagaaaucgucgaccuaaugugccacgccacauuuaccaugcggcugcucagcccggugcgcguacccaauuacaacuuaauaauuauggaugaggcucauuucacggacccagccuccaucgcagccagaggguauauuucaacuagggugggaaugggcgaagcugcggccaucuuuaugacagcaaccccucccggcaccgcugaugccuucccacagaguaaugcaccuauacaggacgaggagcgggacauucccgaacgaagcuggaacucugggaaugauuggaucacugacuuugccggaaagacaguuugguucgucccauccaucaaggcugguaacgauauugccaauugucugagaaaaaacggcaagaaagugauccaacuuucacgcaagaccuuugacacagaguaccagaaaacuaagcugaacgauugggacuucguggucacgaccgauauuagugaaaugggggcgaauuuuaaggcagacaggguaauagauccgcgucggugccucaaaccugugaucuugacagacggacccgagagaguuauucuggccggcccaaugcccgugacugucgcuagcgccgcucagaggcgcggucgaguggggagaaacccucagaaggagaaugaucaauacaucuucaccggccagccacucaacaaugacgaagaccacgcacauuggacagaggccaaaaugcugcuugauaacaucaauacccccgaaggaauuauaccugcucuauucgagccggaacgggagaaguccgccgcaaucgacggcgaguauaggcugaaaggggaaucucgcaagacuuuuguugaguugaugcguagaggagauuuaccaguguggcuggcgcacaaagucgccucggaagguauuaaguacacggaccggaaguggugcuucgauggcgagaggaacaaucagauccucgaagagaacauggacguggagauuuggaccaaagaaggggagaagaaaaagcugcgcccccgauggcuugaugcuagaacauauagcgacccucuggcccucaaagaauuuaaggauuucgcagcuggacggaagucaaucgccuuugacuugguaacugagauaggcagggugcccucccaccuggcacaucgcaccagaaaugcccuagauaaccugguuaugcuccacacaagugaacauggugggagggcuuaccggcacgcggucgaggagcuuccagaaaccauggagacucuguuauugcugggccucaugauccugcuuacaggaggcgccaugcuguuccucauuucugggaaaggaaucgguaagacgagcauuggcuugaucugugugguggcauccucagggaugcuguggauggcugacauaccuuuacaguggauugccucugccaucguccuagaauuuuucaugaugguucugcucauucccgagccagagaaacaacguaccccucaggauaaucagcuugcauaugugguaaucggaauacugacuuuggcugccaucguggcggcuaacgaaaugggccugcucgagacaaccaagcgcgaccuggguaugagcaaagaaccgggggucgugagucccaccuccuaccuugacguugaucuccacccagccagcgcauggacacuguaugccguggcuacuacggucauuaccccuauguugcgacauacaaucgagaauucuacugcaaacguaucacuggccgcgauugcuaaucaagccgugguuuuaaugggccuagacaagggauggcccaucuccaagauggaucugggcgugccacuccuugcacuggggugcuacagucaggucaacccuuugacccugacagccgcugugcuccugcuugucacccacuacgccauaauuggacccggcuuacaggcaaaagcuacuagagaagcccagaagaggacggcggccgguaucaugaaaaacccgacaguggacgggaucaugaccauugaucuggacccaguuaucuaugauagcaaguuugagaaacaacucggacaggugauguugcugguacuaugugcagugcagcugcuccuuaugcggacuucgugggcuuucugcgaggcccugaccuuggcaacaggcccuauaacuacccugugggaagguucucccggcaaguuuuggaauacaacgauugcugucuccauggccaacaucuuccgcgggagcuaccucgccggagcgggccuggcuuuuucaauuaugaagaguguugggaccggaaaaagaggcacugguucucagggggagacauuaggagaaaaguggaaaaagaaacuuaaucaacuguccaggaaggaguucgaccucuauaaaaagagcggcaucaccgaaguggaucggacugaggcaaaggagggucuaaaacgaggcgaaauaacacaucacgccgucucaagagggagugcuaagcugcagugguucguggagcgcaacaugguaaucccagaaggaagggugauugacuugggcugugggcggggaggcuggagcuacuauugcgccggucugaaaaagguuaccgaggugcguggguacacgaaaggaggccccggccaugaagagccugucccgauguccaccuauggguggaauaucgugaagcucaugucuggaaaggaugucuuuuaccuucccccagagaaaugugacacacuguugugcgauauuggugaaagcuccccuucacccacuguggaggaaucuagaaccaucaggguucugaagaugguagagccuuggcucaaaaacaaucaguucuguauuaagguguuaaacccauacaugcccacagucaucgagcaccuggaacgccuucagcggaaacacggcgggaugcuggugcgaaauccucuaaguagaaacucgacucaugagauguauuggauaagcaauggaaccggcaacauuguuuccucugugaauauggucucaaggcuccuguugaaccgcuuuacaaugaccuaccggagaccaacuaucgaaaaggacguggaccugggugcagggacgcgucacguaaaugccgagcccgaaacaccgaacauggaugugaucggagagaggauucggcgcauaaaggaggaacauagcuccaccuggcacuaugacgaugagaacccuuacaaaacuugggcuuaucacggcaguuacgaaguuaaggcgaccggcucugccagcucaaugaucaauggggucgugaaacuccuuacaaagccaugggacgugguccccacgguuacccaaauggcaaugacugauacaaccccuuucggacagcagcgaguguuuaaagagaagguagacacuagaacaccaaagcccaugccggguaccaggaaagugauggaaauuacagcugaguggcuguggcggacuuuaggccgcaacaagagaccuaggcugugcacccgagaggaauucacgaaaaagguccggaccaaugccgcaaugggggccguguuuacagaggaaaaccaaugggauuccgcucgugccgcgguugaggacgaagaguucuggaaauugguggauagagagcgcgaacuccauaagcugggaaaauguggcaguugcgucuauaauaugauggguaagagggagaagaaacuaggggaauuuggaaaggcaaaaggcagccgggccaucugguacauguggcuuggcgcuagauaccuggaguucgaggcccucggguuucugaacgaagaccacugguucucucgcgagaauuccuauucaggaguggaaggugagggcuugcauaagcugggguacauucucagggauaucagcaaaauacccggaggcgcaauguaugcugacgacacugccgguugggauacccgaaucacagaagacgaucuucacaacgaggagaagauuacucagcagauggacccagaacaucggcagcuggcuaaugccaucuuuaaguuaaccuaccaaaacaaaguaguuaaggugcagagaccuacgcccaaagggacagucauggauauuaucucgaggaaggaccagcgcggaucuggccaggugggcaccuaugggcugaauacuuucacaaacauggaggcacaauugauacgucagauggaaggagagggugugcucaguaaaaccgaucuggaaaauccacaccuacuugagaagcggauuacucaguggcuggagaccaagggcgucgaaagacucaaaaggauggcgaucuccggggacgauugcguugugaagcccaucgacgaucgcuucgccaacgcucuguuggccuuaaaugacaugggaaaaguacgaaaggauauuccucaguggcaaccaagcaaaggcuggcacgacuggcagcaggugccguuuuguucacaucacuuccaugagcugauaaugaaggacggucggaagcucgucgugcccugcagaccucaggaugaacuuaucgggagggcacgcauuucccaaggagcuggcuggucucugaaagagacagccugucuaggcaaggcauacgcccagaugugggcgcugauguauuuucacagacgggaccucagguuggcuagcaacgccaucugcagugcaguuccagugcacuggguccccacgucccguaccacuuggagcauucaugcccaccaucaguggaugacaaccgaagauaugcugacuguguggaaccgaguauggaucgaggacaauccuuggauggaggauaaaacaccaguuaccacgugggaagacgugcccuaccuugggaagcgcgaggaucaaugguguggaucucugauaggucucacaucaagagcuaccugggcccagaacaucuuaacugcaauucagcagguccggagucugaucggcaaugaagaguucuuggacuacaugccuuccaugaaaagguuucgcaaggaggaagagcuggaaggggcuauuugguga

SEQ ID NO: 15087 - RNA, 9873 nt, Artificial Sequence
  derived and/or modified CDS sequence (opt3) from DENV-3__AB214882__SS-prME
accagccugugccucaugaugaugcuucccgccacacuggcuuuccacuugacuuccagagacggcgagccuaggaugaucguggggaagaacgaacggggaaaaucuuuacuguuuaagacggcaucagguauuaauauguguacccuaauagccauggaucucggcgagaugugcgacgauacagucacuuacaaauguccacugaucaccgaaguugagccggaagacauugauugcugguguaaccuuacaaguaccugggugacuuaugggacaugcaaucaggcgggagagcaucgccgagacaagcguagcguagcucuggccccccacgugggcauggguuuggauaccagaacgcaaacuuggauguccgcagagggggccuggaggcaggucgaaaaaguggagaccugggcuuuccggcauccuggauuuacaauccucgcacuguuccuggcccacuacauuggcacuucucucacccagaagguugugaucuuuauauuacugaugcuugucacaccaucgaugaccaugcgcugugugggcguagggaacagagacuucguugaaggauugucaggugcuacguggguggaugucgugcuggagcauggcgggugcgugacuacaauggccaagaauaaacccacccuagacaucgagcuccagaagacugaagcgacacaacuggcaacccuuaggaaacuguguauugagggaaagaucacgaacgucaccacagauagccggugcccuacucagggcgaagccauuuugccagaggaacaggaccagaauuauguuuguaaacacaccuacguggaucgcgguugggggaacggaugcggccucuuuggcaaggggagucugguaacaugcgcuaaguuccaauguuuagaguccaucgagggaaaagugguccagcacgaaaaucugaaguauacugugauaauuaccguucauacaggugaccagcaccaggugggcaacgagacccaaggggucacugccgaaaucacgccccaggcaucuacaguggaggcuguacucccugaauacggaacccuuggccuggagugcagcccacgaacugguuuggacuuuaaugagaugauucuacugaccaugaaaaacaaggccuggaugguucauagacagugguucuuugaucucccgcugcccuggacauccggggcgaccacugaaacaccuacguggaauaaaaaggagcuucuggugaccuucaaaaacgcccacgcaaagaagcaagaagucguggucuugggcucacaggagggagcuaugcacacugcccucacaggcgcuaccgaaauccagacaagugggggaacuagcaucuuugccggucaucugaaauguagguuaaagauggacaaacuggagcuaaagggcaugucuuaugcaaugugcuccaaugccuucgugcucaaaaaggagguuucagaaacccagcacgggacgauucugauaaagguggaguacaaaggagaagaugcuccauguaagauccccuucagcaccgaggacggccaagguaaagcgcauaacgggcggcuuauuacagcaaacccuguagucacuaagaaagaggaaccagugaauaucgaggccgaacccccguuuggcgagaguaacauaauuaucggaaucggcgauaaggcuuugaagauuaauugguacaaaaaggggucuuccaucggaaaaauguucgaagccaccgcacguggugcccgcagaauggcuauucugggcgacacagccugggauuuugggagcguuggaggcgugcucaacucgcuggguaagaugguccaccagauauucgggucugcauauacugcgcuuuuuuccggcgugucauggaucaugaaaauuggaaucggcguacuguugaccuggaucgggcucaauaguaagaacacgagcauguccuucucuugcauugugauaggaaucauuacacuguacuuaggcgcuguuguccaggccgacauggguugugugaucaauuggaaggggaaagagcugaagugcggaagcggcauuuuugugaccaacgagguccauacuuggacagaacaguauaaauuccaagcagauucaccuaagaggcuagccaccgcuaucgccggugcaugggagaauggcguuugugggauacggaguacuacccgaauggaaaaccuccuguggaaacagaucgcuaaugagcuuaacuacauuuugugggaaaauaacaucaagcugacaguggugguaggagacauuacgggcauccucgagcaggggaaacgcacccugacuccccagccaauggaguuaaaguauuccuggaagacauggggaaaagccaagauagucaccgcggaaacacaaaauagcucuuuuauuaucgauggcccuaacacucccgagugcccaucagccaguagagcuuggaacgugugggaaguugaggacuacgguuucgggguguuuaccacgaauauuuggcugaaacuuagggaaauguauacacaguugugugaccaccggcucaugagcgcagccgucaaggaugagcgcgcugugcacgccgacaugggauacuggaucgagucccagaaaaacggcucuuggaagcuggaaaaggcaucgcuaauagagguuaaaaccugcacuuggcccaagagccauacccugugguccaauggugugcucgaaucagauaugaucauuccuaaaagucuggcgggcccaaucucucagcacaacuacagaccgggguaucauacacaaacugccggacccuggcaccuuggcaaguuggagcuggacuucaauuacugcgaggggaccacaguagucauuacggaaaacuguggaaccaggggcccuagcuuacguacuacaaccguguccgguaaacucauccacgaguggugcugucggucaugcacucugccaccccuucgauauaugggggaagauggauguugguacggcauggagauaagaccuauuaaugaaaaggaggagaacauggugaagagccuggucucugcugguuccggcaaaguugacaauuuuacaauggggguguugugccucgccauccuguucgaagagguaaugaggggaaaguucggcaaaaagcauaugaucgcaggggugcuauuuaccuucguccugcuccugaguggacagauuacguggcgcgauauggcucggacucuuaucaugauuggcagcaacgccucugacagaauggguaugggggugaccuauuuggcacugauagccacauuuaaaauccagccauucuuagcucucggauuuuuccugaggaagcuuaccucccgcgaaaaucugcuacucggcguuggccuggcgauggccacuacauugcaacugcccgaggauauugaacagauggcaaacgggaucgcuuuaggacucauggcccugaagcuuauuacccaguuugagacauaccagcuguggacugccuuggcuucacucauguguaguaauaccaucuucacgcugacaguggcauggcgaaccgccacucuaauacuggcggguaucagccuucucccggucugccaaucguccucuaugcggaaaaccgacuggcugccuaugacaguggcugccaugggcguuccacccuugccucuguuuauuuucagcuuaaaggauacucucaaacguagaucauggccccugaacgagggggugauggcagucggacuuguaaguauccuggccuccucuuugcucaggaaugacgugccaauggcuggcccucugguugcaggugggcuacugauugccuguuaugugaucaccggaacgagcgcggaucuuacagucgaaaaggcugccgacgugaccugggaggaagaggcagaacagacuggcguaucccacaaccucaugauaacaguggacgaugacggcaccaugcgcauuaaagaugacgagacugagaacauccugacagucuuguuaaagaccgcccugcucaucguuucagggauuuuucccuacagcauaccagcuacgcugcuuguguggcauacuuggcagaaacagacccaacggaguggagugcugugggaugucccgucuccucccgaaacacagaaggccgaguuggaagaggguguguacagaaucaagcagcagggcauuuucgggaaaacccaaguuggaguaggcgugcagaaggagggugucuuucacacaauguggcaugugacuaggggggcaguucuaacccacaauggaaaacgacuggaaccaaacugggcuuccgugaagaaagaccucaucagcuauggcggcggguggcgccugucggcccaguggcaaaagggagaggaaguccaggugauugcgguagagcccgguaagaauccuaaaaacuuccagacgaugccaggcaucuuccagacaacuaccggggaaauaggagccaucgcacuugauuuuaagcccggcacaucagguucuccuauuaucaaucgggaggggaaagucgugggauuauacggcaacggcguugugaccaagagugggggauaugucuccgguauugcucaaacuaaugccgagccggacggcccaacccccgaacuggaggaagagauguucaaaaagagaaaccucacaaucauggauuugcacccugggagcggaaagacgaggaaauaccugccagcuauagugcgugaagcaauuaagcgccggcucagaacucugauccuugcccccaccaggguuguggccgcugagauggaggaagcgcugaaaggcuugccuauccgauaucagacaaccgcaacuaagucugagcauacagguaaagaaauugucgaccuaaugugccacgccaccuuuacgaugcggcugcucagcccggugcgcguacccaauuacaacuuaaucauaauggaugaggcucauuucacugacccagccuccauugcagccagaggguauaucucaacaagggugggaaugggcgaagcugcggccauuuuuaugaccgcaaccccucccggcacugcugaugccuucccacagaguaaugcaccuauccaggacgaggagcgggacauacccgaacgaagcuggaacucugggaaugauuggauuacagacuuugccggaaagaccguuugguucgucccauccaucaaggcugguaacgauaucgccaauugucugagaaaaaacggcaagaaagugauucaacuuucacgcaagacauuugacacugaguaccagaaaacgaagcugaacgauugggacuucguggucaccacagauaucagugaaaugggggcgaauuuuaaggcagacaggguaauugauccgcgucggugccucaaaccugugauauugacugacggacccgagagaguuauccuggccggcccaaugcccgugaccgucgcuagcgccgcucagaggcgcggucgaguggggagaaacccucagaaggagaaugaucaauacauuuucacaggccagccacucaacaaugacgaagaccacgcacauuggaccgaggccaaaaugcugcuugauaacaucaauacucccgaaggaaucauuccugcucuauucgagccggaacgggagaaguccgccgcaauagacggcgaguauaggcugaaaggggaaucucgcaagacguuuguugaguugaugcguagaggagauuuaccaguguggcuggcgcacaaagucgccucggaagguaucaaguacaccgaccggaaguggugcuucgauggcgagaggaacaaucagauucucgaagagaacauggacguggagaucuggacaaaagaaggggagaagaaaaagcugcgcccccgauggcuugaugcuagaacuuauagcgacccucuggcccucaaagaauuuaaggauuucgcagcuggacggaagucaauugccuuugacuugguaaccgagaucggcagggugcccucccaccuggcacaucgcacaagaaaugcccuagauaaccugguuaugcuccacaccagugaacauggugggagggcuuaccggcacgcggucgaggagcuuccagaaacuauggagacacuguuauugcugggccucaugauacugcuuacgggaggcgccaugcuguuccucaucucugggaaaggaauugguaagaccagcaucggcuugauuugugugguggcauccucagggaugcuguggauggcugacaucccuuuacaguggauagccucugccauuguccuagaauuuuucaugaugguucugcucauccccgagccagagaaacaacguacuccucaggauaaucagcuugcauaugugguaauuggaauccugacauuggcugccauaguggcggcuaacgaaaugggccugcucgagaccaccaagcgcgaccuggguaugagcaaagaaccgggggucgugagucccacauccuaccuugacguugaucuccacccagccagcgcauggacucuguaugccguggcuacgaccgucaucacaccuauguugcgacauacuauugagaauucuaccgcaaacguaucacuggccgcgaucgcuaaucaagccgugguuuuaaugggccuagacaagggauggcccauuuccaagauggaucugggcgugccacuccuugcacuggggugcuacagucaggucaacccuuugacacugaccgccgcugugcuccugcuugucacucacuacgccaucauaggacccggcuuacaggcaaaagcuacgagagaagcccagaagaggacagcggccgguauuaugaaaaacccgaccguggacgggaucaugacuaucgaucuggacccaguuauuuaugauagcaaguuugagaaacaacucggacaggugauguugcugguacuaugugcagugcagcugcuccuuaugcggaccucgugggcuuucugcgaggcccugacauuggcaacuggcccuaucaccacacugugggaagguucucccggcaaguuuuggaauacgaccauagcugucuccauggccaacauuuuccgcgggagcuaccucgccggagcgggccuggcuuuuucaaucaugaagaguguugggacuggaaaaagaggcacagguucucagggggagaccuuaggagaaaaguggaaaaagaaacuuaaucaacuguccaggaaggaguucgaccucuauaaaaagagcggcauuacugaaguggaucggacagaggcaaaggagggucuaaaacgaggcgaaaucacccaucacgccgucucaagagggagugcuaagcugcagugguucguggagcgcaacaugguaauaccagaaggaagggugaucgacuugggcugugggcggggaggcuggagcuacuauugcgccggucugaaaaagguuacggaggugcguggguacaccaaaggaggccccggccaugaagagccugucccgauguccacauauggguggaauauugugaagcucaugucuggaaaggaugucuuuuaccuucccccagagaaaugugacacucuguugugcgauaucggugaaagcuccccuucacccaccguggaggaaucuagaacaauuaggguucugaagaugguagagccuuggcucaaaaacaaucaguucuguaucaagguguuaaacccauacaugcccacugucauugagcaccuggaacgccuucagcggaaacacggcgggaugcuggugcgaaauccucuaaguagaaacucgacccaugagauguauuggaucagcaauggaacaggcaacauaguuuccucugugaauauggucucaaggcuccuguugaaccgcuuuaccaugacuuaccggagaccaacgauugaaaaggacguggaccugggugcagggacacgucacguaaaugccgagcccgaaaccccgaacauggaugugaucggagagaggauccggcgcauuaaggaggaacauagcuccacuuggcacuaugacgaugagaacccuuacaaaaccugggcuuaucacggcaguuacgaaguuaaggcgacaggcucugccagcucaaugauaaauggggucgugaaacuccuuacgaagccaugggacgugguccccaccguuacucaaauggcaaugacagauaccacuccuuucggacagcagcgaguguuuaaagagaagguagacacaagaaccccaaagcccaugccggguacaaggaaagugauggaaaucacugcugaguggcuguggcggaccuuaggccgcaacaagagaccuaggcugugcacgcgagaggaauucaccaaaaagguccggacaaaugccgcaaugggggccguguuuacugaggaaaaccaaugggauuccgcucgugccgcgguugaggacgaagaguucuggaaauugguggauagagagcgcgaacuccauaagcugggaaaauguggcaguugcgucuauaauaugauggguaagagggagaagaaacuaggggaauuuggaaaggcaaaaggcagccgggccauuugguacauguggcuuggcgcuagauaccuggaguucgaggcccucggguuucugaacgaagaccacugguucucucgcgagaauuccuauucaggaguggaaggugagggcuugcauaagcugggguacauccucagggauauuagcaaaauccccggaggcgcaauguaugcugacgacaccgccgguugggauacacgaauaacugaagacgaucuucacaacgaggagaagaucacccagcagauggacccagaacaucggcagcuggcuaaugccauuuuuaaguuaacguaccaaaacaaaguaguuaaggugcagagaccuacacccaaagggaccgucauggauaucauuucgaggaaggaccagcgcggaucuggccaggugggcacuuaugggcugaauacauucaccaacauggaggcacaauugauccgucagauggaaggagagggugugcucaguaaaacugaucuggaaaauccacaccuacuugagaagcggauaacccaguggcuggagacaaagggcgucgaaagacucaaaaggauggcgauuuccggggacgauugcguugugaagcccaucgacgaucgcuucgccaacgcucuguuggccuuaaaugacaugggaaaaguacgaaaggauaucccucaguggcaaccaagcaaaggcuggcacgacuggcagcaggugccguuuuguucacaucacuuccaugagcugauuaugaaggacggucggaagcucgucgugcccugcagaccucaggaugaacuuauagggagggcacgcaucucccaaggagcuggcuggucucugaaagagacggccugucuaggcaaggcauacgcccagaugugggcgcugauguauuuucacagacgggaccucagguuggcuagcaacgccauuugcagugcaguuccagugcacuggguccccaccucccguacuacauggagcauccaugcccaccaucaguggaugaccacugaagauaugcugacaguguggaaccgaguauggauugaggacaauccuuggauggaggauaaaaccccaguuacgacaugggaagacgugcccuaccuugggaagcgcgaggaucaaugguguggaucucugaucggucucaccucaagagcuacuugggcccagaacauauuaaccgcaauccagcagguccggagucugauuggcaaugaagaguucuuggacuacaugccuuccaugaaaagguuucgcaaggaggaagagagcgaaggggcuaucugguga

SEQ ID NO: 15088 - RNA, 9873 nt, Artificial Sequence
  derived and/or modified CDS sequence (opt3) from DENV-3__JX669489__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcgccgacgugacaagagaagcguagcccuugcaccccacgugggcaugggucuggauacaaggacccaaacguggauguccgccgagggggcuuggcggcaggucgaaaaaguggagacuugggcauugcgccauccuggauucaccauucucgcccuguuucuggcucacuacaucggcacaucucucacucagaagguugugauauucaucuuacugaugcuugucaccccaucgaugacaaugagaugugugggcguagggaacagggacuuuguugaaggauugucaggugccaccuggguggaugucgugcuggagcauggcgggugcgugacgacuauggcgaagaauaaacccacacuagacauugagcuccagaagaccgaagcaacucaacuggccacacuucggaaacuguguaucgagggaaagauuaccaacaucacgaccgauagccgcugcccuacacagggcgaagcugucuugccagaggaacaggaccagaauuauguuuguaaacacacuuacguggaucgagguugggggaacggaugcggccucuucggcaaggggagucugguaaccugcgccaaguuucaauguuuagagcccauagagggaaaagugguccaguaugaaaaucugaaguacacagugauuaucacuguucacaccggugaccagcaucaggugggcaacgagacacaaggggucaccgcagaaauuacuccucaggcuuccacgacagaggccauccucccagaauauggaacccuuggccuggagugcucuccgagaacugguuuggacuucaaugagaugauccuacugaccaugaaaaacaaggcguggauggugcacaggcagugguuuuucgaucucccccugccuuggacaagcggggccaccacugaaacaccaacguggaaucggaaagagcuucugguaaccuuuaagaacgcacaugcuaaaaagcaagaaguuguggucuugggcucccaggagggagccaugcacacugcucucacaggcgccaccgaaauucagaauucagggggaacaaguauauucgcaggucaccugaagugucguuuaaaaauggacaagcuggagcuaaaaggcaugagcuacgccaugugcacuaacaccuuugugcucaagaaagaggucucugaaacgcagcaugggaccauccugauuaagguggaguaccgcggagaagaugcucccuguaagaucccuuucuccacagaggacggccaagguaaagcgcacaacgggagacuuauaacugcaaauccaguugugaccaagaaagaggaacccguaaacauugaggccgaaccgccuuucggcgagucaaauaucgucaucggaauuggcgauaacgcuuugaagaucaauugguauaaaaaggggagcaguauuggaaagauguuugaagccacagcaaggggugcccggcgaauggcuauacugggcgacacugccugggauuucgggucugugggaggcguucucaacucccuggguaaaauggugcaucagaucuuugggagcgcauacaccgcgcuuuucucgggcgucucuugggugaugaagauuggaaucggcguacuguugacguggaucgggcucaauuccaaaaacacaucaaugaguuuuagcugcauugcuauaggaaucauuacccuguauuuaggcgccgugguucaggcagacauggguugugucaucaauuggaaggggaaagagcugaagugcggauccggcauuuucgugacuaacgaggugcacacauggaccgaacaguacaaguuucaagccgauucucccaaacgccuagcuacugccaucgcaggugcuugggagaauggcgucugugggauaagaagcaccacaaggauggaaaaccuccuguggaagcagaucgccaaugagcuuaacuauauuuugugggaaaauaacaucaaacugacgguuguggugggagacauuaucggcguacucgagcaggggaagcggacccugacuccacagccuauggaguuaaaauacucauggaagacauggggaaaagcgaagauagucaccgccgaaacacaaaacaguuccuucauuaucgauggccccaauacuccagagugccccagcgcuucucgcgcauggaacgugugggaaguugaggacuaugguuuugggguguucaccacgaauauuuggcugaagcuuagagaagucuacacacaguugugugaccauaggcucaugucagccgcugugaaagaugagcgugccguucacgcagacaugggauacuggaucgagagucagaagaacggcagcuggaaacuggaaaaggcgucccuaauagaggugaaaaccugcacuuggccuaagucucacacccuguggucgaaugguguacucgaaagcgauaugaucauuccaaagucccuggccggcccgaucucacagcauaaccaccggcccggguaucauacacaaacugcuggaccuuggcaccuuggcaaauuggagcuggacuuuaauuacugcgaggggaccacagucgugauuacggaaaacuguggaacccgaggcccaaguuuaagaacuacaaccgugucugguaagcucauccacgaguggugcuguaggagcugcacucugcccccucuucgcuauaugggggaagauggauguugguacggcauggagauacggccaauuuccgaaaaagaggagaauauggucaagucacugguuagcgccgguucuggcaaaguggacaacuucacaauggggguauugugccucgcaauccuguuugaagaggugaugagaggaaaguucggcaagaaacauaugaucgcugggguccuauucaccuuugugcugcuccuguccggacagauuacguggagggauauggcccacacucuuaucaugauuggcaguaaugcaagcgaccgcauggguauggggguuaccuauuuggcccugauagcuacauucaagauccagcccuuuuuagcgcucggauucuuucugcgaaaacuuaccucucgggaaaaccugcuacucggcgugggccuggccauggcaacuacauugcaacugccggaggauauugaacagaucgcuaaugggauugccuuaggacucauggcccugaagcuuaucacccaguucgagacauaccagcuguggacugcuuugauaucccucaccuguucaaacacgauguuuacacugaccgucgcauggcguacugccacccuaauccuggcgggugugagucuucucccuguuugccaaagcucguccaugagaaaaacagacuggcugccaauggcuguggccgcaaugggcguccccccuuugccccuguucauuuuuucuuuaaaggauacucucaagaggcgcagcuggccacugaaugaggggguaauggccgugggacuuguuucaauccuggcuaguuccuugcuccggaacgacgugccuauggcaggcccccuggucgccggugggcuacugauugcguguuaugugaucaccggaacgucugcugaucuuacaguagaaaaagccgcagacauaaccugggaggaagaggccgaacagacuggcgugagccauaaccucaugauuacagucgacgaugacggcaccaugagaaucaaggaugacgagacugagaauauccugacaguuuuguuaaaaaccgcucugcucauuguguccgggguguucccauacucaauaccggccacgcugcuugucuggcacacuuggcagaagcagacccaaaggagcggagugcugugggauguuccuagucccccagaaacacagaaagcagaguuggaagaggguguauaccgaaucaagcagcagggcauuuuugggaaaacccaagugggagucggcgugcagaaggaggguguuuuccauacaauguggcacgugacucgcggggcuguccuaaccuauaacggaaagcggcuggaacccaauugggccucugugaaaaaggaccucaucuccuacggcggcggguggagacugagcgcgcaguggcaaaaaggagaggaaguacaggucauugccguggagccugguaagaacccaaaaaauuuucagacgaugcccggcacauuccagacuaccacaggggaaaucggagcaauagcucuugauuucaagccuggcaccucggguucaccgaucauuaacagggaggggaagguugugggauuauauggcaauggcgucgugacuaaaaacgggggauacguuucugguaucgcccaaaccaaugcugagccagacggccccacaccugaacuggaggaagagauguuuaagaaacguaaccucacgauuauggauuugcacccagggaguggaaagacucgcaaauaucugcccgcaaucgugcgggaagccauaaagagaaggcuccgaacccugauucuugccccuacacgggucguggcugcggagauggaggaagcacugaagggcuugccgauccgcuaccagaccacugccacaaaauccgagcauaccgguagagaaaucguagaccuaaugugccacgcuacguucacuaugaggcugcucagccccgugcggguuccaaauuauaacuuaauuaucauggaugaggcccauuuuacagacccugcaucuauagccgcucgaggguacauuagcaccagagucggaaugggcgaagcggccgcaaucuucaugaccgcuacucccccaggcacagccgaugcauuuccucaguccaaugcccccauucaggacgaggagcgcgacaucccagaaaggucauggaacagugggaaugaguggauaaccgauuucgcuggaaagacagugugguuugugccgagcauuaaagccgguaacgacaucgcgaacugucugcguaagaauggcaaaaaggucauccaacuuucucggaagacuuucgauacggaauaccagaaaaccaagcugaacgacugggauuuuguagugacaacugacauuuccgagaugggggcaaauuucaaagccgauagaguuaucgacccuaggcgcugccucaagcccgugauuuugaccgauggaccagagcgagucauacuggcuggccccaugccugugacagccgcuucagcagcccagagacgggguaggguugggcgcaacccacagaaagaaaaugaccaauauaucuuuaccggccagccccucaacaaugaugaggaccacgcucauuggacugaagccaagaugcugcuugacaacauuaauacgccugagggaaucaucccggcacuauucgaaccagagcgugagaagagugcggccauugauggcgaauacagacugaaaggggagagccggaagaccuucguggaauugaugaggcgcggagacuuacccgucuggcuggcucacaaaguggccuccgaggguauaaaguauacagaucgaaaauggugcuuugacggccagagaaacaaucagauccucgaagagaacauggauguagagauuuggacuaaggaaggggagaaaaagaagcugcggccuagguggcuugacgcacgcaccuacucugauccccuggcucucaaagaauucaaggacuuugccgcaggaagaaaaucgaucgccuuggaucuggugacagagauuggcaggguuccaagccaccuagcucaucggacccguaaugcgcuggacaaccucgucaugcuucacacuucagaacauggugggcgcgccuaucgacacgcaguggaggagcugccugaaacaauggagacguuauugcugcucggccugaugauccuucugaccggaggcgcuaugcucuucuugauauccgggaagggaaucgguaaaacuaguauuggccugaucugugugauugccucuagcgggauguuauggauggccgaaaucccccuacaauggauagcauccgcuauuguccuggaguuuuucaugaugguucuccuuaucccagagccugaaaagcagagaacaccgcaggauaaucaacuggccuacgugguaauuggaaucuugacccuggcggcuauaaucgccgcaaacgagaugggccuccuggaaaccacaaagagggaccuugguaugucaaaagagcccgggguggucucuccaacuagcuaucucgauguggaccugcacccugccagugcuuggacguuguacgcaguugccaccacagugauuacucccaugcugcggcauaccaucgaaaauuccacagcgaacgucagcuuagcugccauugcaaaccaggccguagugcuaaugggccuggacaagggauggccaaucucuaaaauggaucucggcguuccucuucuggcuuuggggugcuacucacaggugaauccccugacccucacugccgcaguccugcuuuuaauaacgcacuaugcuauuaucggaccgggccugcaggccaaggcgacacgcgaggcccaaaaaagaaccgcagcugguaucaugaagaacccaacuguggacgggauuaugaccaucgaucucgacccugucauauacgauuccaaguuugagaaacaguugggacaggugaugcugcuaguucugugugccgugcagcuccuucugaugaggacaaguugggcauugugcgaagcucugacucucgccaccggccccauuacaacgcugugggaggguagcccaggcaaguucuggaauaccacuaucgccguaucgauggcgaacauuuuucgggggucuuauuuagcuggagcaggccuugccuucuccaucaugaaaagcguggggacaggaaagcgaggcaccgguucacaaggggaaacucugggagagaaauggaagaagaaacucaaucagcuaaguagaaaggaauuugaccuguacaaaaagucuggcauaacagaggucgaucgcaccgaggcuaaagaagguuugaagaggggcgagaucacgcaucacgccguuucccgggggagcgcaaaacugcagugguucguggaacguaacauggucauucccgagggaagagugaucgaccucggcugugggaggggaggcuggucauauuacugcgccggucuuaagaagguaaccgaagugcgcggguauacaaaaggaggcccuggccaugaggagccgguucccaugaguacuuacggguggaauauugugaagcugaugagcggaaaagaugucuuuuacuugccaccugaaaagugugacacccugcucugcgauaucggugaguccucucccagcccuacaguggaagagucccggacuauucgagucuuaaaaaugguggagccauggcugaagaacaaucaguucuguaucaagguucuuaaccccuauaugccuaccguaauagaacaccuggagagacuacaaaggaaacacggcgggaugcucgugcgcaauccacugucacggaacucuacacaugaaauguacuggauuaguaauggaaccggcaacaucgucgcuucggugaauaugguuagcagauugcugcucaaccguuucacuaugacgcacaggcggcccacaaucgagaaggacguggaucuuggugcggggacccgccaugucaacgccgaaccggagacuccuaauauggacgugauuggagagcgaauaaaaagaaucaaggaagagcacaacuccaccuggcacuaugacgaugaaaauccauacaaaacaugggcauaucauggcucuuacgagguaaaggcuacgggcucagccagcuccaugauuaacggggugguuaagcuguuaaccaaacccugggacgucgugccuauggugacucagauggcaaugacagauaccacuccauuuggacagcaaagggucuucaaggaaaaaguugacacacggaccccccgcaguaugccggguacaagaagggugaugggcaucacugccgaguggcuguggcgaaccuuggggcggaauaagaaaccucgucucugcacgagagaggaauuuaccaagaagguacgcacaaacgcugccaugggagcgguguucacugaggaaaaucagugggauucugcaaaagccgcugucgaggacgaagauuuuuggaagcugguggacagggagcgggagcuacacaaacuuggcaagugugguagcugcguuuauaacaugauggggaaaagagaaaagaaacugggagaguucggcaaggccaagggcucacgcgcaauuugguacauguggcucggggcuagguaccuggaauuugaggccuugggauuccugaaugaggaucauugguuuucccgagaaaacaguuauagcgguguggagggcgaagggcuccacaaacuuggauacauccugcgggacauaucuaagauccccggcggugcuauguaugccgaugacaccgcagggugggacacaagaauuacugaggaugacuuacauaaugaagagaaaaucacccagcagauggauccagagcacaggcaacuggcgaacgccauuuucaaguugacguaccagaauaaagucgugaagguacagcgcccuacacccaccggaacuguuauggacaucauaucccguaaggaucagcggggcucaggccaaguggggacauauggacucaacaccuuuacuaauauggaagcucagcugauuagacagauggagggugaaggcguccuaagcaaagccgaccuugagaacccacaccugcccgaaaagaaaaucacccaguggcucgagacaaaggggguggagaggcugaaacgcauggcaaucucgggagaugacugcguggucaagccuauugaugaccgauucgcuaacgccuuguuagcacugaaugauaugggcaagguucggaaagacauaccacaauggcagccgucuaaggguuggcaugauuggcagcaggugcccuuuuguagucaccauuuccacgaacucaucaugaaagacgggagaaagcuuguagugccuugcaggccacaagacgagcugauuggacgcgccagaaucucccagggcgcgggcuggagccuacgggaaacggcuugucuggggaaagccuacgcacagauguggucacucauguauuuccacaggcgugauuugcgacuggccuccaacgcuauuugcucugccguccccgugcauuggguuccuaccagccgcacuacauggaguauccacgcacaucaccaauggaugaccacugaggacaugcuuacaguguggaauagagucuggauagaagauaacccauggauggaggacaagacccccgugacgacaugggagaauguaccuuaccugggaaagcgggaagaucaguggugugguucccucaucggcuuaaccagcagggcuacuugggcccagaacauuccgaccgcgauccagcaaguucgcucucugauugggaaugaggaauuuuuggacuacaugccaucaaugaaaagauuccggaaggaggaggaaagugagggagcuaucugguga

SEQ ID NO: 15089 - RNA, 9873 nt, Artificial Sequence
  derived and/or modified CDS sequence (opt3) from DENV-3__JX669498__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcgccgacgugacaagagaagcguagcccuugcaccccacgugggcaugggucuggauacaaggacccaaacguggauguccgccgagggggcuuggcggcaggucgaaaaaguggagacuugggcauugcgccauccuggauucaccauucucgcccuguuucuggcucacuacaucggcacaucucucacucagaagguugugauauucaucuuacugaugcuugucaccccaucgaugacaaugagaugugugggcguagggaacagggacuuuguugaaggauugucaggugccaccuggguggaugucgugcuggagcauggcgggugcgugacgacuauggcgaagaauaaacccacacuagacauugagcuccagaagaccgaagcaacucaacuggccacacuucggaaacuguguaucgagggaaagauuaccaacaucacgaccgauagccgcugcccuacacagggcgaagcugucuugccagaggaacaggaccagaauuauguuuguaaacacacuuacguggaucgagguugggggaacggaugcggccucuucggcaaggggagucugguaaccugcgccaaguuucaauguuuagaguccauagagggaaaagugguccaguaugaaaaucugaaguacacagugauuaucacuguucacaccggugaccagcaucaggugggcaacgagacacaaggggucaccgcagaaauuacuccccaggcuucuacgacagaggccauccucccugaauauggaacccuuggccuggagugcagcccaagaacugguuuggacuucaaugagaugauccuacugaccaugaaaaacaaggcguggauggugcacaggcagugguuuuucgaucucccgcugcccuggacauccggggccaccacugaaacaccuacguggaaucggaaagagcuucugguaaccuuuaagaacgcacaugcuaaaaagcaagaaguuguggucuugggcucacaggagggagccaugcacacugcucucacaggcgccaccgaaauucagaauagugggggaacaagcauauucgcaggucaccugaagugucguuuaaaaauggacaagcuggagcuaaaaggcaugucuuacgccaugugcacuaacaccuuugugcucaagaaagaggucuccgaaacgcagcaugggaccauccugauuaagguggaguacaagggagaagaugcuccauguaaaauccccuucucaacagaggacggccaagguaaggcgcacaacgggcgccuuauaacugcaaauccuguugugaccaaaaaggaggaaccaguaaacauugaggccgaacccccguucggcgagagcaauaucgucaucggaacaggcgauaacgcuuugaaaauuaauugguauaagaaggggaguucuaucggaaaaauguuugaagccacugcaagaggugccaggcggauggcuauucugggcgacaccgccugggauuucggguccgugggaggcguucucaacagccuggguaagauggugcaucagauauuugggucggcauacacggcgcuuuucucuggcgucuccugggugaugaaaaucggaauuggcguacuguugacauggaucgggcucaauucaaagaacaccaguaugagcuuuuccugcaucgcuauuggaauaaucacucuguauuuaggcgccgugguucaggcagacauggguugugucauuaauuggaaagggaaggagcugaagugcggaucuggcaucuucgugacaaacgaggugcacaccuggacugaacaguacaaauuucaagccgauagcccuaagcgacuagcuaccgccauugcaggugcuugggagaauggcgucugugggauccgcucaacaacgagaauggaaaaccuccuguggaaacagauagccaaugagcuuaacuauaucuugugggaaaauaacauuaagcugaccguuguggugggagacaucauuggcguacucgagcaggggaaaaggacucugacaccccagccaauggaguuaaaguacaguuggaaaaccuggggaaaggcgaagaucgucacagccgaaacucaaaacuccagcuucauaauugauggcccuaauacccccgagugcccaucugcuucacgggcauggaacgugugggaaguugaggacuaugguuuugggguguucacgacaaauaucuggcugaaacuucgcgaagucuacacccaguugugugaccauagacucaugagugccgcugugaaggaugagagggccguucacgcagacaugggauacuggauugagagccagaaaaacggcuccuggaagcuggaaaaagcgucucuaaucgaggugaagacuugcaccuggcccaagucgcacacacuguggagcaaugguguacucgaauccgauaugauaaucccuaaaucacuggccggcccaauuagucagcauaaccaccguccgggguaucauacucaaaccgcuggacccuggcaccuuggcaaguuggagcuggacuuuaauuacugcgaggggacaacggucgugaucaccgaaaacuguggaacucggggcccuucuuuacgaacaaccacugugagcgguaaacucauucacgaguggugcuguagauccugcacacugccaccccuuagguauaugggggaagauggauguugguacggcauggagauccgcccuauaucagaaaaggaggagaauauggucaaaagccugguuucugccgguuccggcaagguggacaacuucaccauggggguauugugccucgcaauucuguuugaagaggugaugcggggaaaguucggcaaaaagcauaugaucgcuggggucuucuuuacguucgugcuacugcucaguggacagaucacuuggagagauauggcccacacccugauuaugaucggcagcaaugcaucugacaggauggguauggggguuacauaucuugccuugauugcuaccuuuaaaauacagccauuccuggcguuaggauuuuuccuccgcaagcugacuucccgagaaaaccuucugcuaggcgugggccucgccauggcaacaacccugcaauugcccgaggauaucgaacagauggcuaaugggauugcccugggauuaauggcccucaaacugaucacacaguuugagacuuaccagcuuuggaccgcucugauuucauugacguguaguaacacaauguucacccucacugucgcauggcggaccgccacacugauccuagcgggugugagccugcuuccgguuugccaaucguccucuaugcguaagacugacuggcucccuauggcuguggccgcaaugggcgucccaccccugccuuuguuuauauucagccugaaggauaccuuaaaaagaaggucauggccccucaaugaggggguaauggccgugggacugguuaguauccuugcuuccucucuguugcgcaacgacgugccaauggcaggcccucucgucgccggugggcugcuaauugcguguuaugugaucacgggaacaagcgcugaucugaccguagaaaaggccgcagacauuacuugggaggaagaggccgaacagacaggcgugucccauaaccuuaugaucaccgucgacgaugacggcacuaugcggauaaaagaugacgagacagagaauauucucaccguucuguugaagacggcuuuacugaucgugucagggguguuucccuacagcaucccagccacucuccuggucuggcacaccuggcagaaacagacacaaagaaguggagugcuuugggauguuccgucuccucccgaaacccagaaggcagagcuggaagaggguguauacaggauuaaacagcagggcauauucgggaagacacaagugggagucggcgugcagaaggaggguguuuuucauacuauguggcacgugacccgaggggcugucuugacguauaacggaaaacgccuagaaccaaauugggccuccgugaagaaagaccugaucagcuacggcggcggguggcggcucucggcgcaguggcaaaagggagaggaaguacaggucauugccguggagcccgguaaaaacccuaagaauuuccagacaaugccaggcacuuuccagaccacaaccggggaaaucggagcaauugcucuggauuuuaagcccggcacuucagguucuccuaucauaaacagagaggggaaaguugugggacuuuauggcaauggcgucgugaccaagaacgggggauacguuagugguaucgcccaaacaaaugcugagccggacggcccaacgcccgaauuagaggaagagauguucaaaaagaggaaccugacuauuauggaucuccacccuggguccggaaaaacccguaaguauuugccagcaaucgugcgcgaagccauuaagcggagacugaggacacucauccuggcccccacccgagucguggcugcggagauggaggaagcacuuaaaggccugccuauacgguaccagacuacagccaccaagagcgagcauacgggucgcgaaauuguagacuugaugugccacgcuacuuuuacaaugagacuacugucuccggugaggguucccaauuauaaccucaucaucauggaugaggcccauuucaccgacccagcaagcauugccgcucggggguacaucuccacccgagucggaaugggcgaagcggccgcaauauuuaugacugcuacaccucccggcaccgccgaugcauucccacagucaaaugccccuauucaggacgaggagagagacauccccgaacgcaguuggaacagcgggaaugaguggauuacagauuuugcuggaaaaacugugugguucgugccaucuaucaaggccgguaacgacauagcgaacuguuuaaggaaaaauggcaagaaggucauucaacugucccguaaaacguuugauaccgaauaccagaagacaaaacuuaacgacugggauuucguagugacuaccgacaucucagagaugggggcaaauuuuaaggccgaucggguuaucgacccgagaaggugccugaaaccugugauucucacagauggacccgagcgcgucaucuuggcuggcccaaugcccgugaccgccgcuagugcagcccagcgaagaggucggguugggaggaacccucagaaggaaaaugaccaauauauuuucacuggccagccacugaacaaugaugaggaccacgcucauuggacggaagccaagaugcuccuggacaacauaaauacccccgagggaaucauuccugcacuuuucgaaccggagcgcgagaaaagcgcggccaucgauggcgaauaccgucuaaagggggaguccagaaaaacauuuguggaacugaugcggaggggagacuugccagucugguuagcucacaagguggccucugaggguaucaaauauacugaucgcaaguggugcuucgacggccagcgaaacaaucagauucuggaagagaacauggauguagagauauggaccaaagaaggggagaagaagaaacucagaccccgguggcuggacgcaaggacauacucggauccucuugcucugaaggaauuuaaagacuucgccgcaggacgcaagagcaucgcccucgauuuggugaccgagauuggcagaguucccucacaccuggcucauaggacucggaaugcgcuagacaaccuggucaugcuccacacauccgaacauggugggcgugccuaucgccacgcaguggaggagcuuccagaaacgauggagacccuguuauugcugggccucaugauccugcuuacuggaggcgcuaugcuguuucucauuagugggaaaggaaucgguaagacaucuauaggcuugaucugugugauugccagcuccgggaugcuguggauggccgaaaucccuuuacaauggauugcaucagcuaucguccuagaguucuuuaugaugguucugcucauacccgagccagaaaagcagcgaaccccucaggauaaucaacuugccuacgugguaauuggaauccugaccuuggcggcuauuaucgccgcaaacgagaugggccugcucgaaacaacuaaaagagaccuggguaugucuaaggagccggggguggucagccccacgaguuaucuugauguggaccuccacccagccuccgcuuggacccuguacgcaguugccacaacugugauaaccccuauguugaggcauacaaucgaaaauagcaccgcgaacgucucucuggcugccauugcaaaccaggccguaguguuaaugggccuagacaaaggauggcccaucucaaagauggaucugggcguuccacuccuugcucuggggugcuacucccaggugaauccuuugacucugacggccgcaguccuccugcuuauuacacacuaugcuaucauaggacccggcuuacaggccaaagcgacccgggaggcccaaaagcgcacugcagcugguauuaugaagaacccgaccguggacgggaucaugacaaucgaucuggacccagucauuuacgauaguaaauucgagaagcagcucggacaggugauguugcugguucuaugugccgugcagcugcuccuuaugagaacuagcugggcacugugcgaagcuuugacccuggccacaggcccuaucacgacccucugggaggguucgcccggcaaauuuuggaauacuacaauagccguaucuauggcgaacauuuucaggggguccuaucuggcuggagcaggcuuagccuuuagcaucaugaagucaguggggaccggaaaacggggcacugguagucaaggggaaacacuuggagagaaguggaagaaaaagcugaaucagcucucucgaaaagaauucgaccuauacaagaaauccggcauuaccgaggucgauagaacggaggcuaaggaaggucugaaacgcggcgagaucacccaucacgccguuagcagggggucagcaaaguugcagugguuuguggaacggaacauggucauaccagagggacgugugaucgaccugggcugugggagaggaggcuggaguuauuacugcgccggucucaagaaaguaacagaagugaggggguauacuaagggaggccccggccaugaggagccuguuccgaugagcaccuacggguggaauauugugaaacuuauguccggaaaggaugucuucuaccugcccccagaaaaaugugacacauugcugugcgauaucggugagucuagcccuucccccacuguggaagagucacgcaccauucggguccucaagaugguggagccuugguuaaagaacaaucaguucuguaucaaaguucugaacccauauaugcccacaguaauugaacaccuugagcgacugcaaagaaagcacggcgggaugcuagugaggaauccucucucucgcaacaguacccaugaaauguacuggaucucgaauggaacuggcaacauagucgcuagcgugaauaugguuucccggcuguugcugaacagauuuacgaugacacaccguaggccaaccauugagaaagacguggaucucggugcggggacucggcaugucaacgccgaacccgagaccccgaauauggacgugaucggagagcgcaucaagcgaauuaaagaagagcacaacucuacauggcacuaugacgaugaaaauccuuacaagacgugggcauaucauggcucauacgagguaaaggcuaccggcagcgccuccaguaugauaaacggggugguuaaacuucugacuaagccaugggacgucgugcccauggugacacagauggcaaugaccgauacuacaccuuucggacagcaaagagucuuuaaagaaaagguugacaccaggacaccacggucuaugcccgguacucgcagagugaugggcaucaccgccgagugguuauggaggacgcuggggcgaaauaaaaagccgcgguugugcacccgugaggaauucacaaagaaaguaagaacuaacgcugccaugggagcgguguuuaccgaggaaaaucagugggauagcgcaaaggccgcugucgaggacgaagauuucuggaaacucguggaccgcgagagggagcugcacaagcuaggcaaaugugguucaugcguuuauaacaugauggggaagcgggaaaaaaagcuuggagaguuuggcaaggccaaaggcuccagagcaauuugguacauguggcugggggcucgcuaccucgaauucgaggcccugggauuuuugaaugaggaucauugguucaguagggaaaacagcuauucugguguggagggcgaagggcugcacaagcucggauacauccuucgagacauuuccaaaaucccuggcggugcuauguaugccgaugacacagcagggugggacacucggauaaccgaggaugaccugcauaaugaagagaagaucacgcagcagauggaucccgagcacagacaauuagcgaacgccauuuuuaaacugacauaccagaauaaggucgugaagguacagaggccaaccccuacuggaacaguuauggacaucauuucacgcaaagaucagcguggcagcggccaaguggggaccuauggauugaacacuuucaccaauauggaagcucagcucauccggcagauggagggugaaggcguccugucgaaggccgaccuagagaacccccaccuuccagaaaaaaagauaacacaguggcuggagacgaaagggguggagagacucaagaggauggcaauuucuggagaugacugcguggucaagcccaucgaugaccgcuuuggcaacgcucuguuggccuuaaaugauauggguaaaguucgaaaggacaucccucaauggcagccaaguaaaggguggcaugauuggcagcaggugccguucuguucccaccauuuccacgaacugauuaugaaggacggacggaaacucguagugcccugcagaccucaagacgagcuuauaggcagggcacgcaucagccagggcgccggguggucacugagagaaaccgcgugucuaggaaaggcuuacgcccagauguggucccugauguauuuucaccggagggaucuccguuuggcaucuaacgccauuugcagcgcugucccagugcauuggguucccacuagucgaacaaccugguccauccacgcccaucaccaauggaugacuacagaggacaugcugaccguguggaaucgcgucuggauugaagauaacccuuggauggaggacaagacgccagugacaaccugggagaauguacccuaccuugguaaaagagaagaucagugguguggcagccugaucgggcucacuucucgggcaaccugggcucagaacauaccuacagccauccagcaaguuaggucauuaauuggaaaugaggaauuccuggacuacaugccgaguaugaagcgcuuuagaaaagaggaggaauccgagggcgcgaucugguga

SEQ ID NO: 15090 - RNA, 9873 nt, Artificial Sequence
  derived and/or modified CDS sequence (opt3) from DENV-3__KF954946__SS-prME
accagccugugccucaugaugauccuucccgccgcucuggcauuccacuugacuuccagggacggcgagccuaggaugauuguggggaagaacgaacggggaaagucuuuacuguuuaagacugccucagguauaaauauguguacgcucaucgcgauggaucucggcgagaugugcgacgauaccgucacauacaaguguccacauauuacugaaguugagccggaagacaucgauugcugguguaaccugaccaguacaugggugaccuaugggacuugcaaucaggcuggagagcaccgccgagacaagcguagcgucgcccuugcaccccaugugggcaugggucuggauacaagaacccagacguggauguccgccgagggggcuuggaggcaggucgaaaagguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucagcuggccauccuuaggaaacuguguauugagggaaagaucacaaacauaaccacggauagccggugcccuacccagggcgaagcugucuugccagaggaacaggaccagaauuauguuuguaaacacacauacguggaucgcgguugggggaacggaugcggccucuucggcaaggggagucugguaacuugcgccaaguuucaauguuuagagcccauugagggaaaagugguccaguaugaaaaucugaaguacaccgugaucauuacaguucauacuggugaccagcaccaggugggcaacgagacccaagggaucacagcagaaaucaccccucaggcuuccacuacggaggccauucucccagaauauggaacacuuggccuggagugcucuccgcgaaccgguuuggacuucaaugagaugauacuacugacuaugaaaaacaaggcguggaugguccauagacagugguuuuucgaucucccccugccuuggaccagcggggccacaaccgaaacuccaacauggaauaggaaagagcuucuggugacguuuaagaacgcacacgcuaaaaagcaagaaguaguuguguugggcucccaggagggagccaugcacaccgcucucacuggcgccacagaaauccaaaauucagggggaaccaguauuuucgcaggucaucugaagugucgguuaaaaauggacaagcuggagcuaaaaggcaugagcuacgccaugugcacaaacacuuuuguccucaagaaagaggugucugaaacccagcacgggacgauccugauaaaggucgaguacaagggagaagaugcucccuguaaaauuccuuucuccaccgaggacggccaagguaaggcgcauaacgggcgucuuaucacagcaaauccagugguuacuaaaaaggaggaacccgugaacaucgaggccgaaccgccuuucggcgagucaaauauuguaaucggaauuggcgauaacgcuuugaaaauaaauugguauaagaaggggagcaguaucggaaaaauguuugaagccaccgcacgcggugccagaaggauggcuauucugggcgacacagccugggauuucgggucugucggaggcgugcucaacucccuggguaagaugguucaccagaucuuugggagcgcauacacugcgcuuuucucgggcgugucuugggucaugaaaaucggaauuggcgugcuguugaccuggauagggcucaauuccaagaacacgucaaugaguuuuagcugcaucgcuauuggaaucauuacacuguauuuaggcgccguagugcaggcagacauggguuguguuaucaauuggaaagggaaggagcugaagugcggauccggcauauucgucaccaacgaggugcauacuuggacagaacaguacaaauuucaagccgauucucccaagcggcuagcuaccgccaucgugggugcaugggagaauggcgucugugggauucgaagcacuacccgcauggaaaaccuccuguggaaacagaucgcuaaugagcuuaacuauauuuugugggaaaauaacaucaagcugacaguuguggugggagacacgauaggcguacucgagcaggggaaaagaacccugacuccacagccuauggaguuaaaguacucauggaaaacauggggaaaggccaagauugucaccgcggaaacacaaaacaguuccuucaucauugauggccccaauacuccagagugccccagcgccucuagggcuuggaacgugugggaaguugaggacuaugguuuugggguguucaccacgaauaucuggcugaaacuucgggaagucuacacacagaugugugaccaccgcuugaugucagcagccgugaaggaugagagagcuguucacgccgacaugggauacuggauagagagucagaaaaacggcagcuggaagcucgaaaaagcaucccugaucgaggugaagaccugcacuuggccuaagucucauacccuauggucgaaugguguacuggaaagcgauaugauuaucccaaaaucccucgcgggcccgauuucacagcacaacuauaggcccggguaccauacacaaacugccggaccuuggcaccugggcaaacuugaguuggacuuuaauuauugcgaggggaccacagucgugaucacggaaaacuguggaacccguggcccaagucugcggacuacaaccgugucugguaaauuaauacacgaguggugcugucgaagcugcacucuacccccucugagauacaugggggaagauggauguugguauggcauggagauuaggccaaucuccgaaaaggaggagaauauggucaaaucacuuguuagcgcugguucuggcaagguggacaacuucacaauggggguacugugcuuggccauccucuuugaagaggugaugcgcggaaaguucggcaaaaagcauaugauugcaggggucuucuuuaccuucgugcugcuacuguccggacagaucacguggcgggauauggcucacacucucauuaugauaggcaguaaugccagcgacagaauggguauggggguuaccuaccuggcacuuaucgccacauuuaaaauucagcccuucuuggcucugggauuuuucuuaaggaagcucaccucucgcgaaaaccugcuucugggcgugggccuagcgauggccacuacacuccaacugccggaggauaucgaacagauggcaaaugggauugcuuugggacugauggccuuaaaacucaucacccaguuugagacauaucagcuguggacugcccuuauaucccugaccuguucaaacacgaucuucacauugaccgucgcuuggcgaacugcaacccucauucuggccggugugagucuacugccuguuugccaaagcucguccaugcggaagacagacuggcuuccaaugacuguggcggcuaugggcguacccccucucccccuguuuaucuucucuuugaaggauacccugaaacguagaagcuggccauuaaaugaggggguaauggccgugggacucguuucaaugcuggcaaguucccuucugaggaacgacgugccuauggccggccccuuggucgcuggugggcuccugauugcauguuacgugaucacgggaacaucugccgaucuaaccguagaaaaggcggcugacgugacuugggaggaagaggccgaacagacaggcgucagccauaaccugaugauaaccguugacgaugacggcacuaugcgcauuaaagaugacgagacagagaauauccuuaccgugcuccugaagacggcauuguuaaucguguccgggauuuuuccauacucaauaccggccacucugcucgucuggcacaccuggcagaaacagacacaacggagcggagugcugugggauguuccuagucccccagaaacccagaaggcugagcuugaagaggguguauauagaaucaaacagcagggcauucuggggaagacacaagugggagucggcgugcagaaggacgguguuuuccauacuauguggcacgugaccagaggggccgucuugacgcacaacggaaaacgacuagagcccaauugggcaucugugaagaaagaucugaucuccuacggcggcggguggcgccucagcgcucaguggcaaaagggagaagagguacaggucauugccguggaaccugguaaaaacccaaagaauuuucagacaaugcccggcacuuuccagaccacaaccggggagaucggagcgauagcccuggacuucaagccuggcacuucggguucaccgaucauuaaccgggaagggaaaguugugggacuuuauggcaauggcgucgugaccaagaacgggggauacguuucugguaucgcacaaacaaaugcugagccagauggccccacgccugaguuagaagaggaaauguuuaaaaagagaaaccugacuauuauggaccuccauccagggaguggaaaaaccaggaaguauuugcccgccaucgugcgugaggcuauaaagcgccggcugagaacacucauucuggcaccuaccagggucguggccgccgaaauggaggaggcucuuaaaggccugccgauccgauaccagacuacagcgaccaaguccgaacacacgggucgggagaucguagauuugaugugccaugcaacuuucacaaugcgccuacugagccccgugagaguuccaaauuauaaccucauuaucauggacgaagcccacuuuaccgauccugcuucuauagccgcaaggggguacauuagcacccgggucggaaugggcgaggccgcugcgaucuucaugacugccacacccccaggcaccgcagacgcuuuuccucaguccaaugcccccauucaggacgaggaacgagauaucccagagagaucauggaacagugggaaugaauggauaacagacuucgcaggaaaaacugugugguuugugccgagcauuaaggccgguaacgauaucgcuaacuguuuacgcaaaaauggcaagaaggucauccaacugucuaggaaaacguucgacaccgaguaccagaagacaaaacuuaacgauugggacuuuguagugacuaccgauauuuccgaaaugggggccaauuucaaggcggaccguguuaucgauccucggagaugccugaaacccgugauucucacagacggaccagagagggucauauuggcaggccccaugccugugaccgccgcuucagccgcucagcgccgagguagaguugggcggaacccacagaaggagaaugaucaauauaucuuuacuggccagccccugaacaaugacgaagaccaugcacacuggacggaggccaagaugcuccuggauaacauuaauaccccugaaggaaucaucccggcucuuuucgagccagaaagggagaaaagugccgcaauugacggcgaguaccgccuaaagggggaaagccguaaaacauucguggagcugaugagacggggagauuugcccgucugguuagcgcacaagguggccuccgaagguauaaaauauacugacaggaaguggugcuuugauggccagcgcaacaaucagauccuggaggaaaacauggacguagagauuuggaccaaagagggggaaaagaagaaacuccgaccuagauggcuggaugcucggacauacucugacccccuugcccugaaggaguucaaagauuuugcagcuggaaggaagucgaucgcccucgacuuggugaccgaaauuggccgcguuccaagccaucuggcacacagaacuaggaaugcccuagauaaccuggucaugcuccauacaucagagcacggugggcgggcuuaucgucacgcgguggaggaacuuccugagacgauggaaacccuguuauugcugggccucaugauccugcuuacuggaggcgccaugcuguuccucauauccgggaaaggaaucgguaagacaaguauuggcuugaucugugugauugcaucuagcgggaugcuguggauggcugagauccccuuacaauggauagccuccgccauuguccuagaauuuuucaugaugguucugcucaucccagagccugagaagcagcgcaccccgcaggacaaucaacuugcauacgugguaauuggaauccugaccauggcugccauaaucgcggcuaacgaaaugggcuugcuggagacaacuaaacgagaucucgguaugucaaaggaacccgggguggucucuccaacgagcuaucuggacguggaccuucauccugccagugcauggacccucuacgccguugcuacaacugugauuacccccaugcugagacacacaaucgaaaauuccaccgcaaacgucagcuuggccgcgauugcuaaccaggccguagugcuguuaggccuagauaaaggauggccaaucucuaagauggaccugggcguuccucuccuugcacuggggugcuacucacaggugaaucccuugacucugacggccgcuguccuccugcuugugacacauuaugccauaauuggaccgggcuuacaggcaaaagcuaccagggaagcccaaaagcggacugcggccgguaucaugaagaacccaaccgucgaugggaucauuacaaucgaccuggauccugugauauacgacuccaaauuugagaagcagcucggacagguuauguugcuggugcuaugugcaguacagcugcuccuuaugcgcacaaguugggcucugugcgaggccuugacccuggcaacaggccccauuacgacccucugggaagguagcccaggcaaauucuggaauacuacaaucgcugugucgauggccaacauuuuuagagggucuuaucuggccggagcgggcuuagcuuucuccaucaugaaaagcgucgggaccggaaaaaggggcacugguucacaaggggagacacuuggagaaaaguggaagaaaaagcugaaucagcucagucggaaagaguuugaucuauacaagaaaucuggcauaaccgaaguugaccgaacggaggcaaaggagggucugaaaagaggcgaaaccacacaccaugccgugucccgcgggagcgcuaaguugcagugguucgucgagaggaacauggugauccccgaaggacggguaauugaucugggcugugggcguggaggcuggucauauuacugcgccggucucaagaaagugacugagguuagaggguauaccaagggaggcccuggccacgaggaaccggugcccaugaguacauacggguggaauaucgucaaacuuaugagcggaaaggacguguuuuaccugccaccugagaaaugugauacuuugcugugcgacauuggugaauccucucccagcccuaccgucgaggaauccaggacaauccgcgugcucaagaugguugagccaugguuaaagaacaaucaguucuguauuaaaguacugaaccccuauaugccugcagugaucgagcaccuugaacggcugcaacgaaagcauggcgggaugcuagucagaaauccacucucaaggaacucuacccacgagauguacuggauaaguaauggaacuggcaacauugugucgagcguuaauauggugucccgccuguugcugaaccgguucacgaugacacauagacgucccaccaucgaaaaagaugucgaccucggugccgggacuaggcacgugaacgcugagccggaaaccccuaauauggacguaaucggagagcggauuaagcgcauaaaagaggaacacaacucuacauggcauuaugaugacgagaauccauacaagacgugggcguaucacggcucauacgaagugaaggccaccggcagcgcauccaguaugaucaacgggguugucaaacuucugacuaagcccugggauguggugccuauggucacacagauggcuaugaccgacacuacaccauuuggacagcaacgaguuuucaaagagaagguggauaccagaacacccaggccgaugccugguacucggaaaguaauggaaauuaccgccgagugguuauggcgcacgcugggcagaaauaagaggccccgauugugcacccgggaggaauuuacaaagaaagugcguacuaacgcagccaugggggcugucuucaccgaggaaaaucagugggacucugccaaggcggcaguggaggaugaagaguuuuggaaacucguugacagagagcgcgaacugcauaagcuaggaaaauguggcagcugcguguauaacaugauggguaagagggagaagaaacuuggggaguucggaaaagccaaaggcucacgggcuaucugguacauguggcugggcgccagauaccucgaguuugaggcacugggguucuugaaugaagaucacugguuuucccgcgagaacaguuauagcggagucgaaggugagggccugcauaagcucggguacauucuuagggacaucucuaaaauaccaggaggcgcuauguaugccgaugacacagcugguugggacacucgaaucaccgaagaugaccugcacaaugaggagaagauuacgcagcagauggauccugaacaccgguuacuggccaacgcaaucuucaaauugacauaccaaaauaaggugguaaagguucagagacccaccccaacugggacagugauggacauuaucuccaggaaagaucagcgcggaucaggccaggucggcaccuaugggcucaacacuuuuaccaauauggaggcgcaacuggugcgucagauggaaggagagggugugcuaagcaagacagaccuugaaaacccccaucugccugagaaaaagauaacgcaguggcucgagaccaaaggcgucgaacggcugaagagaauggccauuucgggggaugacugcguugugaagccaaucgaugacagguucgcuaacgccuuguuagcacugaaugauaugggaaaaguacgcaaggacaucccgcaguggcaacccucuaaaggcuggcacgauuggcaacaggugccuuuuuguagucaucacuuccacgagcucauuaugaaggacggucgaaaacuugucgugccaugccggccccaggacgaacugauagggagagcuaggaucucccaaggagccggcuggagccuacgcgagacugcaugucugggcaaggccuacgcgcagauguggucacucauguauuuccauagacgggauuugaggcuggcuuccaacgccauuugcucugcaaucccuguucacugggugccaacaagccguaccacuuggaguauucaugcccaccaucaguggaugacaaccgaagacaugcuuacggucuggaaucgaguguggaucgaggauaaccccuggauggaggacaagacaccuauaaccacuugggaaaauguaccguaccuggggaaacgcgaggaucaaugguguggaucccucaucgguuuaaccagcagagcuacaugggcccagaacauuccaacugcaauccagcagguucggucucugauuggcaaugaagaguuuuuggacuacaugcccucaaugaagagguuccgcaaagaggaagagagugaaggggcuaucugguga

SEQ ID NO: 15091 - RNA, 9873 nt, Artificial Sequence
  derived and/or modified CDS sequence (opt3) from DENV-3__KF954947__SS-prME
accagccugugccucaugaugauccuucccgccgcucuggcauuccacuugacauccagggacggagagccuaggaugauuguggggaagaacgaacggggaaagucuuuacuguuuaagacugccucagguauaaauauguguacgcucaucgcgauggaucucggcgagaugugcgacgauaccgucaccuacaaguguccacauauuacugaaguugagccggaagacaucgauugcugguguaaccugaccaguacaugggugaccuaugggacuugcaaucaggcuggagagcaccgccgagacaagcguagcgucgcccuugcaccccaugugggcaugggucuggauacaagaacccagacguggauguccgccgagggggcuuggaggcaggucgaaaagguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaagggauuaccgcagaaaucacuccucaggcuuccacgacagaggccauccucccagaauauggaacccuuggccuggagugcucuccgcgaacugguuuggacuucaaugagaugauucuacugaccaugaaaaacaaggcguggaugguccauagacagugguuuuucgaucucccccugccuuggacaagcggggccaccacugaaacaccaacguggaauaggaaagagcuucuggugaccuuuaagaacgcacacgcuaaaaagcaagaaguaguuguguugggcucccaggagggagccaugcacacugcucucacaggcgccaccgaaauacaaaauucagggggaacaaguaucuucgcaggucaucugaagugucgguuaaaaauggacaagcuggagcuaaaaggcaugagcuacgccaugugcacuaacaccuuuguccucaagaaagaggugucugaaacgcagcacgggaccauucugaucaaggucgaguacaagggagaagaugcucccuguaaaauaccuuucuccacagaggacggccaagguaaggcgcauaacgggcgucuuauuacugcaaauccagugguuaccaaaaaggaggaacccgugaacaucgaggccgaaccgccuuucggcgagucaaauaucguaauuggaaucggcgauaacgcuuugaaaauuaauugguauaagaaggggagcaguauaggaaaaauguuugaagccacagcacgcggugccagaaggauggcuauccugggcgacacugccugggauuucgggucugucggaggcgugcucaacucccuggguaagaugguucaccagauuuuugggagcgcauacaccgcgcuuuucucgggcgugucuugggucaugaaaaucggaaucggcgugcuguugacguggauugggcucaauuccaagaacacaucaaugaguuuuagcugcauagcuaucggaauuaucacccuguauuuaggcgccguagugcaggcagacauggguuguguuauuaauuggaaagggaaggagcugaagugcggauccggcaucuucgucacuaacgaggugcauacauggaccgaacaguacaaauuucaagccgauucucccaagcggcuagcuacugccauagugggugcaugggagaauggcgucugugggauccgaagcaccacacgcauggaaaaccuccuguggaaacagauugcuaaugagcuuaacuauaucuugugggaaaauaacauuaagcugacgguuguggugggagacaccaucggcguacucgagcaggggaaaagaacucugacaccacagccuauggaguuaaaguacucauggaaaaccuggggaaaggccaagauagucacagcggaaacucaaaacaguuccuucauuaucgauggccccaauaccccagagugccccagcgccucuagggcuuggaacgugugggaaguugaggacuaugguuuugggguguucacgacaaauauuuggcugaaacuucgggaagucuacacccagaugugugaccaccgcuugaugucagcagccgugaaggaugagagagcuguucacgccgacaugggauacuggaucgagagucagaaaaacggcagcuggaagcucgaaaaagcaucccugauagaggugaagacuugcaccuggccuaagucucauacacuauggucgaaugguguacuggaaagcgauaugaucauuccaaaaucccucgcgggcccgaucucacagcacaacuauaggcccggguaccauacucaaaccgccggaccuuggcaccugggcaaacuugaguuggacuuuaauuauugcgaggggacaacggucgugauuaccgaaaacuguggaacucguggcccaagucugcggacaaccacugugucugguaaauuaauccacgaguggugcugucgaagcugcacacuacccccucugagauacaugggggaagauggauguugguauggcauggagauaaggccaauuuccgaaaaggaggagaauauggucaaaucacuuguuagcgcugguucuggcaagguggacaacuucaccauggggguacugugcuuggccauccucuuugaagaggugaugcgcggaaaguucggcaaaaagcauaugaucgcaggggucuucuuuacguucgugcugcuacuguccggacagauuacuuggcgggauauggcucacacccucaucaugauuggcaguaaugccagcgacagaauggguauggggguuacauaccuggcacuuauagccaccuuuaaaauccagcccuucuuggcucugggauuuuucuuaaggaagcucacuucucgcgaaaaccugcuucugggcgugggccuagcgauggccacaacccuccaacugccggaggauauugaacagauggcaaaugggaucgcuuugggacugauggccuuaaaacucauuacacaguuugagacuuaucagcuguggaccgcccuuaucucccugacguguucaaacacaauauucaccuugacugucgcuuggcgaaccgcaacacucauccuggccggugugagucuacugccuguuugccaaagcucguccaugcggaagacugacuggcuuccaaugaccguggcggcuaugggcguacccccucucccccuguuuauuuucucuuugaaggauacgcugaaacguagaagcuggccauuaaaugaggggguaauggccgugggacucguuucaaugcuggcaaguucccuucugaggaacgacgugccuauggccggccccuuggucgcuggugggcuccugaucgcauguuacgugauuacaggaaccucugccgaucuaacuguagaaaaggcggcugacgugacaugggaggaagaggccgaacagaccggcgucagccauaaccugaugaucacuguugacgaugacggcacaaugcgcauaaaagaugacgagaccgagaauauucuuacggugcuccugaagacugcauuguuaaucguguccgggaucuuuccauacucaauuccggccacccugcucgucuggcacacauggcagaaacagacccaacggagcggagugcugugggauguuccuagucccccagaaacacagaaggcugagcuugaagaggguguauauagaauaaaacagcagggcauccuggggaagacucaagugggagucggcgugcagaaggacgguguuuuccauaccauguggcacgugacgagaggggccgucuugacacacaacggaaaacgacuagagcccaauugggcaucugugaagaaagaucugauuuccuacggcggcggguggcgccucagcgcucaguggcaaaagggagaagagguacaggucaucgccguggaaccugguaaaaacccaaagaauuuucagacuaugcccggcaccuuccagacaaccacuggggagauuggagcgaucgcccuggacuucaagccuggcaccucggguucaccgauaaucaaccgggaagggaaaguugugggacuuuauggcaauggcgucgugacaaagaacgggggauacguuucugguauugcacaaacgaaugcugagccagauggccccacuccugaguuagaagaggaaauguuuaaaaagagaaaccugaccaucauggaccuccauccagggaguggaaaaacaaggaaguauuugcccgccauugugcgugaggcuaucaagcgccggcugagaacccucauacuggcaccuacuagggucguggccgccgaaauggaggaggcucuuaaaggccugccgauucgauaccagacaaccgcgacgaaguccgaacacacuggucgggagaucguagauuugaugugccaugcaacauucaccaugcgccuacugagccccgugagaguuccaaauuauaaccucaucauuauggacgaagcccacuuuaccgauccugcuucuaucgccgcaaggggguacauaagcacucgggucggaaugggcgaggccgcugcgauuuucaugacagccacacccccaggcacagcagacgcuuuuccucaguccaaugcccccauccaggacgaggaacgagauauuccagagagaucauggaacagugggaaugaauggaucacugacuucgcaggaaaaacggugugguuugugccgagcauaaaggccgguaacgauauugcuaacuguuuacgcaaaaauggcaagaaggucauccaacugucuaggaaaaccuucgacacagaguaccagaagacuaaacuuaacgauugggacuuuguagugaccacagauaucuccgaaaugggggccaauuucaaggcggaccguguuauugauccucggagaugccugaaacccgugauccucaccgacggaccagagagggucauuuuggcaggccccaugccugugacugccgcuucagccgcucagcgccgagguagaguugggcggaacccacagaaggagaaugaucaauauauauuuacgggccagccccugaacaaugacgaagaccaugcacacuggaccgaggccaagaugcuccuggauaacaucaauacaccugaaggaauuaucccggcucuuuucgagccagaaagggagaaaagugccgcaaucgacggcgaguaccgccuaaagggggaaagccguaaaacuuucguggagcugaugagacggggagauuugcccgucugguuagcgcacaagguggccuccgaagguauuaaauauaccgacaggaaguggugcuuugauggccagcgcaacaaucagauacuggaggaaaacauggacguagagaucuggacaaaagagggggaaaagaagaaacuccgaccuagauggcuggaugcucggaccuacucugacccccuugcccugaaggaguucaaagauuuugcagcuggaaggaagucgauugcccucgacuuggugacugaaaucggccgcguuccaagccaucuggcacacagaacaaggaaugcccuagauaaccuggucaugcuccauacgucagagcacggugggcgggcuuaucgucacgcgguggaggaacuuccugagaccauggaaacucuguuauugcugggccucaugauucugcuuacaggaggcgccaugcuguuccucaucuccgggaaaggaauagguaagaccaguaucggcuugauuugugugaucgcaucuagcgggaugcuguggauggcugagauucccuuacaauggaucgccuccgccauaguccuagaauuuuucaugaugguucugcucauuccagagccugagaagcagcgcaccccgcaggacaaucaacuugcauacgugguaaucggcauucugacaauggcugccaucauagcggcuaacgaaaugggcuugcuggagacuacgaaacgagaucucgguaugucaaaggaacccgggguggucucuccaaccagcuaucuggacguggaccuucauccugccagugcauggacacucuacgccguugcuacuaccgugaucacacccaugcugagacacaccauugaaaauuccacugcaaacgucagcuuggccgcgaucgcuaaccaggccguagugcugaugggcuuagauaaaggauggccaauuucuaagauggaccuaggcguuccucugcucgcacuugggugcuacucacaggugaauccccugacguugacagccgcuguccugcuccuggugacccauuaugccaucauaggaccgggccuucaggcaaaagcuacuagggaagcccaaaagcggaccgcggccgguauuaugaagaacccaacagucgaugggaucaucacuauugacuuagauccugugaucuacgacuccaaauuugagaagcagcugggacagguuaugcucuuggugcugugugcaguacagcuacugcucaugcgcaccaguugggcucuuugcgaggcccugacauuggcaacgggccccauaaccacucugugggaagguagcccaggcaaauucuggaauacaaccauugcugugucgauggccaacaucuuuagagggucuuaucucgccggagcgggccuggcuuucuccauuaugaaaagcgucgggacuggaaaaaggggcacagguucacaaggggagaccuuaggagaaaaguggaagaagaaacuuaaucagcugagucggaaagaguuugaucucuacaagaaaucuggcaucacggaaguugaccgaaccgaggcaaaagagggucuaaaaagaggcgaaacaacucaccaugccgugucccgcgggagcgcuaagcugcagugguucgucgagaggaacauggugauacccgaaggacggguaaucgauuugggcugugggcguggaggcuggucauauuacugcgccggucugaagaaagugaccgagguuagaggguauacaaagggaggcccuggccacgaggaaccggugcccaugaguacuuacggguggaauauugucaaacucaugagcggaaaggacguguuuuaccuuccaccugagaaaugugauacccuguugugcgacaucggugaauccucucccagcccuacagucgaggaauccaggaccauucgcgugcugaagaugguugagccauggcucaagaacaaucaguucuguaucaaaguauuaaaccccuauaugccugcagugauugagcaccuggaacggcuucaacgaaagcauggcgggaugcuggucagaaauccacuaucaaggaacucuacucacgagauguacuggaucaguaauggaacgggcaacauagugucgagcguuaauauggugucccgccuccuguugaaccgguucacaaugacccauagacgucccacuauugaaaaagaugucgaccugggugccgggaccaggcacgugaacgcugagccggaaacaccuaauauggacguaaucggagagcggaucaagcgcauuaaagaggaacacaacucuacguggcauuaugaugacgagaauccauacaagaccugggcguaucacggcucauacgaagugaaggccacuggcagcgcauccaguaugauaaacgggguugucaaacuccuuacaaagcccugggauguggugccuauggucacccagauggcuaugacugacacaaccccauuuggacagcaacgaguuuucaaagagaagguggauacaagaacucccaggccgaugccugguacccggaaaguaauggaaaucacggccgaguggcuguggcgcaccuuaggcagaaauaagaggccccgacugugcacacgggaggaauuuacuaagaaagugcguaccaacgcagccaugggggcugucuucacagaggaaaaucagugggacucugccaaggcggcaguggaggaugaagaguuuuggaaauugguugacagagagcgcgaacuccauaagcugggaaaauguggcagcugcguguauaacaugauggguaagagggagaaaaagcuaggggaguucggaaaggccaaaggcucacgggcuauuugguacauguggcuuggcgccagauaccuggaguuugaggcacucggguuccugaaugaagaucacugguuuucccgcgagaacaguuauagcggagucgaaggugagggcuugcauaagcugggguacauccucagggacauuucuaaaaucccaggaggcgcuauguaugccgaugacacugcugguugggacacccgaauaacggaagaugaccuucacaaugaggagaagaucacacagcggauggauccugaacacagacuguuagccaacgcaauuuucaaacugaccuaccagaauaaggugguaaagguucaaaggcccacuccaacagggaccgugauggacaucauuucccgcaaagaucagcguggaucaggccaggucggcacuuauggguugaacaccuuuacaaauauggaggcgcagcucgugcggcaaauggaaggagagggugugcugagcaagacggaccuagaaaacccccaucuuccugagaaaaagaucacccaguggcuggagacuaaaggcgucgaaagacucaagaggauggccauaucgggggaugacugcguugugaagccaauugaugaccgcuucgcuaacgcccuguuggcauuaaaugauaugggaaaaguacgaaaggacaucccgcaguggcagcccucuaaaggcuggcacgauuggcaacaggugccuuuuuguagucaucacuuccacgagcugaucaugaaggacggucggaaacucgucgugccaugcagaccccaggacgaacuuauugggagggcucgcauaucccagggagccggcuggagccugagagagacagcaugucuaggcaaggccuacgcgcaaauguggucacugauguauuuccaucggagggaucuccguuuggcuuccaacgccaucugcucugcaauuccuguucacugggugccaaccagccgaacuacauggaguauccaugcccaccaucaguggaugaccacggaagacaugcugacagucuggaaucgcguguggauugaggauaaccccuggauggaggacaagaccccuaucacuaccugggaaaauguaccguaccuugggaaaagagaggaucagugguguggaucccugauaggucucacaagccgggcuacuugggcccaaaacaucccaaccgcaauucagcagguuaggucuuuaaucggcaaugaagaguuucuggacuacaugcccucaaugaagcgcuucagaaaagaggaagagagugaaggggcuauuugguga

SEQ ID NO: 15092 - RNA, 9873 nt, Artificial Sequence
  derived and/or modified CDS sequence (opt3) from DENV-3__KF954945__SS-prME
accagccugugccucaugaugauccuucccgccgcucuggcauuccacuugacuuccagggacggcgagccuaggaugauuguggggaagaacgaacggggaaagucuuuacuguuuaagacugccucagguauaaauauguguacgcucaucgcgauggaucucggcgagaugugcgacgauaccgucacauacaaguguccacauauuacugaaguugagccggaagacaucgauugcugguguaaccugaccaguacaugggugaccuaugggacuugcaaucaggcuggagagcaccgccgagacaagcguagcgucgcccuugcaccccaugugggcaugggucuggauacaagaacccagacguggauguccgccgagggggcuuggaggcaggucgaaaagguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucagcuggccauccuuaggaaacuguguauugagggaaagaucacaaacauaaccacggauagccggugcccuacccagggcgaagcugucuugccagaggaacaggaccagaauuauguuuguaaacacacauacguggaucgcgguugggggaacggaugcggccucuucggcaaggggagucugguaacuugcgccaaguuucaauguuuagagcccauugagggaaaagugguccaguaugaaaaucugaaguacaccgugaucauuacaguucauacuggugaccagcaccaggugggcaacgagacccaagggaucacagcagaaaucaccccucaggcuuccacuacggaggccauucucccagaauauggaacacuuggccuggagugcucuccgcgaaccgguuuggacuucaaugagaugauacuacugacuaugaaaaacaaggcguggaugguccauagacagugguuuuucgaucucccccugccuuggaccagcggggccacaaccgaaacuccaacauggaauaggaaagagcuucuggugacguuuaagaacgcacacgcuaaaaagcaagaaguaguuguguugggcucccaggagggagccaugcacaccgcucucacuggcgccacagaaauccaaaauucagggggaaccaguauuuucgcaggucaucugaagugucgguuaaaaauggacaagcuggagcuaaaaggcaugagcuacgccaugugcacaaacacuuuuguccucaagaaagaggugucugaaacccagcacgggacgauccugauaaaggucgaguacaagggagaagaugcucccuguaaaauuccuuucuccaccgaggacggccaagguaaggcgcauaacgggcgucuuaucacagcaaauccagugguuacuaaaaaggaggaacccgugaacaucgaggccgaaccgccuuucggcgagucaaauauuguaaucggaauuggcgauaacgcuuugaaaauaaauugguauaagaaggggagcaguaucggaaaaauguuugaagccaccgcacgcggugccagaaggauggcuauucugggcgacacagccugggauuucgggucugucggaggcgugcucaacucccuggguaagaugguucaccagaucuuugggagcgcauacacugcgcuuuucucgggcgugucuugggucaugaaaaucggaauuggcgugcuguugaccuggauagggcucaauuccaagaacacgucaaugaguuuuagcugcaucgcuauuggaaucauuacacuguauuuaggcgccguagugcaggcagacauggguuguguuaucaauuggaaagggaaggagcugaagugcggauccggcauauucgucaccaacgaggugcauacuuggacagaacaguacaaauuucaagccgauucucccaagcggcuagcuaccgccaucgugggugcaugggagaauggcgucugugggauucgaagcacuacccgcauggaaaaccuccuguggaaacagaucgcuaaugagcuuaacuauauuuugugggaaaauaacaucaagcugacaguuguggugggagacacgauaggcguacucgagcaggggaaaagaacccugacuccacagccuauggaguuaaaguacucauggaaaacauggggaaaggccaagauugucaccgcggaaacacaaaacaguuccuucaucauugauggccccaauacuccagagugccccagcgccucuagggcuuggaacgugugggaaguugaggacuaugguuuugggguguucaccacgaauaucuggcugaaacuucgggaagucuacacacagaugugugaccaccgcuugaugucagcagccgugaaggaugagagagcuguucacgccgacaugggauacuggauagagagucagaaaaacggcagcuggaagcucgaaaaagcaucccugaucgaggugaagaccugcacuuggccuaagucucauacccuauggucgaaugguguacuggaaagcgauaugauuaucccaaaaucccucgcgggcccgauuucacagcacaacuauaggcccggguaccauacacaaacugccggaccuuggcaccugggcaaacuugaguuggacuuuaauuauugcgaggggaccacagucgugaucacggaaaacuguggaacccguggcccaagucugcggacuacaaccgugucugguaaauuaauacacgaguggugcugucgaagcugcacucuacccccucugagauacaugggggaagauggauguugguauggcauggagauuaggccaaucuccgaaaaggaggagaauauggucaaaucacuuguuagcgcugguucuggcaagguggacaacuucacaauggggguacugugcuuggccauccucuuugaagaggugaugcgcggaaaguucggcaaaaagcauaugauugcaggggucuucuuuaccuucgugcugcuacuguccggacagaucacguggcgggauauggcucacacucucauuaugauaggcaguaaugccagcgacagaauggguauggggguuaccuaccuggcacuuaucgccacauuuaaaauucagcccuucuuggcucugggauuuuucuuaaggaagcucaccucucgcgaaaaccugcuucugggcgugggccuagcgauggccacuacacuccaacugccggaggauaucgaacagauggcaaaugggauugcuuugggacugauggccuuaaaacucaucacccaguuugagacauaucagcuguggacugcccuuauaucccugaccuguucaaacacgaucuucacauugaccgucgcuuggcgaacugcaacccucauucuggccggugugagucuacugccuguuugccaaagcucguccaugcggaagacagacuggcuuccaaugacuguggcggcuaugggcguacccccucucccccuguuuaucuucucuuugaaggauacccugaaacguagaagcuggccauuaaaugaggggguaauggccgugggacucguuucaaugcuggcaaguucccuucugaggaacgacgugccuauggccggccccuuggucgcuggugggcuccugauugcauguuacgugaucacgggaacaucugccgaucuaaccguagaaaaggcggcugacgugacuugggaggaagaggccgaacagacaggcgucagccauaaccugaugauaaccguugacgaugacggcacuaugcgcauuaaagaugacgagacagagaauauccuuaccgugcuccugaagacggcauuguuaaucguguccgggauuuuuccauacucaauaccggccacucugcucgucuggcacaccuggcagaaacagacacaacggagcggagugcugugggauguuccuagucccccagaaacccagaaggcugagcuugaagaggguguauauagaaucaaacagcagggcauucuggggaagacacaagugggagucggcgugcagaaggacgguguuuuccauacuauguggcacgugaccagaggggccgucuugacgcacaacggaaaacgacuagagcccaauugggcaucugugaagaaagaucugaucuccuacggcggcggguggcgccucagcgcucaguggcaaaagggagaagagguacaggucauugccguggaaccugguaaaaacccaaagaauuuucagacaaugcccggcacuuuccagaccacaaccggggagaucggagcgauagcccuggacuucaagccuggcacuucggguucaccgaucauuaaccgggaagggaaaguugugggacuuuauggcaauggcgucgugaccaagaacgggggauacguuucugguaucgcacaaacaaaugcugagccagauggccccacgccugaguuagaagaggaaauguuuaaaaagagaaaccugacuauuauggaccuccauccagggaguggaaaaaccaggaaguauuugcccgccaucgugcgugaggcuauaaagcgccggcugagaacacucauucuggcaccuaccagggucguggccgccgaaauggaggaggcucuuaaaggccugccgauccgauaccagacuacagcgaccaaguccgaacacacgggucgggagaucguagauuugaugugccaugcaacuuucacaaugcgccuacugagccccgugagaguuccaaauuauaaccucauuaucauggacgaagcccacuuuaccgauccugcuucuauagccgcaaggggguacauuagcacccgggucggaaugggcgaggccgcugcgaucuucaugacugccacacccccaggcaccgcagacgcuuuuccucaguccaaugcccccauucaggacgaggaacgagauaucccagagagaucauggaacagugggaaugaauggauaacagacuucgcaggaaaaacugugugguuugugccgagcauuaaggccgguaacgauaucgcuaacuguuuacgcaaaaauggcaagaaggucauccaacugucuaggaaaacguucgacaccgaguaccagaagacaaaacuuaacgauugggacuuuguagugacuaccgauauuuccgaaaugggggccaauuucaaggcggaccguguuaucgauccucggagaugccugaaacccgugauucucacagacggaccagagagggucauauuggcaggccccaugccugugaccgccgcuucagccgcucagcgccgagguagaguugggcggaacccacagaaggagaaugaucaauauaucuuuacuggccagccccugaacaaugacgaagaccaugcacacuggacggaggccaagaugcuccuggauaacauuaauaccccugaaggaaucaucccggcucuuuucgagccagaaagggagaaaagugccgcaauugacggcgaguaccgccuaaagggggaaagccguaaaacauucguggagcugaugagacggggagauuugcccgucugguuagcgcacaagguggccuccgaagguauaaaauauacugacaggaaguggugcuuugauggccagcgcaacaaucagauccuggaggaaaacauggacguagagauuuggaccaaagagggggaaaagaagaaacuccgaccuagauggcuggaugcucggacauacucugacccccuugcccugaaggaguucaaagauuuugcagcuggaaggaagucgaucgcccucgacuuggugaccgaaauuggccgcguuccaagccaucuggcacacagaacuaggaaugcccuagauaaccuggucaugcuccauacaucagagcacggugggcgggcuuaucgucacgcgguggaggaacuuccugagacgauggaaacccuguuauugcugggccucaugauccugcuuacuggaggcgccaugcuguuccucauauccgggaaaggaaucgguaagacaaguauuggcuugaucugugugauugcaucuagcgggaugcuguggauggcugagauccccuuacaauggauagccuccgccauuguccuagaauuuuucaugaugguucugcucaucccagagccugagaagcagcgcaccccgcaggacaaucaacuugcauacgugguaauuggaauccugaccauggcugccauaaucgcggcuaacgaaaugggcuugcuggagacaacuaaacgagaucucgguaugucaaaggaacccgggguggucucuccaacgagcuaucuggacguggaccuucauccugccagugcauggacccucuacgccguugcuacaacugugauuacccccaugcugagacacacaaucgaaaauuccaccgcaaacgucagcuuggccgcgauugcuaaccaggccguagugcugaugggcuuagauaaaggauggccaaucucuaagauggaccuaggcguuccucugcucgcacuugggugcuacucacaggugaauccccugacuuugacggccgcuguccugcuccuggugacacauuaugccauaauuggaccgggccuucaggcaaaagcuaccagggaagcccaaaagcggacugcggccgguaucaugaagaacccaaccgucgaugggaucauuacaaucgacuuagauccugugauauacgacuccaaauuugagaagcagcugggacagguuaugcucuuggugcugugugcaguacagcuacugcucaugcgcacaaguugggcucuuugcgaggcccugaccuuggcaacaggccccauuacgacccugugggaagguagcccaggcaaauucuggaauacuacaaucgcugugucgauggccaacauuuuuagagggucuuaucucgccggagcgggccuggcuuucuccaucaugaaaagcgucgggaccggaaaaaggggcacugguucacaaggggagacauuaggagaaaaguggaagaagaaacuuaaucagcugagucggaaagaguuugaucucuacaagaaaucuggcauaaccgaaguugaccgaacggaggcaaaagagggucuaaaaagaggcgaaaccacacaccaugccgugucccgcgggagcgcuaagcugcagugguucgucgagaggaacauggugauccccgaaggacggguaauugauuugggcugugggcguggaggcuggucauauuacugcgccggucugaagaaagugacugagguuagaggguauaccaagggaggcccuggccacgaggaaccggugcccaugaguacauacggguggaauaucgucaaacucaugagcggaaaggacguguuuuaccuuccaccugagaaaugugauacucuguugugcgacauuggugaauccucucccagcccuaccgucgaggaauccaggacaauccgcgugcugaagaugguugagccauggcucaagaacaaucaguucuguauuaaaguauuaaaccccuauaugccugcagugaucgagcaccuggaacggcuucaacgaaagcauggcgggaugcuggucagaaauccacuaucaaggaacucuacccacgagauguacuggauaaguaauggaacuggcaacauugugucgagcguuaauauggugucccgccuccuguugaaccgguucacgaugacacauagacgucccaccaucgaaaaagaugucgaccugggugccgggacuaggcacgugaacgcugagccggaaaccccuaauauggacguaaucggagagcggauuaagcgcauaaaagaggaacacaacucuacauggcauuaugaugacgagaauccauacaagacgugggcguaucacggcucauacgaagugaaggccaccggcagcgcauccaguaugaucaacgggguugucaaacuccuuacuaagcccugggauguggugccuauggucacacagauggcuaugaccgacacuacaccauuuggacagcaacgaguuuucaaagagaagguggauaccagaacacccaggccgaugccugguacucggaaaguaauggaaauuaccgccgaguggcuguggcgcacguuaggcagaaauaagaggccccgacugugcacccgggaggaauuuacaaagaaagugcguacuaacgcagccaugggggcugucuucaccgaggaaaaucagugggacucugccaaggcggcaguggaggaugaagaguuuuggaaauugguugacagagagcgcgaacuccauaagcugggaaaauguggcagcugcguguauaacaugauggguaagagggagaaaaagcuaggggaguucggaaaggccaaaggcucacgggcuaucugguacauguggcuuggcgccagauaccuggaguuugaggcacucggguuccugaaugaagaucacugguuuucccgcgagaacaguuauagcggagucgaaggugagggcuugcauaagcugggguacauucucagggacaucucuaaaauaccaggaggcgcuauguaugccgaugacacagcugguugggacacucgaaucaccgaagaugaccuucacaaugaggagaagauuacgcagcagauggauccugaacaccggcuguuagccaacgcaaucuucaaacugacauaccaaaauaaggugguaaagguucagagacccaccccaacugggacagugauggacauuaucuccaggaaagaucagcgcggaucaggccaggucggcaccuauggguugaacacuuuuaccaauauggaggcgcaacucgugcgucagauggaaggagagggugugcugagcaagacagaccuagaaaacccccaucuuccugagaaaaagauaacgcaguggcuggagaccaaaggcgucgaacggcucaagagaauggccauuucgggggaugacugcguugugaagccaaucgaugacagguucgcuaacgcccuguuggcauuaaaugauaugggaaaaguacgcaaggacaucccgcaguggcaacccucuaaaggcuggcacgauuggcaacaggugccuuuuuguagucaucacuuccacgagcugauuaugaaggacggucgaaaacucgucgugccaugccggccccaggacgaacuuauagggagagcuaggaucucccaaggagccggcuggagccugcgcgagacugcaugucuaggcaaggccuacgcgcagauguggucacugauguauuuccauagacgggaucucagguuggcuuccaacgccauuugcucugcaaucccuguucacugggugccaacaagccguaccacuuggaguauucaugcccaccaucaguggaugacaaccgaagacaugcugacggucuggaaucgaguguggaucgaggauaaccccuggauggaggacaagacaccuauaaccacuugggaaaauguaccguaccuugggaaacgcgaggaucaaugguguggaucccugaucggucucaccagcagagcuacaugggcccagaacauuccaacugcaauccagcagguucggucuuuaauuggcaaugaagaguuucuggacuacaugcccucaaugaagagguuccgcaaagaggaagagagugaaggggcuaucugguga

SEQ ID NO: 15093 - RNA, 9873 nt, Artificial Sequence
  derived and/or modified CDS sequence (opt3) from DENV-3__JX669495__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcgccgacgugacaagagaagcguagcccuugcaccccacgugggcaugggucuggauacaaggacccaaacguggauguccgccgagggggcuuggcggcaggucgaaaaaguggagacuugggcauugcgccauccuggauucaccauucucgcccuguuucuggcucacuacaucggcacaucucucacucagaagguugugauauucaucuuacugaugcuugucaccccaucgaugacaaugagaugugugggcguagggaacagggacuuuguugaaggauugucaggugccaccuggguggaugucgugcuggagcauggcgggugcgugacgacuauggcgaagaauaaacccacacuagacauugagcuccagaagaccgaagcaacucaacuggccacacuucggaaacuguguaucgagggaaagauuaccaacaucacgaccgauagccgcugcccuacacagggcgaagcugucuugccagaggaacaggaccagaauuauguuuguaaacacacuuacguggaucgagguugggggaacggaugcggccucuucggcaaggggagucugguaaccugcgccaaguuucaauguuuagagcccauagagggaaaagugguccaguaugaaaaucugaaguacacagugauuaucacuguucacaccggugaccagcaucaggugggcaacgagacacaaggggucaccgcagaaauuacuccucaggcuuccacgacagaggccauccucccagaauauggaacccuuggccuggagugcucuccgagaacugguuuggacuucaaugagaugauccuacugaccaugaaaaacaaggcguggauggugcacaggcagugguuuuucgaucucccccugccuuggacaagcggggccaccacugaaacaccaacguggaaucggaaagagcuucugguaaccuuuaagaacgcacaugcuaaaaagcaagaaguuguggucuugggcucccaggagggagccaugcacacugcucucacaggcgccaccgaaauucagaauucagggggaacaaguauauucgcaggucaccugaagugucguuuaaaaauggacaagcuggagcuaaaaggcaugagcuacgccaugugcacuaacaccuuugugcucaagaaagaggucucugaaacgcagcaugggaccauccugauuaagguggaguacaagggagaagaugcucccuguaaaaucccuuucuccacagaggacggccaagguaaggcgcacaacgggcgccuuauaacugcaaauccaguugugaccaaaaaggaggaacccguaaacauugaggccgaaccgccuuucggcgagucaaauaucgucaucggaauuggcgauaacgcuuugaaaaucaauugguauaagaaggggagcaguauuggaaaaauguuugaagccacagcaagaggugccaggcggauggcuauacugggcgacacugccugggauuucgggucugugggaggcguucucaacucccuggguaagauggugcaucagaucuuugggagcgcauacaccgcgcuuuucucgggcgucucuugggugaugaaaauuggaaucggcguacuguugacguggaucgggcucaauuccaagaacacaucaaugaguuuuagcugcauugcuauaggaaucauuacccuguauuuaggcgccgugguucaggcagacauggguugugucaucaauuggaaagggaaggagcugaagugcggauccggcauuuucgugacuaacgaggugcacacauggaccgaacaguacaaauuucaagccgauucucccaagcgacuagcuacugccaucgcaggugcuugggagaauggcgucugugggauacgcagcaccacaagaauggaaaaccuccuguggaaacagaucgccaaugagcuuaacuauauuuugugggaaaauaacaucaagcugacgguuguggugggagacauuaucggcguacucgagcaggggaaaaggacccugacuccacagccuauggaguuaaaguacucauggaaaacauggggaaaggcgaagauagucaccgccgaaacacaaaacaguuccuucauuaucgauggccccaauacuccagagugccccagcgcuucucgggcauggaacgugugggaaguugaggacuaugguuuugggguguucaccacgaauauuuggcugaaacuucgcgaagucuacacacaguugugugaccauagacucaugucagccgcugugaaggaugagagggccguucacgcagacaugggauacuggaucgagagucagaaaaacggcagcuggaagcuggaaaaagcgucccuaauagaggugaagaccugcacuuggccuaagucucacacccuguggucgaaugguguacucgaaagcgauaugaucauuccaaaaucccuggccggcccgaucucacagcauaaccaccgucccggguaucauacacaaacugcuggaccuuggcaccuuggcaaguuggagcuggacuuuaauuacugcgaggggaccacagucgugauuacggaaaacuguggaacccggggcccaaguuuacgaacuacaaccgugucugguaaacucauccacgaguggugcuguagaagcugcacucugcccccucuuagguauaugggggaagauggauguugguacggcauggagauacgcccaauuuccgaaaaggaggagaauauggucaaaucacugguuagcgccgguucuggcaagguggacaacuucacaauggggguauugugccucgcaauccuguuugaagaggugaugcggggaaaguucggcaaaaagcauaugaucgcuggggucuucuuuaccuucgugcuacugcucuccggacagauuacguggagagauauggcccacacucugaucaugauuggcaguaaugcaagcgacaggauggguauggggguuaccuaucuugccuugauagcuacauuuaaaauccagcccuuccuggcguuaggauuuuuccuccgcaagcugaccucucgagaaaaccuucugcuaggcgugggccucgccauggcaacuacacugcaauugccggaggauauugaacagauggcuaaugggaucgcccugggauuaauggcccucaaacugauuacccaguuugagacauaccagcuuuggacugcucugaucuccuugaccuguucaaacacgauguucacacucaccgucgcauggcggacugccacccugauacuagcgggugugagucugcuuccuguuugccaaagcucguccaugcguaagacagacuggcucccaauggcuguggccgcaaugggcguccccccucugcccuuguuuaucuucucucugaaggauacuuuaaaaagaaggagcuggccacucaaugaggggguaauggccgugggacugguuucaauucuugcuaguucccuguugcgcaacgacgugccuauggcaggcccccucgucgccggugggcugcuaaucgcguguuaugugauuaccggaacgucugcugaucugacaguagaaaaggccgcagacaucaccugggaggaagaggccgaacagacuggcgugagccauaaccuuaugauaacagucgacgaugacggcaccaugcggauuaaagaugacgagacugagaauauccucacaguucuguugaagaccgcuuuacugaucguguccgggguguuuccauacucaauuccggccacgcuccuggucuggcacacuuggcagaaacagacccaaagaagcggagugcuuugggauguuccuagucccccagaaacacagaaggcagagcuggaagaggguguauacaggauaaaacagcagggcaucuucgggaagacccaagugggagucggcgugcagaaggaggguguuuuucauacaauguggcacgugacucgaggggcugucuugaccuauaacggaaaacgccuagaacccaauugggccucugugaagaaagaccugauuuccuacggcggcggguggcggcucagcgcgcaguggcaaaagggagaggaaguacaggucaucgccguggagccugguaaaaacccaaagaauuuccagacgaugcccggcacauuccagacuaccacaggggaaauuggagcaaucgcucuggauuuuaagccuggcaccucggguucaccgauaaucaacagagaggggaaaguugugggacuuuauggcaauggcgucgugacuaagaacgggggauacguuucugguauugcccaaaccaaugcugagccagacggccccacaccugaauuagaggaagagauguucaaaaagaggaaccugacgaucauggaucuccacccagggaguggaaaaacucguaaguauuugcccgcaauugugcgcgaagccaucaagcggagacugaggacccucauacuggccccuacacgagucguggcugcggagauggaggaagcacuuaaaggccugccgauucgguaccagaccacugccacaaaguccgagcauaccggucgcgaaaucguagacuugaugugccacgcuacguuuacuaugagacuacugagccccgugaggguuccaaauuauaaccucaucauuauggaugaggcccauuucacagacccugcaucuaucgccgcucggggguacauaagcacccgagucggaaugggcgaagcggccgcaauuuuuaugaccgcuacucccccaggcacagccgaugcauucccucaguccaaugcccccauccaggacgaggagagagacauuccagaacgcucauggaacagugggaaugaguggaucaccgauuuugcuggaaaaacagugugguucgugccgagcauaaaggccgguaacgacauugcgaacuguuuaaggaaaaauggcaagaaggucauccaacugucucguaaaacuuuugauacggaauaccagaagaccaaacuuaacgacugggauuucguagugacaacugacaucuccgagaugggggcaaauuuuaaggccgaucggguuauugacccuagaaggugccugaaacccgugauccucaccgauggaccagagcgcgucauuuuggcuggccccaugccugugacagccgcuucagcagcccagcgaagaggucggguugggaggaacccacagaaggaaaaugaccaauauauauucaccggccagccccugaacaaugaugaggaccacgcucauuggacugaagccaagaugcuccuggacaacaucaauacgccugagggaauuaucccggcacuuuucgaaccagagcgcgagaaaagugcggccaucgauggcgaauaccgucuaaagggggagagcagaaaaaccuuuguggaacugaugcggaggggagacuugcccgucugguuagcucacaagguggccuccgaggguauuaaauauacagaucgcaaguggugcuucgacggccagcgaaacaaucagauacuggaagagaacauggauguagagaucuggacuaaagaaggggagaagaagaaacucagaccucgguggcuggacgcaaggaccuacucugauccccuugcucugaaggaauuuaaagacuucgccgcaggacgcaagucgauugcccucgauuuggugacagagaucggcagaguuccaagccaccuggcucauaggacccggaaugcgcuagacaaccuggucaugcuccacacuucagaacauggugggcgugccuaucgccacgcaguggaggagcuuccugaaacaauggagacgcuguuauugcugggccucaugauucugcuuaccggaggcgcuaugcuguuucucaucuccgggaaaggaauagguaagacuaguaucggcuugauuugugugaucgccucuagcgggaugcuguggauggccgaaauucccuuacaauggaucgcauccgcuauaguccuagaguucuuuaugaugguucugcucauuccagagccugaaaagcagcgaacaccgcaggauaaucaacuugccuacgugguaaucggaauucugaccuuggcggcuaucauagccgcaaacgagaugggccugcucgaaaccacaaaaagagaccuggguaugucaaaggagcccgggguggucucuccaacuagcuaucuugauguggaccuccacccugccagugcuuggacgcuguacgcaguugccaccacagugaucacucccauguugaggcauaccauugaaaauuccacagcgaacgucagccuggcugccaucgcaaaccaggccguaguguuaaugggccuagacaaaggauggccaauuucuaagauggaucugggcguuccucuccuugcucuggggugcuacucacaggugaaucccuugacccugacugccgcaguccuccugcuuaucacgcacuaugcuauaauuggaccgggcuuacaggccaaagcgacacgggaggcccaaaagcgcaccgcagcugguaucaugaagaacccaacuguggacgggaucaugaccauugaucuggacccugucaucuacgauuccaaauucgagaagcagcucggacaggugauguugcugguucuaugugccgugcagcugcuccuuaugagaacaaguugggcacugugcgaagcuuugacucuggccaccggccccauaacaacgcucugggaggguagcccaggcaaauuuuggaauaccacuauugccguaucgauggcgaacaucuucagggggucuuaucuggcuggagcaggcuuagccuuuuccauuaugaagagcguggggacaggaaaacggggcaccgguucacaaggggaaacucuuggagagaaguggaagaaaaagcugaaucagcucagucgaaaagaauucgaccuauacaagaaaucuggcaucacagaggucgauagaaccgaggcuaaggaaggucugaaacgcggcgagauaacgcaucacgccguuuccagggggagcgcaaaguugcagugguuuguggaacggaacauggucauccccgagggacgugugauugaccugggcugugggagaggaggcuggucauauuacugcgccggucucaagaaaguaaccgaagugaggggguauacaaagggaggcccuggccaugaggagccgguucccaugaguacuuacggguggaauaucgugaaacuuaugagcggaaaggaugucuucuaccugccaccugaaaaaugugacaccuugcugugcgauauuggugaguccucucccagcccuacaguggaagagucccgcacuauccggguccucaagaugguggagccaugguuaaagaacaaucaguucuguauuaaaguucugaaccccuauaugccuaccguaaucgaacaccuugagcgacugcaaagaaagcacggcgggaugcuagugaggaauccacucucacgcaacucuacacaugaaauguacuggauaaguaauggaaccggcaacauugucgcuucggugaauaugguuagccggcuguugcugaacagauuuacuaugacgcaccguaggcccacaaucgagaaagacguggaucucggugcggggacccggcaugucaacgccgaaccggagacuccuaauauggacgugaucggagagcgcauuaagcgaauaaaagaagagcacaacuccaccuggcacuaugacgaugaaaauccauacaagacaugggcauaucauggcucuuacgagguaaaggcuacgggcucagccagcuccaugaucaacggggugguuaaacuucugaccaagcccugggacgucgugccuauggugacucagauggcaaugacagauaccacuccauucggacagcaaagagucuuuaaagaaaagguugacacaaggaccccccggaguaugccggguacacgcagagugaugggcauuacugccgagugguuauggaggacccuggggcgaaauaaaaagccucgguugugcacgcgugaggaauucaccaagaaaguaagaacaaacgcugccaugggagcgguguuuacugaggaaaaucagugggauucugcaaaggccgcugucgaggacgaagauuucuggaaacucguggaccgcgagagggagcugcacaagcuaggcaaaugugguagcugcguuuauaacaugauggggaagcgggaaaaaaagcuuggagaguuuggcaaggccaaaggcucaagagcaaucugguacauguggcugggggcucgcuaccucgaauucgaggcccugggauuuuugaaugaggaucauugguucuccagggaaaacaguuauagcgguguggagggcgaagggcugcacaagcucggauacauucuucgagacaucucuaaaauacccggcggugcuauguaugccgaugacaccgcagggugggacacacggaucacugaggaugaccugcauaaugaagagaagauuacccagcagauggauccagagcacagacaauuagcgaacgccaucuuuaaacugacguaccagaauaaggucgugaagguacagaggccuacacccaccggaacuguuauggacauuaucucccgcaaagaucagcguggcucaggccaaguggggacauauggauugaacaccuucacuaauauggaagcucagcucauacggcagauggagggugaaggcguccugagcaaggccgaccuagagaacccacaccuucccgaaaaaaaggugacccaguggcuggagacaaaagggguggagagacucaagaggauggcaauuucgggagaugacugcgucguuaagccuaucgaugaccgcuuugcuaacgcccuguuggcauuaaaugauaugggcaaagugcgaaaggacaucccacaauggcagccgucuaaagguuggcaugauuggcagcagguacccuucuguagucaccauuuccacgaacugauuaugaaggacgggcggaaacucguggucccuugcagaccacaagacgagcuuauaggaagggcccgcaucucccagggcgcgggcuggagccugagagaaacggcuugucuagggaaggccuacgcacagauguggucacugauguauuuucaccggagggaucuccguuuggccuccaacgcuauuugcucugccgugcccguucauugggugccuaccagccgaacuacauggaguauccacgcacaucaccaauggaugaccacugaggacaugcugacagucuggaaucgcguguggauugaagauaacccauggauggaggacaagacccccguaacgacaugggagaauguuccuuaccuuggaaaaagagaagaucaguggugugguucccugaucggccucaccagccgggcuacuugggcccagaacauaccgaccgcgauccagcaagugaggucuuuaauugggaaugaggaauuccuggacuacaugccaucaaugaagcgcuuuagaaaagaggaggaaagugagggagcuaucugguga

SEQ ID NO: 15094 - RNA, 9873 nt, Artificial Sequence
  derived and/or modified CDS sequence (opt3) from DENV-3__JX669499__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcgccgacgugacaagagaagcguagcccuugcaccccacgugggcaugggucuggauacaaggacccaaacguggauguccgccgagggggcuuggcggcaggucgaaaaaguggagacuugggcauugcgccauccuggauucaccauucucgcccuguuucuggcucacuacaucggcacaucucucacucagaagguugugauauucaucuuacugaugcuugucaccccaucgaugacaaugagaugugugggcguagggaacagggacuuuguugaaggauugucaggugccaccuggguggaugucgugcuggagcauggcgggugcgugacgacuauggcgaagaauaaacccacacuagacauugagcuccagaagaccgaagcaacucaacuggccacacuucggaaacuguguaucgagggaaagauuaccaacaucacgaccgauagccgcugcccuacacagggcgaagcugucuugccagaggaacaggaccagaauuauguuuguaaacacacuuacguggaucgagguugggggaacggaugcggccucuucggcaaggggagucugguaaccugcgccaaguuucaauguuuagagcccauagagggaaaagugguccaguaugaaaaucugaaguacacagugauuaucacuguucacaccggugaccagcaucaggugggcaacgagacacaaggggucaccgcagaaauuacuccucaggcuuccacgacagaggccauccucccagaauauggaacccuuggccuggagugcucuccgagaacugguuuggacuucaaugagaugauccuacugaccaugaaaaacaaggcguggauggugcacaggcagugguuuuucgaucucccccugccuuggacaagcggggccaccacugaaacaccaacguggaaucggaaagagcuucugguaaccuuuaagaacgcacaugcuaaaaagcaagaaguuguggucuugggcucccaggagggagccaugcacacugcucucacaggcgccaccgaaauucagaauucagggggaacaaguauauucgcaggucaccugaagugucguuuaaaaauggacaagcuggagcuaaaaggcaugagcuacgccaugugcacuaacaccuuugugcucaagaaagaggucucugaaacgcagcaugggaccauccugauuaagguggaguacaagggagaagaugcucccuguaaaaucccuuucuccacagaggacggccaagguaaggcgcacaacgggcgccuuauaacugcaaauccaguugugaccaaaaaggaggaacccguaaacauugaggccgaaccgccuuucggcgagucaaauaucgucaucggaauuggcgauaacgcuuugaaaaucaauugguauaagaaggggagcaguauuggaaaaauguuugaagccacagcaagaggugccaggcggauggcuauacugggcgacacugccugggauuucgggucugugggaggcguucucaacucccuggguaagauggugcaucagaucuuugggagcgcauacaccgcgcuuuucucgggcgucucuugggugaugaaaauuggaaucggcguacuguugacguggaucgggcucaauuccaagaacacaucaaugaguuuuagcugcauugcuauaggaaucauuacccuguauuuaggcgccgugguucaggcagacauggguugugucaucaauuggaaagggaaggagcugaagugcggauccggcauuuucgugacuaacgaggugcacacauggaccgaacaguacaaauuucaagccgauucucccaagcgacuagcuacugccaucgcaggugcuugggagaauggcgucugugggauacgcagcaccacaagaauggaaaaccuccuguggaaacagaucgccaaugagcuuaacuauauuuugugggaaaauaacaucaagcugacgguuguggugggagacauuaucggcguacucgagcaggggaaaaggacccugacuccacagccuauggaguuaaaguacucauggaaaacauggggaaaggcgaagauagucaccgccgaaacacaaaacaguuccuucauuaucgauggccccaauacuccagagugccccagcgcuucucgggcauggaacgugugggaaguugaggacuaugguuuugggguguucaccacgaauauuuggcugaaacuucgcgaagucuacacacaguugugugaccauagacucaugucagccgcugugaaggaugagagggccguucacgcagacaugggauacuggaucgagagucagaaaaacggcagcuggaagcuggaaaaagcgucccuaauagaggugaagaccugcacuuggccuaagucucacacccuguggucgaaugguguacucgaaagcgauaugaucauuccaaaaucccuggccggcccgaucucacagcauaaccaccgucccggguaucauacacaaacugcuggaccuuggcaccuuggcaaguuggagcuggacuuuaauuacugcgaggggaccacagucgugauuacggaaaacuguggaacccggggcccaaguuuacgaacuacaaccgugucugguaaacucauccacgaguggugcuguagaagcugcacucugcccccucuuagguauaugggggaagauggauguugguacggcauggagauacgcccaauuuccgaaaaggaggagaauauggucaaaucacugguuagcgccgguucuggcaagguggacaacuucacaauggggguauugugccucgcaauccuguuugaagaggugaugcggggaaaguucggcaaaaagcauaugaucgcuggggucuucuuuaccuucgugcuacugcucuccggacagauuacguggagagauauggcccacacucugaucaugauuggcaguaaugcaagcgacaggauggguauggggauaaccuaucuugccuugaucgcuacauuuaaaauucagcccuuccuggcguuaggauuuuuccuccgcaagcugaccucucgagaaaaccuucugcuaggcguuggccucgccauggcaacuacacugcaauugccggaggauaucgaacagauggcuaaugggauugcccugggauuaauggcccucaaacugaucacccaguuugagacauaccagcuuuggacugcucugauauccuugaccuguucaaacacgauguucacacucaccguggcauggcggacugccacccugauccuagcgggugucagucugcuuccugugugccaaagcucguccaugcguaagacagacuggcucccaauggcuguugccgcaaugggcgugcccccucugcccuuguuuauuuucucucugaaggauacuuuaaaaagaaggagcuggccacucaaugagggggucauggccguaggacuggugucaauccuugcuaguucccuguugcgcaacgacguuccuauggcaggcccccucguggccggugggcugcuaauugcguguuaugucaucaccggaacgucugcugaucugacaguggaaaaggccgcagacauaaccugggaggaagaggccgaacagacuggcguaagccauaaccuuaugauuacaguggacgaugacggcaccaugcggaucaaagaugacgagacugagaauauccucacaguccuguugaagaccgcuuuacugauuguuuccgggguguuuccauacucaauaccggccacgcuccugguguggcacacuuggcagaaacagacccaaagaagcggaguccuuugggaugugccuagucccccagaaacacagaaggcagagcuggaagaggguguuuacaggaucaaacagcagggcauuuucgggaagacccaaguaggagugggcguccagaaggaggguguguuucauacaauguggcacguuacucgaggggcuguguugaccuauaacggaaaacgccuagaacccaauugggccucugucaagaaagaccugaucuccuacggcggcggguggcggcucagcgcgcaguggcaaaagggagaggaagugcagguaauugccgucgagccugguaaaaacccaaagaauuuccagacgaugcccggcacauuccagacuaccacaggggaaaucggagcaauagcucuggauuuuaagccuggcaccucggguucaccgaucauuaacagagaggggaaagugguuggacuuuauggcaauggcguggucacuaagaacgggggauacgugucugguaucgcccaaaccaaugcugagccagacggccccacaccugaauuagaggaagagauguucaaaaagaggaaccugacgauuauggaucuccacccagggaguggaaaaacucguaaguauuugcccgcaaucguucgcgaagccauaaagcggagacugaggacccucauucuggccccuacacgaguggucgcugcggagauggaggaagcacuuaaaggccugccgauccgguaccagaccacugccacaaaguccgagcauaccggucgcgaaaucguggacuugaugugccacgcuacguuuacuaugagacuacugagccccguaagggugccaaauuauaaccucauuaucauggaugaggcccauuucacagacccugcaucuauagccgcucggggguacauuagcacccgaguuggaaugggcgaagcggccgcaaucuuuaugaccgcuacucccccaggcacagccgaugcauucccucaguccaaugcccccauucaggacgaggagagagacaucccagaacgcucauggaacagugggaaugaguggauaaccgauuuugcuggaaaaacagucugguucgugccgagcauuaaggccgguaacgacaucgcgaacuguuuaaggaaaaauggcaagaaggugauccaacugucucguaaaacuuuugauacggaauaccagaagaccaaacuuaacgacugggauuucgucguaacaacugacauuuccgagaugggggcaaauuuuaaggccgaucgggugaucgacccuagaaggugccugaaacccguuauucucaccgauggaccagagcgcgugauauuggcuggccccaugccugucacagccgcuucagcagcccagcgaagaggucggguggggaggaacccacagaaggaaaaugaccaauauaucuucaccggccagccccugaacaaugaugaggaccacgcucauuggacugaagccaagaugcuccuggacaacauuaauacgccugagggaaucaucccggcacuuuucgaaccagagcgcgagaaaagugcggccauugauggcgaauaccgucuaaagggggagagcagaaaaaccuuuguugaacugaugcggaggggagacuugcccgugugguuagcucacaaggucgccuccgaggguauaaaauauacagaucgcaaguggugcuucgacggccagcgaaacaaucagauccuggaagagaacauggauguggagauuuggacuaaagaaggggagaagaagaaacucagaccucgguggcuggacgcaaggaccuacucugauccccuugcucugaaggaauuuaaagacuucgccgcaggacgcaagucgaucgcccucgauuugguaacagagauuggcagagugccaagccaccuggcucauaggacccggaaugcgcuagacaaccugguuaugcuccacacuucagaacauggugggcgugccuaucgccacgcagucgaggagcuuccugaaacaauggagacgcuguuauugcugggccucaugauccugcuuaccggaggcgcuaugcuguuucucauauccgggaaaggaaucgguaagacuaguauuggcuugaucugugugauugccucuagcgggaugcuguggauggccgaaauccccuuacaauggauagcauccgcuauugugcuagaguucuuuaugaugguccugcucaucccagagccugaaaagcagcgaacaccgcaggauaaucaacuugccuacguugugauuggaauccugaccuuggcggcuauaaucgccgcaaacgagaugggccugcucgaaaccacaaaaagagaccuggguaugucaaaggagcccgggguagugucuccaacuagcuaucuugaugucgaccuccacccugccagugcuuggacgcuguacgcaguggccaccacaguuauuacucccauguugaggcauaccaucgaaaauuccacagcgaacgugagccuggcugccauugcaaaccaggccgucguauuaaugggccuagacaaaggauggccaaucucuaagauggaucugggcgugccucuccuugcucuggggugcuacucacagguuaaucccuugacccugacugccgcagugcuccugcuuauaacgcacuaugcuauuaucggaccgggcuuacaggccaaagcgacacgggaggcccaaaagcgcaccgcagcugguaucaugaagaacccaacugucgacgggauuaugaccaucgaucuggacccugugauauacgauuccaaauucgagaagcagcucggacaggucauguugcuggugcuaugugccguucagcugcuccuuaugagaacaaguugggcacugugcgaagcuuugacucuggccaccggccccauuacaacgcucugggaggguagcccaggcaaauuuuggaauaccacuaucgccgugucgauggcgaacauuuucagggggucuuaucuggcuggagcaggcuuagccuuuuccaucaugaagagcguagggacaggaaaacggggcaccgguucacaaggggaaacucuuggagagaaguggaagaaaaagcugaaucagcucagucgaaaagaauucgaccuauacaagaaaucuggcauaacagagguggauagaaccgaggcuaaggaaggucugaaacgcggcgagaucacgcaucacgccgucuccagggggagcgcaaaguugcagugguuuguugaacggaacauggugauucccgagggacgugucaucgaccugggcugugggagaggaggcuggucauauuacugcgccggucucaagaaagugaccgaaguaaggggguauacaaagggaggcccuggccaugaggagccggugcccaugaguacuuacggguggaauauuguuaaacuuaugagcggaaaggauguguucuaccugccaccugaaaaaugugacaccuugcugugcgauaucggugaguccucucccagcccuacagucgaagagucccgcacuauucgggugcucaagauggucgagccaugguuaaagaacaaucaguucuguaucaaagugcugaaccccuauaugccuaccguuauagaacaccuugagcgacugcaaagaaagcacggcgggaugcuaguaaggaauccacucucacgcaacucuacacaugaaauguacuggauuaguaauggaaccggcaacaucguggcuucggucaauauggugagccggcuguugcugaacagauuuacuaugacgcaccguaggcccacaaucgagaaagacguugaucucggugcggggacccggcaugugaacgccgaaccggagacuccuaauauggacgucauuggagagcgcauaaagcgaaucaaagaagagcacaacuccaccuggcacuaugacgaugaaaauccauacaagacaugggcauaucauggcucuuacgaggugaaggcuacgggcucagccagcuccaugauuaacgggguagugaaacuucugaccaagcccugggacguugucccuauggugacucagauggcaaugacagauaccacuccauucggacagcaaagaguguuuaaagaaaaggucgacacaaggaccccccggaguaugccggguacacgcagaguuaugggcaucacugccgagugguuauggaggacccuggggcgaaauaaaaagccucgguugugcacgcgugaggaauucaccaagaaagugagaacaaacgcugccaugggagcgguauuuacugaggaaaaucagugggauucugcaaaggccgcuguggaggacgaagauuucuggaaacucgucgaccgcgagagggagcugcacaagcuaggcaaaugugguagcugcguguauaacaugauggggaagcgggaaaaaaagcuuggagaguuuggcaaggccaaaggcucaagagcaauuugguacauguggcugggggcucgcuaccucgaauucgaggcccugggauuuuugaaugaggaucauugguucuccagggaaaacaguuauagcgguguugagggcgaagggcugcacaagcucggauacauccuucgagacauaucuaaaauccccggcggugcuauguaugccgaugacaccgcagggugggacacacggauuacugaggaugaccugcauaaugaagagaagaucacccagcagauggauccagagcacagacaauuagcgaacgccauuuuuaaacugacguaccagaauaagguggucaaggugcagaggccuacacccaccggaacuguaauggacaucauaucccgcaaagaucagcguggcucaggccaaguugggacauauggauugaacaccuucacuaauauggaagcucagcucauucggcagauggagggugaaggcgugcugagcaaggccgaccuagagaacccacaccuucccgaaaaaaagaucacccaguggcuggagacaaaaggggucgagagacucaagaggauggcaaucucgggagaugacugcguggugaagccuauugaugaccgcuuugcuaacgcccuguuggcauuaaaugauaugggcaaaguccgaaaggacauaccacaauggcagccgucuaaagguuggcaugauuggcagcagguucccuucuguagucaccauuuccacgaacugaucaugaaggacgggcggaaacucgugguaccuugcagaccacaagacgagcuuauuggaagggcccgcaucucccagggcgcgggcuggagccugagagaaacggcuugucuagggaaggccuacgcacagauguggucacugauguauuuucaccggagggaucuccguuuggccuccaacgcuauuugcucugccgugcccguccauugggugccuaccagccgaacuacauggaguauccacgcacaucaccaauggaugaccacugaggacaugcugacaguuuggaaucgcguguggauagaagauaacccauggauggaggacaagacccccgucacgacaugggagaaugugccuuaccuuggaaaaagagaagaucaguggugugguucccugaucggccucaccagccgggcuacuugggcccagaacauuccgaccgcgauccagcaaguaaggucuuuaauugggaaugaggaauuccuggacuacaugccaucaaugaagcgcuuuagaaaagaggaggaaagugagggagcuaucugguga

SEQ ID NO: 15095 - RNA, 9873 nt, Artificial Sequence
  derived and/or modified CDS sequence (opt3) from DENV-3__JX669492__SS-prME
accagcuucugccugaugaugauccuccccgcagcucuugcauuucaccugacuuccagagacggagaaccuaggaugauuguggggaagaacgaacggggaaagucuuuguuauucaagacugccucagguauaaauauguguacgcugaucgcgauggaucucggcgaaaugugcgacgauaccgucaccuacaaauguccacauauuacugaaguugagccggaagacaucgauugcugguguaaccucaccaguacaugggugaccuaugggacuugcaaucaggcuggagagcgccgacgugacaagagaagcgucgcccuggcaccccacgugggcaugggucuugauacaaggacccagacguggauguccgccgagggggcuuggcggcaggucgaaaaaguggagacuugggcacugcgccauccuggauuuaccauuuuggcccucuuccuggcucacuacaucggcacaucucugacucagaagguugugauauuuauccucuuaaugcuggucaccccaucgaugacaaugagaugugugggcguagggaacagggacuucguugaaggacuuucaggugccaccuggguggaugucguguuggagcauggcgggugcgugacgacuauggcgaagaauaaacccacacuggacauugaguugcagaagaccgaagcaacucagcucgccacacugcggaaacuuuguaucgagggaaagauuaccaacaucacgaccgauagccgcugcccuacacagggcgaagcuguccugccagaggaacaggaccagaauuauguuuguaaacacacuuacguggaucgagguugggggaacggaugcggcuuguuuggcaaggggagucucguaaccugcgccaaguuccaaugucuggagcccauagagggaaaagugguccaguaugaaaauuuaaaguacacagugauuaucacuguucacaccggugaccagcaucaggugggcaacgagacacaaggggucaccgcagaaauuacuccucaggcuuccacgacagaggccauccugccagaauauggaacccucggccuugagugcucuccgagaacuggucuggacuuuaaugagaugaucuugcuaaccaugaaaaacaaggcguggauggugcacaggcagugguucuuugaucugccccucccuuggacaagcggggccaccacugaaacaccaacguggaaucggaaagagcugcuuguaaccuucaagaacgcacaugcuaaaaagcaagaaguugugguccugggcucccaggagggagccaugcacacugcuuugacaggcgccaccgaaauucaaaauucagggggaacaaguauauuugcaggucaccucaagugucgucugaaaauggacaaguuagagcugaaaggcaugagcuacgccaugugcacuaacaccuucgugcuaaagaaagaggucucugaaacgcagcaugggaccauccucauuaagguggaguacaagggagaagaugcucccuguaaaaucccuuucuccacagaggacggccaagguaaggcgcacaacgggcgccugauaacugcaaauccaguugugaccaaaaaggaggaacccguaaacauugaggccgaaccgccuuuuggcgagucaaauaucgucaucggaauuggcgauaacgcucuuaaaaucaauugguauaagaaggggagcaguauuggaaaaauguucgaagccacagcaagaggugccaggcggauggcuauauugggcgacacugccugggauuuugggucugugggaggcguucugaacucccucgguaagauggugcaucagaucuucgggagcgcauacaccgcgcuguuuucgggcgucucuugggugaugaaaauuggaaucggcguacuucugacguggaucgggcuaaauuccaagaacacaucaaugaguuucagcugcauugcuauaggaaucauuacccucuaucugggcgccgugguucaggcagacauggguugugucaucaauuggaaagggaaggaguuaaagugcggauccggcauuuuugugacuaacgaggugcacacauggaccgaacaguacaaauuccaagccgauucucccaagcgacuggcuacugccaucgccggugcuugggagaauggcgucugugggauacgcagcaccacaagaauggaaaaccuacucuggaaacagaucgccaaugagcugaacuauauucuuugggaaaauaacaucaaguugacgguuguggugggagacauuaucggcguacuggagcaggggaaaaggacccucacuccacagccuauggagcugaaguacucauggaaaacauggggaaaggcgaagauagucaccgccgaaacacaaaacaguuccuuuauuaucgauggccccaauacuccagagugccccagcgcuucucgggcauggaacgugugggaaguugaggacuaugguuucgggguguuuaccacgaauauuugguuaaaacugcgcgaagucuacacacagcuuugugaccauagauugaugucagccgcugugaaggaugagagggccguucacgcagacaugggauacuggaucgagagucagaaaaacggcagcuggaagcucgaaaaagcgucccugauagaggugaagaccugcacuuggccuaagucucacacccuauggucgaaugguguacuggaaagcgauaugaucauuccaaaaucccucgccggcccgaucucacagcauaaccaccgucccggguaucauacacaaacugcuggaccuuggcaccugggcaaacuugaguuggacuucaauuacugcgaggggaccacagucgugauuacggaaaacuguggaacccggggcccaagucugcgaacuacaaccgugucugguaaauuaauccacgaguggugcuguagaagcugcacucuacccccucugagguauaugggggaagauggauguugguacggcauggagauacgcccaauuuccgaaaaggaggagaauauggucaaaucacuuguuagcgccgguucuggcaagguggacaacuuuacaauggggguacugugcuuggcaauccucuucgaagaggugaugcggggaaaguucggcaaaaagcauaugaucgcuggggucuuuuucaccuuugugcugcuacuguccggacagauuacguggagagauauggcccacacucucaucaugauuggcaguaaugcaagcgacaggauggguauggggguuaccuaucuggcccuuauagcuacauucaaaauccagcccuuuuuggcgcugggauucuuuuuacgcaagcucaccucucgagaaaaccugcuucugggcgugggccuagccauggcaacuacacuccaacugccggaggauauugaacagauggcuaaugggaucgccuugggacugauggccuuaaaacucauuacccaguucgagacauaccagcuguggacugcucuuaucucccugaccuguucaaacacgauguuuacauugaccgucgcauggcggacugccacccucauacuggcgggugugagucuacugccuguuugccaaagcucguccaugcguaagacagacuggcuuccaauggcuguggccgcaaugggcguacccccucucccccuguucaucuuuucuuugaaggauacucugaaaagaaggagcuggccauuaaaugaggggguaauggccgugggacucguuucaauucuggcuaguucccuucugcgcaacgacgugccuauggcaggccccuuggucgccggugggcuccugaucgcguguuaugugauuaccggaacgucugcugaucuaacaguagaaaaggccgcagacaucaccugggaggaagaggccgaacagacuggcgugagccauaaccugaugauaacagucgacgaugacggcaccaugcggauuaaagaugacgagacugagaauauccuuacaguucuccugaagaccgcuuuguuaaucguguccgggguguucccauacucaauuccggccacgcugcucgucuggcacacuuggcagaaacagacccaaagaagcggagugcugugggauguuccuagucccccagaaacacagaaggcagagcuugaagaggguguauacaggauaaaacagcagggcaucuuugggaagacccaagugggagucggcgugcagaaggaggguguuuuccauacaauguggcacgugacucgaggggcuguccugaccuauaacggaaaacgcuuggaacccaauugggccucugugaagaaagaccuaauuuccuacggcggcggguggcggcugagcgcgcaguggcaaaagggagaggaaguacaggucaucgccguggagccugguaaaaacccaaagaauuuccagacgaugcccggcacauuucagacuaccacaggggaaauuggagcaaucgcucucgauuucaagccuggcaccucggguucaccgauaaucaacagagaggggaaaguugugggacuguauggcaauggcgucgugacuaagaacgggggauacguuucugguauugcccaaaccaaugcugagccagacggccccacaccugaacuugaggaagagauguuuaaaaagaggaacuuaacgaucauggaucugcacccagggaguggaaaaacucguaaguaucuccccgcaauugugcgcgaagccaucaagcggagauugaggacccugauacucgccccuacacgagucguggcugcggagauggaggaagcacugaaaggccuuccgauucgguaccagaccacugccacaaaguccgagcauaccggucgcgaaaucguagaccugaugugccacgcuacguucacuaugagauugcuaagccccgugaggguuccaaauuauaaccugaucauuauggaugaggcccauuuuacagacccugcaucuaucgccgcucggggguacauaagcacccgagucggaaugggcgaagcggccgcaauuuucaugaccgcuacucccccaggcacagccgaugcauuuccucaguccaaugcccccauccaggacgaggagagagacauuccagaacgcucauggaacagugggaaugaguggaucaccgauuucgcuggaaaaacagugugguuugugccgagcauaaaggccgguaacgacauugcgaacugucucaggaaaaauggcaagaaggucauccaauuaucucguaaaacuuucgauacggaauaccagaagaccaaacugaacgacugggauuuuguagugacaacugacaucuccgagaugggggcaaauuucaaggccgaucggguuauugacccuagaaggugccuuaaacccgugauccugaccgauggaccagagcgcgucauucucgcuggccccaugccugugacagccgcuucagcagcccagcgaagaggucggguugggaggaacccacagaaggaaaaugaccaauauauauucaccggccagcccuugaacaaugaugaggaccacgcucauuggacugaagccaagaugcugcucgacaacaucaauacgccugagggaauuaucccggcacuguuugaaccagagcgcgagaaaagugcggccaucgauggcgaauaccgucuuaagggggagagcagaaaaaccuucguggaacuaaugcggaggggagaccugcccgucugguuggcucacaagguggccuccgaggguauuaaauauacagaucgcaaguggugcuuugacggccagcgaaacaaucagauauuagaagagaacauggauguagagaucuggacuaaagaaggggagaagaagaaacugagaccucgguggcucgacgcaaggaccuacucugauccccuggcucuuaaggaguucaaagacuuugccgcaggacgcaagucgauugcccuggaucucgugacagagaucggcagaguuccaagccacuuggcucauaggacccggaaugcgcuggacaaccuagucaugcugcacacuucagaacauggugggcgugccuaucgccacgcaguggaggagcucccugaaacaauggagacgcuucuguuauugggccugaugauucuccugaccggaggcgcuaugcuuuuccugaucuccgggaaaggaauagguaagacaaguaucggccucauuugugugaucgccucuagcgggauguuguggauggccgaaauuccccugcaauggaucgcauccgcuauagucuuagaguuuuucaugaugguucuacugauuccagagccugaaaagcagcgaacaccgcaggauaaucaacucgccuacgugguaaucggcauucuuacccuggcggcuaucauagccgcaaacgagaugggcuugcuggaaaccacaaaaagagaccucgguaugucaaaggagcccgggguggucucuccaacuagcuaucuggauguggaccuucacccugccagugcuuggacgcucuacgcaguugccaccacagugaucacucccaugcugaggcauaccauugaaaauuccacagcgaacgucagcuuggcugccaucgcaaaccaggccguagugcugaugggcuuagacaaaggauggccaauuucuaagauggaucuaggcguuccucugcucgcucuugggugcuacucacaggugaauccccugaccuugacugccgcaguccugcuccugaucacgcacuaugcuauaauuggaccgggccuucaggccaaagcgacacgggaggcccaaaagcgcaccgcagcugguaucaugaagaacccaacuguggacgggaucaugaccauugauuuagacccugucaucuacgauuccaaauuugagaagcagcugggacaggugaugcucuugguucugugugccgugcagcuacugcucaugagaacaaguugggcacuuugcgaagcucugacuuuggccaccggccccauaacaacgcugugggaggguagcccaggcaaauucuggaauaccacuauugccguaucgauggcgaacaucuuuagggggucuuaucucgcuggagcaggccuggccuucuccauuaugaaaagcguggggacaggaaaacggggcaccgguucacaaggggaaacuuuaggagagaaguggaagaagaaacuuaaucagcugagucgaaaagaauuugaccucuacaagaaaucuggcaucacagaggucgauagaaccgaggcuaaagaaggucuaaaacgcggcgagauaacgcaucacgccguuuccagggggagcgcaaagcugcagugguucguggaacggaacauggucauccccgagggacgugugauugacuugggcugugggagaggaggcuggucauauuacugcgccggucugaagaaaguaaccgaagugaggggguauacaaagggaggcccuggccaugaggagccgguucccaugaguacuuacggguggaauaucgugaaacucaugagcggaaaggaugucuucuaccuuccaccugaaaaaugugacacccuguugugcgauauuggugaguccucucccagcccuacaguggaagagucccgcacuauccggguccugaagaugguggagccauggcucaagaacaaucaguuuuguauuaaaguuuuaaaccccuauaugccuaccguaaucgaacaccuggagcgacuucaaagaaagcacggcgggaugcuggugaggaauccacuaucacgcaacucuacacaugaaauguacuggauaaguaauggaaccggcaacauugucgcuucggugaauaugguuagccggcuccuguugaacagauucacuaugacgcaccguaggcccacaaucgagaaagacguggaucugggugcggggacccggcaugucaacgccgaaccggagacuccuaauauggacgugaucggagagcgcauuaagcgaauaaaagaagaacacaacuccaccuggcacuaugacgaugaaaauccauacaagacaugggcauaucauggcucuuacgagguaaaggcuacgggcucagccagcuccaugaucaacggggugguuaaacuccuuaccaagcccugggacgucgugccuauggugacucagauggcaaugacagauaccacuccauuuggacagcaaagagucuucaaagaaaagguugacacaaggacaccccggaguaugccggguacacgcagagugaugggcauuacugccgaguggcuguggaggaccuuagggcgaaauaaaaagccucggcugugcacgcgugaggaauuuaccaagaaaguaagaacaaacgcugccaugggagcgguguucacugaggaaaaucagugggauucugcaaaggccgcugucgaggacgaagauuuuuggaaauugguggaccgcgagagggagcuccacaagcugggcaaaugugguagcugcguuuauaacaugauggggaagcgggagaagaagcuaggagaguucggcaaggccaaaggcucaagagcaaucugguacauguggcuuggggcucgcuaccuggaauuugaggcccucggauuccugaaugaggaucauugguuuuccagggaaaacaguuauagcgguguggagggcgaaggguugcacaagcugggauacauucuccgagacaucucuaaaauacccggcggugcuauguaugccgaugacaccgcagggugggacacacggaucacugaggaugaccuucauaaugaagagaagauuacccagcagauggauccagagcacagacaacuggcgaacgccaucuucaaauuaacguaccagaauaaggucgugaagguacagaggccuacacccaccggaacuguuauggacauuaucucccgcaaagaucagcguggcucaggccaaguggggacauauggacugaacaccuuuacuaauauggaagcucaguugauacggcagauggagggugaaggcguccucagcaaggccgaccuggagaacccacaccuacccgagaagaagauuacccaguggcuugagacaaaagggguggagagacugaagaggauggcaaucucgggagaugacugcguggucaagccuaucgaugaccgcuucgcuaacgcccuccuggcauugaaugauaugggcaaaguucgaaaggacauuccacaauggcagccgucuaaagguuggcaugauuggcaacaggugcccuucuguagucaccauuuucacgaauuaauaaugaaggacgggcggaaacugguagugccuugcagaccacaagacgagcucaucggaagggcccgcauuucccagggcgcgggcuggagccuuagagaaacggcuugucuggggaaggccuacgcacagauguggucacuaauguauuuccaccggagggaucugcgucucgccuccaacgcuaucugcucugccguccccgugcauuggguuccuaccagccgaacuacauggaguauucacgcacaucaccaauggaugaccacugaggacauguugacaguguggaaucgcgucuggaucgaagauaacccauggauggaggacaagacccccgugacgacaugggagaauguaccuuaccugggaaaaagagaagaucaguggugugguucccuuauaggccugaccagccgggcuacuugggcccagaacaucccgaccgcgauucagcaaguuaggucucucaucgggaaugaggaauuuuuagacuacaugccaucaaugaagcgcuucagaaaagaggaggaaagugagggagcuauuugguga

SEQ ID NO: 15096 - RNA, 9873 nt, Artificial Sequence
  derived and/or modified CDS sequence (opt3) from DENV-3__JX669500__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcgccgacgugacaagagaagcguagcccuugcaccccacgugggcaugggucuggauacaaggacccaaacguggauguccgccgagggggcuuggcggcaggucgaaaaaguggagacuugggcauugcgccauccuggauucaccauucucgcccuguuucuggcucacuacaucggcacaucucucacucagaagguugugauauucaucuuacugaugcuugucaccccaucgaugacaaugagaugugugggcguagggaacagggacuuuguugaaggauugucaggugccaccuggguggaugucgugcuggagcauggcgggugcgugacgacuauggcgaagaauaaacccacacuagacauugagcuccagaagaccgaagcaacucaacuggccacacuucggaaacuguguaucgagggaaagauuaccaacaucacgaccgauagccgcugcccuacacagggcgaagcugucuugccagaggaacaggaccagaauuauguuuguaaacacacuuacguggaucgagguugggggaacggaugcggccucuucggcaaggggagucugguaaccugcgccaaguuucaauguuuagagcccauagagggaaaagugguccaguaugaaaaucugaaguacacagugauuaucacuguucacaccggugaccagcaucaggugggcaacgagacacaaggggucaccgcagaaauuacuccucaggcuuccacgacagaggccauccucccagaauauggaacccuuggccuggagugcucuccgagaacugguuuggacuucaaugagaugauccuacugaccaugaaaaacaaggcguggauggugcacaggcagugguuuuucgaucucccccugccuuggacaagcggggccaccacugaaacaccaacguggaaucggaaagagcuucugguaaccuuuaagaacgcacaugcuaaaaagcaagaaguuguggucuugggcucccaggagggagccaugcacacugcucucacaggcgccaccgaaauucagaauucagggggaacaaguauauucgcaggucaccugaagugucguuuaaaaauggacaagcuggagcuaaaaggcaugagcuacgccaugugcacuaacaccuuugugcucaagaaagaggucucugaaacgcagcaugggaccauccugauuaagguggaguacaagggagaagaugcucccuguaaaaucccuuucuccacagaggacggccaagguaaggcgcacaacgggcgccuuauaacugcaaauccaguugugaccaaaaaggaggaacccguaaacauugaggccgaaccgccuuucggcgagucaaauaucgucaucggaauuggcgauaacgcuuugaaaaucaauugguauaagaaggggagcaguauuggaaaaauguuugaagccacagcaagaggugccaggcggauggcuauacugggcgacacugccugggauuucgggucugugggaggcguucucaacucccuggguaagauggugcaucagaucuuugggagcgcauacaccgcgcuuuucucgggcgucucuugggugaugaaaauuggaaucggcguacuguugacguggaucgggcucaauuccaagaacacaucaaugaguuuuagcugcauugcuauaggaaucauuacccuguauuuaggcgccgugguucaggcagacauggguugugucaucaauuggaaagggaaggagcugaagugcggauccggcauuuucgugacuaacgaggugcacacauggaccgaacaguacaaauuucaagccgauucucccaagcgacuagcuacugccaucgcaggugcuugggagaauggcgucugugggauacgcagcaccacaagaauggaaaaccuccuguggaaacagaucgccaaugagcuuaacuauauuuugugggaaaauaacaucaagcugacgguuguggugggagacauuaucggcguacucgagcaggggaaaaggacccugacuccacagccuauggaguuaaaguacucauggaaaacauggggaaaggcgaagauagucaccgccgaaacacaaaacaguuccuucauuaucgauggccccaauacuccagagugccccagcgcuucucgggcauggaacgugugggaaguugaggacuaugguuuugggguguucaccacgaauauuuggcugaaacuucgcgaagucuacacacaguugugugaccauagacucaugucagccgcugugaaggaugagagggccguucacgcagacaugggauacuggaucgagagucagaaaaacggcagcuggaagcuggaaaaagcgucccuaauagaggugaagaccugcacuuggccuaagucucacacccuguggucgaaugguguacucgaaagcgauaugaucauuccaaaaucccuggccggcccgaucucacagcauaaccaccgucccggguaucauacacaaacugcuggaccuuggcaccuuggcaaguuggagcuggacuuuaauuacugcgaggggaccacagucgugauuacggaaaacuguggaacccggggcccaaguuuacgaacuacaaccgugucugguaaacucauccacgaguggugcuguagaagcugcacucugcccccucuuagguauaugggggaagauggauguugguacggcauggagauacgcccaauuuccgaaaaggaggagaauauggucaaaucacugguuagcgccgguucuggcaagguggacaacuucacaauggggguauugugccucgcaauccuguuugaagaggugaugcggggaaaguucggcaaaaagcauaugaucgcuggggucuucuuuaccuucgugcuacugcucuccggacagauuacguggagagauauggcccacacucugaucaugauuggcaguaaugcaagcgacaggauggguauggggguuaccuaucuugccuugauagcuacauuuaaaauccagcccuuccuggcguuaggauuuuuccuccgcaagcugaccucucgagaaaaccuucugcuaggcgugggccucgccauggcaacuacacugcaauugccggaggauauugaacagauggcuaaugggaucgcccugggauuaauggcccucaaacugauuacccaguuugagacauaccagcuuuggacugcucugaucuccuugaccuguucaaacacgauguucacacucaccgucgcauggcggacugccacccugauacuagcgggugugagucugcuuccuguuugccaaagcucguccaugcguaagacagacuggcucccaauggcuguggccgcaaugggcguccccccucugcccuuguuuaucuucucucugaaggauacuuuaaaaagaaggagcuggccacucaaugaggggguaauggccgugggacugguuucaauucuugcuaguucccuguugcgcaacgacgugccuauggcaggcccccucgucgccggugggcugcuaaucgcguguuaugugauuaccggaacgucugcugaucugacaguagaaaaggccgcagacaucaccugggaggaagaggccgaacagacuggcgugagccauaaccuuaugauaacagucgacgaugacggcaccaugcggauuaaagaugacgagacugagaauauccucacaguucuguugaagaccgcuuuacugaucguguccgggguguuuccauacucaauuccggccacgcuccuggucuggcacacuuggcagaaacagacccaaagaagcggagugcuuugggauguuccuagucccccagaaacacagaaggcagagcuggaagaggguguauacaggauaaaacagcagggcaucuucgggaagacccaagugggagucggcgugcagaaggaggguguuuuucauacaauguggcacgugacucgaggggcugucuugaccuauaacggaaaacgccuagaacccaauugggccucugugaagaaagaccugauuuccuacggcggcggguggcggcucagcgcgcaguggcaaaagggagaggaaguacaggucaucgccguggagccugguaaaaacccaaagaauuuccagacgaugcccggcacauuccagacuaccacaggggaaauuggagcaaucgcucuggauuuuaagccuggcaccucggguucaccgauaaucaacagagaggggaaaguugugggacuuuauggcaauggcgucgugacuaagaacgggggauacguuucugguauugcccaaaccaaugcugagccagacggccccacaccugaauuagaggaagagauguucaaaaagaggaaccugacgaucauggaucuccacccagggaguggaaaaacucguaaguauuugcccgcaauugugcgcgaagccaucaagcggagacugaggacccucauacuggccccuacacgagucguggcugcggagauggaggaagcacuuaaaggccugccgauucgguaccagaccacugccacaaaguccgagcauaccggucgcgaaaucguagacuugaugugccacgcuacguuuacuaugagacuacugagccccgugaggguuccaaauuauaaccucaucauuauggaugaggcccauuucacagacccugcaucuaucgccgcucggggguacauaagcacccgagucggaaugggcgaagcggccgcaauuuuuaugaccgcuacucccccaggcacagccgaugcauucccucaguccaaugcccccauccaggacgaggagagagacauuccagaacgcucauggaacagugggaaugaguggaucaccgauuuugcuggaaaaacagugugguucgugccgagcauaaaggccgguaacgacauugcgaacuguuuaaggaaaaauggcaagaaggucauccaacugucucguaaaacuuuugauacggaauaccagaagaccaaacuuaacgacugggauuucguagugacaacugacaucuccgagaugggggcaaauuuuaaggccgaucggguuauugacccuagaaggugccugaaacccgugauccucaccgauggaccagagcgcgucauuuuggcuggccccaugccugugacagccgcuucagcagcccagcgaagaggucggguugggaggaacccacagaaggaaaaugaccaauauauauucaccggccagccccugaacaaugaugaggaccacgcucauuggacugaagccaagaugcuccuggacaacaucaauacgccugagggaauuaucccggcacuuuucgaaccagagcgcgagaaaagugcggccaucgauggcgaauaccgucuaaagggggagagcagaaaaaccuuuguggaacugaugcggaggggagacuugcccgucugguuagcucacaagguggccuccgaggguauuaaauauacagaucgcaaguggugcuucgacggccagcgaaacaaucagauacuggaagagaacauggauguagagaucuggacuaaagaaggggagaagaagaaacucagaccucgguggcuggacgcaaggaccuacucugauccccuugcucugaaggaauuuaaagacuucgccgcaggacgcaagucgauugcccucgauuuggugacagagaucggcagaguuccaagccaccuggcucauaggacccggaaugcgcuagacaaccuggucaugcuccacacuucagaacauggugggcgugccuaucgccacgcaguggaggagcuuccugaaacaauggagacgcuguuauugcugggccucaugauucugcuuaccggaggcgcuaugcuguuucucaucuccgggaaaggaauagguaagacuaguaucggcuugauuugugugaucgccucuagcgggaugcuguggauggccgaaauucccuuacaauggaucgcauccgcuauaguccuagaguucuuuaugaugguucugcucauuccagagccugaaaagcagcgaacaccgcaggauaaucaacuugccuacgugguaaucggaauucugaccuuggcggcuaucauagccgcaaacgagaugggccugcucgaaaccacaaaaagagaccuggguaugucaaaggagcccgggguggucucuccaacuagcuaucuugauguggaccuccacccugccagugcuuggacgcuguacgcaguugccaccacagugaucacucccauguugaggcauaccauugaaaauuccacagcgaacgucagccuggcugccaucgcaaaccaggccguaguguuaaugggccuagacaaaggauggccaauuucuaagauggaucugggcguuccucuccuugcucuggggugcuacucacaggugaaucccuugacccugacugccgcaguccuccugcuuaucacgcacuaugcuauaauuggaccgggcuuacaggccaaagcgacacgggaggcccaaaagcgcaccgcagcugguaucaugaagaacccaacuguggacgggaucaugaccauugaucuggacccugucaucuacgauuccaaauucgagaagcagcucggacaggugauguugcugguucuaugugccgugcagcugcuccuuaugagaacaaguugggcacugugcgaagcuuugacucuggccaccggccccauaacaacgcucugggaggguagcccaggcaaauuuuggaauaccacuauugccguaucgauggcgaacaucuucagggggucuuaucuggcuggagcaggcuuagccuuuuccauuaugaagagcguggggacaggaaaacggggcaccgguucacaaggggaaacucuuggagagaaguggaagaaaaagcugaaucagcucagucgaaaagaauucgaccuauacaagaaaucuggcaucacagaggucgauagaaccgaggcuaaggaaggucugaaacgcggcgagauaacgcaucacgccguuuccagggggagcgcaaaguugcagugguuuguggaacggaacauggucauccccgagggacgugugauugaccugggcugugggagaggaggcuggucauauuacugcgccggucucaagaaaguaaccgaagugaggggguauacaaagggaggcccuggccaugaggagccgguucccaugaguacuuacggguggaauaucgugaaacuuaugagcggaaaggaugucuucuaccugccaccugaaaaaugugacaccuugcugugcgauauuggugaguccucucccagcccuacaguggaagagucccgcacuauccggguccucaagaugguggagccaugguuaaagaacaaucaguucuguauuaaaguucugaaccccuauaugccuaccguaaucgaacaccuugagcgacugcaaagaaagcacggcgggaugcuagugaggaauccacucucacgcaacucuacacaugaaauguacuggauaaguaauggaaccggcaacauugucgcuucggugaauaugguuagccggcuguugcugaacagauuuacuaugacgcaccguaggcccacaaucgagaaagacguggaucucggugcggggacccggcaugucaacgccgaaccggagacuccuaauauggacgugaucggagagcgcauuaagcgaauaaaagaagagcacaacuccaccuggcacuaugacgaugaaaauccauacaagacaugggcauaucauggcucuuacgagguaaaggcuacgggcucagccagcuccaugaucaacggggugguuaaacuucugaccaagcccugggacgucgugccuauggugacucagauggcaaugacagauaccacuccauucggacagcaaagagucuuuaaagaaaagguugacacaaggaccccccggccgaugccugguacacgcagagugaugggcauuacugccgagugguuauggaggacccuggggcgaaauaaaaagccccgguugugcacgcgugaggaauucaccaagaaaguaagaacaaacgcugccaugggagcgguguuuacugaggaaaaucagugggauagugcaaaggccgcugucgaggacgaagauuucuggaaacucguggaccgcgagagggagcugcacaagcuaggcaaaugugguucuugcguuuauaacaugauggggaagcgggaaaaaaagcuuggagaguuuggcaaggccaaaggcagcagagcaaucugguacauguggcugggggcucgcuaccucgaauucgaggcccugggauuuuugaaugaggaucauugguucucaagggaaaacuccuauagugguguggagggcgaagggcugcacaagcucggauacauucuucgagacaucagcaaaauaccaggcggugcuauguaugccgaugacaccgcagggugggacacacggaucacugaggaugaccugcauaaugaagagaagauuacccagcagauggauccugagcacagacaauuagcgaacgccaucuuuaaacugacguaccagaauaaggucgugaagguacagaggcccacaccaaccggaacuguuauggacauuaucucucgcaaagaucagcguggcuccggccaaguggggacauauggauugaacaccuucacuaauauggaagcucagcucauacggcagauggagggugaaggcguccugucaaaggccgaccuagagaacccccaccuuccugaaaaaaagauuacccaguggcuggagacaaaagggguggagagacucaagaggauggcaaucagcggagaugacugcguggucaagccaaucgaugaccgcuuugcuaacgcccuguuggcauuaaaugauaugggcaaaguucgaaaggacauuccgcaauggcagcccucgaaagguuggcaugauuggcagcaggugccuuucuguucucaccauuuccacgaacugauaaugaaggacgggcggaaacucguagugccaugcagaccccaagacgagcuuaucggaagggcccgcauuagucagggcgcgggcuggucccugagagaaacggcuugucuagggaaggccuacgcacagauguggagccugauguauuuucaccggagggaucuccguuuggccucaaacgcuaucugcuccgccgucccugugcauuggguuccaaccucucgaacuacauggagcauucacgcacaucaccaauggaugaccacugaggacaugcugacaguguggaaucgcgucuggaucgaagauaaccccuggauggaggacaagaccccugugacgacaugggagaauguaccguaccuuggaaaaagagaagaucaguggugugguagucugauaggccucaccucccgggcuacuugggcccagaacaucccaaccgcgauucagcaaguuaggagcuuaaucgggaaugaggaauuccuggacuacaugcccucuaugaagcgcuuuagaaaagaggaggaaucagagggagcuauuugguga

SEQ ID NO: 15097 - RNA, 9873 nt, Artificial Sequence
  derived and/or modified CDS sequence (opt3) from DENV-3__JX669497__SS-prME
accagccugugccucaugaugauccuucccgcagcucuggcauuccacuugacuuccagagacggagaaccuaggaugauuguggggaagaacgaacggggaaaaucuuuacuguuuaagacugccucagguauaaauauguguacgcucaucgcgauggaucucggcgaaaugugcgacgauaccgucaccuacaaauguccacauauuacugaaguugaaccggaagacaucgauugcugguguaaccugaccaguacaugggugaccuaugggacuugcaaucaggcuggagaacgccgacgugacaagagaagcgucgcccuugcaccccacgugggcaugggucuggauacaaggacccagacguggauguccgccgaaggggcuuggcggcaggucgaaaaaguggagacuugggcauugcgccauccuggauucaccauucucgcccuguuucuggcucacuacaucggcacaucucucacucagaagguugugauauucaucuuacugaugcuugucaccccaucgaugacaaugagaugugugggcguagggaacagggacuuuguugaaggauugucaggugccaccuggguggaugucgugcuggagcauggcgggugcgugacgacuauggcgaagaauaaacccacauuggacauugagcuccagaagaccgaagcaacucagcuggccacacuucggaaacuguguaucgagggaaagauuaccaacaucacgaccgauagccgcugcccuacacagggcgaagcugucuugccagaggaacaggaccagaauuauguuuguaaacacacuuacguggaucgagguugggggaacggaugcggccucuucggcaaggggagucugguaaccugcgccaaguuucaauguuuagagcccauagagggaaaagugguccaguaugaaaaucugaaguacacagugauuaucacuguucacaccggugaccagcaucaggugggcaacgagacacaaggggucaccgcagaaauuacuccucaggcuuccacgacagaggccauccucccagaauauggaacccuuggccuggagugcucuccgagaacugguuuggacuucaaugagaugauccuacugaccaugaaaaacaaggcguggauggugcacaggcagugguuuuucgaucucccccugccuuggacaagcggggccaccacugaaacaccaacguggaaucggaaagagcuucugguaaccuuuaagaacgcacaugcuaaaaagcaagaaguuguggucuugggcucccaggagggagccaugcacacugcucucacaggcgccaccgaaauucaaaauucagggggaacaaguauauucgcaggucaccugaagugucguuuaaaaauggacaagcuggagcuaaaaggcaugagcuacgccaugugcacuaacaccuuugugcucaagaaagaggucucugaaacgcagcaugggaccauccugauuaagguggaguacaagggagaagaugcucccuguaaaaucccuuucuccacagaggacggccaagguaaggcgcacaacgggcgccuuauaacugcaaauccaguugugaccaaaaaggaggaacccguaaacauugaggccgaaccgccuuucggcgagucaaauaucgucaucggaauuggcgauaacgcuagcaaaaucaauugguauaagaaggggaguucuauuggaaaaauguuugaagccacagcaagaggugccaggcggauggcuauauugggcgacacugccugggauuucggguccgugggaggcguucugaacagccucgguaagauggugcaucagaucuuugggucggcauacaccgcgcuguucucuggcgucuccugggugaugaaaauuggaaucggcguacuucugacguggaucgggcuaaauucaaagaacacaaguaugagcuuuuccugcauugcuauaggaaucauuacccucuaucugggcgccgugguucaggcagacauggguugugucaucaauuggaaagggaaggaguuaaagugcggaucuggcauuuucgugacuaacgaggugcacacauggaccgaacaguacaaauuucaagccgauagccccaagcgacuggcuacugccaucgccggugcuugggagaauggcgucugugggauacgcucaaccacaagaauggaaaaccuacucuggaaacagaucgccaaugagcugaacuauauucuuugggaaaauaacaucaaguugacgguuguggugggagacauuaucggcguacuggagcaggggaaaaggacccucacuccacagccuauggagcugaaguacaguuggaaaacauggggaaaggcgaagauagucaccgccgaaacacaaaacuccagcuucauuaucgauggccccaauacuccagagugccccucugcuucacgggcauggaacgugugggaaguugaggacuaugguuuugggguguucaccacgaauauuugguuaaaacugcgcgaagucuacacacagcuuugugaccauagauugaugagugccgcugugaaggaugagagggccguucacgcagacaugggauacuggaucgagagccagaaaaacggcuccuggaagcucgaaaaagcgucucugauagaggugaagaccugcacuuggccuaagucgcacacccuauggagcaaugguguacuggaauccgauaugaucauuccaaaaucacucgccggcccgaucagucagcauaaccaccgucccggguaucauacacaaacugcuggaccuuggcaccugggcaaacuugaguuggacuuuaauuacugcgaggggaccacagucgugauuacggaaaacuguggaacccggggcccaucucugcgaacuacaaccgugagcgguaaauuaauccacgaguggugcuguagauccugcacucuacccccucugagguauaugggggaagauggauguugguacggcauggagauacgcccaauuucagaaaaggaggagaauauggucaaaagccuuguuucugccgguuccggcaagguggacaacuucacaauggggguacugugcuuggcaauccucuuugaagaggugaugcggggaaaguucggcaaaaagcauaugaucgcuggggucuucuuuaccuucgugcugcuacugaguggacagauuacguggagagauauggcccacacucucaucaugauuggcagcaaugcaucugacaggauggguauggggguuaccuaucuggcccuuauagcuacauuuaaaauccagcccuucuuggcgcugggauuuuucuuacgcaagcucaccucccgagaaaaccugcuucugggcgugggccuagccauggcaacuacacuccaacugccggaggauauugaacagauggcuaaugggaucgccuugggacugauggccuuaaaacucauuacccaguuugagacauaccagcuguggacugcucuuaucucacugaccuguaguaacacgauguucacauugaccgucgcauggcggacugccacccucauacuggcgggugugagccuacugccuguuugccaaucguccucuaugcguaagacagacuggcuuccaauggcuguggccgcaaugggcguacccccucucccccuguuuaucuucagcuugaaggauacucugaaaagaaggucauggccauuaaaugaggggguaauggccgugggacucguuaguauucuggcuuccucucuucugcgcaacgacgugccuauggcaggccccuuggucgccggugggcuccugaucgcguguuaugugauuaccggaacgagcgcugaucuaacaguagaaaaggccgcagacaucaccugggaggaagaggccgaacagacuggcgugucccauaaccugaugauaacagucgacgaugacggcaccaugcggauuaaagaugacgagacugagaauauccuuacaguucuccugaagaccgcuuuguuaaucgugucagggguguuuccauacagcauuccggccacgcugcucgucuggcacacuuggcagaaacagacccaaagaaguggagugcugugggauguuccuucucccccagaaacacagaaggcagagcuugaagaggguguauacaggauaaaacagcagggcaucuucgggaagacccaagugggagucggcgugcagaaggaggguguuuuucauacaauguggcacgugacucgaggggcuguccugaccuauaacggaaaacgcuuggaacccaauugggccuccgugaagaaagaccuaauuagcuacggcggcggguggcggcugucggcgcaguggcaaaagggagaggaaguacaggucaucgccguggagccugguaaaaacccaaagaauuuccagacgaugcccggcacauuccagacuaccacaggggaaauuggagcaaucgcucucgauuuuaagccuggcaccucagguucuccgauaaucaacagagaggggaaaguugugggacuguauggcaauggcgucgugacuaagaacgggggauacguuagugguauugcccaaaccaaugcugagccagacggccccacaccugaacuugaggaagagauguucaaaaagaggaacuuaacgaucauggaucugcacccaggguccggaaaaacucguaaguaucuccccgcaauugugcgcgaagccaucaagcggagauugaggacccugauacucgccccuacacgagucguggcugcggagauggaggaagcacugaaaggccuuccgauucgguaccagaccacugccacaaagagcgagcauaccggucgcgaaaucguagaccugaugugccacgcuacguuuacuaugagauugcuaucucccgugaggguuccaaauuauaaccugaucauuauggaugaggcccauuucacagacccugcaagcaucgccgcucggggguacauauccacccgagucggaaugggcgaagcggccgcaauuuuuaugaccgcuacucccccaggcacagccgaugcauucccucagucaaaugcccccauccaggacgaggagagagacauuccagaacgcaguuggaacagcgggaaugaguggaucaccgauuuugcuggaaaaacagugugguucgugccgucuauaaaggccgguaacgacauugcgaacugucucaggaaaaauggcaagaaggucauccaauuaucccguaaaacuuuugauacggaauaccagaagaccaaacugaacgacugggauuucguagugacaacugacaucucagagaugggggcaaauuuuaaggccgaucggguuauugacccuagaaggugccuuaaacccgugauccugaccgauggaccagagcgcgucauucucgcuggccccaugccugugacagccgcuagugcagcccagcgaagaggucggguugggaggaacccacagaaggaaaaugaccaauauauauucaccggccagcccuugaacaaugaugaggaccacgcucauuggacugaagccaagaugcugcucgacaacaucaauacgccugagggaauuaucccggcacuguucgaaccagagcgcgagaaaagcgcggccaucgauggcgaauaccgucuuaagggggaguccagaaaaaccuuuguggaacuaaugcggaggggagaccugcccgucugguuggcucacaagguggccucugaggguauuaaauauacagaucgcaaguggugcuucgacggccagcgaaacaaucagauauuagaagagaacauggauguagagaucuggacuaaagaaggggagaagaagaaacugagaccucgguggcucgacgcaaggaccuacucggauccccuggcucuuaaggaauuuaaagacuucgccgcaggacgcaagagcauugcccuggaucucgugacagagaucggcagaguuccaucacacuuggcucauaggacccggaaugcgcuggacaaccuagucaugcugcacacuuccgaacauggugggcgugccuaucgccacgcaguggaggagcucccugaaacaauggagacgcuucuguuauugggccugaugauucuccugaccggaggcgcuaugcuuuuucugaucagugggaaaggaauagguaagacuucuaucggccucauuugugugaucgccagcuccgggauguuguggauggccgaaauuccccugcaauggaucgcaucagcuauagucuuagaguucuuuaugaugguucuacugauuccagagccugaaaagcagcgaacaccgcaggauaaucaacucgccuacgugguaaucggcauucuuacccuggcggcuaucauagccgcaaacgagaugggcuugcuggaaaccacaaaaagagaccucgguaugucuaaggagcccgggguggucagcccaacaaguuaucuggauguggaccuucacccugccuccgcuuggacgcucuacgcaguugccaccacagugaucacucccaugcugaggcauaccauugaaaauagcacagcgaacgucucuuuggcugccaucgcaaaccaggccguagugcugaugggcuuagacaaaggauggccaauuucaaagauggaucuaggcguuccucugcucgcucuugggugcuacucccaggugaauccccugaccuugacugccgcaguccugcuccugaucacgcacuaugcuauaauuggaccgggccuucaggccaaagcgacacgggaggcccaaaagcgcaccgcagcugguaucaugaagaacccaacuguggacgggaucaugaccauugauuuagacccugucaucuacgauaguaaauucgagaagcagcugggacaggugaugcucuugguucugugugccgugcagcuacugcucaugagaacaagcugggcacuuugcgaagcucugacuuuggccaccggccccauaacaacgcugugggaggguucgccaggcaaauuuuggaauaccacuauugccguaucuauggcgaacaucuucaggggguccuaucucgcuggagcaggccuggccuuuagcauuaugaagucaguggggacaggaaaacggggcaccgguagucaaggggaaacuuuaggagagaaguggaagaagaaacuuaaucagcugucucgaaaagaguucgaccucuacaagaaauccggcaucacagaggucgauagaaccgaggcuaaagaaggucuaaaacgcggcgagauaacgcaucacgccguuagcagggggucagcaaagcugcagugguuuguggaacggaacauggucauccccgagggacgugugauugacuugggcugugggagaggaggcuggaguuauuacugcgccggucugaagaaaguaaccgaagugaggggguauacaaagggaggcccuggccaugaggagccgguucccaugagcacuuacggguggaauaucgugaaacucauguccggaaaggaugucuucuaccuuccaccugaaaaaugugacacccuguugugcgauauuggugagucuagccccuccccuacaguggaagagucacgcacuauccggguccugaagaugguggagccauggcucaagaacaaucaguucuguauuaaaguuuuaaaccccuauaugccuaccguaaucgaacaccuggagcgacuucaaagaaagcacggcgggaugcuggugaggaauccacuaucucgcaacaguacacaugaaauguacuggauaucgaauggaaccggcaacauugucgcuagcgugaauaugguuucccggcuccuguugaacagauuuacuaugacgcaccguaggcccacaaucgagaaagacguggaucugggugcggggacccggcaugucaacgccgaaccggagacuccuaauauggacgugaucggagagcgcauuaagcgaauaaaagaagaacacaacucuaccuggcacuaugacgaugaaaauccauacaagacaugggcauaucauggcucauacgagguaaaggcuacgggcagcgccuccaguaugaucaacggggugguuaaacuccuuaccaagcccugggacgucgugccuauggugacucagauggcaaugacagauaccacuccauucggacagcaaagagucuuuaaagaaaagguugacacaaggacaccccggucuaugccggguacacgcagagugaugggcauuacugccgaguggcuguggaggaccuuagggcgaaauaaaaagccucggcugugcacgcgugaggaguucaccaagaaaguaagaacaaacgcugccaugggagcgguguuuacugaggaaaaucagugggauagcgcaaaggccgcugucgaggacgaagauuucuggaaauugguggaccgcgagagggagcuccacaagcugggcaaaugugguucaugcguuuauaacaugauggggaagcgggagaagaagcuaggagaguuuggcaaggccaaaggcuccagagcaaucugguacauguggcuuggggcucgcuaccuggaguucgaggcccucggauuucugaaugaggaucauugguucaguagggaaaacagcuauucugguguggagggcgaaggguugcacaagcugggauacauucuccgagacaucuccaaaauacccggcggugcuauguaugccgaugacaccgcagggugggacacacggaucacugaggaugaccuucauaaugaagagaagauuacccagcagauggauccagagcacagacaacuggcgaacgccaucuuuaaauuaacguaccagaauaaggucgugaagguacagaggccuacacccaccggaacuguuauggacauuaucucacgcaaagaucagcguggcagcggccaaguggggacauauggacugaacaccuucacuaauauggaagcucaguugauacggcagauggagggugaaggcguccucucgaaggccgaccuggagaacccacaccuacccgagaagaagauuacccaguggcuugagacaaaagggguggagagacugaagaggauggcaaucucuggagaugacugcguggucaagccuaucgaugaccgcuuugcuaacgcccuccuggcauugaaugauaugggcaaaguucgaaaggacauuccacaauggcagccgaguaaagguuggcaugauuggcaacaggugcccuucuguucccaccauuuccacgaauuaauaaugaaggacgggcggaaacugguagugccuugcagaccacaagacgagcucaucggaagggcccgcauuagccagggcgcgggcuggucacuuagagaaacggcuugucuggggaaggccuacgcacagauguggucccuaauguauuuucaccggagggaucugcgucucgccucuaacgcuaucugcagcgccguccccgugcauuggguuccuaccagucgaacuacaugguccauucacgcacaucaccaauggaugaccacugaggacauguugacaguguggaaucgcgucuggaucgaagauaacccauggauggaggacaagacccccgugacgacaugggagaauguaccuuaccugggaaaaagagaagaucaguggugugguagccuuauaggccugaccucucgggcuacuugggcccagaacaucccgaccgcgauucagcaaguuaggucacucaucgggaaugaggaguucuuagacuacaugccaaguaugaagcgcuuuagaaaagaggaggaauccgagggagcuauuugguga

SEQ ID NO: 15098 - RNA, 9873 nt, Artificial Sequence
  derived and/or modified CDS sequence (opt3) from DENV-3__JX669501__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcgccgacgugacaagagaagcguagcccuugcaccccacgugggcaugggucuggauacaaggacccaaacguggauguccgccgagggggcuuggcggcaggucgaaaaaguggagacuugggcauugcgccauccuggauucaccauucucgcccuguuucuggcucacuacaucggcacaucucucacucagaagguugugauauucaucuuacugaugcuugucaccccaucgaugacaaugagaugugugggcguagggaacagggacuuuguugaaggauugucaggugccaccuggguggaugucgugcuggagcauggcgggugcgugacgacuauggcgaagaauaaacccacacuagacauugagcuccagaagaccgaagcaacucaacuggccacacuucggaaacuguguaucgagggaaagauuaccaacaucacgaccgauagccgcugcccuacacagggcgaagcugucuugccagaggaacaggaccagaauuauguuuguaaacacacuuacguggaucgagguugggggaacggaugcggccucuucggcaaggggagucugguaaccugcgccaaguuucaauguuuagagcccauagagggaaaagugguccaguaugaaaaucugaaguacacagugauuaucacuguucacaccggugaccagcaucaggugggcaacgagacacaaggggucaccgcagaaauuacuccucaggcuuccacgacagaggccauccucccagaauauggaacccuuggccuggagugcucuccgagaacugguuuggacuucaaugagaugauccuacugaccaugaaaaacaaggcguggauggugcacaggcagugguuuuucgaucucccccugccuuggacaagcggggccaccacugaaacaccaacguggaaucggaaagagcuucugguaaccuuuaagaacgcacaugcuaaaaagcaagaaguuguggucuugggcucccaggagggagccaugcacacugcucucacaggcgccaccgaaauucagaauucagggggaacaaguauauucgcaggucaccugaagugucguuuaaaaauggacaagcuggagcuaaaaggcaugagcuacgccaugugcacuaacaccuuugugcucaagaaagaggucucugaaacgcagcaugggaccauccugauuaagguggaguaccgcggagaagaugcucccuguaagaucccuuucuccacagaggacggccaagguaaagcgcacaacgggagacuuauaacugcaaauccaguugugaccaagaaagaggaacccguaaacauugaggccgaaccgccuuucggcgagucaaauaucgucaucggaauuggcgauaacgcuuugaagaucaauugguauaaaaaggggagcaguauuggaaagauguuugaagccacagcaaggggugcccggcgaauggcuauacugggcgacacugccugggauuucgggucugugggaggcguucucaacucccuggguaaaauggugcaucagaucuuugggagcgcauacaccgcgcuuuucucgggcgucucuugggugaugaagauuggaaucggcguacuguugacguggaucgggcucaauuccaaaaacacaucaaugaguuuuagcugcauugcuauaggaaucauuacccuguauuuaggcgccgugguucaggcagacauggguugugucgugaauuggaaggggaaagagcugaagugcggauccggcaucuucgugacuaacgagguccacacauggaccgaacaguacaaguuucaagccgauucucccaaacgccuagcuacugccauugcaggugcuugggagaauggcguuugugggaucagaagcaccacaaggauggaaaaccuccuguggaagcagauagccaaugagcuuaacuauaucuugugggaaaauaacauuaaacugacgguggugguaggagacaucauuggcguccucgagcaggggaagcggacccugacuccacagccuauggaguuaaaauacucauggaagacauggggaaaagcgaagaucgugaccgccgaaacacaaaacaguuccuucauaauugauggccccaauacuccagagugccccagcgcuucucgcgcauggaacguuugggaaguggaggacuaugguuuuggggucuucaccacgaauaucuggcugaagcuuagagaaguguacacacaguugugugaccauaggcucaugucagccgcuguuaaagaugagcgugccgugcacgcagacaugggauacuggauugagagucagaagaacggcagcuggaaacuggaaaaggcgucccuaaucgagguaaaaaccugcacuuggccuaagucucacacccuguggucgaaugguguccucgaaagcgauaugauaaucccaaagucccuggccggcccgauuucacagcauaaccaccggcccggguaucauacacaaacugcuggaccuuggcaccuuggcaaauuggagcuggacuuuaauuacugcgaggggaccacaguggugaucacggaaaacuguggaacccgaggcccaaguuuaagaacuacaaccgucucugguaagcucauucacgaguggugcuguaggagcugcacucugcccccucuucgcuauaugggggaagauggauguugguacggcauggagauccggccaauauccgaaaaagaggagaauaugguuaagucacuggugagcgccgguucuggcaaaguagacaacuucacaauggggguguugugccucgcaauucuguuugaagaggucaugagaggaaaguucggcaagaaacauaugaucgcugggguguucuuuaccuucguucuacugcucuccggacagaucacguggagggauauggcccacacucugaccaugauuggcaguaaugcaagcgaccgcauggguaugggggugacauaucuugccuugaucgcuaccuuuaagauucagcccuuccuggcguuaggauuuuuccuccgaaaacugacuucucgggaaaaccuucugcuaggcgucggccucgccauggcaacaacccugcaauugccggaggauauagaacagauggcuaaugggaucgcccugggauuaauggcccucaagcugauuacacaguuugagacuuaccagcuuuggaccgcucugaucuccuugacguguucaaacacaauguucacccucacuguggcauggcguaccgccacacugauucuagcggguguuagucugcuuccugugugccaaagcucguccaugagaaaaacugacuggcucccaauggcugucgccgcaaugggcguacccccucugcccuuguuuaucuucucucugaaggauaccuuaaagaggcgcagcuggccacucaaugagggggugauggccguuggacuggugucaauacuugcuaguucccuguugcggaacgacgucccuauggcaggcccccucguggccggugggcugcuaaucgcguguuauguaauuacgggaacaucugcugaucugaccguggaaaaagccgcagacaucacuugggaggaagaggccgaacagacaggcgucagccauaaccuuaugauuaccguugacgaugacggcacuaugagaaucaaggaugacgagacagagaauauacucaccgugcuguugaaaacggcuuuacugauuguguccggggucuuuccauacucaaucccggccacucuccugguguggcacaccuggcagaagcagacacaaaggagcggaguucuuugggauguaccuagucccccagaaacccagaaagcagagcuggaagaggguguguaccgaaucaagcagcagggcauuuucgggaaaacacaagucggagugggcguucagaaggaggguguguuucauacuauguggcacgucacccgcggggcuguguugacguauaacggaaagcggcuagaacccaauugggccucuguaaaaaaggaccugauauccuacggcggcggguggagacucagcgcgcaguggcaaaaaggagaggaaguccaggugaucgccguugagccugguaagaacccaaaaaauuuccagacaaugcccggcacuuuccagaccacaaccggggaaauuggagcaaucgcucuggauuuuaagccuggcacuucggguucaccgauuaucaacagggaggggaagguggucggacuuuauggcaauggcgugguuaccaaaaacgggggauacgugucugguauagcccaaacaaaugcugagccagacggccccacgccugaauuagaggaagagauguucaagaaacguaaccugacuaucauggaucuccacccagggaguggaaagacccgcaaauauuugcccgcaauuguccgggaagccaucaagagaaggcugcgaacacucauucuggccccuacccgggugguagcugcggagauggaggaagcacuuaagggccugccgauccgcuaccagacuacagccaccaaauccgagcauacggguagagaaauaguggacuugaugugccacgcuacuuuuacaaugaggcuacugagccccguucgggucccaaauuauaaccucauuaucauggaugaggcccauuucaccgacccugcaucuaucgccgcucgaggguacauuagcaccagagugggaaugggcgaagcggccgcaaucuuuaugacugcuacacccccaggcaccgccgaugcauucccucaguccaaugcccccauacaggacgaggagcgcgacauuccagaaaggucauggaacagugggaaugaguggaucacagauuuugcuggaaagacugugugguucgucccgagcauuaaagccgguaacgacaucgcgaacuguuuacguaagaauggcaaaaagguaauacaacugucucggaagacguuugauaccgaauaccagaaaacaaagcuuaacgacugggauuucgugguuacuaccgacauuuccgagaugggggcaaauuuuaaagccgauagagugaucgacccuaggcgcugccugaagcccgucauccucacagauggaccagagcgagugauuuuggcuggccccaugccuguuaccgccgcuucagcagcccagagacgggguaggguggggcgcaacccacagaaagaaaaugaccaauauaucuucacuggccagccccugaacaaugaugaggaccacgcucauuggacggaagccaagaugcuccuggacaacauuaauaccccugagggaauaaucccggcacuuuucgaaccagagcgugagaagagugcggccauugauggcgaauacagacuaaaaggggagagccggaagacauuugucgaacugaugaggcgcggagacuugcccgugugguuagcucacaaaguagccuccgaggguaucaaguauacugaucgaaaauggugcuucgacggccagagaaacaaucagauccuggaagagaacauggauguggagauuuggaccaaggaaggggagaaaaagaagcuccggccuagguggcuggacgcacgcacauacucugauccccuugcucugaaagaauuuaaggacuucgccgcaggaagaaaaucgauagcccucgauuugguuaccgagaucggcagggucccaagccaccuggcucaucggacucguaaugcgcuagacaaccuggugaugcuccacacaucagaacauggugggcgcgccuaucgacacgcaauggaggagcuuccugaaacgauggagacccuguuauugcugggccucaugauucugcuuacuggaggcgcuaugcuguuucucaucuccgggaagggaauugguaaaacaaguaucggcuugauaugugugaucgccucuagcgggaugcuguggauggccgaaauucccuuacaauggaucgcauccgcuauuguccuagaguucuuuaugaugguucugcucaucccagagccugaaaagcagagaaccccgcaggauaaucaacuugccuacgugguaauaggaauucugaccuuggcggcuaucauugccgcaaacgagaugggccugcucgaaacaacuaagagggaccuggguaugucaaaagagcccgggguggucucuccaacgagcuaucuugauguggaccuccacccugccagugcuuggacccuguacgcaguugccacaacugugaucacccccauguugcggcauacaauagaaaauuccaccgcgaacgucagccuggcugccaucgcaaaccaggccguaguguuaaugggccuagacaagggauggccaauuucuaaaauggaucugggcguuccucuccuugcucuggggugcuacucacaggugaaucccuugacucugacggccgcaguccuccugcuuaucacacacuaugcuauuaucggaccgggcuuacaggccaaggcgacccgcgaggcccaaaaaagaacugcagcugguauaaugaagaacccaaccguggacgggauuaugacaaucgaucuggacccugucauguacgauuccaaguucgagaaacagcucggacaggugauguugcugguucuaugugccgugcagcugcuccuuaugaggacuaguugggcacugugcgaagcuuugacccuggccacaggccccaucacgacccucugggaggguagcccaggcaaguuuuggaauacuacaauugccguaucgauggcgaacaucuuccgggggucuuaucuggcuggagcaggcuuagccuuuuccauaaugaaaagcguggggaccggaaagcgaggcacugguucacaaggggaaacacuuggagagaaauggaagaagaaacugaaucagcucaguagaaaggaauucgaccuauacaaaaagucuggcauuaccgaggucgaucgcacggaggcuaaagaaggucugaagaggggcgagaucacccaucacgccguuucccgggggagcgcaaaauugcagugguuuguggaacguaacauggucauucccgagggaagagugaucgaccugggcugugggaggggaggcuggucauauuacugcgccggucucaagaagguaacagaagugcgcggguauacuaaaggaggcccuggccaugaggagccgguucccaugaguaccuacggguggaauauagugaagcuuaugagcggaaaagaugucuucuaccugccaccugaaaagugugacacauugcugugcgauaucggugaguccucucccagcccuacuguggaagagucccggaccauucgaguccucaaaaugguggagccaugguuaaagaacaaucaguucuguaucaagguucugaaccccuauaugccuacaguaauugaacaccuugagagacugcaaaggaaacacggcgggaugcuagugcgcaauccacucucacggaacucuacccaugaaauguacuggaucaguaauggaacuggcaacauugucgcuucggugaauaugguuagcagacuguugcugaaccguuuuacgaugacacacaggcggcccaccaucgagaaggacguggaucucggugcggggacucgccaugucaacgccgaaccggagaccccuaauauggacgugauaggagagcgaauuaaaagaaucaaggaagagcacaacuccacauggcacuaugacgaugaaaauccauacaaaacgugggcauaucauggcucuuacgagguaaaggcuaccggcucagccagcuccaugaucaacggggugguuaagcuucugacuaaacccugggacgucgugccuauggugacacagauggcaaugaccgauacuacaccauucggacagcaaagggucuuuaaggaaaaaguugacacccggacaccccgcaguaugccggguacuagaagggugaugggcauuaccgccgagugguuauggcgaacgcuggggcggaauaagaaaccucguuugugcaccagagaggaauucacaaagaagguacgcacuaacgcugccaugggagcgguguuuaccgaggaaaaucagugggauucugcaaaagccgcugucgaggacgaagauuucuggaagcucguggacagggagcgggagcugcacaaacuaggcaagugugguagcugcguuuauaacaugauggggaaaagagaaaagaaacuuggagaguuuggcaaggccaagggcucacgcgcaauaugguacauguggcugggggcuagguaccucgaauucgaggcccugggauuuuugaaugaggaucauugguucucccgagaaaacaguuauagcgguguggagggcgaagggcugcacaaacucggauacauccuucgggacauuucuaagauccccggcggugcuauguaugccgaugacacagcagggugggacacuagaauuaccgaggaugaccugcauaaugaagagaaaaucacgcagcagauggauccagagcacaggcaauuagcgaacgccauauuuaagcugacauaccagaauaaagucgugaagguacagcgcccuacccccacuggaacaguuauggacaucauuucccguaaggaucagcggggcucaggccaaguggggaccuauggauugaacacuuucaccaauauggaagcucagcucaucagacagauggagggugaaggcguccugagcaaagccgaccuagagaacccacaccuucccgaaaagaaaauuacacaguggcuggagacgaaggggguggagaggcucaaacgcauggcaaucucgggagaugacugcguggucaagccuauagaugaccgauuugcuaacgcccuguuggcauuaaaugauaugggcaagguucggaaagacauuccacaauggcagccgucuaaggguuggcaugauuggcagcaggugcccuucuguagucaccauuuccacgaacugaucaugaaagacgggagaaagcucguagugccuugcaggccacaagacgagcuuaucggacgcgccagaauuucccagggcgcgggcuggagccugcgggaaaccgcuugucuagggaaagccuacgcacagauguggucacugauguauuuucacaggcgugaucuccgauuggccuccaacgcuauaugcucugccguccccgugcauuggguuccuacuagccgcacaaccuggaguauccacgcacaucaccaauggaugacuacagaggacaugcugaccguguggaauagagucuggauugaagauaacccauggauggaggacaagacgcccgugacaaccugggagaauguaccuuaccuuggaaagcgggaagaucaguggugugguucccugaucggccucacuagcagggcuaccugggcccagaacauuccgacagcgauccagcaaguucgcucuuuaauagggaaugaggaauuccuggacuacaugccaucaaugaaaagauuucggaaggaggaggaaagugagggagcuaucugguga

SEQ ID NO: 15099 - RNA, 9873 nt, Artificial Sequence
  derived and/or modified CDS sequence (opt3) from DENV-3__JX669494__SS-prME
accagccugugccucaugaugauccuucccgccgcucuggcauuccacuugacauccagagacggcgagccuaggaugauuguggggaagaacgaacggggaaaaucuuuacuguuuaagacugccucagguacgaauauguguacccuaauagcgauggaucucggcgagaugugcgacgauacagucacuuacaaauguccacauaucaccgaaguugagccggaagacauugauugcugguguaaccugacaaguaccugggugacuuaugggacaugcaaucaggcuggagagcgccgacgugacaagagaagcguagcccuugcaccccacgugggcaugggucuggauaccaggacgcaaacuuggauguccgccgagggggcuuggcggcaggucgaaaaaguggagaccugggcauugcgccauccuggauucacaauccucgcccuguuucuggcucacuacauuggcacuucucucacccagaagguugugaucuucauauuacugaugcuugucacaccaucgaugaccaugagaugugugggcguagggaacagggacuuuguugaaggauugucaggugccacguggguggaugucgugcuggagcauggcgggugcgugacuacaauggcgaagaauaaacccacccuagacaucgagcuccagaagacugaagcaacacaacuggccacccuucggaaacuguguauugagggaaagaucacgaacauuaccacagauagccgcugcccuacucagggcgaagcugucuugccagaggaacaggaccagaauuauguuuguaaacacaccuacguggaucgagguugggggaacggaugcggccucuucggcaaggggagucugguaacaugcgccaaguuucaauguuuagagcccaucgagggaaaagugguccaguaugaaaaucugaaguacacugugauaauuaccguucacacaggugaccagcaucaggugggcaacgagacccaaggggucacugcagaaaucacgccucaggcuuccacaaccgaggccauucucccagaauauggaacucuuggccuggagugcucuccgagaaccgguuuggacuucaaugagaugauccuacugacaaugaaaaacaaggcguggauggugcacaggcagugguuuuucgaucucccccugccuuggaccagcggggccacuacagaaacgccaaccuggaaucggaaagagcuucugguaacuuuuaagaacgcacaugcuaaaaagcaagaaguuguggucuugggcucccaggagggagccaugcacacagcucucaccggcgccacagaaauccagaauucagggggaacuaguauuuucgcaggucaccugaagugucguuuaaaaauggacaagcuggagcuaaaaggcaugagcuacgccaugugcaccaacacguuugugcucaagaaagaggucucugaaacccagcaugggacaauacugaucaagguggaguaccgcggagaagaugcucccuguaagauuccuuucuccacugaggacggccaagguaaagcgcacaacgggagacuuaucaccgcaaauccaguugugacaaagaaagaggaacccguaaacauagaggccgaaccgccuuucggcgagucaaauauugucaucggaaucggcgauaacgcuuugaagauuaauugguauaaaaaggggagcaguaucggaaagauguuugaagccacugcaaggggugcccggcgaauggcuauucugggcgacaccgccugggauuucgggucugugggaggcguucucaacucccuggguaaaauggugcaucagauauuugggagcgcauacacggcgcuuuucucgggcgucucuugggugaugaagaucggaauuggcguacuguugacauggaucgggcucaauuccaaaaacaccucaaugaguuuuagcugcaucgcuauuggaauaaucacucuguauuuaggcgccgugguucaggcagacauggguugugucauuaauuggaaggggaaagagcugaagugcggauccggcaucuucgugacaaacgaggugcacaccuggacugaacaguacaaguuucaagccgauucucccaaacgccuagcuaccgccauugcaggugcuugggagaauggcgucugugggaucagaagcacaacgaggauggaaaaccuccuguggaagcagauagccaaugagcuuaacuauaucuugugggaaaauaacauuaaacugaccguuguggugggagacaucauuggcguacucgagcaggggaagcggacucugacaccacagccuauggaguuaaaauacucauggaagaccuggggaaaagcgaagaucgucacagccgaaacucaaaacaguuccuucauaauugauggccccaauaccccagagugccccagcgcuucucgcgcauggaacgugugggaaguugaggacuaugguuuugggguguucacgacaaauaucuggcugaagcuuagagaagucuacacccaguugugugaccauaggcucaugucagccgcugugaaagaugagcgugccguucacgcagacaugggauacuggauugagagucagaagaacggcagcuggaaacuggaaaaggcgucccuaaucgaggugaaaacuugcaccuggccuaagucucacacacuguggucgaaugguguacucgaaagcgauaugauaaucccaaagucccuggccggcccgauuucacagcauaaccaccggcccggguaucauacucaaaccgcuggaccuuggcaccuuggcaaauuggagcuggacuuuaauuacugcgaggggacaacggucgugaucaccgaaaacuguggaacucgaggcccaaguuuaagaacaaccacugugucugguaagcucauucacgaguggugcuguaggagcugcacacugcccccucuucgcuauaugggggaagauggauguugguacggcauggagauccggccaauauccgaaaaagaggagaauauggucaagucacugguuagcgccgguucuggcaaaguggacaacuucaccauggggguauugugccucgcaauucuguuugaagaggugaugagaggaaaguucggcaagaaacauaugaucgcugggguccuauucacguuugugcugcuccuguccggacagaucacuuggagggauauggcccacacccuuauuaugaucggcaguaaugcaagcgaccgcauggguauggggguuacauauuuggcccugauugcuaccuucaagauacagcccuuuuuagcgcucggauucuuucugcgaaaacuuacuucucgggaaaaccugcuacucggcgugggccuggccauggcaacaaccuugcaacugccggaggauaucgaacagauggcuaaugggauugccuuaggacucauggcccugaagcuuaucacacaguucgagacuuaccagcuguggaccgcuuugauuucccucacguguucaaacacaauguuuacccugacugucgcauggcguaccgccacacuaauccuggcgggugugagucuucucccuguuugccaaagcucguccaugagaaaaacugacuggcugccaauggcuguggccgcaaugggcguccccccuuugccccuguucauauuuucuuuaaaggauacccucaagaggcgcagcuggccacugaaugaggggguaauggccgugggacuuguuucaauccuggcuaguuccuugcuccggaacgacgugccuauggcaggcccccuggucgccggugggcuacugauugcguguuaugugaucacgggaacaucugcugaucuuaccguagaaaaagccgcagacauuacuugggaggaagaggccgaacagacaggcgugagccauaaccucaugaucaccgucgacgaugacggcacuaugagaauaaaggaugacgagacagagaauauucugaccguuuuguuaaaaacggcucugcucaucguguccgggguguucccauacucaaucccggccacucugcuugucuggcacaccuggcagaagcagacacaaaggagcggagugcugugggauguuccuagucccccagaaacccagaaagcagaguuggaagaggguguauaccgaauuaagcagcagggcauauuugggaaaacacaagugggagucggcgugcagaaggaggguguuuuccauacuauguggcacgugacccgcggggcuguccuaacguauaacggaaagcggcuggaacccaauugggccucugugaaaaaggaccucaucuccuacggcggcggguggagacugagcgcgcaguggcaaaaaggagaggaaguacaggucauugccguggagccugguaagaacccaaaaaauuuucagacaaugcccggcacuuuccagaccacaaccggggaaaucggagcaauugcucuugauuucaagccuggcacuucggguucaccgaucauaaacagggaggggaagguugugggauuauauggcaauggcgucgugaccaaaaacgggggauacguuucugguaucgcccaaacaaaugcugagccagacggccccacgccugaacuggaggaagagauguuuaagaaacguaaccucacuauuauggauuugcacccagggaguggaaagacccgcaaauaucugcccgcaaucgugcgggaagccauuaagagaaggcuccgaacacugauccuugccccuacccgggucguggcugcggagauggaggaagcacugaagggcuugccgauacgcuaccagacuacagccaccaaauccgagcauacggguagagaaauuguagaccuaaugugccacgcuacuuucacaaugaggcugcucagccccgugcggguuccaaauuauaacuuaaucaucauggaugaggcccauuuuaccgacccugcaucuauugccgcucgaggguacaucagcaccagagucggaaugggcgaagcggccgcaauauucaugacugcuacacccccaggcaccgccgaugcauuuccucaguccaaugcccccauucaggacgaggagcgcgacaucccagaaaggucauggaacagugggaaugaguggauuacagauuucgcuggaaagacugugugguuugugccgagcaucaaagccgguaacgacauagcgaacugucugcguaagaauggcaaaaaggucauucaacuuucucggaagacguucgauaccgaauaccagaaaacaaagcugaacgacugggauuuuguagugacuaccgacaucuccgagaugggggcaaauuucaaagccgauagaguuaucgacccuaggcgcugccucaagcccgugauuuugacagauggaccagagcgagucauccuggcuggccccaugccugugaccgccgcuucagcagcccagagacgggguaggguugggcgcaacccacagaaagaaaaugaccaauauauuuuuacuggccagccccucaacaaugaugaggaccacgcucauuggacggaagccaagaugcugcuugacaacauaaauaccccugagggaaucauuccggcacuauucgaaccagagcgugagaagagugcggccaucgauggcgaauacagacugaaaggggagagccggaagacauucguggaauugaugaggcgcggagacuuacccgucuggcuggcucacaaaguggccuccgaggguaucaaguauacugaucgaaaauggugcuuugacggccagagaaacaaucagauucucgaagagaacauggauguagagauauggaccaaggaaggggagaaaaagaagcugcggccuagguggcuugacgcacgcacauacucugauccccuggcucucaaagaauucaaggacuuugccgcaggaagaaaaucgaucgccuuggaucuggugaccgagauuggcaggguuccaagccaccuagcucaucggacucguaaugcgcuggacaaccucgucaugcuucacacaucagaacauggugggcgcgccuaucgacacgcaguggaggagcugccugaaacgauggagaccuuauugcugcucggccugaugauccuucugacuggaggcgcuaugcucuucuugauuuccgggaagggaaucgguaaaacaaguauaggccugaucugugugauugccucuagcgggauguuauggauggccgaaaucccccuacaauggauugcauccgcuaucguccuggaguuuuucaugaugguucuccuuauaccagagccugaaaagcagagaaccccgcaggauaaucaacuggccuacgugguaauuggaaucuugacccuggcggcuauuaucgccgcaaacgagaugggccuccuggaaacaacuaagagggaccuugguaugucaaaagagcccgggguggucucuccaacgagcuaucucgauguggaccugcacccugccagugcuuggaccuuguacgcaguugccacaacugugauaacccccaugcugcggcauacaaucgaaaauuccaccgcgaacgucagcuuagcugccauugcaaaccaggccguagugcuaaugggccuggacaagggauggccaaucucuaaaauggaucucggcguuccucuucuggcuuuggggugcuacucacaggugaauccccugacucucacggccgcaguccugcuuuuaauuacacacuaugcuaucauaggaccgggccugcaggccaaggcgacccgcgaggcccaaaaaagaacugcagcugguauuaugaagaacccaaccguggacgggaucaugacaaucgaucucgacccugucauuuacgauuccaaguuugagaaacaguugggacaggugaugcugcuaguucugugugccgugcagcuccuucugaugaggacuaguugggcauugugcgaagcucugacccucgccacaggccccaucacgacccugugggaggguagcccaggcaaguucuggaauacuacaauagccguaucgauggcgaacauuuuucgggggucuuauuuagcuggagcaggccuugccuucuccaucaugaaaagcguggggaccggaaagcgaggcacugguucacaaggggaaacacugggagagaaauggaagaagaaacucaaucagcuaaguagaaaggaauuugaccuguacaaaaagucuggcauuaccgaggucgaucgcacggaggcuaaagaagguuugaagaggggcgagaucacccaucacgccguuucccgggggagcgcaaaacugcagugguucguggaacguaacauggucauacccgagggaagagugaucgaccucggcugugggaggggaggcuggucauauuacugcgccggucuuaagaagguaacagaagugcgcggguauacuaaaggaggcccuggccaugaggagccgguucccaugaguaccuacggguggaauauugugaagcugaugagcggaaaagaugucuuuuacuugccaccugaaaagugugacacacugcucugcgauaucggugaguccucucccagcccuacuguggaagagucccggaccauucgagucuuaaaaaugguggagccauggcugaagaacaaucaguucuguaucaagguucuuaaccccuauaugccuacaguaauugaacaccuggagagacuacaaaggaaacacggcgggaugcucgugcgcaauccacugucacggaacucuacccaugaaauguacuggaucaguaauggaacuggcaacauagucgcuucggugaauacgguuagcagauugcugcucaaccguuucacaaugacccacaggcggcccacuaccgagaaggacguggaucuuggugcggggacacgccaugucaacgccgaaccggagacgccuaauauggacgugauuggagagcgaaucaaaagaaucaaggaagagcacaacuccaccuggcacuaugacgaugaaaauccauacaaaacuugggcauaucauggcucuuacgagguaaaggcuacaggcucagccagcuccaugauuaacggggugguuaagcuguuaaccaaacccugggacgucgugccuauggugacucagauggcaaugacagauaccacaccauuuggacagcaaagggucuucaaggaaaaaguugacacucggaccccccgcaguaugccggguacgagaagggugaugggcauaaccgccgaguggcuguggcgaacauuggggcggaauaagaaaccucgucucugcacuagagaggaauuuaccaagaagguacgcacaaacgcugccaugggagcgguguucacugaggaaaaucagugggauucugcaaaagccgcugucgaggacgaagauuuuuggaagcugguggacagggagcgggagcuacacaaacuuggcaagugugguagcugcguuuauaacaugauggggaaaagagaaaagaaacugggagaguucggcaaggccaagggcucacgcgcaaucugguacauguggcucggggcuagguaccuggaauuugaggccuugggauuccugaaugaggaucauugguuuucccgagaaaacaguuauagcgguguggagggcgaagggcuccacaaacuuggauacauucugcgggacaucucuaagauucccggcggugcuauguaugccgaugacaccgcagggugggacacgagaaucacagaggaugacuuacauaaugaagagaaaauaacccagcagauggauccagagcacaggcaacuggcgaacgccaucuucaaguugacuuaccagaauaaagucgugaagguacagcgcccuacacccaccggaacuguuauggacauuaucucccguaaggaucagcggggcucaggccaaguggggaccuauggacucaacacauuuacgaauauggaagcucagcugauuagacagauggagggugaaggcguccuaagcaaagccgaccuugagaacccacaccugcccgaaaagaaaaucacccaguggcucgagacuaaggggguggagaggcugaaacgcauggcaauaucgggagaugacugcguggucaagccuauugaugaccgauucgcuaacgccuuguuagcacugaaugauaugggcaagguucggaaagacaucccacaauggcagccgucuaaggguuggcaugauuggcagcaggugcccuuuuguagucaccauuuccacgaacucaucaugaaagacgggagaaagcuuguagugccuugcaggccacaagacgagcugauuggacgcgccagaauaucccagggcgcgggcuggagccuacgggaaacagcuugucuggggaaagccuacgcacagauguggucacucauguauuuccacaggcgugauuugcgacuggccuccaacgcuaucugcucugccguccccgugcauuggguuccuaccagccgcacuacauggaguauucacgcacaucaccaauggaugaccacggaggacaugcuuacaguguggaauagagucuggaucgaagauaacccauggauggaggacaagacccccgugacuaccugggagaauguaccuuaccugggaaagcgggaagaucaguggugugguucccucauuggcuuaacaagcagggcuacuugggcccagaacaucccgaccgcgauacagcaaguucgcucucugaucgggaaugaggaauuuuuggacuacaugccaucaaugaaaagauuccggaaggaggaggaaagugagggagcuauuugguga

SEQ ID NO: 15100 - RNA, 9873 nt, Artificial Sequence
  derived and/or modified CDS sequence (opt3) from DENV-3__JX669503__SS-prME
accagcuucugccugaugaugauccuccccgcagcucuugcauuucaccugacuuccagagacggcgaaccuaggaugauuguggggaagaacgaacggggaaagucuuuguuauucaagacugccucagguauaaauauguguacgcugaucgcgauggaucucggcgaaaugugcgacgauaccgucaccuacaaauguccacauauuacugaaguugagccggaagacaucgauugcugguguaaccucaccaguacaugggugaccuaugggacuugcaaucaggcuggagagcgccgacgugacaagagaagcguagcccuggcaccccacgugggcaugggucuugauacaaggacccagacguggauguccgccgagggggcuuggcggcaggucgaaaaaguggagacuugggcacugcgccauccuggauuuaccauuuuggcccucuuccuggcucacuacaucggcacaucucugacucagaagguugugauauuuauccucuuaaugcuggucaccccaucgaugacaaugagaugugugggcguagggaacagggacuucguugaaggacuuucaggugccaccuggguggaugucguguuggagcauggcgggugcgugacgacuauggcgaagaauaaacccacacuggacauugaguugcagaagaccgaagcaacucaacucgccacacugcggaaacuuuguaucgagggaaagauuaccaacaucacgaccgauagccgcugcccuacacagggcgaagcuguccugccagaggaacaggaccagaauuauguuuguaaacacacuuacguggaucgagguugggggaacggaugcggcuuguuuggcaaggggagucucguaaccugcgccaaguuccaaugucuggagcccauagagggaaaagugguccaguaugaaaauuuaaaguacacagugauuaucacuguucacaccggugaccagcaucaggugggcaacgagacacaaggggucaccgcagaaauuacuccucaggcuuccacgacagaggccauccugccagaauauggaacccucggccuugagugcucuccgagaacuggucuggacuuuaaugagaugaucuugcuaaccaugaaaaacaaggcguggauggugcacaggcagugguucuuugaucugccccucccuuggacaagcggggccaccacugaaacaccaacguggaaucggaaagagcugcuuguaaccuucaagaacgcacaugcuaaaaagcaagaaguugugguccugggcucccaggagggagccaugcacacugcuuugacaggcgccaccgaaauucaaaauucagggggaacaaguauauuugcaggucaccucaagugucgucugaaaauggacaaguuagagcugaaaggcaugagcuacgccaugugcacuaacaccuucgugcuaaagaaagaggucucugaaacgcagcaugggaccauccucauuaagguggaguacaagggagaagaugcucccuguaaaaucccuuucuccacagaggacggccaagguaaggcgcacaacgggcgccugauaacugcaaauccaguugugaccaaaaaggaggaacccguaaacauugaggccgaaccgccuuuuggcgagucaaauaucgucaucggaauuggcgauaacgcucuuaaaaucaauugguauaagaaggggagcaguauuggaaaaauguucgaagccacagcaagaggugccaggcggauggcuauauugggcgacacugccugggauuuugggucugugggaggcguucugaacucccucgguaagauggugcaucagaucuucgggagcgcauacaccgcgcuguuuucgggcgucucuugggugaugaaaauuggaaucggcguacuucugacguggaucgggcuaaauuccaagaacacaucaaugaguuucagcugcauugcuauaggaaucauuacccucuaucugggcgccgugguucaggcagacauggguugugucaucaauuggaaagggaaggaguuaaagugcggauccggcauuuuugugacuaacgaggugcacacauggaccgaacaguacaaauuccaagccgauucucccaagcgacuggcuacugccaucgccggugcuugggagaauggcgucugugggauacgcagcaccacaagaauggaaaaccuacucuggaaacagaucgccaaugagcugaacuauauucuuugggaaaauaacaucaaguugacgguuguggugggagacauuaucggcguacuggagcaggggaaaaggacccucacuccacagccuauggagcugaaguacucauggaaaacauggggaaaggcgaagauagucaccgccgaaacacaaaacaguuccuuuauuaucgauggccccaauacuccagagugccccagcgcuucucgggcauggaacgugugggaaguugaggacuaugguuucgggguguuuaccacgaauauuugguuaaaacugcgcgaagucuacacacagcuuugugaccauagauugaugucagccgcugugaaggaugagagggccguucacgcagacaugggauacuggaucgagagucagaaaaacggcagcuggaagcucgaaaaagcgucccugauagaggugaagaccugcacuuggccuaagucucacacccuauggucgaaugguguacuggaaagcgauaugaucauuccaaaaucccucgccggcccgaucucacagcauaaccaccgucccggguaucauacacaaacugcuggaccuuggcaccugggcaaacuugaguuggacuucaauuacugcgaggggaccacagucgugauuacggaaaacuguggaacccggggcccaagucugcgaacuacaaccgugucugguaaauuaauccacgaguggugcuguagaagcugcacucuacccccucugagguauaugggggaagauggauguugguacggcauggagauacgcccaauuuccgaaaaggaggagaauauggucaaaucacuuguuagcgccgguucuggcaagguggacaacuuuacaauggggguacugugcuuggcaauccucuucgaagaggugaugcggggaaaguucggcaaaaagcauaugaucgcuggggucuuuuucaccuuugugcugcuacuguccggacagauuacguggagagauauggcccacacucucaucaugauuggcaguaaugcaagcgacaggauggguauggggguuaccuaucuggcccuuauagcuacauucaaaauccagcccuuuuuggcgcugggauucuuuuuacgcaagcucaccucucgagaaaaccugcuucugggcgugggccuagccauggcaacuacacuccaacugccggaggauauugaacagauggcuaaugggaucgccuugggacugauggccuuaaaacucauuacccaguucgagacauaccagcuguggacugcucuuaucucccugaccuguucaaacacgauguuuacauugaccgucgcauggcggacugccacccucauacuggcgggugugagucuacugccuguuugccaaagcucguccaugcguaagacagacuggcuuccaauggcuguggccgcaaugggcguacccccucucccccuguucaucuuuucuuugaaggauacucugaaaagaaggagcuggccauuaaaugaggggguaauggccgugggacucguuucaauucuggcuaguucccuucugcgcaacgacgugccuauggcaggccccuuggucgccggugggcuccugaucgcguguuaugugauuaccggaacgucugcugaucuaacaguagaaaaggccgcagacaucaccugggaggaagaggccgaacagacuggcgugagccauaaccugaugauaacagucgacgaugacggcaccaugcggauuaaagaugacgagacugagaauauccuuacaguucuccugaagaccgcuuuguuaaucguguccgggguguucccauacucaauuccggccacgcugcucgucuggcacacuuggcagaaacagacccaaagaagcggagugcugugggauguuccuagucccccagaaacacagaaggcagagcuugaagaggguguauacaggauaaaacagcagggcaucuuugggaagacccaagugggagucggcgugcagaaggaggguguuuuccauacaauguggcacgugacucgaggggcuguccugaccuauaacggaaaacgcuuggaacccaauugggccucugugaagaaagaccuaauuuccuacggcggcggguggcggcugagcgcgcaguggcaaaagggagaggaaguacaggucaucgccguggagccugguaaaaacccaaagaauuuccagacgaugcccggcacauuucagacuaccacaggggaaauuggagcaaucgcucucgauuucaagccuggcaccucggguucaccgauaaucaacagagaggggaaaguugugggacuguauggcaauggcgucgugacuaagaacgggggauacguuucugguauugcccaaaccaaugcugagccagacggccccacaccugaacuugaggaagagauguuuaaaaagaggaacuuaacgaucauggaucugcacccagggaguggaaaaacucguaaguaucuccccgcaauugugcgcgaagccaucaagcggagauugaggacccugauacucgccccuacacgagucguggcugcggagauggaggaagcacugaaaggccuuccgauucgguaccagaccacugccacaaaguccgagcauaccggucgcgaaaucguagaccugaugugccacgcuacguucacuaugagauugcuaagccccgugaggguuccaaauuauaaccugaucauuauggaugaggcccauuuuacagacccugcaucuaucgccgcucggggguacauaagcacccgagucggaaugggcgaagcggccgcaauuuucaugaccgcuacucccccaggcacagccgaugcauuuccucaguccaaugcccccauccaggacgaggagagagacauuccagaacgcucauggaacagugggaaugaguggaucaccgauuucgcuggaaaaacagugugguuugugccgagcauaaaggccgguaacgacauugcgaacugucucaggaaaaauggcaagaaggucauccaauuaucucguaaaacuuucgauacggaauaccagaagaccaaacugaacgacugggauuuuguagugacaacugacaucuccgagaugggggcaaauuucaaggccgaucggguuauugacccuagaaggugccuuaaacccgugauccugaccgauggaccagagcgcgucgugcucgcuggccccaugccuguuacagccgcuucagcagcccagcgaagaggucggguggggaggaacccacagaaggaaaaugaccaauauauuuucaccggccagcccuugaacaaugaugaggaccacgcucauuggacugaagccaagaugcugcucgacaacauaaauacgccugagggaaucauuccggcacuguuugaaccagagcgcgagaaaagugcggccaucgauggcgaauaccgucuuaagggggagagcagaaaaaccuucgucgaacuaaugcggaggggagaccugcccgugugguuggcucacaagguagccuccgaggguaucaaauauacagaucgcaaguggugcuuugacggccagcgaaacaaucagauuuuagaagagaacauggauguggagauauggacuaaagaaggggagaagaagaaacugagaccucgguggcucgacgcaaggaccuacucugauccccuggcucuuaaggaguucaaagacuuugccgcaggacgcaagucgaucgcccuggaucucguuacagagauuggcagagucccaagccacuuggcucauaggacccggaaugcgcuggacaaccuagugaugcugcacacuucagaacauggugggcgugccuaucgccacgcaguggaggagcucccugaaacaauggagacgcuucuguuauugggccugaugauccuccugaccggaggcgcuaugcuuuuccugauuuccgggaaaggaaucgguaagacaaguauaggccucaucugugucauugccucuagcgggauguuguggauggccgaaaucccccugcaauggauugcauccgcuaucguuuuagaguuuuucaugauggugcuacugauaccagagccugaaaagcagcgaacaccgcaggauaaucaacucgccuacguagugauuggaauccuuacccuggcggcuauuaucgccgcaaacgagaugggcuugcuggaaaccacaaaaagagaccucgguaugucaaaggagcccggggucgugucuccaacuagcuaucuggauguugaccuucacccugccagugcuuggacgcucuacgcaguggccaccacagucauaacucccaugcugaggcauaccaucgaaaauuccacagcgaacgucagcuuggcugccauugcaaaccaggccgugguucugaugggcuuagacaaaggauggccaaucucuaagauggaucuaggcgugccucugcucgcucuugggugcuacucacaggucaauccccugaccuugacugccgcagugcugcuccugauuacgcacuaugcuaucauaggaccgggccuucaggccaaagcgacacgggaggcccaaaagcgcaccgcagcugguauuaugaagaacccaacugucgacgggaucaugaccaucgauuuagacccugugauuuacgauuccaaauuugagaagcagcugggacagguuaugcucuuggugcugugugccguacagcuacugcucaugagaacaaguugggcacuuugcgaagcucugacuuuggccaccggccccaucacaacgcugugggaggguagcccaggcaaauucuggaauaccacuauagccgugucgauggcgaacauuuuuagggggucuuaucucgcuggagcaggccuggccuucuccaucaugaaaagcgucgggacaggaaaacggggcaccgguucacaaggggaaacuuuaggagagaaguggaagaagaaacuuaaucagcugagucgaaaagaauuugaccucuacaagaaaucuggcauuacagagguugauagaaccgaggcuaaagaaggucuaaaacgcggcgagaucacgcaucacgccguguccagggggagcgcaaagcugcagugguucgucgaacggaacauggugauacccgagggacguguaaucgacuugggcugugggagaggaggcuggucauauuacugcgccggucugaagaaagugaccgaaguuaggggguauacaaagggaggcccuggccaugaggagccggugcccaugaguacuuacggguggaauauugucaaacucaugagcggaaaggauguguucuaccuuccaccugaaaaaugugacacccuguugugcgauaucggugaguccucucccagcccuacagucgaagagucccgcacuauucgggugcugaagaugguugagccauggcucaagaacaaucaguuuuguaucaaaguauuaaaccccuauaugccuaccgugauugaacaccuggagcgacuucaaagaaagcacggcgggaugcuggucaggaauccacuaucacgcaacucuacacaugaaauguacuggaucaguaauggaaccggcaacauaguggcuucgguuaauauggugagccggcuccuguugaacagauucacuaugacgcaccguaggcccacaauugagaaagacgucgaucugggugcggggacccggcaugugaacgccgaaccggagacuccuaauauggacguaaucggagagcgcaucaagcgaauuaaagaagaacacaacuccaccuggcacuaugacgaugaaaauccauacaagacaugggcauaucauggcucuuacgaggugaaggcuacgggcucagccagcuccaugauaaacgggguugucaaacuccuuaccaagcccugggacguggugccuauggucacucagauggcaaugacagauaccacuccauuuggacagcaaagaguuuucaaagaaaagguggacacaaggacaccccggaguaugccggguacacgcagaguaaugggcaucacugccgaguggcuguggaggaccuuagggcgaaauaaaaagccucggcugugcacgcgugaggaauuuaccaagaaagugagaacaaacgcugccaugggagcggucuucacugaggaaaaucagugggauucugcaaaggccgcuguggaggacgaagauuuuuggaaauugguugaccgcgagagggagcuccacaagcugggcaaaugugguagcugcguguauaacaugauggggaagcgggagaagaagcuaggagaguucggcaaggccaaaggcucaagagcaauuugguacauguggcuuggggcucgcuaccuggaauuugaggcccucggauuccugaaugaggaucauugguuuuccagggaaaacaguuauagcggugucgagggcgaaggguugcacaagcugggauacauccuccgagacauuucuaaaauccccggcggugcuauguaugccgaugacaccgcagggugggacacacggauaacugaggaugaccuucauaaugaagagaagaucacccagcagauggauccagagcacagacaacuggcgaacgccauuuucaaauuaacguaccagaauaaggugguaaagguucagaggccuacacccaccggaacugugauggacaucauuucccgcaaagaucagcguggcucaggccaagucgggacauauggacugaacaccuuuacuaauauggaagcucaguugauccggcagauggagggugaaggcgugcucagcaaggccgaccuggagaacccacaccuacccgagaagaagauaacccaguggcuugagacaaaagggguggagagacugaagaggauggcaauuucgggagaugacugcgucguuaagccuaucgaugaccgcuucgcuaacgcccuccuggcauugaaugauaugggcaaagugcgaaaggacaucccacaauggcagccgucuaaagguuggcaugauuggcagcagguacccuucuguagucaccauuuucacgaauuaauuaugaaggacgggcggaaacugguggucccuugcagaccacaagacgagcucauaggaagggcccgcaucucccagggcgcgggcuggagccuuagagaaacggcuugucuggggaaggccuacgcacagauguggucacuaauguauuuccaccggagggaucugcgucucgccuccaacgcuauuugcucugccgugcccguucauugggugccuaccagccgaacuacauggaguauccacgcacaucaccaauggaugaccacugaggacauguugacagucuggaaucgcguguggauugaagauaacccauggauggaggacaagacccccguaacgacaugggagaauguuccuuaccugggaaaaagagaagaucaguggugugguucccuuaucggccugaccagccgggcuacuugggcccagaacauaccgaccgcgauccagcaagugaggucucucauugggaaugaggaauuuuuagacuacaugccaucaaugaagcgcuucagaaaagaggaggaaagugagggagcuaucugguga

SEQ ID NO: 15101 - RNA, 9873 nt, Artificial Sequence
  derived and/or modified CDS sequence (opt3) from DENV-3__JX669493__SS-prME
accagcuucugccugaugaugauccuccccgcagcucuugcauuucaccugacuuccagagacggcgaaccuaggaugauuguggggaagaacgaacggggaaagucuuuguuauucaagacugccucagguauuaauauguguacgcugaucgcgauggaucucggcgaaaugugcgacgauaccgucaccuacaaauguccacauauuacugaaguugagccggaagacaucgauugcugguguaaccucaccaguacaugggugaccuaugggacuugcaaucaggcuggagagcgccgacgugacaagagaagcgucgcccuggcaccccacgugggcaugggucuugauacaaggacccagacguggauguccgccgagggggcuuggcggcaggucgaaaaaguggagacuugggcacugcgccauccuggauuuaccauuuuggcccucuuccuggcucacuacaucggcacaucucugacucagaagguugugauauuuauccucuuaaugcuggucaccccaucgaugacaaugagaugugugggcguagggaacagggacuucguugaaggacuuucaggugccaccuggguggaugucguguuggagcauggcgggugcgugacgacuauggcgaagaauaaacccacacuggacauugaguugcagaagaccgaagcaacucagcucgccacacugcggaaacuuuguaucgagggaaagauuaccaacaucacgaccgauagccgcugcccuacacagggcgaagcuguccugccagaggaacaggaccagaauuauguuuguaaacacacuuacguggaucgagguugggggaacggaugcggcuuguuuggcaaggggagucucguaaccugcgccaaguuccaaugucuggagcccauagagggaaaagugguccaguaugaaaauuuaaaguacacagugauuaucacuguucacaccggugaccagcaucaggugggcaacgagacacaaggggucaccgcagaaauuacuccucaggcuuccacgacagaggccauccugccagaauauggaacccucggccuugagugcucuccgagaacuggucuggacuuuaaugagaugaucuugcuaaccaugaaaaacaaggcguggauggugcacaggcagugguucuuugaucugccccucccuuggacaagcggggccaccacugaaacaccaacguggaaucggaaagagcugcuuguaaccuucaagaacgcacaugcuaaaaagcaagaaguugugguccugggcucccaggagggagccaugcacacugcuuugacaggcgccaccgaaauucaaaauucagggggaacaaguauauuugcaggucaccucaagugucgucugaaaauggacaaguuagagcugaaaggcaugagcuacgccaugugcacuaacaccuucgugcuaaagaaagaggucucugaaacgcagcaugggaccauccucauuaagguggaguacaagggagaagaugcucccuguaaaaucccuuucuccacagaggacggccaagguaaggcgcacaacgggcgccugauaacugcaaauccaguugugaccaaaaaggaggaacccguaaacauugaggccgaaccgccuuuuggcgagucaaauaucgucaucggaauuggcgauaacgcucuuaaaaucaauugguauaagaaggggagcaguauuggaaaaauguucgaagccacagcaagaggugccaggcggauggcuauauugggcgacacugccugggauuuugggucugugggaggcguucugaacucccucgguaagauggugcaucagaucuucgggagcgcauacaccgcgcuguuuucgggcgucucuugggugaugaaaauuggaaucggcguacuucugacguggaucgggcuaaauuccaagaacacaucaaugaguuucagcugcauugcuauaggaaucauuacccucuaucugggcgccgugguucaggcagacauggguugugucaucaauuggaaagggaaggaguuaaagugcggauccggcauuuuugugacuaacgaggugcacacauggaccgaacaguacaaauuccaagccgauucucccaagcgacuggcuacugccaucgccggugcuugggagaauggcgucugugggauacgcagcaccacaagaauggaaaaccuacucuggaaacagaucgccaaugagcugaacuauauucuuugggaaaauaacaucaaguugacgguuguggugggagacauuaucggcguacuggagcaggggaaaaggacccucacuccacagccuauggagcugaaguacucauggaaaacauggggaaaggcgaagauagucaccgccgaaacacaaaacaguuccuuuauuaucgauggccccaauacuccagagugccccagcgcuucucgggcauggaacgugugggaaguugaggacuaugguuucgggguguuuaccacgaauauuugguuaaaacugcgcgaagucuacacacagcuuugugaccauagauugaugucagccgcugugaaggaugagagggccguucacgcagacaugggauacuggaucgagagucagaaaaacggcagcuggaagcucgaaaaagcgucccugauagaggugaagaccugcacuuggccuaagucucacacccuauggucgaaugguguacuggaaagcgauaugaucauuccaaaaucccucgccggcccgaucucacagcauaaccaccgucccggguaucauacacaaacugcuggaccuuggcaccugggcaaacuugaguuggacuucaauuacugcgaggggaccacagucgugauuacggaaaacuguggaacccggggcccaagucugcgaacuacaaccgugucugguaaauuaauccacgaguggugcuguagaagcugcacucuacccccucugagguauauaggggaagauggauguugguacggcauggagauucgcccaaucuccgaaaaggaggagaauauggucaaaucacuuguuagcgccgguucuggcaagguggacaacuuuacaauggggguacugugcuuggcaauccucuucgaagaggugaugcggggaaaguucggcaaaaagcauaugauugcuggggucuuuuucaccuuugugcugcuacuguccggacagaucacguggagagauauggcccacacucucauuaugauaggcaguaaugcaagcgacaggauggguauggggguuaccuaucuggcccuuaucgcuacauucaaaauucagcccuuuuuggcgcugggauucuuuuuacgcaagcucaccucucgagaaaaccugcuucugggcgugggccuagccauggcaacuacacuccaacugccggaggauaucgaacagauggcuaaugggauugccuugggacugauggccuuaaaacucaucacccaguucgagacauaccagcuguggacugcucuuauaucccugaccuguucaaacacgauguuuacauugaccgucgcauggcggacugccacccucauccuggcgggugugagucuacugccuguuugccaaagcucguccaugcguaagacagacuggcuuccaauggcuguggccgcaaugggcguacccccucucccccuguucauauuuucuuugaaggauacucugaaaagaaggagcuggccauuaaaugaggggguaauggccgugggacucguuucaauccuggcuaguucccuucugcgcaacgacgugccuauggcaggccccuuggucgccggugggcuccugauugcguguuaugugaucaccggaacgucugcugaucuaacaguagaaaaggccgcagacauaaccugggaggaagaggccgaacagacuggcgugagccauaaccugaugauuacagucgacgaugacggcaccaugcggaucaaagaugacgagacugagaauauccuuacaguucuccugaagaccgcuuuguuaauuguguccgggguguucccauacucaauaccggccacgcugcucgucuggcacacuuggcagaaacagacccaaagaagcggagugcugugggauguuccuagucccccagaaacacagaaggcagagcuugaagaggguguauacaggaucaaacagcagggcauuuuugggaagacccaagugggagucggcgugcagaaggaggguguuuuccauacaauguggcacgugacucgaggggcuguccugaccuauaacggaaaacgcuuggaacccaauugggccucugugaagaaagaccuaaucuccuacggcggcggguggcggcugagcgcgcaguggcaaaagggagaggaaguacaggucauugccguggagccugguaaaaacccaaagaauuuccagacgaugcccggcacauuucagacuaccacaggggaaaucggagcaauagcucucgauuucaagccuggcaccucggguucaccgaucauuaacagagaggggaaaguugugggacuguauggcaauggcgucgugacuaagaacgggggauacguuucugguaucgcccaaaccaaugcugagccagacggccccacaccugaacuugaggaagagauguuuaaaaagaggaacuuaacgauuauggaucugcacccagggaguggaaaaacucguaaguaucuccccgcaaucgugcgcgaagccauaaagcggagauugaggacccugauucucgccccuacacgagucguggcugcggagauggaggaagcacugaaaggccuuccgauccgguaccagaccacugccacaaaguccgagcauaccggucgcgaaaucguagaccugaugugccacgcuacguucacuaugagauugcuaagccccgugaggguuccaaauuauaaccugauuaucauggaugaggcccauuuuacagacccugcaucuauagccgcucggggguacauuagcacccgagucggaaugggcgaagcggccgcaaucuucaugaccgcuacucccccaggcacagccgaugcauuuccucaguccaaugcccccauucaggacgaggagagagacaucccagaacgcucauggaacagugggaaugaguggauaaccgauuucgcuggaaaaacagugugguuugugccgagcauuaaggccgguaacgacaucgcgaacugucucaggaaaaauggcaagaaggucauccaauuaucucguaaaacuuucgauacggaauaccagaagaccaaacugaacgacugggauuuuguagugacaacugacauuuccgagaugggggcaaauuucaaggccgaucggguuaucgacccuagaaggugccuuaaacccgugauucugaccgauggaccagagcgcgucauacucgcuggccccaugccugugacagccgcuucagcagcccagcgaagaggucggguugggaggaacccacagaaggaaaaugaccaauauaucuucaccggccagcccuugaacaaugaugaggaccacgcucauuggacugaagccaagaugcugcucgacaacauuaauacgccugagggaaucaucccggcacuguuugaaccagagcgcgagaaaagugcggccauugauggcgaauaccgucuuaagggggagagcagaaaaaccuucguggaacuaaugcggaggggagaccugcccgucugguuggcucacaagguggccuccgaggguauaaaauauacagaucgcaaguggugcuuugacggccagcgaaacaaucagaucuuagaagagaacauggauguagagauuuggacuaaagaaggggagaagaagaaacugagaccucgguggcucgacgcaaggaccuacucugauccccuggcucuuaaggaguucaaagacuuugccgcaggacgcaagucgaucgcccuggaucucgugacagagauuggcagaguuccaagccacuuggcucauaggacccggaaugcgcuggacaaccuagucaugcugcacacuucagaacauggugggcgugccuaucgccacgcaguggaggagcucccugaaacaauggagacgcuucuguuauugggccugaugauccuccugaccggaggcgcuaugcuuuuccugauauccgggaaaggaaucgguaagacaaguauuggccucaucugugugauugccucuagcgggauguuguggauggccgaaaucccccugcaauggauagcauccgcuauugucuuagaguuuuucaugaugguucuacugaucccagagccugaaaagcagcgaacaccgcaggauaaucaacucgccuacgugguaauuggaauccuuacccuggcggcuauaaucgccgcaaacgagaugggcuugcuggaaaccacaaaaagagaccucgguaugucaaaggagcccgggguggucucuccaacuagcuaucuggauguggaccuucacccugccagugcuuggacgcucuacgcaguugccaccacagugauuacucccaugcugaggcauaccaucgaaaauuccacagcgaacgucagcuuggcugccauugcaaaccaggccguagugcugaugggcuuagacaaaggauggccaaucucuaagauggaucuaggcguuccucugcucgcucuugggugcuacucacaggugaauccccugaccuugacugccgcaguccugcuccugauaacgcacuaugcuauuaucggaccgggccuucaggccaaagcgacacgggaggcccaaaagcgcaccgcagcugguaucaugaagaacccaacuguggacgggauuaugaccaucgauuuagacccugucauauacgauuccaaauuugagaagcagcugggacaggugaugcucuugguucugugugccgugcagcuacugcucaugagaacaaguugggcacuuugcgaagcucugacuuuggccaccggccccauuacaacgcugugggaggguagcccaggcaaauucuggaauaccacuaucgccguaucgauggcgaacauuuuuagggggucuuaucucgcuggagcaggccuggccuucuccaucaugaaaagcguggggacaggaaaacggggcaccgguucacaaggggaaacuuuaggagagaaguggaagaagaaacuuaaucagcugagucgaaaagaauuugaccucuacaagaaaucuggcauaacagaggucgauagaaccgaggcuaaagaaggucuaaaacgcggcgagaucacgcaucacgccguuuccagggggagcgcaaagcugcagugguucguggaacggaacauggucauucccgagggacgugugaucgacuugggcugugggagaggaggcuggucauauuacugcgccggucugaagaaaguaaccgaagugaggggguauacaaagggaggcccuggccaugaggagccgguucccaugaguacuuacggguggaauauugugaaacucaugagcggaaaggaugucuucuaccuuccaccugaaaaaugugacacccuguugugcgauaucggugaguccucucccagcccuacaguggaagagucccgcacuauucggguccugaagaugguggagccauggcucaagaacaaucaguuuuguaucaaaguuuuaaaccccuauaugccuaccguaauagaacaccuggagcgacuucaaagaaagcacggcgggaugcuggugaggaauccacuaucacgcaacucuacacaugaaauguacuggauuaguaauggaaccggcaacaucgucgcuucggugaauaugguuagccggcuccuguugaacagauucacuaugacgcaccguaggcccacaaucgagaaagacguggaucugggugcggggacccggcaugucaacgccgaaccggagacuccuaauauggacgugauuggagagcgcauaaagcgaaucaaagaagaacacaacuccaccuggcacuaugacgaugaaaauccauacaagacaugggcauaucauggcucuuacgagguaaaggcuacgggcucagccagcuccaugauuaacggggugguuaaacuccuuaccaagcccugggacgucgugccuauggugacucagauggcaaugacagauaccacuccauuuggacagcaaagagucuucaaagaaaagguugacacaaggacaccccggaguaugccggguacacgcagagugaugggcaucacugccgaguggcuguggaggaccuuagggcgaaauaaaaagccucggcugugcacgcgugaggaauuuaccaagaaaguaagaacaaacgcugccaugggagcgguguucacugaggaaaaucagugggauucugcaaaggccgcugucgaggacgaagauuuuuggaaauugguggaccgcgagagggagcuccacaagcugggcaaaugugguagcugcguuuauaacaugauggggaagcgggagaagaagcuaggagaguucggcaaggccaaaggcucaagagcaauuugguacauguggcuuggggcucgcuaccuggaauuugaggcccucggauuccugaaugaggaucauugguuuuccagggaaaacaguuauagcgguguggagggcgaaggguugcacaagcugggauacauccuccgagacauaucuaaaauccccggcggugcuauguaugccgaugacaccgcagggugggacacacggauuacugaggaugaccuucauaaugaagagaagaucacccagcagauggauccagagcacagacaacuggcgaacgccauuuucaaauuaacguaccagaauaaggucgugaagguacagaggccuacacccaccggaacuguuauggacaucauaucccgcaaagaucagcguggcucaggccaaguggggacauauggacugaacaccuuuacuaauauggaagcucaguugauucggcagauggagggugaaggcguccucagcaaggccgaccuggagaacccacaccuacccgagaagaagaucacccaguggcuugagacaaaagggguggagagacugaagaggauggcaaucucgggagaugacugcguggucaagccuauugaugaccgcuucgcuaacgcccuccuggcauugaaugauaugggcaaaguucgaaaggacauaccacaauggcagccgucuaaagguuggcaugauuggcaacaggugcccuucuguagucaccauuuucacgaauuaaucaugaaggacgggcggaaacugguagugccuugcagaccacaagacgagcucauuggaagggcccgcaucucccagggcgcgggcuggagccuuagagaaacggcuugucuggggaaggccuacgcacagauguggucacuaauguauuuccaccggagggaucugcgucucgccuccaacgcuauuugcucugccguccccgugcauuggguuccuaccagccgaacuacauggaguauccacgcacaucaccaauggaugaccacugaggacauguugacaguguggaaucgcgucuggauagaagauaacccauggauggaggacaagacccccgugacgacaugggagaauguaccuuaccugggaaaaagagaagaucaguggugugguucccuuaucggccugaccagccgggcuacuugggcccagaacauuccgaccgcgauccagcaaguuaggucucucauugggaaugaggaauuuuuagacuacaugccaucaaugaagcgcuucagaaaagaggaggaaagugagggagcuaucugguga

SEQ ID NO: 15102 - RNA, 9873 nt, Artificial Sequence
  derived and/or modified CDS sequence (opt3) from DENV-3__JX669504__SS-prME
accagccugugccucaugaugauccuucccgccgcucuggcauuccacuugacauccagagacggcgagccuaggaugauuguggggaagaacgaacggggaaaaucuuuacuguuuaagacugccucagguacgaauauguguacccuaauagcgauggaucucggcgagaugugcgacgauacagucacuuacaaauguccacauaucaccgaaguugagccggaagacauugauugcugguguaaccugacaaguaccugggugacuuaugggacaugcaaucaggcuggagagcgccgacgugacaagagaagcguagcccuugcaccccacgugggcaugggucuggauaccaggacgcaaacuuggauguccgccgagggggcuuggcggcaggucgaaaaaguggagaccugggcauugcgccauccuggauucacaauccucgcccuguuucuggcucacuacauuggcacuucucucacccagaagguugugaucuucauauuacugaugcuugucacaccaucgaugaccaugagaugugugggcguagggaacagggacuuuguugaaggauugucaggugccacguggguggaugucgugcuggagcauggcgggugcgugacuacaauggcgaagaauaaacccacccuagacaucgagcuccagaagacugaagcaacacaacuggccacccuucggaaacuguguauugagggaaagaucacgaacauuaccacagauagccgcugcccuacucagggcgaagcugucuugccagaggaacaggaccagaauuauguuuguaaacacaccuacguggaucgagguugggggaacggaugcggccucuucggcaaggggagucugguaacaugcgccaaguuucaauguuuagagcccaucgagggaaaagugguccaguaugaaaaucugaaguacacugugauaauuaccguucacacaggugaccagcaucaggugggcaacgagacccaaggggucacugcagaaaucacgccucaggcuuccacaaccgaggccauucucccagaauauggaacucuuggccuggagugcucuccgagaaccgguuuggacuucaaugagaugauccuacugacaaugaaaaacaaggcguggauggugcacaggcagugguuuuucgaucucccccugccuuggaccagcggggccacuacagaaacgccaaccuggaaucggaaagagcuucugguaacuuuuaagaacgcacaugcuaaaaagcaagaaguuguggucuugggcucccaggagggagccaugcacacagcucucaccggcgccacagaaauccagaauucagggggaacuaguauuuucgcaggucaccugaagugucguuuaaaaauggacaagcuggagcuaaaaggcaugagcuacgccaugugcaccaacacguuugugcucaagaaagaggucucugaaacccagcaugggacaauacugaucaagguggaguaccgcggagaagaugcucccuguaagauuccuuucuccacugaggacggccaagguaaagcgcacaacgggagacuuaucaccgcaaauccaguugugacaaagaaagaggaacccguaaacauagaggccgaaccgccuuucggcgagucaaauauugucaucggaaucggcgauaacgcuuugaagauuaauugguauaaaaaggggagcaguaucggaaagauguuugaagccacugcaaggggugcccggcgaauggcuauucugggcgacaccgccugggauuucgggucugugggaggcguucucaacucccuggguaaaauggugcaucagauauuugggagcgcauacacggcgcuuuucucgggcgucucuugggugaugaagaucggaauuggcguacuguugacauggaucgggcucaauuccaaaaacaccucaaugaguuuuagcugcaucgcuauuggaauaaucacucuguauuuaggcgccgugguucaggcagacauggguugugucauuaauuggaaggggaaagagcugaagugcggauccggcaucuucgugacaaacgaggugcacaccuggacugaacaguacaaguuucaagccgauucucccaaacgccuagcuaccgccauugcaggugcuugggagaauggcgucugugggaucagaagcacaacgaggauggaaaaccuccuguggaagcagauagccaaugagcuuaacuauaucuugugggaaaauaacauuaaacugaccguuguggugggagacaucauuggcguacucgagcaggggaagcggacucugacaccacagccuauggaguuaaaauacucauggaagaccuggggaaaagcgaagaucgucacagccgaaacucaaaacaguuccuucauaauugauggccccaauaccccagagugccccagcgcuucucgcgcauggaacgugugggaaguugaggacuaugguuuugggguguucacgacaaauaucuggcugaagcuuagagaagucuacacccaguugugugaccauaggcucaugucagccgcugugaaagaugagcgugccguucacgcagacaugggauacuggauugagagucagaagaacggcagcuggaaacuggaaaaggcgucccuaaucgaggugaaaacuugcaccuggccuaagucucacacacuguggucgaaugguguacucgaaagcgauaugauaaucccaaagucccuggccggcccgauuucacagcauaaccaccggcccggguaucauacucaaaccgcuggaccuuggcaccuuggcaaauuggagcuggacuuuaauuacugcgaggggacaacggucgugaucaccgaaaacuguggaacucgaggcccaaguuuaagaacaaccacugugucugguaagcucauucacgaguggugcuguaggagcugcacacugcccccucuucgcuauaugggggaagauggauguugguacggcauggagauccggccaauauccgaaaaagaggagaauauggucaagucacugguuagcgccgguucuggcaaaguggacaacuucaccauggggguauugugccucgcaauucuguuugaagaggugaugagaggaaaguucggcaagaaacauaugaucgcuggggucuucuuuacgcuagugcugcuccuguccggacagaucacuuggagggauauggcccacacccuuauuaugaucggcaguaaugcaagcgaccgcauggguauggggguuacauauuuggcccugauugcuaccuucaagauacagcccuuuuuagcgcucggauucuuucugcgaaaacuuacuucucgggaaaaccugcuacucggcgugggccuggccauggcaacaaccuugcaacugccggaggauaucgaacagauggcuaaugggauugccuuaggacucauggcccugaagcuuaucacacaguucgagacuuaccagcuguggaccgcuuugauuucccucacguguucaaacacaauguuuacccugacugucgcauggcguaccgccacacuaauccuggcgggugugagucuucucccuguuugccaaagcucguccaugagaaaaacugacuggcugccaauggcuguggccgcaaugggcguccccccuuugccccuguucauauuuucuuuaaaggauacccucaagaggcgcagcuggccacugaaugaggggguaauggccgugggacuuguuucaauccuggcuaguuccuugcuccggaacgacgugccuauggcaggcccccuggucgccggugggcuacugauugcguguuaugugaucacgggaacaucugcugaucuuaccguagaaaaagccgcagacauuacuugggaggaagaggccgaacagacaggcgugagccauaaccucaugaucaccgucgacgaugacggcacuaugagaauaaaggaugacgagacagagaauauucugaccguuuuguuaaaaacggcucugcucaucguguccgggguguucccauacucaaucccggccacucugcuugucuggcacaccuggcagaagcagacacaaaggagcggagugcugugggauguuccuagucccccagaaacccagaaagcagaguuggaagaggguguauaccgaauuaagcagcagggcauauuugggaaaacacaagugggagucggcgugcagaaggaggguguuuuccauacuauguggcacgugacccgcggggcuguccuaacguauaacggaaagcggcuggaacccaauugggccucugugaaaaaggaccucaucuccuacggcggcggguggagacugagcgcgcaguggcaaaaaggagaggaaguacaggucauugccguggagccugguaagaacccaaaaaauuuucagacaaugcccggcacuuuccagaccacaaccggggaaaucggagcaauugcucuugauuucaagccuggcacuucggguucaccgaucauaaacagggaggggaagguugugggauuauauggcaauggcgucgugaccaaaaacgggggauacguuucugguaucgcccaaacaaaugcugagccagacggccccacgccugaacuggaggaagagauguuuaagaaacguaaccucacuauuauggauuugcacccagggaguggaaagacccgcaaauaucugcccgcaaucgugcgggaagccauuaagagaaggcuccgaacacugauccuugccccuacccgggucguggcugcggagauggaggaagcacugaagggcuugccgauacgcuaccagacuacagccaccaaauccgagcauacggguagagaaauuguagaccuaaugugccacgcuacuuucacaaugaggcugcucagccccgugcggguuccaaauuauaacuuaaucaucauggaugaggcccauuuuaccgacccugcaucuauugccgcucgaggguacaucagcaccagagucggaaugggcgaagcggccgcaauauucaugacugcuacacccccaggcaccgccgaugcauuuccucaguccaaugcccccauucaggacgaggagcgcgacaucccagaaaggucauggaacagugggaaugaguggauuacagauuucgcuggaaagacugugugguuugugccgagcaucaaagccgguaacgacauagcgaacugucugcguaagaauggcaaaaaggucauucaacuuucucggaagacguucgauaccgaauaccagaaaacaaagcugaacgacugggauuuuguagugacuaccgacaucuccgagaugggggcaaauuucaaagccgauagaguuaucgacccuaggcgcugccucaagcccgugauuuugacagauggaccagagcgagucauccuggcuggccccaugccugugaccgccgcuucagcagcccagagacgggguaggguugggcgcaacccacagaaagaaaaugaccaauauauuuuuacuggccagccccucaacaaugaugaggaccacgcucauuggacggaagccaagaugcugcuugacaacauaaauaccccugagggaaucauuccggcacuauucgaaccagagcgugagaagagugcggccaucgauggcgaauacagacugaaaggggagagccggaagacauucguggaauugaugaggcgcggagacuuacccgucuggcuggcucacaaaguggccuccgaggguaucaaguauacugaucgaaaauggugcuuugacggccagagaaacaaucagauucucgaagagaacauggauguagagauauggaccaaggaaggggagaaaaagaagcugcggccuagguggcuugacgcacgcacauacucugauccccuggcucucaaagaauucaaggacuuugccgcaggaagaaaaucgaucgccuuggaucuggugaccgagauuggcaggguuccaagccaccuagcucaucggacucguaaugcgcuggacaaccucgucaugcuucacacaucagaacauggugggcgcgccuaucgacacgcaguggaggagcugccugaaacgauggagaccuuauugcugcucggccugaugauccuucugacuggaggcgcuaugcucuucuugauuuccgggaagggaaucgguaaaacaaguauaggccugaucugugugauugccucuagcgggauguuauggauggccgaaaucccccuacaauggauugcauccgcuaucguccuggaguuuuucaugaugguucuccuuauaccagagccugaaaagcagagaaccccgcaggauaaucaacuggccuacgugguaauuggaaucuugacccuggcggcuauuaucgccgcaaacgagaugggccuccuggaaacaacuaagagggaccuugguaugucaaaagagcccgggguggucucuccaacgagcuaucucgauguggaccugcacccugccagugcuuggaccuuguacgcaguugccacaacugugauaacccccaugcugcggcauacaaucgaaaauuccaccgcgaacgucagcuuagcugccauugcaaaccaggccguagugcuaaugggccuggacaagggauggccaaucucuaaaauggaucucggcguuccucuucuggcuuuggggugcuacucacaggugaauccccugacucucacggccgcaguccugcuuuuaauuacacacuaugcuaucauaggaccgggccugcaggccaaggcgacccgcgaggcccaaaaaagaacugcagcugguauuaugaagaacccaaccguggacgggaucaugacaaucgaucucgacccugucauuuacgauuccaaguuugagaaacaguugggacaggugaugcugcuaguucugugugccgugcagcuccuucugaugaggacuaguugggcauugugcgaagcucugacccucgccacaggccccaucacgacccugugggaggguagcccaggcaaguucuggaauacuacaauagccguaucgauggcgaacauuuuucgggggucuuauuuagcuggagcaggccuugccuucuccaucaugaaaagcguggggaccggaaagcgaggcacugguucacaaggggaaacacugggagagaaauggaagaagaaacucaaucagcuaaguagaaaggaauuugaccuguacaaaaagucuggcauuaccgaggucgaucgcacggaggcuaaagaagguuugaagaggggcgagaucacccaucacgccguuucccgggggagcgcaaaacugcagugguucguggaacguaacauggucauacccgagggaagagugaucgaccucggcugugggaggggaggcuggucauauuacugcgccggucuuaagaagguaacagaagugcgcggguauacuaaaggaggcccuggccaugaggagccgguucccaugaguaccuacggguggaauauugugaagcugaugagcggaaaagaugucuuuuacuugccaccugaaaagugugacacacugcucugcgauaucggugaguccucucccagcccuacuguggaagagucccggaccauucgagucuuaaaaaugguggagccauggcugaagaacaaucaguucuguaucaagguucuuaaccccuauaugccuacaguaauugaacaccuggagagacuacaaaggaaacacggcgggaugcucgugcgcaauccacugucacggaacucuacccaugaaauguacuggaucaguaauggaacuggcaacauagucgcuucggugaauacgguuagcagauugcugcucaaccguuucacaaugacccacaggcggcccacuaccgagaaggacguggaucuuggugcggggacacgccaugucaacgccgaaccggagacgccuaauauggacgugauuggagagcgaaucaaaagaaucaaggaagagcacaacuccaccuggcacuaugacgaugaaaauccauacaaaacuugggcauaucauggcucuuacgagguaaaggcuacaggcucagccagcuccaugauuaacggggugguuaagcuguuaaccaaacccugggacgucgugccuauggugacucagauggcaaugacagauaccacaccauuuggacagcaaagggucuucaaggaaaaaguugacacucggaccccccgcaguaugccggguacgagaagggugaugggcauaaccgccgaguggcuguggcgaacauuggggcggaauaagaaaccucgucucugcacuagagaggaauuuaccaagaagguacgcacaaacgcugccaugggagcgguguucacugaggaaaaucagugggauucugcaaaagccgcugucgaggacgaagauuuuuggaagcugguggacagggagcgggagcuacacaaacuuggcaagugugguagcugcguuuauaacaugauggggaaaagagaaaagaaacugggagaguucggcaaggccaagggcucacgcgcaaucugguacauguggcucggggcuagguaccuggaauuugaggccuugggauuccugaaugaggaucauugguuuucccgagaaaacaguuauagcgguguggagggcgaagggcuccacaaacuuggauacauucugcgggacaucucuaagauucccggcggugcuauguaugccgaugacaccgcagggugggacacgagaaucacagaggaugacuuacauaaugaagagaaaauaacccagcagauggauccagagcacaggcaacuggcgaacgccaucuucaaguugacuuaccagaauaaagucgugaagguacagcgcccuacacccaccggaacuguuauggacauuaucucccguaaggaucagcggggcucaggccaaguggggaccuauggacucaacacauuuacgaauauggaagcucagcugauuagacagauggagggugaaggcguccuaagcaaagccgaccuugagaacccacaccugcccgaaaagaaaaucacccaguggcucgagacuaaggggguggagaggcugaaacgcauggcaauaucgggagaugacugcguggucaagccuauugaugaccgauucgcuaacgccuuguuagcacugaaugauaugggcaagguucggaaagacaucccacaauggcagccgucuaaggguuggcaugauuggcagcaggugcccuuuuguagucaccauuuccacgaacucaucaugaaagacgggagaaagcuuguagugccuugcaggccacaagacgagcugauuggacgcgccagaauaucccagggcgcgggcuggagccuacgggaaacagcuugucuggggaaagccuacgcacagauguggucacucauguauuuccacaggcgugauuugcgacuggccuccaacgcuaucugcucugccguccccgugcauuggguuccuaccagccgcacuacauggaguauucacgcacaucaccaauggaugaccacggaggacaugcuuacaguguggaauagagucuggaucgaagauaacccauggauggaggacaagacccccgugacuaccugggagaauguaccuuaccugggaaagcgggaagaucaguggugugguucccucauuggcuuaacaagcagggcuacuugggcccagaacaucccgaccgcgauacagcaaguucgcucucugaucgggaaugaggaauuuuuggacuacaugccaucaaugaaaagauuccggaaggaggaggaaagugagggagcuauuugguga

SEQ ID NO: 15103 - RNA, 9873 nt, Artificial Sequence
  derived and/or modified CDS sequence (opt3) from DENV-3__JX669506__SS-prME
accagcuucugccugaugaugauccuccccgcagcucuugcauuucaccugacuuccagagacggagaaccuaggaugauuguggggaagaacgaacggggaaagucuuuguuauucaagacugccucagguauaaauauguguacgcugaucgcgauggaucucggcgaaaugugcgacgauaccgucaccuacaaauguccacauauuacugaaguugagccggaagacaucgauugcugguguaaccucaccaguacaugggugaccuaugggacuugcaaucaggcuggagagcgccgacgugacaagagaagcgucgcccuggcaccccacgugggcaugggucuugauacaaggacccagacguggauguccgccgagggggcuuggcggcaggucgaaaaaguggagacuugggcacugcgccauccuggauuuaccauuuuggcccucuuccuggcucacuacaucggcacaucucugacucagaagguugugauauuuauccucuuaaugcuggucaccccaucgaugacaaugagaugugugggcguagggaacagggacuucguugaaggacuuucaggugccaccuggguggaugucguguuggagcauggcgggugcgugacgacuauggcgaagaauaaacccacacuggacauugaguugcagaagaccgaagcaacucagcucgccacacugcggaaacuuuguaucgagggaaagauuaccaacaucacgaccgauagccgcugcccuacacagggcgaagcuguccugccagaggaacaggaccagaauuauguuuguaaacacacuuacguggaucgagguugggggaacggaugcggcuuguuuggcaaggggagucucguaaccugcgccaaguuccaaugucuggagcccauagagggaaaagugguccaguaugaaaauuuaaaguacacagugauuaucacuguucacaccggugaccagcaucaggugggcaacgagacacaaggggucaccgcagaaauuacuccucaggcuuccacgacagaggccauccugccagaauauggaacccucggccuugagugcucuccgagaacuggucuggacuuuaaugagaugaucuugcuaaccaugaaaaacaaggcguggauggugcacaggcagugguucuuugaucugccccucccuuggacaagcggggccaccacugaaacaccaacguggaaucggaaagagcugcuuguaaccuucaagaacgcacaugcuaaaaagcaagaaguugugguccugggcucccaggagggagccaugcacacugcuuugacaggcgccaccgaaauucaaaauucagggggaacaaguauauuugcaggucaccucaagugucgucugaaaauggacaaguuagagcugaaaggcaugagcuacgccaugugcacuaacaccuucgugcuaaagaaagaggucucugaaacgcagcaugggaccauccucauuaagguggaguacaagggagaagaugcucccuguaaaaucccuuucuccacagaggacggccaagguaaggcguauaacgggcgccugauaacugcaaauccaguugugaccaaaaaggaggaacccguaaacauugaggccgaaccgccuuuuggcgagucaaauaucgucaucggaauuggcgauaacgcucuuaaaaucaauugguacaagaaggggagcaguauuggaaaaauguucgaagccacagcaagaggugccaggcggauggcuauauugggcgacacugccugggauuuugggucugugggaggcguucugaacucccucgguaagauggugcaccagaucuucgggagcgcauauaccgcgcuguuuucgggcgucucuugggugaugaaaauuggaaucggcguacuucugacguggaucgggcuaaauuccaagaacacaucaaugaguuucagcugcauugcuauaggaaucauuacccucuaccugggcgccgugguucaggcagacauggguugugucaucaauuggaaagggaaggaguuaaagugcggauccggcauuuuugugacuaacgaggugcauacauggaccgaacaguauaaauuccaagccgauucucccaagcgacuggcuacugccaucgccggugcuugggagaauggcgucugugggauacgcagcaccacaagaauggaaaaccuacucuggaaacagaucgccaaugagcugaacuacauucuuugggaaaauaacaucaaguugacgguuguggugggagacauuaucggcguacuggagcaggggaaaaggacccucacuccacagccuauggagcugaaguauucauggaaaacauggggaaaggcgaagauagucaccgccgaaacacaaaacaguuccuuuauuaucgauggccccaauacuccagagugccccagcgcuucucgggcauggaacgugugggaaguugaggacuacgguuucgggguguuuaccacgaauauuugguuaaaacugcgcgaagucuacacacagcuuugugaccacagauugaugucagccgcugugaaggaugagagggccguucaugcagacaugggauauuggaucgagagucagaaaaacggcagcuggaagcucgaaaaagcgucccugauagaggugaagaccugcacuuggccuaagucucacacccuauggucgaaugguguacuggaaagcgauaugaucauuccaaaaucccucgccggcccgaucucacagcacaaccaucgucccggguaccacacacaaacugcuggaccuuggcaucugggcaaacuugaguuggacuucaauuauugcgaggggaccacagucgugauuacggaaaacuguggaacccggggcccaagucugcgaacuacaaccgugucugguaaauuaauccacgaguggugcuguagaagcugcacucuacccccucugagguacaugggggaagauggauguugguauggcauggagauacgcccaauuuccgaaaaggaggagaauauggucaaaucacuuguuagcgccgguucuggcaagguggacaacuuuacaauggggguacugugcuuggcaauccucuucgaagaggugaugcggggaaaguucggcaaaaagcacaugaucgcuggggucuuuuucaccuuugugcugcuacuguccggacagauuacguggagagauauggcccauacucucaucaugauuggcaguaaugcaagcgacaggauggguauggggguuaccuaccuggcccuuauagcuacauucaaaauccagcccuuuuuggcgcugggauucuuuuuacgcaagcucaccucucgagaaaaccugcuucugggcgugggccuagccauggcaacuacacuccaacugccggaggauauugaacagauggcuaaugggaucgccuugggacugauggccuuaaaacucauuacccaguucgagacauaucagcuguggacugcucuuaucucccugaccuguucaaacacgauguuuacauugaccgucgcauggcggacugccacccucauacuggcgggugugagucuacugccuguuugccaaagcucguccaugcguaagacagacuggcuuccaauggcuguggccgcaaugggcguacccccucucccccuguucaucuuuucuuugaaggauacucugaaaagaaggagcuggccauuaaaugaggggguaauggccgugggacucguuucaauucuggcuaguucccuucugcgcaacgacgugccuauggcaggccccuuggucgccggugggcuccugaucgcguguuacgugauuaccggaacgucugcugaucuaacaguagaaaaggccgcagacaucaccugggaggaagaggccgaacagacuggcgugagccacaaccugaugauaacagucgacgaugacggcaccaugcggauuaaagaugacgagacugagaauauccuuacaguucuccugaagaccgcuuuguuaaucguguccgggguguucccauacucaauuccggccacgcugcucgucuggcauacuuggcagaaacagacccaaagaagcggagugcugugggauguuccuagucccccagaaacacagaaggcagagcuugaagaggguguauauaggauaaaacagcagggcaucuuugggaagacccaagugggagucggcgugcagaaggaggguguuuuccacacaauguggcaugugacucgaggggcuguccugaccuacaacggaaaacgcuuggaacccaauugggccucugugaagaaagaccuaauuuccuauggcggcggguggcggcugagcgcgcaguggcaaaagggagaggaaguacaggucaucgccguggagccugguaaaaacccaaagaauuuccagacgaugcccggcacauuucagacuaccacaggggaaauuggagcaaucgcucucgauuucaagccuggcaccucggguucaccgauaaucaacagagaggggaaaguugugggacuguacggcaauggcgucgugacuaagaacgggggauauguuucugguauugcccaaaccaaugcugagccagacggccccacaccugaacuugaggaagagauguuuaaaaagaggaacuuaacgaucauggaucugcacccagggaguggaaaaacucguaaguaccuccccgcaauugugcgcgaagccaucaagcggagauugaggacccugauacucgccccuacacgagucguggcugcggagauggaggaagcacugaaaggccuuccgauucgguaucagaccacugccacaaaguccgagcacaccggucgcgaaaucguagaccugaugugccaugcuacguucacuaugagauugcuaagccccgugaggguuccaaauuacaaccugaucauuauggaugaggcccacuuuacagacccugcaucuaucgccgcucggggguacauaagcacccgagucggaaugggcgaagcggccgcaauuuucaugaccgcuacucccccaggcacagccgaugcauuuccucaguccaaugcccccauccaggacgaggagagagacauuccagaacgcucauggaacagugggaaugaguggaucaccgauuucgcuggaaaaacagugugguuugugccgagcauaaaggccgguaacgacauugcgaacugucucaggaaaaauggcaagaaggucauccaauuaucucguaaaacuuucgauacggaauaucagaagaccaaacugaacgacugggauuuuguagugacaacugacaucuccgagaugggggcaaauuucaaggccgaucggguuauugacccuagaaggugccuuaaacccgugauccugaccgauggaccagagcgcgucauucucgcuggccccaugccugugacagccgcuucagcagcccagcgaagaggucggguugggaggaacccacagaaggaaaaugaccaauacauauucaccggccagcccuugaacaaugaugaggaccaugcucacuggacugaagccaagaugcugcucgacaacaucaauacgccugagggaauuaucccggcacuguuugaaccagagcgcgagaaaagugcggccaucgauggcgaauaucgucuuaagggggagagcagaaaaaccuucguggaacuaaugcggaggggagaccugcccgucugguuggcucauaagguggccuccgaggguauuaaauacacagaucgcaaguggugcuuugacggccagcgaaacaaucagauauuagaagagaacauggauguagagaucuggacuaaagaaggggagaagaagaaacugagaccucgguggcucgacgcaaggaccuauucugauccccuggcucuuaaggaguucaaagacuuugccgcaggacgcaagucgauugcccuggaucucgugacagagaucggcagaguuccaagccacuuggcucacaggacccggaaugcgcuggacaaccuagucaugcugcauacuucagaacacggugggcgugccuaccgccaugcaguggaggagcucccugaaacaauggagacgcuucuguuauugggccugaugauucuccugaccggaggcgcuaugcuuuuccugaucuccgggaaaggaauagguaagacaaguaucggccucauuugugugaucgccucuagcgggauguuguggauggccgaaauuccccugcaauggaucgcauccgcuauagucuuagaguuuuucaugaugguucuacugauuccagagccugaaaagcagcgaacaccgcaggauaaucaacucgccuaugugguaaucggcauucuuacccuggcggcuaucauagccgcaaacgagaugggcuugcuggaaaccacaaaaagagaccucgguaugucaaaggagcccgggguggucucuccaacuagcuaccuggauguggaccuucacccugccagugcuuggacgcucuacgcaguugccaccacagugaucacucccaugcugaggcacaccauugaaaauuccacagcgaacgucagcuuggcugccaucgcaaaccaggccguagugcugaugggcuuagacaaaggauggccaauuucuaagauggaucuaggcguuccucugcucgcucuugggugcuauucacaggugaauccccugaccuugacugccgcaguccugcuccugaucacgcauuacgcuauaauuggaccgggccuucaggccaaagcgacacgggaggcccaaaagcgcaccgcagcugguaucaugaagaacccaacuguggacgggaucaugaccauugauuuagacccugucaucuaugauuccaaauuugagaagcagcugggacaggugaugcucuugguucugugugccgugcagcuacugcucaugagaacaaguugggcacuuugcgaagcucugacuuuggccaccggccccauaacaacgcugugggaggguagcccaggcaaauucuggaauaccacuauugccguaucgauggcgaacaucuuuagggggucuuaccucgcuggagcaggccuggccuucuccauuaugaaaagcguggggacaggaaaacggggcaccgguucacaaggggaaacuuuaggagagaaguggaagaagaaacuuaaucagcugagucgaaaagaauuugaccucuauaagaaaucuggcaucacagaggucgauagaaccgaggcuaaagaaggucuaaaacgcggcgagauaacgcaccaugccguuuccagggggagcgcaaagcugcagugguucguggaacggaacauggucauccccgagggacgugugauugacuugggcugugggagaggaggcuggucauacuauugcgccggucugaagaaaguaaccgaagugaggggguacacaaagggaggcccuggccacgaggagccgguucccaugaguacuuacggguggaauaucgugaaacucaugagcggaaaggaugucuucuaucuuccaccugaaaaaugugacacccuguugugcgauauuggugaguccucucccagcccuacaguggaagagucccgcacuauccggguccugaagaugguggagccauggcucaagaacaaucaguuuuguauuaaaguuuuaaaccccuacaugccuaccguaaucgaacaucuggagcgacuucaaagaaagcacggcgggaugcuggugaggaauccacuaucacgcaacucuacacacgaaauguauuggauaaguaauggaaccggcaacauugucgcuucggugaauaugguuagccggcuccuguugaacagauucacuaugacgcaucguaggcccacaaucgagaaagacguggaucugggugcggggacccggcacgucaacgccgaaccggagacuccuaauauggacgugaucggagagcgcauuaagcgaauaaaagaagaacauaacuccaccuggcacuacgacgaugaaaauccauauaagacaugggcauaccacggcucuuaugagguaaaggcuacgggcucagccagcuccaugaucaacggggugguuaaacuccuuaccaagcccugggacgucgugccuauggugacucagauggcaaugacagauaccacuccauuuggacagcaaagagucuucaaagaaaagguugacacaaggacaccccggaguaugccggguacacgcagagugaugggcauuacugccgaguggcuguggaggaccuuagggcgaaauaaaaagccucggcugugcacgcgugaggaauuuaccaagaaaguaagaacaaacgcugccaugggagcgguguucacugaggaaaaucagugggauucugcaaaggccgcugucgaggacgaagauuuuuggaaauugguggaccgcgagagggagcuccauaagcugggcaaaugugguagcugcguuuacaacaugauggggaagcgggagaagaagcuaggagaguucggcaaggccaaaggcucaagagcaaucugguacauguggcuuggggcucgcuaucuggaauuugaggcccucggauuccugaaugaggaucacugguuuuccagggaaaacaguuacagcgguguggagggcgaaggguugcauaagcugggauauauucuccgagacaucucuaaaauacccggcggugcuauguacgccgaugacaccgcagggugggacacacggaucacugaggaugaccuucacaaugaagagaagauuacccagcagauggauccagagcauagacaacuggcgaacgccaucuucaaauuaacguaucagaauaaggucgugaagguacagaggccuacacccaccggaacuguuauggacauuaucucccgcaaagaucagcguggcucaggccaaguggggacauacggacugaacaccuuuacuaauauggaagcucaguugauacggcagauggagggugaaggcguccucagcaaggccgaccuggagaacccacaccuacccgagaagaagauuacccaguggcuugagacaaaagggguggagagacugaagaggauggcaaucucgggagaugacugcguggucaagccuaucgaugaccgcuucgcuaacgcccuccuggcauugaaugauaugggcaaaguucgaaaggacauuccacaauggcagccgucuaaagguuggcacgauuggcaacaggugcccuucuguagucaucacuuucaugaauuaauaaugaaggacgggcggaaacugguagugccuugcagaccacaagacgagcucaucggaagggcccgcauuucccagggcgcgggcuggagccuuagagaaacggcuugucuggggaaggccuaugcacagauguggucacuaauguacuuccaccggagggaucugcgucucgccuccaacgcuaucugcucugccguccccgugcacuggguuccuaccagccgaacuacauggaguauucaugcacaccaucaauggaugaccacugaggacauguugacaguguggaaucgcgucuggaucgaagauaacccauggauggaggacaagacccccgugacgacaugggagaauguaccuuaccugggaaaaagagaagaucaguggugugguucccuuauaggccugaccagccgggcuacuugggcccagaacaucccgaccgcgauucagcaaguuaggucucucaucgggaaugaggaauuuuuagacuauaugccaucaaugaagcgcuucagaaaagaggaggaaagugagggagcuauuugguga

SEQ ID NO: 15104 - RNA, 9873 nt, Artificial Sequence
  derived and/or modified CDS sequence (opt3) from DENV-3__JX669496__SS-prME
accagccugugccucaugaugauccuucccgccgcucuggcauuccacuugacauccagagacggcgagccuaggaugauuguggggaagaacgaacggggaaaaucuuuacuguuuaagacugccucagguacgaauauguguacccuaauagcgauggaucucggcgagaugugcgacgauacagucacuuacaaauguccacauaucaccgaaguugagccggaagacauugauugcugguguaaccugacaaguaccugggugacuuaugggacaugcaaucaggcuggagagcgccgacgugacaagagaagcguagcccuugcaccccacgugggcaugggucuggauaccaggacgcaaacuuggauguccgccgagggggcuuggcggcaggucgaaaaaguggagaccugggcauugcgccauccuggauucacaauccucgcccuguuucuggcucacuacauuggcacuucucucacccagaagguugugaucuucauauuacugaugcuugucacaccaucgaugaccaugagaugugugggcguagggaacagggacuuuguugaaggauugucaggugccacguggguggaugucgugcuggagcauggcgggugcgugacuacaauggcgaagaauaaacccacccuagacaucgagcuccagaagacugaagcaacacaacuggccacccuucggaaacuguguauugagggaaagaucacgaacauuaccacagauagccgcugcccuacucagggcgaagcugucuugccagaggaacaggaccagaauuauguuuguaaacacaccuacguggaucgagguugggggaacggaugcggccucuucggcaaggggagucugguaacaugcgccaaguuucaauguuuagagcccaucgagggaaaagugguccaguaugaaaaucugaaguacacugugauaauuaccguucacacaggugaccagcaucaggugggcaacgagacccaaggggucacugcagaaaucacgccucaggcuuccacaaccgaggccauucucccagaauauggaacucuuggccuggagugcucuccgagaaccgguuuggacuucaaugagaugauccuacugacaaugaaaaacaaggcguggauggugcacaggcagugguuuuucgaucucccccugccuuggaccagcggggccacuacagaaacgccaaccuggaaucggaaagagcuucugguaacuuuuaagaacgcacaugcuaaaaagcaagaaguuguggucuugggcucccaggagggagccaugcacacagcucucaccggcgccacagaaauccagaauucagggggaacuaguauuuucgcaggucaccugaagugucguuuaaaaauggacaagcuggagcuaaaaggcaugagcuacgccaugugcgcuaacaccuuugugcucaagaaagaggucucugaaacgcagcaugggaccauacugaucaagguggaguaccgcggagaagaugcgcccuguaagauuccuuucuccacagaggacggccaagguaaagcacacaacgggagacuuaucacugccaauccaguugugaccaagaaagaggaacccguaaacauagaggcugaaccgccuuucggcgagucaaauauugucaucggaaucggcgauaacgccuugaagauuaauugguauaaaaaggggagcaguaucggaaagauguuugaagcaacagccaggggugcucggcgaauggccauucugggcgacacugcaugggauuucgggucugugggaggcguucucaacucccuggguaaaauggugcaucagauauuugggagcgcguacaccgcucuuuucucgggcgucucuugggugaugaagaucggaauuggcguacuguugacguggaucgggcucaauuccaaaaacacaucaaugaguuuuagcugcaucgccauuggaauaaucacccuguauuuaggcgcagugguucaggccgacauggguugugucauuaauuggaaggggaaagagcugaagugcggauccggcaucuucgugacuaacgaggugcacacauggaccgaacaguacaaguuucaagcugauucucccaaacgccuagccacugcaauugcuggugccugggagaauggcgucugugggaucagaagcaccacaaggauggaaaaccuccuguggaagcagauagcgaaugagcuuaacuauaucuugugggaaaauaacauuaaacugacgguuguggugggagacaucauuggcguacucgagcaggggaagcggacccugacuccacagccuauggaguuaaaauacucauggaagacauggggaaaagccaagaucgucaccgcugaaacacaaaacaguuccuucauaauugauggccccaauacuccagagugccccagcgcaucucgcgccuggaacgugugggaaguugaggacuaugguuuugggguguucaccacgaauaucuggcugaagcuuagagaagucuacacacaguugugugaccauaggcucaugucagcugccgugaaagaugagcgugcaguucacgcggacaugggauacuggauugagagucagaagaacggcagcuggaaacuggaaaaggccucccuaaucgaggugaaaaccugcacuuggccuaagucucacacccuguggucgaaugguguacucgaaagcgauaugauaaucccaaagucccuggcuggcccgauuucacagcauaaccaccggcccggguaucauacacaaacugccggaccuuggcaccuuggcaaauuggagcuggacuuuaauuacugcgaggggaccacagucgugaucacggaaaacuguggaacccgaggcccaaguuuaagaacuacaaccgugucugguaagcucauucacgaguggugcuguaggagcugcacucugcccccucuucgcuauaugggggaagauggauguugguacggcauggagauccggccaauauccgaaaaagaggagaauauggucaagucacugguuagcgcagguucuggcaaaguggacaacuucacaauggggguauugugccucgcuauucuguuugaagaggugaugagaggaaaguucggcaagaaacauaugaucgccgggguccuauucaccuuugugcugcuccuguccggacagaucacguggagggauauggcacacacucuuauuaugaucggcaguaaugccagcgaccgcauggguauggggguuaccuauuuggcucugauugcgacauucaagauacagcccuuuuuagcccucggauucuuucugcgaaaacuuaccucucgggaaaaccugcuacucggcgugggccuggcaauggcuacuacauugcaacugccggaggauaucgaacagauggccaaugggauugccuuaggacucauggcucugaagcuuaucacccaguucgagacauaccagcuguggacugcauugauuucccucaccuguucaaacacgauguuuacacugaccgucgccuggcguacugcgacccuaauccuggcuggugugagucuucucccuguuugccaaagcucguccaugagaaaaacagacuggcugccaauggccguggcagccaugggcguccccccuuugccccuguucauauuuucuuuaaaggauacucucaagaggcgcagcuggccacugaaugaggggguaauggcugugggacuuguuucaauccuggcaaguuccuugcuccggaacgacgugccuauggccggcccccuggucgcgggugggcuacugauugcuuguuaugugaucaccggaacgucugccgaucuuacaguagaaaaagcagccgacauuaccugggaggaagaggcugaacagacuggcgugagccauaaccucaugaucacagucgacgaugacggcaccaugagaauaaaggaugacgagacugagaauauucugacaguuuuguuaaaaaccgcccugcucaucguguccgggguguucccauacucaaucccggcaacgcugcuugucuggcacacuuggcagaagcagacccaaaggagcggagugcugugggauguuccuagucccccagaaacacagaaagcugaguuggaagaggguguauaccgaauuaagcagcagggcauauuugggaaaacccaagugggagucggcgugcagaaggaggguguuuuccauacaauguggcacgugacucgcggggccguccuaaccuauaacggaaagcggcuggaacccaauugggcgucugugaaaaaggaccucaucuccuacggcggcggguggagacugagcgcccaguggcaaaaaggagaggaaguacaggucauugcaguggagccugguaagaacccaaaaaauuuucagacgaugcccggcacauuccagacuaccacaggggaaaucggagcuauugcccuugauuucaagccuggcaccucggguucaccgaucauaaacagggaggggaagguugugggauuauauggcaauggcgucgugacuaaaaacgggggauacguuucugguaucgcucaaaccaaugcagagccagacggccccacaccugaacuggaggaagagauguuuaagaaacguaaccucacgauuauggauuugcacccagggaguggaaagacucgcaaauaucugcccgccaucgugcgggaagccauuaagagaaggcuccgaacccugauccuugcuccuacacgggucguggcggcagagauggaggaagcccugaagggcuugccgauacgcuaccagaccacugcuacaaaauccgagcauaccgguagagaaauuguagaccuaaugugccacgccacguucacuaugaggcugcucagccccgugcggguuccaaauuauaacuuaaucaucauggaugaggcacauuuuacagacccugccucuauugcugcgcgaggguacaucagcaccagagucggaaugggcgaagccgcagcuauauucaugaccgccacucccccaggcacagcagaugccuuuccucaguccaaugcucccauucaggacgaggagcgcgacaucccagaaaggucauggaacagugggaaugaguggauuaccgauuucgccggaaagacagugugguuugugccgagcaucaaagcggguaacgacauagcaaacugucugcguaagaauggcaaaaaggucauucaacuuucucggaagacuuucgauacggaauaccagaaaaccaagcugaacgacugggauuuuguagugacaacugacaucuccgagaugggggccaauuucaaagcugauagaguuaucgacccuaggcgcugccucaagcccgugauuuugaccgauggaccagagcgagucauccuggccggccccaugccugugacagcugcaucagccgcucagagacgggguaggguugggcgcaacccacagaaagaaaaugaccaauauauuuuuaccggccagccccucaacaaugaugaggaccacgcccauuggacugaagcaaagaugcugcuugacaacauaaauacgccugagggaaucauuccggcgcuauucgaaccagagcgugagaagagugccgcuaucgauggcgaauacagacugaaaggggagagccggaagaccuucguggaauugaugaggcgcggagacuuacccgucuggcuggcccacaaaguggcauccgaggguaucaaguauacagaucgaaaauggugcuuugacggccagagaaacaaucagauucucgaagagaacauggauguagagauauggacuaaggaaggggagaaaaagaagcugcggccuagguggcuugacgcucgcaccuacucugauccccuggcccucaaagaauucaaggacuuugcagccggaagaaaaucgaucgcuuuggaucuggugacagagauuggcaggguuccaagccaccuagcgcaucggacccguaaugcccuggacaaccucgucaugcuucacacuucagaacauggugggcgcgcauaucgacacgcuguggaggagcugccugaaacaauggagacguuauugcugcucggccugaugauccuucugaccggaggcgccaugcucuucuugauuuccgggaagggaaucgguaaaacuaguauaggccugaucugugugauugccucuagcgggauguuauggauggcagaaaucccccuacaauggauugcuuccgccaucguccuggaguuuuucaugaugguucuccuuauaccagagccugaaaagcagagaacaccgcaggauaaucaacuggcguacgugguaauuggaaucuugacccuggcugccauuaucgcagccaacgagaugggccuccuggaaaccacaaagagggaccuugguaugucaaaagagcccgggguggucucuccaacuagcuaucucgauguggaccugcacccugcuagugcauggacguuguacgccguugcgaccacagugauaacucccaugcugcggcauaccaucgaaaauuccacagcuaacgucagcuuagccgcaauugccaaccaggcuguagugcuaaugggccuggacaagggauggccaaucucuaaaauggaucucggcguuccucuucuggccuuggggugcuacucacaggugaauccccugacccucacugcagcuguccugcuuuuaauuacgcacuaugccaucauaggaccgggccugcaggcgaaggccacacgcgaggcacaaaaaagaaccgcugccgguauuaugaagaacccaacuguggacgggaucaugaccaucgaucucgacccugucauuuacgauuccaaguuugagaaacaguugggacaggugaugcugcuaguucugugugcagugcagcuccuucugaugaggacaaguugggcuuugugcgaagcccugacucucgccaccggccccaucacaacgcugugggaggguagcccaggcaaguucuggaauaccacuauagcgguaucgauggcuaacauuuuucgggggucuuauuuagcaggagccggccuugcuuucuccaucaugaaaagcguggggacaggaaagcgaggcaccgguucacaaggggaaacucugggagagaaauggaagaagaaacucaaucagcuaaguagaaaggaauuugaccuguacaaaaagucuggcauuacagaggucgaucgcaccgaggccaaagaagguuugaagaggggcgagaucacgcaucacgcaguuucccgggggagcgccaaacugcagugguucguggaacguaacauggucauacccgagggaagagugaucgaccucggcugugggaggggaggcuggucauauuacugcgcuggucuuaagaagguaaccgaagugcgcggguauacaaaaggaggcccuggccaugaggagccgguucccaugaguacuuacggguggaauauugugaagcugaugagcggaaaagaugucuuuuacuugccaccugaaaagugugacacccugcucugcgauaucggugaguccucucccagcccuacaguggaagagucccggacuauucgagucuuaaaaaugguggagccauggcugaagaacaaucaguucuguaucaagguucuuaaccccuauaugccuaccguaauugaacaccuggagagacuacaaaggaaacacggcgggaugcucgugcgcaauccacugucacggaacucuacacaugaaauguacuggaucaguaauggaaccggcaacauagucgcgucggugaauacuguuagcagauugcugcucaaccguuucacgaugacacacaggcggcccaccacugagaaggacguggaucuuggugccgggacccgccaugucaacgcagaaccggagacaccuaauauggacgugauuggagagcgaaucaaaagaaucaaggaagagcacaacuccacguggcacuaugacgaugaaaauccauacaaaaccugggcuuaucauggcucuuacgagguaaaggccacuggcucagcaagcuccaugauuaacggggugguuaagcuguuaacaaaacccugggacgucgugccuauggugacccagauggccaugacugauacaaccccauuuggacagcaaagggucuucaaggaaaaaguugacacacggacuccccgcaguaugccggguaccagaagggugaugggcauaacggcugaguggcuguggcgaaccuuggggcggaauaagaaaccucgucucugcacaagagaggaauuuacuaagaagguacgcaccaacgccgcgaugggagcaguguucacagaggaaaaucagugggauucugccaaagcugccgucgaggacgaagauuuuuggaagcugguggacagggagcgggagcuacacaaacuuggcaagugugguagcugcguuuauaacaugauggggaaaagagaaaagaaacugggagaguucggcaaggcaaagggcucacgcgcuaucugguacauguggcucggggccagguaccuggaauuugaggcuuugggauuccugaaugaggaucauugguuuucccgagaaaacaguuauagcgguguggagggcgaagggcuccacaaacuuggauacauucugcgggacaucucuaagauucccggcggugccauguaugcagaugacacugcggggugggacaccagaaucacggaggaugacuuacauaaugaagagaaaauaacacagcagauggauccagagcacaggcaacuggccaacgcuaucuucaaguugaccuaccagaauaaagucgugaagguacagcgcccuacucccacaggaaccguuauggacauuaucucccguaaggaucagcggggcucaggccaaguggggacuuauggacucaacaccuuuacaaauauggaagcccagcugauuagacagauggagggugaaggcguccuaagcaaagcagaccuugagaacccacaccugcccgaaaagaaaaucacgcaguggcucgagaccaaggggguggagaggcugaaacgcauggcuauaucgggagaugacugcguggucaagccuauugaugaccgauucgccaacgcauuguuagcccugaaugauaugggcaagguucggaaagacaucccacaauggcagccgucuaaggguuggcaugauuggcagcaggugcccuuuuguagucaccauuuccacgaacucaucaugaaagacgggagaaagcuuguagugccuugcaggccacaagacgagcugauuggacgcgcgagaauaucccagggcgcuggcuggagccuacgggaaacugccugucuggggaaagcauacgcccagauguggucacucauguauuuccacaggcgugauuugcgacuggcuuccaacgccaucugcucugcaguccccgugcauuggguuccuacaagccgcaccacuuggaguauucacgcucaucaccaauggaugacaaccgaggacaugcuuacgguguggaauagagucuggaucgaagauaacccauggauggaggacaagacacccgugaccacuugggagaauguaccuuaccugggaaagcgggaagaucaguggugugguucccucauuggcuuaaccagcagggccacaugggcgcagaacaucccgacugcuauacagcaaguucgcucucugaucgggaaugaggaauuuuuggacuacaugccaucaaugaaaagauuccggaaggaggaggaaagugagggagccauuugguga

SEQ ID NO: 15105 - RNA, 9873 nt, Artificial Sequence
  derived and/or modified CDS sequence (opt3) from DENV-3__JX669490__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcgccgacgugacaagagaagcguagcccuugcaccccacgugggcaugggucuggauacaaggacccaaacguggauguccgccgagggggcuuggcggcaggucgaaaaaguggagacuugggcauugcgccauccuggauucaccauucucgcccuguuucuggcucacuacaucggcacaucucucacucagaagguugugauauucaucuuacugaugcuugucaccccaucgaugacaaugagaugugugggcguagggaacagggacuuuguugaaggauugucaggugccaccuggguggaugucgugcuggagcauggcgggugcgugacgacuauggcgaagaauaaacccacacuagacauugagcuccagaagaccgaagcaacucaacuggccacacuucggaaacuguguaucgagggaaagauuaccaacaucacgaccgauagccgcugcccuacacagggcgaagcugucuugccagaggaacaggaccagaauuauguuuguaaacacacuuacguggaucgagguugggggaacggaugcggccucuucggcaaggggagucugguaaccugcgccaaguuucaauguuuagagcccauagagggaaaagugguccaguaugaaaaucugaaguacacagugauuaucacuguucacaccggugaccagcaucaggugggcaacgagacacaaggggucaccgcagaaauuacuccucaggcuuccacgacagaggccauccucccagaauauggaacccuuggccuggagugcucuccgagaacugguuuggacuucaaugagaugauccuacugaccaugaaaaacaaggcguggauggugcacaggcagugguuuuucgaucucccccugccuuggacaagcggggccaccacugaaacaccaacguggaaucggaaagagcuucugguaaccuuuaagaacgcacaugcuaaaaagcaagaaguuguggucuugggcucccaggagggagccaugcacacugcucucacaggcgccaccgaaauucagaauucagggggaacaaguauauucgcaggucaccugaagugucguuuaaaaauggacaagcuggagcuaaaaggcaugagcuacgccaugugcacuaacaccuuugugcucaagaaagaggucucugaaacgcagcaugggaccauccugauuaagguggaguaccgcggagaagaugcucccuguaagaucccuuucuccacagaggacggccaagguaaagcgcacaacgggagacuuauaacugcaaauccaguugugaccaagaaagaggaacccguaaacauugaggccgaaccgccuuucggcgagucaaauaucgucaucggaauuggcgauaacgcuuugaagaucaauugguauaaaaaggggagcaguauuggaaagauguuugaagccacagcaaggggugcccggcgaauggcuauacugggcgacacugccugggauuucgggucugugggaggcguucucaacucccuggguaaaauggugcaucagaucuuugggagcgcauacaccgcgcuuuucucgggcgucucuugggugaugaagauuggaaucggcguacuguugacguggaucgggcucaauuccaaaaacacaucaaugaguuuuagcugcauugcuauaggaaucauuacccuguauuuaggcgccgugguucaggcagacauggguugugucaucaauuggaaggggaaagagcugaagugcggauccggcauuuucgugacuaacgaggugcacacauggaccgaacaguacaaguuucaagccgauucucccaaacgccuagcuacugccaucgcaggugcuugggagaauggcgucugugggauaagaagcaccacaaggauggaaaaccuccuguggaagcagaucgccaaugagcuuaacuauauuuugugggaaaauaacaucaaacugacgguuguggugggagacauuaucggcguacucgagcaggggaagcggacccugacuccacagccuauggaguuaaaauacucauggaagacauggggaaaagcgaagauagucaccgccgaaacacaaaacaguuccuucauuaucgauggccccaauacuccagagugccccagcgcuucucgcgcauggaacgugugggaaguugaggacuaugguuuugggguguucaccacgaauauuuggcugaagcuuagagaagucuacacacaguugugugaccauaggcucaugucagccgcugugaaagaugagcgugccguucacgcagacaugggauacuggaucgagagucagaagaacggcagcuggaaacuggaaaaggcgucccuaauagaggugaaaaccugcacuuggccuaagucucacacccuguggucgaaugguguacucgaaagcgauaugaucauuccaaagucccuggccggcccgaucucacagcauaaccaccggcccggguaucauacacaaacugcuggaccuuggcaccuuggcaaauuggagcuggacuuuaauuacugcgaggggaccacagucgugauuacggaaaacuguggaacccgaggcccaaguuuaagaacuacaaccgugucugguaagcucauccacgaguggugcuguaggagcugcacucugcccccucuucgcuauaugggggaagauggauguugguacggcauggagauacggccaauuuccgaaaaagaggagaauauggucaagucacugguuagcgccgguucuggcaaaguggacaacuucacaauggggguauugugccucgcaauccuguuugaagaggugaugagaggaaaguucggcaagaaacauaugaucgcuggggucuucuuuaccuucgugcuacugcucuccggacagauuacguggagggauauggcccacacucugaucaugauuggcaguaaugcaagcgaccgcauggguauggggguuaccuaucuugccuugauagcuacauuuaagauccagcccuuccuggcguuaggauuuuuccuccgaaaacugaccucucgggaaaaccuucugcuaggcgugggccucgccauggcaacuacacugcaauugccggaggauauugaacagauggcuaaugggaucgcccugggauuaauggcccucaagcugauuacccaguuugagacauaccagcuuuggacugcucugaucuccuugaccuguucaaacacgauguucacacucaccgucgcauggcguacugccacccugauacuagcgggugugagucugcuuccuguuugccaaagcucguccaugagaaaaacagacuggcucccaauggcuguggccgcaaugggcguccccccucugcccuuguuuaucuucucucugaaggauacuuuaaagaggcgcagcuggccacucaaugaggggguaauggccgugggacugguuucaauucuugcuaguucccuguugcggaacgacgugccuauggcaggcccccucgucgccggugggcugcuaaucgcguguuaugugauuaccggaacgucugcugaucugacaguagaaaaagccgcagacaucaccugggaggaagaggccgaacagacuggcgugagccauaaccuuaugauaacagucgacgaugacggcaccaugagaauuaaggaugacgagacugagaauauccucacaguucuguugaaaaccgcuuuacugaucguguccgggguguuuccauacucaauuccggccacgcuccuggucuggcacacuuggcagaagcagacccaaaggagcggagugcuuugggauguuccuagucccccagaaacacagaaagcagagcuggaagaggguguauaccgaauaaagcagcagggcaucuucgggaaaacccaagugggagucggcgugcagaaggaggguguuuuucauacaauguggcacgugacucgcggggcugucuugaccuauaacggaaagcggcuagaacccaauugggccucugugaaaaaggaccugauuuccuacggcggcggguggagacucagcgcgcaguggcaaaaaggagaggaaguacaggucaucgccguggagccugguaagaacccaaaaaauuuccagacgaugcccggcacauuccagacuaccacaggggaaauuggagcaaucgcucuggauuuuaagccuggcaccucggguucaccgauaaucaacagggaggggaagguugugggacuuuauggcaauggcgucgugacuaaaaacgggggauacguuucugguauugcccaaaccaaugcugagccagacggccccacaccugaauuagaggaagagauguucaagaaacguaaccugacgaucauggaucuccacccagggaguggaaagacucgcaaauauuugcccgcaauugugcgggaagccaucaagagaaggcugcgaacccucauacuggccccuacacgggucguggcugcggagauggaggaagcacuuaagggccugccgauucgcuaccagaccacugccacaaaauccgagcauaccgguagagaaaucguagacuugaugugccacgcuacguuuacuaugaggcuacugagccccgugcggguuccaaauuauaaccucaucauuauggaugaggcccauuucacagacccugcaucuaucgccgcucgaggguacauaagcaccagagucggaaugggcgaagcggccgcaauuuuuaugaccgcuacucccccaggcacagccgaugcauucccucaguccaaugcccccauccaggacgaggagcgcgacauuccagaaaggucauggaacagugggaaugaguggaucaccgauuuugcuggaaagacagugugguucgugccgagcauaaaagccgguaacgacauugcgaacuguuuacguaagaauggcaaaaaggucauccaacugucucggaagacuuuugauacggaauaccagaaaaccaagcuuaacgacugggauuucguagugacaacugacaucuccgagaugggggcaaauuuuaaagccgauagaguuauugacccuaggcgcugccugaagcccgugauccucaccgauggaccagagcgagucauuuuggcuggccccaugccugugacagccgcuucagcagcccagagacgggguaggguugggcgcaacccacagaaagaaaaugaccaauauauauucaccggccagccccugaacaaugaugaggaccacgcucauuggacugaagccaagaugcuccuggacaacaucaauacgccugagggaauuaucccggcacuuuucgaaccagagcgugagaagagugcggccaucgauggcgaauacagacuaaaaggggagagccggaagaccuuuguggaacugaugaggcgcggagacuugcccgucugguuagcucacaaaguggccuccgaggguauuaaguauacagaucgaaaauggugcuucgacggccagagaaacaaucagauacuggaagagaacauggauguagagaucuggacuaaggaaggggagaaaaagaagcuccggccuagguggcuggacgcacgcaccuacucugauccccuugcucugaaagaauuuaaggacuucgccgcaggaagaaaaucgauugcccucgauuuggugacagagaucggcaggguuccaagccaccuggcucaucggacccguaaugcgcuagacaaccuggucaugcuccacacuucagaacauggugggcgcgccuaucgacacgcaguggaggagcuuccugaaacaauggagacgcuguuauugcugggccucaugauucugcuuaccggaggcgcuaugcuguuucucaucuccgggaagggaauagguaaaacuaguaucggcuugauuugugugaucgccucuagcgggaugcuguggauggccgaaauucccuuacaauggaucgcauccgcuauaguccuagaguucuuuaugaugguucugcucauuccagagccugaaaagcagagaacaccgcaggauaaucaacuugccuacgugguaaucggaauucugaccuuggcggcuaucauagccgcaaacgagaugggccugcucgaaaccacaaagagggaccuggguaugucaaaagagcccgggguggucucuccaacuagcuaucuugauguggaccuccacccugccagugcuuggacgcuguacgcaguugccaccacagugaucacucccauguugcggcauaccauugaaaauuccacagcgaacgucagccuggcugccaucgcaaaccaggccguaguguuaaugggccuagacaagggauggccaauuucuaaaauggaucugggcguuccucuccuugcucuggggugcuacucacaggugaaucccuugacccugacugccgcaguccuccugcuuaucacgcacuaugcuauaauuggaccgggcuuacaggccaaggcgacacgcgaggcccaaaaaagaaccgcagcugguaucaugaagaacccaacuguggacgggaucaugaccauugaucuggacccugucaucuacgauuccaaguucgagaaacagcucggacaggugauguugcugguucuaugugccgugcagcugcuccuuaugaggacaaguugggcacugugcgaagcuuugacucuggccaccggccccauaacaacgcucugggaggguagcccaggcaaguuuuggaauaccacuauugccguaucgauggcgaacaucuuccgggggucuuaucuggcuggagcaggcuuagccuuuuccauuaugaaaagcguggggacaggaaagcgaggcaccgguucacaaggggaaacucuuggagagaaauggaagaagaaacugaaucagcucaguagaaaggaauucgaccuauacaaaaagucuggcaucacagaggucgaucgcaccgaggcuaaagaaggucugaagaggggcgagauaacgcaucacgccguuucccgggggagcgcaaaauugcagugguuuguggaacguaacauggucauccccgagggaagagugauugaccugggcugugggaggggaggcuggucauauuacugcgccggucucaagaagguaaccgaagugcgcggguauacaaaaggaggcccuggccaugaggagccgguucccaugaguacuuacggguggaauaucgugaagcuuaugagcggaaaagaugucuucuaccugccaccugaaaagugugacaccuugcugugcgauauuggugaguccucucccagcccuacaguggaagagucccggacuauccgaguccucaaaaugguggagccaugguuaaagaacaaucaguucuguauuaagguucugaaccccuauaugccuaccguaaucgaacaccuugagagacugcaaaggaaacacggcgggaugcuagugcgcaauccacucucacggaacucuacacaugaaauguacuggauaaguaauggaaccggcaacauugucgcuucggugaauaugguuagcagacuguugcugaaccguuuuacuaugacgcacaggcggcccacaaucgagaaggacguggaucucggugcggggacccgccaugucaacgccgaaccggagacuccuaauauggacgugaucggagagcgaauuaaaagaauaaaggaagagcacaacuccaccuggcacuaugacgaugaaaauccauacaaaacaugggcauaucauggcucuuacgagguaaaggcuacgggcucagccagcuccaugaucaacggggugguuaagcuucugaccaaacccugggacgucgugccuauggugacucagauggcaaugacagauaccacuccauucggacagcaaagggucuuuaaggaaaaaguugacacacggaccccccgcaguaugccggguacaagaagggugaugggcauuacugccgagugguuauggcgaacccuggggcggaauaagaaaccucguuugugcacgagagaggaauucaccaagaagguacgcacaaacgcugccaugggagcgguguuuacugaggaaaaucagugggauucugcaaaagccgcugucgaggacgaagauuucuggaagcucguggacagggagcgggagcugcacaaacuaggcaagugugguagcugcguuuauaacaugauggggaaaagagaaaagaaacuuggagaguuuggcaaggccaagggcucacgcgcaaucugguacauguggcugggggcuagguaccucgaauucgaggcccugggauuuuugaaugaggaucauugguucucccgagaaaacaguuauagcgguguggagggcgaagggcugcacaaacucggauacauucuucgggacaucucuaagauacccggcggugcuauguaugccgaugacaccgcagggugggacacaagaaucacugaggaugaccugcauaaugaagagaaaauuacccagcagauggauccagagcacaggcaauuagcgaacgccaucuuuaagcugacguaccagaauaaagucgugaagguacagcgcccuacacccaccggaacuguuauggacauuaucucccguaaggaucagcggggcucaggccaaguggggacauauggauugaacaccuucacuaauauggaagcucagcucauaagacagauggagggugaaggcguccugagcaaagccgaccuagagaacccacaccuucccgaaaagaaaauuacccaguggcuggagacaaaggggguggagaggcucaaacgcauggcaaucucgggagaugacugcguggucaagccuaucgaugaccgauuugcuaacgcccuguuggcauuaaaugauaugggcaagguucggaaagacauuccacaauggcagccgucuaaggguuggcaugauuggcagcaggugcccuucuguagucaccauuuccacgaacugauaaugaaagacgggagaaagcucguagugccuugcaggccacaagacgagcuuaucggacgcgccagaauuucccagggcgcgggcuggagccugcgggaaacggcuugucuagggaaagccuacgcacagauguggucacugauguauuuucacaggcgugaucuccgauuggccuccaacgcuaucugcucugccguccccgugcauuggguuccuaccagccgcacuacauggaguauucacgcacaucaccaauggaugaccacugaggacaugcugacaguguggaauagagucuggaucgaagauaacccauggauggaggacaagacccccgugacgacaugggagaauguaccuuaccuuggaaagcgggaagaucaguggugugguucccugauaggccucaccagcagggcuacuugggcccagaacaucccgaccgcgauucagcaaguucgcucuuuaaucgggaaugaggaauuccuggacuacaugccaucaaugaaaagauuucggaaggaggaggaaagugagggagcuauuugguga

SEQ ID NO: 15106 - RNA, 9873 nt, Artificial Sequence
  derived and/or modified CDS sequence (opt3) from DENV-3__JN406515__SS-prME
accagccugugccucaugaugaugcuucccgccacacuggcuuuccacuugacuucccgggacggagagccuagaaugaucguggggaagaacgaacggggaaaaucuuuacuguuuaagacggccucagguauuaauauguguaccuuaauugccauggaucucggcgagaugugcgacgauacagucacuuacaaauguccacugaucaccgaaguugagccggaagacauugauugcugguguaaccuuacaaguaccugggugacuuaugggacaugcaaucaggcgggagagcaucgccgagacaagcguagcguggcucuggcaccccacgugggcauggguuuggauaccagagcacagacguggauguccgccgagggggcuuggaggcaggucgaaaaaguggagacuugggcauuccggcauccuggauuuaccauccucgcccuguuccuggcucacuacauuggcacaucucucacucagaagguugugaucuuuauauuacugaugcuugucaccccaucgaugacaaugcgcugugugggcguagggaacagagacuucguugaaggauugucaggugccaccuggguggaugucgugcuggagcauggcgggugcgugacgacuauggcgaagaauaaacccacacuggacaucgagcuccagaagaccgaagcaacucaacuggccacacuuaggaaacuguguauugagggaaagaucaccaacgucacgaccgauagccggugcccuacacagggcgaagcuauuuugccagaggaacaggaccagaauuauguuuguaaacacacuuacguggaucgcgguugggggaacggaugcggccucuuuggcaaggggagucugguaaccugcgccaaguuccaauguuuagagcugaucgagggaaaagugguccagcacgaaaaucucaaguauacagugauaauuacuguucauaccggugaccagcaccaggugggcaacgagacacaaggggucaccgcagaaaucacuccccaggcuuccacgguggaggccauucuuccugaauacggaacacugggcuuggagugcucuccacgaaccggucucgacuuuaaugagaugauccugcucacuaugaaaaacaaggcguggaugguacauagacagugguucuuugaucugccgcuucccuggaccagcggggccacaaccgaaacuccuacauggaauaaaaaggagcuguugguuacguucaaaaacgcacacgcuaagaagcaagaaguggucgugcucggcucccaggagggagccaugcacaccgcucugacuggcgccacagaaauccagaccucagggggaacaaguauuuuugcaggucauuuaaaauguaggcugaagauggacaaacuagagcucaagggcaugagcuaugccaugugcucuaaugcuuucguccugaaaaaggagguguccgaaacucagcacgggaccauacuuaucaagguugaguacaaaggagaagaugcgccauguaagauucccuucucaacggaggacgagcaaggcaaagcacauaacggucgguugaucaccgccaacccugugguaacaaagaaagaagaaccagucaauauagaagcugagcccccguuuggggaaagcaacauuaucaucggcauuggagauaaggcccugaagaucaauugguacaaaaagggcaguucuauugggaaaauguucgaggcaacugcccguggagcucgcagaauggccauacucggugacaccgcaugggauuuuggcuccguagggggaguucugaacagccuuggcaagauggugcaccagaucuucgguucggcguauacagcucuguuuucuggggucuccuggauuaugaaaaucggcaucggaguguugcucacuuggauuggccuaaauucaaagaacaccaguaugagcuucuccugcauaguaaucgggauuaucacguuauaccugggagccgugguucaggcagacaugggcugugucauuaauuggaaggguaaagagcuaaagugcgggucuggaaucuuugugacaaacgaagugcauaccuggacugagcaguauaaauuccaagccgauagcccuaagaggcucgcuacagccauagcaggcgcuugggaaaauggugucuguggcauccggucaaccacucgaauggagaaccugcuuuggaaacagauugccaaugaauugaacuacauccugugggagaauaacauuaagcucaccguuguggugggggacaucauaggaguacuggagcagggcaaacgcacauuaacgccccagccaauggaacugaaguauaguuggaagaccugggggaaagcgaagauugucacugccgagacacaaaauuccagcuuuaucauugauggaccuaacacccccgaaugcccaaacgcuucuagagcauggaaugugugggagguugaagacuacggcuucgguguguuuacaacuaacaucuggcuuaaauugagggagauguauacccagcucugugaccaccggcugaugucagccgcugucaaggaugagcgcgccgugcacgcagacaugggguacuggauagaaagucagaaaaauggaagcuggaagcuagagaaggcgucccugaucgaaguuaaaacgugcacauggcccaagucucauacccucuggucgaacggcgugcuggagagcgauaugauuaucccuaaaucccuugccgguccaauuucacagcacaauuacagaccgggcuaucauacucaaaccgcugggcccuggcacuugggaaagcuggaguuagacuucaacuacugcgaaggcacaacuguagucaucaccgagaauugugggacaaggggaccuagucuccguacgaccacugugucuggcaaacugauacacgaauggugcugucggagcugcacacuuccaccccugcgauauaugggugaggauggguguugguacggaauggaaauuagaccuaucaacgagaaggaggaaaauauggugaaguccuuggucucagccggcagcgguaaaguugacaacuuuaccaugggcgugcucugccuggcaauccuauucgaggaaguaaugagggggaaguucggcaagaagcauaugauugcuggcgugcuguuuacuuucguccuccugcuuucugggcagaucacauggcgcgauauggcccggaccuugauuaugauaggauccaaugcaagugacagaaugggcaugggugugacguaucuggccuuaaucgcuacuuuuaaaauucagccauuccucgcgcugggguuuuuccuuaggaagcugaccagccgcgagaaccuacuccugggaguuggcuuggccauggcaacaacccugcaauuacccgaagauguggagcagauggcuaauggcaucgcccucgggcugauggcccuuaagcugauuacucaguuugagacauaccaguuguggaccgcucucgucucucugauguguuccaacacaaucuucacucuaaccguggcauggcgaacggccacacugauacuugcgggaaucucacucuuuccgguuugccaaaguagcucgaugcggaaaaccgacuggcugccuaugacuguggcugccaugggugucccacccuugccucuguucauauuuuccuuaaaggauacccucaaacguagaucuuggccccugaaugaaggcguaauggcaguggggcuuguuagcauccuggccucaaguuugcucaggaacgacgugccaauggcuggaccucuggucgcaggcggucuacugauugccuguuaugugaucacagggacuuccgcggaucuuaccguagagaaggcugccgacgugacgugggaagaggaagcagagcagacaggagucucucacaaccucaugauaaccguugacgaugacggcacuaugcgcauuaaagaugacgagacagaaaauauccugaccguguuguuaaagacugcccugcucaucgugagcggcauuuuccccuacuccauaccagcuacacugcuugucuggcauaccuggcagaaacagacgcaacggucaggggugcugugggauguuccgagcccucccgagacucagaaggccgaauuggaggagggaguauacagaaucaagcagcaggguauuuuuggcaaaacccaagugggggucggagugcagaaggaaggcguuuuccacacaauguggcaugugaccaggggugcaguccuaacauauaacgggaaacgacuggagccaaauugggcuagugugaagaaagaccucaucucuuacggaggcggcuggcgccuguccgcccaguggcaaaagggggaagagguacaggucauugcgguggaacccggaaagaacccuaaaaauuuccagacuaugccagguaucuuucagaccacgacaggcgagauaggggccaucgcacuugauuucaagcccggaacuagcggcucgccuauuaucaaccgggaggguaaaguugugggguuauauggaaauggcgucgugaccaagaacggcggguacguuucaggaauugcucaaacaaaugccgaaccggacgguccaacccccgagcuggaagaggaaauguuuaaaaagagaaaccucacuaugauggauuugcacccuggcucugggaagaccaggaaauaucugccagcuaucgugcgugaggcaauaaagcgccggcucagaacacugauucuugcccccacgagggucguggccgcugagauggaagaggcgcugaaaggauugccuauccgauaccagacuaccgcaacaaagagugaacacaccggcaaagagaucguagaccuaaugugccaugccacuuucacaaugcggcugcucuccccggugcgcguucccaauuauaacuuaauuaucauggaugaagcucacuuuaccgacccagccagcauagcagccagagguuacauuucuacgagggucgggaugggagaggcugcggccaucuucaugacugcaacaccucccggcaccgcugaugccuuuccacagagcaaugcaccuauucaggacgaggaacgggacauccccgagcgauccuggaacucaggcaaugauuggauaaccgacuucgccgggaagacugugugguuugugccaaguauuaaggcuggaaacgauaucgccaacugucugaggaaaaaugguaagaaagucauccaacuuagccgcaagacauucgacaccgaauaccagaaaacaaagcugaacgauugggacuuuguagugacuacggauauuucugagaugggcgcgaauuucaaggcagacaggguuaucgauccgcgucggugccucaaaccugugauuuugaccgacgggcccgagagagucauacuggccggaccaaugcccgugacaguugcuuccgccgcucagaggcgcggccgaguggguagaaacccucagaaggaaaaugaucaauauaucuucacugggcagccacucaacaaugacgaggaccaugcacacuggaccgaagccaaaaugcugcuugauaacauuaauacacccgagggcaucaucccugcucuauuugaaccggagcgggagaagucagccgcaauugacggagaauacaggcugaaaggcgagagucgcaagaccuucgucgaauugaugcguagaggggauuuaccaguguggcuggcgcauaaaguagccagcgagggaauaaaguauacugaccggaaguggugcuuugauggugaaaggaacaaucagauccucgaggagaacauggacguggaaauuuggacgaaagagggcgaaaagaaaaagcugcgcccccgauggcuugaugcuagaaccuacuccgacccucuggcccucaaagaguucaaggauuuugcagcugggcggaagucuaucgccuuggaccugguuacagaaauuggaaggguccccucgcaccuagcacaccgcacuagaaaugcccuggauaaccucgugaugcuucauaccagcgagcacggcgguagggcuuaucggcaugcgguggaggaacugccagagacaauggaaaccuuauugcugcucgggcugaugauccuucugacuggcggagccaugcuauucuugauaucaggcaaaggggucggaaagacauccaucggucugauuuguguuguggcaaguucuggcauguuauggauggcugacaucccucuacaguggauugccagcgccaucguacuggaguuuuucaugauggugcuccuuauacccgagccagaaaaacaacguacgccucaggauaaucagcuggcauacgucgugauugggaucuugacccuggcugccauuguugcggcuaacgagaugggacuccuggaaacuacaaagcgcgaccuuggcauguccaaagagccggguguggucucacccaccucuuaucucgacguagaucugcacccagccagcgcauggaccuuguacgccguggcuacaacuguuaucacgccuaugcugcgacacaccauagaaaauaguacagcaaacguguccuuagccgcgaucgcuaaccaagccgucgugcuaauggggcuggacaagggcuggcccauuagcaagauggaucucggagucccacuucuggcauugggcugcuacucucaggugaauccucugacucucaccgccgcuguucugcuuuuagugacacauuaugccaucauugggcccggacugcaggcaaaagcuaccagagaggcccagaagaggacugcggccggcaucaugaaaaacccgacgguagacgguauaaugacaauugaucucgacccagugaucuacgauucaaaguuugagaaacaauuggggcaggucaugcugcuaguucugugugcagugcagcuccuucugaugcggaccuccugggcuuucugcgaagccuugacucuggcaaccggaccuaucacaacucucugggagggcagucccgguaaguuuuggaauaccacaauugcugucagcauggccaacaucuuccgcggcucguaucuggccggggcgggauuagcuuuuucuauaaugaaguccgugggcacggggaaaagaggaaccggcagccagggugaaacucuuggggagaaguggaaaaagaaacugaaucaacucucaaggaaggaguucgaccuauacaaaaagaguggaauuacagagguagaucggaccgaggcaaaggaaggccugaaacgaggugagaucacucaccaugccgugucuagaggcuccgcuaaguugcagugguucguugaacgcaacauggugauuccagaggggagggucaucgaccugggauguggcagagggggauggagcuauuacugcgccggccucaaaaaggugacagaaguccgugguuauaccaaagggggacccggccacgaggagccugugccgaugucaacguacggcuggaauauaguuaaacuuaugagugggaaggauguauuuuaccugcccccagaaaaaugugacaccuugcugugcgauaucggagagagcuccccuucucccacaguggaagagagcagaacuauuaggguccucaagaugguggagccuugguugaaaaacaaucaguucuguaucaagguucugaacccauauaugcccaccgugauugaacaucuugagcgccugcagcggaaacacgguggcaugcuaguccgaaauccucucuccagaaacucaacacacgaaauguacuggaucucuaaugggacuggaaacauugugaguucgguaaauauggugagcaggcuguugcugaaccgcuuuaccaugacauaucggagaccaaccaucgagaaggacguugaccucggcgcagguacucgucaugucaacgccgaacccgagacgccgaauauggaugugauaggggagaggauucggcgcaucaaggaggaacacuccucuacauggcauuacgacgaugaaaacccuuauaaaaccugggcuuaccacggaucauaugaggugaaggcgacuggcagcgccuccaguaugaucaauggcgucguuaaacuucugaccaagccaugggacgugguacccacagugacgcaaauggcaaugaccgauacuacaccuuucgggcagcagcgagucuuuaaagaaaagguggacaccagaacuccaaagcccaugccgggaacaaggaaaguuauggagauuaccgcugagugguuauggcggacacugggucgcaacaagagaccuagguugugcacucgagaagaguucaccaaaaaggugcggacgaaugccgcaaugggcgccgucuuuaccgaagagaaccaaugggauucugcucgugccgcgguggaagacgaggaguucuggaaacucguagauagagaacgcgagcugcacaagcuagggaaauguggaagcugcguuuacaauaugaugggcaagagggaaaagaaacuuggugaguuugggaaggcaaaaggaucacgggccauaugguacauguggcugggcgcuagauaucucgaguucgaagcccugggcuuuuugaacgaggaccauugguucucccgcgaaaauaguuacagcgggguggagggagaaggucugcacaagcucggcuauauccuuagggauauuucuaaaauccccgggggagcaauguacgcugacgacacagccggcugggauacucgaauuaccgaggacgaucugcauaacgaggaaaagaucacacagcagauggacccagagcaccggcaguuagcuaaugccauauuuaagcugacuuaucaaaacaaagucgugaaggugcagagaccuacccccaaagguacggucauggauaucauuuccaggaaggaccagcgcgggucaggacagguuggcacauacggcuugaauaccuucacuaacauggaagcacaacucauccgucagauggagggggaaggagugcugagcaaaacagaucuagagaauccacaucuucuggagaagaagauuacccaguggcucgaaacuaaagguguagagcggcugaagagaauggcgaucucgggcgacgauugcguggucaaacccauagacgauagguucgccaacgcuuuguuagcccugaacgacauggggaaggugcgcaaagauauuccucaguggcaaccaucuaagggauggcacgacuggcagcagguuccguuuuguagucaccauuuccacgaacucaucaugaaggacggccgaaaacuugugguccccugccggccucaggaugagcugaucgguagagcaaggauuucccaaggggcuggauggagccuaaaggaaaccgccugucugggcaaagcauaugcccagaugugggcgcucauguacuuucaucgcagagacuugcggcuggcuucaaaugccauaugcuccgcagugccaguacacuggguucccacaucuaggacgaccuggagcauccacgcccaucaccaguggaugacuacagaggauaugcuuaccguguggaaccgugucuggauugaggacaauccuuggauggaagauaaggcuccagugacuacaugggaggacguucccuaccugggcaaacgagaagaucaauggugugggagucucaucggauuaaccucccgcgccacgugggcacagaacauucugacagcuauccaacaggugagaagccuaauagguaaugaggaguuccuggacuauaugccuucuaugaagcgguuuaggaaggaagaggaaucagagggcgccaucugguga

SEQ ID NO: 15107 - RNA, 9873 nt, Artificial Sequence
  derived and/or modified CDS sequence (opt3) from DENV-3__JN406514__SS-prME
accagccugugccucaugaugaugcuucccgcaacacuggcuuuccacuugacuuccagagacggcgaaccuaggaugaucguggggaagaacgaacggggaaaaucuuuacuguuuaagacggcaucagguauuaauauguguacccuaauagccauggaucucggcgagaugugcgacgauacagucacuuacaaauguccacugaucgcggaaguugagccggaagacauugauugcugguguaaccuuaccaguacaugggugaccuaugggacuugcaaucaggcuggagagcaucgccgagacaagcguagcguagcccuggcaccccacgugggcauggguuuggauacaagaacccagacguggauguccgccgagggggcuuggaggcaggucgaaaaaguggagacuugggcacuccggcauccuggauucaccauccuggcccuguuucucgcucacuacauuggcacaucuuuaacucagaagguugugaucuucauacugcuuauguuggucaccccaucgaugacaaugcgcugugugggcguagggaacagagacuuuguugaaggacugucaggugccaccuggguggaugucgugcuagagcauggcgggugcgugacgacuauggcgaagaauaaacccacacucgacaucgagcugcagaagaccgaagcaacucaacuugccacacugaggaaauuguguauugagggaaagaucaccaacauuacgaccgauagccggugcccuacacagggcgaagcuauccucccagaggaacaggaccagaauuaugucuguaaacacacuuacguugaucgcgguugggggaacggaugcggccuguucggcaaggggaguuuagugaccugcgccaaguuucaaugucuggagcccauagagggaaaaguagugcaguaugaaaaucucaaguacacagucauuaucacugugcacaccggugaccagcaucagguuggcaacgacacacaaggggugaccgucgagauuacuccucaggcauccacgguggaagcuguacuuccagaguauggaacacugggcuuggaaugcucuccgcgaaccggucuagauuucaaugagaugauccugcucacuaugaaaaacaaggccuggaugguucacagacagugguuucuggaccuuccccugccuuggaccagcggggcgacaaccgagaggccaacuuggaaucggaaagaauugcucgugacauucaagaacgcccaugcaaagaaacaagaggucgugguccugggcucccaggaaggagcuaugcacacggccuuaaccggcgcuacugagauccaaaauucagggggaacaaguauuuuugccggucaccugaagugucgucuaaaaauggauaagcucgaacugaaaggcaugagcuacgcaaugugccuuaacaccuucguguugaagaaagagguuucugagacacagcaugggacuauacugaucaagguggaauacaagggagaggacgcccccuguaaaauuccuuuuuccaccgaagauggccaagguaaggcucacaacgggcgccucaucacggcgaauccaguagucaccaaaaaggaggagcccgugaacauagaagcagagccgccuuucggcgaaucaaauauuguuaucggaaucggcgacaaagcccugaagauuaacugguauaagaaagggagcaguaucggaaagauguucgaggcuacagccagaggugcaaggcggauggccauucuuggcgauacugcuugggacuuugggucugugggaggcguccuaaauuccuuggguaaaauggugcaucagauauucgggagcgccuacaccgcacucuuuucgggcguaucuuggaucaugaagauuggaaucggcgugcuguuaacauggaucgggcugaacuccaaaaauacuucaaugaguuucagcugcauuguuauaggaaucauuacccuauaucucggcgcggucgugcaggcugauauggguugugugaucaacuggaaggggaaggaacugaaaugcggauccggcauuuuugucacgaaugagguucacacauggaccgagcaguacaaguuccaagccgacucucccaaacgacuugcaacugccaucgcuggugccugggaaaacggcgugugugggauacgcagcacaaccagaauggagaauuugcuguggaagcagaucgcaaacgaacucaauuauauucugugggagaacaauaucaaauuaacugugguagucggagauaccauuggcgugcuggaacaggggaagaggacacuuacgccacagccuauggaguugaaauacucauggaagaccuggggaaaggcuaaaaucguuacugccgagacacaaaacaguuccuuuauaauugacggccccaacaccccagaaugccccagcgcgucucgggccuggaaugugugggaggucgaagacuaugguuucgggguguuuucaacaaacaucuggcucaagcugcgcgagguuuacacucagaguugugaucauagacuaaugagcgcugcaauuaaagacgaaagggccgugcacgcugauaugggauacuggaucgagucccagaagaauggcucuuggaaacuggagaaggccucguucauagaaguaaagaccugcaucuggccuaaaagccacacgcucugguccaacgguguccuggagucagacaugauuaucccaaagagucuugcaggcccgauuucucagcauaaucaccgucccggguaucauacacaaaccgcgggaccuuggcacuugggcaaacuggaauuagauuuuaacuacugcgaggggacuaccguggugaucacagagaauuguggaacucggggcccaagccuccgaaccacaacggucuccgguaagcugauacacgaauggugcuguagaucaugcacccuucccccucugagguauaugggggaggacggauguugguacggcauggaaauucgcccaaucaacgagaaagaagagaauaugguuaagagcuuggugucugccgguuccggcaagguagauaacuucacuaugggggugcucugccuggcuauccuauuugaggaagucaugcggggaaaauucggcaagaaacauaugauugccggggugcuguucacauuuguucuccugcuuaguggacagaucaccuggagagacauggcacacacuuugauuaugauaggcagcaaugcuucugauaggauggguaugggggugacauaucuggccuuaaucgcaaccuucaagauucagcccuuucucgcccugggauucuuucuucgcaaacugacgucccgagagaaccuacuccugggcgucggcuuggcuauggcgacuacccugcaauuaccggaagacaucgagcagauggccaaugggauugcacucggacugaugacacuuaagcugaucacccaguucgaaacuuaccaguuguggacagcucucgugucacugaccuguaguaacacaauauuuacucuaaccguugccuggcggacggccacacugauccuugcuggugugagccuccugccuuugugccaaucguccucuaugcguaagaccgauuggcugccaaugacugucgcagccaugggcguacccccuuuaccccucuucauuuuuagccugaaagacaccccaaagagaaggucauggccucuuaaugagggggugauggcgguuggacuggugaguaucuuggcuuccucucuccugcgcaacgauguccccauggccggcccgcuaguagccggugggcugcuuauugccuguuauguaaucacaggaacuagcgcugaccucaccguggagaaagcagccgacgucacgugggaagaggaagcggagcagacaggcguuucccauaaccugaugauaaccguggaugacgauggcacuaugcggauuaaggacgaugaaacagagaauaucuugaccguguuacugaaaacugcucuccugaucgucucagggauuuucccauacagcauaccugccacacuucugguguggcacaccuggcagaagcagacgcaaagaaguggaguuuugugggacguacccucuccacccgagacucagaaagcagaacuagaggaagguguguacaggaucaagcagcagggcauuuuugggaagacccaagucggagugggcguucagaaagaggguguguuccauacaauguggcacgucacccgaggggccgugcugacacacaacggaaagcgccucgagccuaauugggcuuccgugaagaaagaucugaucagcuauggcggcggguggcggcuuucggcccaguggcaaaaaggagaagagguccaggugauugcaguugaaccagguaaaaaccccaagaauuuucagacuaugccuggcaucuuccagaccacgacaggggagauaggagcuaucgccuuagacuucaaaccgggcacuucagguucuccaauuaucaacagagaagggaagguggucggacuguacggcaauggcgugguuaccaaaaacgggggauaugugagugguauugcgcaaacaaaugccgagcccgauggcccuaccccagagcucgaagaggaaauguuuaagaaaaggaacuugacuaucauggaccugcaucccggguccggaaagacccguaaguaccucccugcaauaguccgcgaggcuauuaaacggagacugaggacacuuauccuggccccgacgcgagugguagcugcagaaauggaggaggccuugaagggccuacccauccgguaucagacuaccgccacaaaaagcgaacacaccggucgcgagauuguggaucugaugugccaugcuacuuucacaaugagacucuuaucuccaguuagggucccuaauuacaaccugaucauaauggacgaagcgcacuuuaccgaucccgcaagcauugccgcucggggguauaucuccacgcgagugggaaugggcgaggccgcagccauuuucaugacugcuacaccaccuggcaccgcggaagccuuuccccagucaaaugcaccaauccaggacgaggagagagacauaccggaacgcaguuggaacagcgggaaugaguggauuaccgauuucgugggaaagacugucugguuuguaccuucuaucaaagcugguaacgacaucgccaacugucuuaggaagaauggcaagaaagugauucaacugucccguaagacauucgauaccgaauaccagaaaacacggcucaacgacugggauuuuguugugacuacggacaucucagagaugggggcaaauuucaaggccgauagagucauugaccccaggcgcugcuugaaaccagugauacugaccgauggacccgagcgaguuauccucgcuggcccuaugccagugacagccgcgagugcagcccagagacgggguagggucgggcgcaacccccagaaggaaaaugaccaauacauuuuuacuggccagccucugaacaaugaugaggaccaugcucacuggaccgaagccaagaugcuucuagacaacaucaauacaccggagggaaucauuccagcucuguucgaacccgagcgugagaaaagcgcagccauagauggcgaauauagauugaagggggagucccggaaaaccuucguggaauuaaugaggcgcggagaccugccuguauggcucgcucacaagguggccucugaggguaucaaauacacugaucgaaaguggugcuuugacggcgaaagaaacaaucagauucuggaggagaacauggauguugaaaucuggacgaaagagggggaacggaagaaacuuaggccccgcuggcuggacgcaagaaccuauucggauccacucgcguugaaagaguucaaggacuuugccgcuggaaggaaaagcauugcccuggaucuagucacagaaaucggccgggugccuucacaucuggcacaccguacucgcaaugcucucgacaaccuugugaugcugcauaccuccgagcacggugggcgagccuacagacacgcagucgaggaauuacccgagacaauggaaaccuugcugcuccugggccuuaugauacugcucacuggaggcgccauguuguuccugaucagugggaagggaauugguaaaacaucuaucggcuuaauuuguguuaucgugagcuccgggaugcuauggauggcugauguaccacugcaguggauagcgucagccauugugcucgaguuuuucaugaugguccuucugaucccugagccggaaaagcaaaggacgccccaggacaaucaguuggcauaugugguuauuggaauccugacccucgcugccauaguggccgcaaacgagaugggccugcuugaaacuacaaagcgggaucucgguaugucuaaagagccaggggucguaagcccuaccaguuaccuggacguggacuugcaucccgcuuccgccuggacccuguaugcgguugcuacaacugugaucacgccaauguuacgccacaccauugaaaauagcacagccaacgucucucuagcagccaucgcuaaccaagcagugguccugaugggccucgauaagggauggccuauuucaaaaauggaccuuggcgugccccuguuggcccuggggugcuacucccagguuaauccgcucacucugaccgcggcugugcuuuuacugguaacacauuacgccaucauaggaccaggccuccaggcaaaggccaccagagaggcucagaaaaggacugccgcagguauuaugaagaacccuacgguggaugggaucaugacaaucgacuuggaucccgucauuuaugacaguaaguuugagaaacaacugggacagguuaugcuacuggugcucugugcuguccagcuucuguugaugcggaccagcugggcccugugcgaagcgcucacucuggccaccggcccaaucacaacuuuaugggaggguucgcccggcaaguucuggaauaccacaauagcagugucuauggcuaacauuuuucgaggguccuaccuugccggagcaggccuggcuuucagcaucaugaaaucaguagggacgggaagacgcggcaccgguagucagggggaaacucucggagagaaguggaaaaagaagcuaaaucaacugucuaggaaagaauuugauuuguauaagaaauccggcauuacagagguggaccggaccgaggccaaggaaggucugaaacguggcgagacuacacaccaugccguuagcagagggucagcgaagcuccagugguucguggaaaggaacauggucaucccugagggacgcgugauagaucuuggcugugggcggggaggcuggaguuacuauugcgcuggucugaaaaaggucaccgaagugcgaggguacacgaagggaggcccgggccacgaggagcccguuccaaugagcaccuauggguggaauaucguaaaauugauguccggaaaggacguguuuuaccugccucccgaaaaaugugauacacucuuaugcgacauuggugagucuagcccuuccccaacugucgaagagucaagaaccaucagggugcugaagaugguugagcccuggcuuaaaaacaaucaguucuguauuaaggugcugaacccuuacaugccaacagucaucgaacaccuagagcgccuccagcggaaguauggcgggaugcuggugagaaaucccuugucucguaacaguacucaugaaauguacuggauuucgaauggaaccggcaacaucguaagcuccgugaauaugguuucuaggcugcuccuuaaccgguucacaaugacccaccgccgaccgacuauagagaaagaugucgaccugggugcagggacgagacaugugaacgccgaaccugagacaccaaauauggacgugauuggagagaggaucaagcggaucaaagaggaacacucaagcaccuggcacuaugaugacgaaaaccccuacaagacuugggcuuaucauggcuccuacgaggucaaagccaccggcagugcaucuagcaugauuaaugggguugugaaguuacugacaaagccuugggauguagugccaauggucacgcaaauggccaugaccgacacuacacccuuuggacagcagcgcguguucaaagaaaagguugauaccagaacuccgaggccuaugcccgguacacgaaaagugauggagauaaccgcugagugguuguggcggacacucggccguaacaagaaaccaagacugugcacucgcgaagaguuuaccaagaaggucaggacgaaugcggccaugggggcaguguucaccgaagagaaccaaugggacucagcucgggccgcaguagaagaugaggaguuuuggaagcugguugacagagaacgcgagcuucacaagcugggaaaauguggcuccugcguguauaauaugauggguaagagggagaaaaagcucggggaguucggaaaagccaagggcagucgagcuaucugguacauguggcugggcgcccgguacuuggaguuugaagcgcugggguuccucaacgaggaucauugguuuagcagagaaaauucuuauuccggagucgagggugaaggccuucacaagcugggguacauuuuaagggacaucucaaaaauuccuggaggcgcaauguaugccgaugacacagcugguugggacacucgcaucaccgaggaugaccugcauaacgaggaaaagauaacacagcagauggaucccgagcacaaacaguuggccaaugcaaucuucaagcucacuuaccaaaacaaaguggugaagguccagcguccaacccccaaggggacgguuauggacauuaucagccggaaagaucagagaggaucgggccaggugggcacauaugggcugaauaccuuuacuaacauggaagcucagcuaguaaggcagauggagggagaaggugugcuuucuaaggccgaccuggagaauccucaccuccuggagaaaaagauuacacagugguuggaaaccaaaggcgucgagcgcuuaaagcgaauggcuaucaguggggaugacugcgugguuaagccaauagaugaccgguucgccaacgcacugcucgcgcuuaacgauaugggaaaagugagaaaggacauuccgcaguggcaacccuccaaaggcuggcaugauuggcagcaggucccuuuuuguagccaccauuuccacgaacugaucaugaaggacgguaggaagcuagugguaccaugccgcccccaggacgagcugaucgggagagcccggauuucacaaggagcuggcuggucccucaaggaaacugccuguuugggcaaggcauacgcucagauguggucucugauguauuuccacaggcgugaucuucgacuggccagcaaugcaauaugcagugccguuccugugcauugggucccaaccucccgcacaacguggagcauccacgcgcaucaccaguggaugaccacugaggacaugcucacaguguggaacagaguuuggauugaggauaaucccuggauggaagacaaaaccccugugacuacaugggaggaugucccguacuuagggaagcgggaagaccaaugguguggaucucugaucgguuugaccucaagggcuacgugggcccagaacauucugacagcaauccaacaggugcgcagucucauaggcgaugaggaguuucuugacuacaugccauccaugaaaagauuccggaaggaagaggaaagcgagggggccaucugguga

SEQ ID NO: 15108 - RNA, 9873 nt, Artificial Sequence
  derived and/or modified CDS sequence (opt3) from DENV-3__KT726340__SS-prME
accagccugugccucaugaugauccuuccagccgcucuggcauuccacuugacuuccagagacggcgaaccuaggaugauuguggggaagaacgaacggggaaaaucuuuacuguuuaagacugccucagguauaaauauguguacgcuaaucgcgauggaucucggcgagaugugcgacgauaccguaacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccagacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucaaaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagauguucccuguaaaaucccuuucuccacagaggacggccaagguaaggcucauaacgggcgucuuauaacugcgaauccagugguaaccaaaaaggaggaacccgucaacauugaggcagaaccgccuuucggcgagucaaauaucgugaucggaauuggcgauaacgccuugaaaaucaauugguauaagaaggggagcaguauuggaaaaauguuugaagcuacagcccgcggugcaagaaggauggccauacugggcgacacugcuugggauuucgggucuguuggaggcgugcucaacucccuggguaagaugguccaccagaucuuugggagcgccuacaccgcacuuuucucgggcgugucuuggguaaugaaaauuggaaucggcgugcuguugacguggaucgggcucaauuccaagaacacaucaaugaguuuuagcugcauugcgauaggaaucauuacccuguauuuaggcgcuguuguccaggccgacauggguugugugaucaauuggaaagggaaggagcugaagugcggauccggcauuuucgugacuaacgagguccauacauggaccgaacaguacaaauuucaagcagauucucccaagcggcuagccacugcuaucgccggugcaugggagaauggcguuugugggauacgaagcaccacacgcauggaaaaccuccuguggaaacagaucgcuaaugagcuuaacuauauuuugugggaaaauaacaucaagcugacgguggugguaggagacauuaucggcguccucgagcaggggaaaagaacccugacuccacagccuauggaguuaaaguacucauggaaaacauggggaaaggccaagauagugaccgcggaaacacaaaacaguuccuucauuaucgauggccccaauacuccagagugccccagcgccucuagggcuuggaacguuugggaaguggaggacuaugguuuuggggucuucaccacgaauauuuggcugaaacuucgggaaguguacacacaguugugugaccaccgccucaugucagcagccguuaaggaugagagagcugugcacgccgacaugggauacuggaucgagagucagaaaaacggcagcuggaagcuggaaaaagcaucccuaauagagguaaagaccugcacuuggccuaagucucauacccuguggucgaaugguguccucgaaagcgauaugaucauuccaaaaucccuggcgggcccgaucucacagcacaacuauaggcccggguaccauacacaaacugccggaccuuggcaccuuggcaaguuggagcuggacuuuaauuauugcgaggggaccacaguggugauuacggaaaacuguggaacccguggcccaaguuuacggacuacaaccgucucugguaaacucauccacgaguggugcugucgaagcugcacucugcccccucuuagauacaugggggaagauggauguugguauggcauggagauaaggccaauuuccgaaaaggaggagaauaugguuaaaucacuggugagcgcugguucuggcgaaguagacaacuucacaauggggguguugugccucgccauccuguuugaggaagucaugcgcggaaaguucggcaagaaacauaugaucgcagggguguucuuuaccuucguucuacugcucuccggacagauuacguggcgggauauggcucacacucugaucaugauuggcaguaaugccagcgacagaauggguaugggggugaccuaccuugcauugauagccacauuuaagauccagcccuuccuggcuuuaggauuuuuccucaggaaacugaccucucgcgagaaccuucugcuaggcgucggccucgcgauggccacuacacugcaauugccggaagauauugagcagauggcaaaugggaucgcucugggauuaauggcccucaagcugauuacccaguuugagacauaucagcuuuggacugcccugaucuccuugaccuguucaaacacgauauucacacucaccguggcuuggcgaacugcaacccugauccuagccgguguuagucugcuuccugugugccaaagcucguccaugcggaaaacagacuggcucccaaugacugucgcggcuaugggcguacccccucugcccuuguuuauuuucucucugaaggauaccuuaaagcguagaagcuggccacucaaugaaggggugauggccguuggacuggugucaauccuugcaaguucccuguugaggaacgacgucccuauggccggcccccucguggcuggugggcugcuaauugcauguuacguaaucacgggaacaucugccgaucugaccguggagaaagcggcugacgucacuugggaagaggaagccgagcagacaggcguuagccauaaccuuaugauaaccguggacgaugacggcacuaugcgcauuaaggaugacgagacagaaaauauccucaccgugcuguugaaaacggcauuacugaucgucuccgggauuuuuccauacucaauaccggccacucuccugguguggcacaccuggcagaagcagacacaacggagcggaguucuuugggauguaccuagucccccagagacccagaaagcugaacuggaggaggguguguauagaaucaagcagcagggcauuuucgggaaaacacaagucggagugggcguucagaaggaagguguguuucauacuauguggcacgucaccagaggggccguguugacguacaacggaaagcgacuagagcccaauugggcaucugucaagaaggaccugaucuccuauggcggcggguggcgccucagcgcucaguggcaaaaaggagaagagguccaggugauugccguugaaccugguaagaaccccaagaauuuccagacaaugcccggcacuuuccagaccacaaccggggagaucggagcgauagcccuggauuuuaagccuggcacuucggguucaccgaucauuaaccgggaggggaagguggucggacuuuacggcaauggcgugaucaccaaaaacgggggauauguuucugguauugcacaaacaaaugcugaaccagacggccccacgccugaguuagaagaggaaauguucaagaaaagaaaccugacuaucauggaucuccacccagggaguggaaagaccaggaaauacuugcccgccauagugcgugaggcuauuaagcgccggcugagaacacucauccuggcaccuaccagggucguggccgccgagauggaagaggcucuuaagggccugccgauccgauaucagacuacagcgaccaaauccgaacauacgggucgggagauuguagacuugaugugccacgcaacuuuuacaaugcgccuacugagccccgugagaguuccaaauuacaaccucaucauaauggaugaagcccauuucaccgacccugcuucuauugccgcaaggggguacaucagcacccgggucggaaugggcgaggccgcugcgauuuuuaugacugccacacccccaggcaccgcagaugcuuucccucaguccaaugcccccauccaggacgaggaacgagacauaccagagagaucauggaacagugggaaugaauggauuacagauuuugcaggaaagacugugugguucgugccgagcaucaaagccgguaacgacaucgcuaacuguuuacgcaagaauggcaaaaaggucauucaacugucuaggaagacguuugauaccgaguaucagaaaacaaaacuuaacgacugggauuucguagugacuaccgacaucuccgagaugggggccaauuuuaaagcggaucguguuauugacccucggagaugccugaagcccgugauacucacagauggaccagaaagggucaucuuggcaggccccaugccugugaccgccgcuucagccgcucagcgccgagguagaguugggcggaacccacagaaagagaaugaccaauacauuuucacuggccagccccugaacaaugaugaagaccacgcacauuggacggaggccaagaugcuccuggacaacaucaauaccccugaaggaaucauuccggcucuuuucgagccagagagggaaaagagugccgcaauagauggcgaguaucgccuaaaaggggaaagccguaagacauuuguggagcugaugagacggggagacuugcccgucugguuagcgcacaaaguggccuccgaagguaucaaguacacugauaggaaauggugcuucgacggccagcgcaacaaucagauucuggaggagaacauggauguagaaaucuggaccaaggagggggagaagaagaagcuccgaccuagauggcuggacgcucggacauauucugauccccuugcccugaaagaguuuaaggacuucgcagcuggaaggaaaucgauugcccucgauuuggugaccgaaaucggccgcguuccaagccaccuggcacauagaacuaggaaugcccuagacaaccuggucaugcuccacacaucagagcauggugggaaggcuuaccggcacgcgguggaggaacuuccugagacgauggaaacccuguuauugcugggccucaugauacugcuuacuggaggcgccaugcuguuucucaucuccgggaaaggaauugguaagacaaguaucggcuugauuugugugaucgcaucuagcgggaugcuguggauggcugagauacccuuacaauggauugccuccgccaucguccuagaguucuuuaugaugguucugcucauuccagaaccugagaagcagcguaccccgcaggauaaucaacuugcauaugugguaaucggaauacugaccuuggcugccaucauugcggcuaacgaaaugggccugcucgagacaacuaaacgcgaccuggguaugucaaaggaacccgggguggucucuccaacgagcuaccuugauguggaccuccacccugccagugcauggacccuguacgccguugcuacaacugugaucacccccauguugcgacauacaauugaaaauuccaccgcaaacgucagccuggccgcgaucgcuaaccaggccguaguguuaaugggccuagacaaaggauggccaauaucuaagauggaucugggcguuccucuccuugcacuggggugcuauucacaggugaaucccuugacucugacggccgcuguccuccugcuuauuacacacuacgccaucaucggaccgggcuuacaggcaaaagcuaccagagaggcccaaaagaggacugcggccgguauuaugaagaacccaaccguggacgggaucaugacaauagaucuggacccugucauuuaugauuccaaauucgagaagcagcucggacaggugauguugcugguucuaugugcagugcagcugcuccuuaugcggacaaguugggcucugugcgaggccuugacccuggcaacaggccccaucacgacccucugggaagguagcccaggcaaauuuuggaauacuacaauugcuguaucgauggccaacaucuuccgcgggucuuaccuggccggagcgggcuuagcuuuuuccauaaugaaaagcguggggaccggaaaaagaggcacugguucacaaggggagacacuuggagaaaaguggaagaaaaagcugaaucagcucaguaggaaagaguucgaccuauauaagaaaucuggcaucaccgaggucgaucggacggaagcaaaggagggucugaaacgaggcgaaauuacccaucacgccguuuccagagggagcgcuaaguugcagugguuuguggagcgcaacauggucauccccgaaggaagggugauugaccugggcugugggcggggaggcuggucauacuauugcgccggucucaagaaaguaacagaggugcguggguacacuaagggaggcccuggccaugaggaaccgguucccaugaguaccuacggguggaauaucgugaaacuuaugagcggaaaggaugucuucuaucugccaccugagaaaugugacacauugcugugcgauauuggugaauccucucccagcccuacuguggaggaguccagaaccaucaggguccucaagaugguggaaccaugguuaaagaacaaucaguucuguauaaaaguucugaaccccuacaugccuacaguaguggagcaccuugaacgccugcaacggaagcacggcgggaugcuaguccgaaauccacucucaagaaacucuacccaugagauguauuggauuaguaauggaacuggcaacaucguggcaucgguuaauauggugagcaggcuguugcugaaccgcuuuacgaugacacaccggagacccaccaucgaaaaagacgucgaucucggugccgggacucgucaugugaacgcugagccggagaccccuaauauggacguaauuggagaaaggauaaagcggaucaaagaggaacacaacuccacauggcacuacgacgaugagaauccauauaagacgugggcguaccauggcucuuaugaagugaaggccaccggcucagcaagcuccaugauuaacgggguugucaaacuucugacuaagcccugggacguggugccuauggucacacagauggcuaugaccgauacuacaccauucggacagcaacgcguuuuuaaagagaagguggacacccgaacacccagaaguaugccggguacuaggcggguaaugggcaucaccgccgagugguuauggcgcacgcuggggagaaauaaaaagccuagguugugcacccgagaagaguucacaaagaaagugcggacuaacgcagccaugggagcugucuuuaccgaagagaaucagugggauucugccaaggcggcaguggaagacgaggauuucuggaaacucguugaccgugagagagaacugcacaagcuaggcaaaugugguagcugcguguacaacaugauggggaagcgcgagaagaaacuuggagaauuuggcaaagccaaaggcucaagggcuauuugguacauguggcugggggcccgguaucucgaguucgaggcacugggauuuuugaaugaagaucauugguucuccagagagaacaguuacagcggugucgaaggcgaggggcugcacaagcucggauauauccuucgcgacauaucuaaaauccccggcggugcuauguacgccgaugacacagcugggugggacacuaggauuaccgaagaugaccugcauaaugaggagaagaucacgcagcagauggauccagaacaccgacaauuagccaacgcaauuuuuaaacugacauaucagaauaaggugguaaagguucagcggccuacccccacuggaacagugauggacaucauauccagaaaagaucagaggggcucaggccaagucgggaccuacggauugaacacuuucaccaauauggaggcgcagcucauucgccagauggaaggugagggcgugcugagcaaggccgaccuagaaaacccacgucuucccgagaaaaagaucacacaguggcuggagacgaaagggguggaacggcucaagagaauggcuaucucgggagaugacugcgucguuaagccuauugaugacagguuugccaacgcacuguuggcuuuaaaugauaugggcaaagugcgcaaggacauaccacaauggcagccgucuaaagguuggcacgauuggcagcagguacccuucuguagucaucacuuccaugagcugaucaugaaggacgggcgaaaacucguggucccuugccggccacaagacgaacuuauuggaagggccaggaucucccagggcgcaggcuggagccugcgcgagaccgccugucuagggaaggcguaugcucagauguggucacugauguacuuucacagacgggaucucagguuggccuccaacgcaauuugcucugccgugcccguucacugggugccuacuagccguacaaccuggaguauccaugcucaccaucaauggaugacuacagaagacaugcugaccgucuggaaucgaguguggauagaggauaacccauggauggaggacaagacgcccaucacaaccugggaaaauguaccuuaccuuggaaaacgcgaggaucaguggugugguucccugauuggccucacuagcagagccaccugggcacagaacaucccgacagcuauucagcaaguucggucuuuaaucgggaaugaagaguuccuggacuauaugccaucaaugaagagguuucgcaaagaggaagagagugaaggagccauuugguga

SEQ ID NO: 15109 - RNA, 9873 nt, Artificial Sequence
  derived and/or modified CDS sequence (opt3) from DENV-3__KT726345__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucagaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagauguucccuguaaaaucccuuucuccacagaggacggccaagguaaggcucauaacgggcgucuuauaacugcgaauccagugguaaccaaaaaggaggaacccgucaacauugaggcagaaccgccuuucggcgagucaaauaucgugaucggaauuggcgauaacgccuugaaaaucaauugguauaagaaggggagcaguauuggaaaaauguuugaagcuacagcccgcggugcaagaaggauggccauacugggcgacacugcuugggauuucgggucuguuggaggcgugcucaacucccuggguaagaugguccaccagaucuuugggagcgccuacaccgcacuuuucucgggcgugucuuggguaaugaaaauuggaaucggcgugcuguugacguggaucgggcucaauuccaagaacacaucaaugaguuuuagcugcauugcgauaggaaucauuacccuguauuuaggcgcuguuguccaggccgacauggguugugugaucaauuggaaagggaaggagcugaagugcggauccggcauuuucgugacuaacgagguccauacauggaccgaacaguacaaauuucaagcagauucucccaagcggcuagccacugcuaucgccggugcaugggagaauggcguuugugggauacgaagcaccacacgcauggaaaaccuccuguggaaacagaucgcuaaugagcuuaacuauauuuugugggaaaauaacaucaagcugacgguggugguaggagacauuaucggcguccucgagcaggggaaaagaacccugacuccacagccuauggaguuaaaguacucauggaaaacauggggaaaggccaagauagugaccgcggaaacacaaaacaguuccuucauuaucgauggccccaauacuccagagugccccagcgccucuagggcuuggaacguuugggaaguggaggacuaugguuuuggggucuucaccacgaauauuuggcugaaacuucgggaaguguacacacaguugugugaccaccgccucaugucagcagccguuaaggaugagagagcugugcacgccgacaugggauacuggaucgagagucagaaaaacggcagcuggaagcuggaaaaagcaucccuaauagagguaaagaccugcacuuggccuaagucucauacccuguggucgaaugguguccucgaaagcgauaugaucauuccaaaaucccuggcgggcccgaucucacagcacaaccauaggcccggguaucacacacaaacugccggaccuuggcaccuuggcaaguuggagcuggacuuuaauuacugcgaggggaccacaguggugauuacggaaaacuguggaacccguggcccaaguuuacggacuacaaccgucucugguaaacucauccaugaguggugcugucgaagcugcacucugcccccucuuagauauaugggggaagauggauguugguacggcauggagauaaggccaauuuccgaaaaggaggagaauaugguuaaaucacuggugagcgcugguucuggcaagguagacaacuucacaauggggguguugugccucgccauccuguuugaagaggucaugcgcggaaaguucggcaaaaagcacaugaucgcagggguguucuuuaccuucguucuacugcucuccggacagauuacguggcgggauauggcucauacucugaucaugauuggcaguaaugccagcgacagaauggguaugggggugaccuaucuugcauugauagccacauuuaaaauccagcccuuccuggcuuuaggauuuuuccucaggaagcugaccucucgcgaaaaccuucugcuaggcgucggccucgcgauggccacuacacugcaauugccggaggauauugaacagauggcaaaugggaucgcucugggauuaauggcccucaaacugauuacccaguuugagacauaccagcuuuggacugcccugaucuccuugaccuguucaaacacgauauucacacucaccguggcuuggcgaacugcaacccugauccuagccgguguuagucugcuuccugugugccaaagcucguccaugcggaagacagacuggcucccaauggcggucgcugccaugggcguacccccucugcccuuguuuauuuucucucugaaggauacuuuaaaacguagaagcuggccacucaaugagggggugauggcaguuggacuggugucaauccuugccaguucccuguugaggaacgacgucccuauggcuggcccccucguggcaggugggcugcuaauugccuguuauguaaucaccggaacgucugcggaucugacaguggaaaaggcugccgacauaauuugggaggaagaggcagaacagaccggcgucagccacaaccuuaugaucacuguugacgaugacggcacaaugcgcaucaaagaugacgagaccgagaauauucucacugugcuguugaagacagccuuacugauaguguccgggaucuuuccauacucaauuccggcuacccuccuggucuggcauacguggcagaaacagacucaacggagcggagugcuuugggauguuccuagucccccagaaacccagaaggccgagcuggaagaggguguauacagaaucaaacagcagggcauuuucgggaagacacaagugggagucggcgugcagaaggaggguguuuuucacaccauguggcacgugacaaggggggcagucuugacucauaacggaaaacgacuagaacccaauugggcuucugugaagaaagaccugaucuccuauggcggcggguggcgccucagcgcccaguggcaaaagggagaggaaguacaggucauagcgguggagccugguaaaaacccaaagaauuuccagaccaugcccggcacguuccagacaacuaccggggaaaucggagccauugcacuggauuuuaagccuggcacaucggguucaccgaucauuaaccgggaggggaaaguugugggacuuuacggcaauggcgucgugaccaagaacgggggauauguuucugguaucgcucaaacuaaugccgagccagacggccccaccccugaauuagaggaagagauguucaaaaagagaaaccugacaauaauggaucuccacccagggaguggaaaaacgaggaaguacuugcccgcuauugugcgugaagcaaucaagcgccggcugagaacucucauccuggccccuaccagggucguggccgcugagauggaggaagcgcuuaaaggccugccgauucgauaucagacaaccgcaacuaaguccgagcauacaggucgggaaaucguagacuugaugugccacgccaccuuuacgaugcgccuacugagccccgugagaguuccaaauuacaaccucauaauuauggaugaggcucauuucacugacccugccucuaucgcagccaggggguauauuagcacacgggucggaaugggcgaagcugcggccaucuuuaugaccgcaacccccccaggcacugcugaugccuucccucaguccaaugcacccauacaggacgaggagcgagacauuccagaaagaucauggaacagugggaaugaguggaucacagauuuugccggaaaaaccgugugguucgugccgagcaucaaggcugguaacgacauugccaacuguuuacgcaaaaauggcaagaaggucauccaacugucuaggaaaacauuugauacugaauaccagaagacgaaacuuaacgacugggauuucguagugaccacagacauuuccgagaugggggcgaauuuuaaggcagaucguguuauagacccucggagaugccugaaacccgugauccucacugauggaccagagagggucauuuuggccggccccaugccugugaccgcugccucagcugcacagcgccgagguagaguugggcggaacccacagaaggaaaaugaccaauacaucuucacaggccagccccugaacaaugaugaggaccacgcccacuggaccgaagcuaagaugcuccuggacaacaucaauacuccugagggaauuauaccggcccuuuucgaaccagagagggagaaaagugcagcgaucgauggcgaauaucgccuaaagggggagagccguaaaacguuuguggaacugaugagacggggagacuugcccgucugguuagcccauaagguggcuuccgaggguauuaaauacaccgauaggaaguggugcuucgacggccagcgcaacaaucagauccuggaagagaacauggauguagagauuuggacaaaagaaggggagaagaagaaacuccgaccuagauggcuggacgcccggacuuauucugauccccuugcacugaaggaauuuaaagacuucgcugccggaaggaagucgaucgcacucgauuuggugaccgagauaggccgcguuccaagccaccuggcccauagaacaaggaaugcucuagacaaccuggucaugcuccacaccucagaacacggugggcgggcguaccgucaugccguggaggagcuuccugaaacuauggagacacuguuauugcugggccucaugauccugcuuacgggaggcgcaaugcuguuucucauuuccgggaaaggaaucgguaagaccaguauuggcuugaucugugugauagcuucuagcgggaugcuguggauggccgaaauucccuuacaauggaucgccuccgcaauuguccuagaguucuuuaugaugguucugcucaucccagagccugaaaagcagcgcacuccgcaggauaaucaacuugcuuaugugguaauaggaauccugacauuggccgcgauuaucgcugccaacgagaugggccugcucgaaaccaccaaacgagaccuggguaugucaaaggagcccgggguggucucuccaacaagcuaccuugauguggaccuccacccugcaagugccuggacucuguaugcuguugcaacgaccgugauuacacccauguugagacauacuaucgaaaauuccaccgccaacgucagccuggcggcuauagccaaccaggcaguaguguuaaugggccuagacaaaggauggccaauuucuaagauggaucugggcguuccucuccuugcccuggggugcuacucacaggugaaucccuugacacugaccgcugccguccuccugcuuaucacucacuacgcaaucauuggaccgggcuuacaggcuaaagccacgagggaggcgcaaaagcggacagccgcagguaucaugaagaacccaaccguggacgggauaaugacuauugaucuggacccugucaucuaugauuccaaauucgagaagcagcucggacaggugauguugcugguucuaugugcugugcagcugcuccuuaugcgcaccaguugggcccugugcgaagcauugacacuggcuacuggccccauuaccacacucugggaggguagcccaggcaaauuuuggaauacgaccaucgccguaucgauggccaacauauucagagggucuuaccuggcgggagcuggcuuagcauuuuccaucaugaagagcguggggacuggaaaaaggggcacagguucacaaggggaaacccuuggagagaaguggaagaaaaagcugaaucagcucagucggaaagaauucgaccuauauaagaaaucuggcauuacugaggucgaucgaacagaggccaaggaaggucugaaaagaggcgagaucacccaucacgcuguuucccgcgggagcgccaaguugcagugguuuguggaaaggaacauggucauucccgagggacgggugaucgaccugggcugugggcguggaggcuggucauacuauugcgcaggucucaagaaaguaacggaagugagaggguacaccaagggaggcccuggccacgaggagccgguucccaugaguacauauggguggaauauugugaaacuuaugagcggaaaggaugucuucuaccugccaccugaaaaaugugacacuuugcugugcgauaucggugaguccucucccagcccuaccguggaagaguccaggacaauacgcguccucaagaugguggagccaugguuaaagaacaaucaguucuguauuaaaguucugaaccccuacaugccuacuguaaucgaacaucuugagcggcugcaacgaaagcacggcgggaugcuagugagaaauccacucucaaggaacucuacccaugaaauguauuggaucaguaauggaacaggcaacauugucgccucggugaauaugguuagccgccuguugcugaaccgguuuaccaugacucacagacgucccacgauagagaaagacguggaucucggugcugggacaaggcacgucaacgcggaaccggagaccccuaauauggacgugaucggagagcggauuaagcgcaucaaagaagagcauaacuccacuuggcacuacgacgaugaaaauccauauaagaccugggccuaccauggcucuuaugagguaaaggcaacaggcucagcuagcuccaugauuaacggggugguuaaacuucugacgaagcccugggacgucgugccuauggugacccagauggccaugacugauacaaccccauucggacagcaacgagucuuuaaagaaaagguugacacuagaacacccaggaguaugccggguacccggcgcgugaugggcaucacagcagagugguuauggagaacucuggggaggaauaaaaagccucgauugugcacccgggaggaauucacgaagaaaguacguaccaacgccgcuaugggagccguguuuacagaggaaaaucagugggauucugcgaaggcagccgucgaggacgaagauuucuggaaacucguggacagagagcgcgagcugcacaagcuaggcaaaugugguagcugcguuuacaacaugauggggaagagggaaaaaaagcuuggagaguuuggcaaggcuaaaggcucacgggccauaugguauauguggcugggggcaagauaccucgaauucgaggcucugggauuuuugaaugaggaucauugguucucccgcgaaaacaguuacagcgguguggagggcgaagggcugcacaagcucggauauauccuuagggacauuucuaaaauccccggcggugccauguacgcugaugacacugccgggugggacacccgaauuacagaggaugaccugcacaaugaagagaagaucacucagcagauggauccagagcaucggcaauuagcaaacgcgauauuuaaacugaccuaucagaauaaggucgugaagguacagagaccuacgcccacaggaaccguuauggacauuaucuccaggaaagaucagcgcggcucaggccaaguggggacuuacggauugaacacauucaccaauauggaagcccagcucauccgucagauggagggugaaggcguccugagcaaggcugaccuagagaacccacaccuucccgaaaaaaagauuacucaguggcuggagaccaaagggguggagcggcucaagagaauggccauaucgggagaugacugcguggucaagccuaucgaugacagguuugcaaacgcucuguuggccuuaaaugauaugggcaaaguucgcaaggacauuccacaauggcagccgucuaaagguuggcaugauuggcagcaggugcccuucuguagucaccacuuccaugaacugaucaugaaggacgggcgaaaacucguagugccuugccggccacaagacgagcuuauuggaagagcaaggaucucccagggcgccggcuggagccugcgcgaaacagcgugucuagggaaggcuuaugcccagauguggucacugauguacuuucacagacgggaucucagguuggcauccaacgccauaugcucugcuguccccgugcauuggguuccuacgagccguaccacuuggaguauccacgcccaucaccaauggaugacaaccgaggacaugcugacuguguggaaucgagucuggauugaagauaacccauggauggaggacaagacacccgugaccacgugggagaauguaccuuaucuuggaaaacgcgaagaucaguggugugguucccugaucggccucacaagcagagcaaccugggcucagaacauuccgacugccauccagcaaguucggucuuuaauugggaaugaggaauuccuggacuacaugccaucaaugaagagguuucgcaaagaggaggaaagugagggagcgauaugguga

SEQ ID NO: 15110 - RNA, 9873 nt, Artificial Sequence
  derived and/or modified CDS sequence (opt3) from DENV-3__KT726349__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucagaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagauguucccuguaaaaucccuuucuccacagaggacggccaagguaaggcucauaacgggcgucuuauaacugcgaauccagugguaaccaaaaaggaggaacccgucaacauugaggcagaaccgccuuucggcgagucaaauaucgugaucggaauuggcgauaacgccuugaaaaucaauugguauaagaaggggagcaguauuggaaaaauguuugaagcuacagcccgcggugcaagaaggauggccauacugggcgacacugcuugggauuucgggucuguuggaggcgugcucaacucccuggguaagaugguccaccagaucuuugggagcgccuacaccgcacuuuucucgggcgugucuuggguaaugaaaauuggaaucggcgugcuguugacguggaucgggcucaauuccaagaacacaucaaugaguuuuagcugcauugcgauaggaaucauuacccuguauuuaggcgcuguuguccaggccgacauggguugugugaucaauuggaaagggaaggagcugaagugcggauccggcauuuucgugacuaacgagguccauacauggaccgaacaguacaaauuucaagcagauucucccaagcggcuagccacugcuaucgccggugcaugggagaauggcguuugugggauacgaagcaccacacgcauggaaaaccuccuguggaaacagaucgcuaaugagcuuaacuauauuuugugggaaaauaacaucaagcugacgguggugguaggagacauuaucggcguccucgagcaggggaaaagaacccugacuccacagccuauggaguuaaaguacucauggaaaacauggggaaaggccaagauagugaccgcggaaacacaaaacaguuccuucauuaucgauggccccaauacuccagagugccccagcgccucuagggcuuggaacguuugggaaguggaggacuaugguuuuggggucuucaccacgaauauuuggcugaaacuucgggaaguguacacacaguugugugaccaccgccucaugucagcagccguuaaggaugagagagcugugcacgccgacaugggauacuggaucgagagucagaaaaacggcagcuggaagcuggaaaaagcaucccuaauagagguaaagaccugcacuuggccuaagucucauacccuguggucgaaugguguccucgaaagcgauaugaucauuccaaaaucccuggcgggcccgaucucacagcacaaccauaggcccggguaucacacacaaacugccggaccuuggcaccuuggcaaguuggagcuggacuuuaauuacugcgaggggaccacaguggugauuacggaaaacuguggaacccguggcccaaguuuacggacuacaaccgucucugguaaacucauccaugaguggugcugucgaagcugcacucugcccccucuuagauauaugggggaagauggauguugguacggcauggagauaaggccaauuuccgaaaaggaggagaauaugguuaaaucacuggugagcgcugguucuggcaagguagacaacuucacaauggggguguugugccucgccauccuguuugaagaggucaugcgcggaaaguucggcaaaaagcacaugaucgcagggguguucuuuaccuucguucuacugcucuccggacagauuacguggcgggauauggcucauacucugaucaugauuggcaguaaugccagcgacagaauggguaugggggugaccuaucuugcauugauagccacauuuaaaauccagcccuuccuggcuuuaggauuuuuccucaggaagcugaccucucgcgaaaaccuucugcuaggcgucggccucgcgauggccacuacacugcaauugccggaggauauugaacagauggcaaaugggaucgcucugggauuaauggcccucaaacugauuacccaguuugagacauaccagcuuuggacugcccugaucuccuugaccuguucaaacacgauauucacacucaccguggcuuggcgaacugcaacccugauccuagccgguguuagucugcuuccugugugccaaagcucguccaugcggaagacagacuggcucccaauggcggucgcugccaugggcguacccccucugcccuuguuuauuuucucucugaaggauacuuuaaaacguagaagcuggccacucaaugagggggugauggcaguuggacuggugucaauccuugccaguucccuguugaggaacgacgucccuauggcuggcccccucguggcaggugggcugcuaauugccuguuauguaaucaccggaacgucugcggaucugacaguggaaaaggcugccgacauaaccugggaggaagaggcagaacagacuggcgucagccacaaccuuaugauuacaguugacgaugacggcaccaugcgcaucaaagaugacgagacugaguccauccucacagugcuguugaagaccgccuuacugauugugucagggauauuuccauacagcaucccggcuacgcuccuggucuggcauacuuggcagaaacagacccaacggaguggagugcuuugggauguuccuucucccccagaaacacagaaggccgagcuggaagaggguguauacagaauuaaacagcagggcaucuucgggaagacccaagugggagucggcgugcagaaggaggguguuuuucacacaauguggcacgugacuaggggggcagucuugacccauaauggaaaacgacuagaacccaacugggcuuccgugaagaaagaccugauuagcuauggcggcggguggcgccucucggcccaguggcaaaagggagaggaaguacaggucaucgcgguggagccugguaaaaauccaaagaacuuccagacgaugcccggcacauuccagacuaccacaggggaaauaggagccaucgcacuggauuuuaagccuggcaccucagguucuccgauuaucaaucgggaggggaaaguugugggacuuuacggcaacggcgucgugacuaagaaugggggauauguuagugguauugcucaaaccaacgccgagccagacggccccacaccugaauuagaggaagagauguucaaaaagagaaaucugacgaucauggaucuccacccaggguccggaaaaacuaggaaguacuugcccgcuauagugcgugaagcaauuaagcgccggcugagaacccucauccuggccccuacaagggucguggccgcugagauggaggaagcgcuuaaaggccugccgauccgauaucagaccacugcaacaaagagcgagcauaccggucgggaaauuguagacuugaugugccacgccacguuuacuaugcgccuacugucucccgugagaguuccaaacuacaaucucaucauaauggaugaggcucauuucacagacccugccagcauugcagccaggggguauaucuccacccgggucggaaugggcgaagcugcggccauuuuuaugaccgcaacucccccaggcacagcugaugccuucccucagucaaacgcacccauccaggacgaggagcgagacauaccagaaagaaguuggaauagcgggaacgaguggauuaccgauuuugccggaaaaacagugugguucgugccgucuaucaaggcugguaaugacaucgccaacuguuuacgcaaaaacggcaagaaggucauucaacuguccaggaaaacuuuugauacggaauaccagaagaccaaacuuaaugacugggauuucguagugacaacugacaucucagagaugggggcgaacuuuaaggcagaucguguuauugacccucggagaugccugaaacccgugauacucaccgauggaccagagagggucaucuuggccggccccaugccugugacagcugccagugcugcacagcgccgagguagaguugggcggaauccacagaaggaaaacgaccaauacauuuucaccggccagccccugaauaacgaugaggaccacgcccacuggacugaagcuaagaugcuccuggacaauaucaacacgccugagggaaucauuccggcccuuuucgaaccagagagggagaaaagcgcagcgauagauggcgaauaucgccuaaagggggagucccguaaaaccuuuguggaacugaugagacggggagacuugcccgucugguuagcccauaagguggcuucugaggguaucaaauacacagauaggaaguggugcuucgacggccagcgcaauaaccagauucuggaagagaauauggauguagagaucuggacuaaagaaggggagaagaagaaacuccgaccuagauggcuggacgcccggaccuauucggauccccuugcacugaaggaauuuaaagacuucgcugccggaaggaagagcauugcacucgauuuggugacagagaucggccgcguuccaucacaccuggcccauagaaccaggaacgcucuagacaaucuggucaugcuccacacuuccgaacacggugggcgggcguaccgucaugccguggaggagcuuccugaaacaauggagacgcuguuauugcugggccucaugauacugcuuaccggaggcgcaaugcuguuucucaucagugggaaaggaauugguaagacuucuaucggcuugauuugugugaucgcuagcuccgggaugcuguggauggccgaaauacccuuacaauggauugccucagcaaucguccuagaguucuuuaugaugguucugcucauuccagagccugaaaagcagcgcacaccgcaggauaaccaacuugcuuaugugguaaucggaauacugaccuuggccgcgaucauugcugccaaugagaugggccugcucgaaaccacaaaacgagaccuggguaugucuaaggagcccgggguggucagcccaacuaguuaccuugauguggaccuccacccugcauccgccuggacgcuguaugcuguugcaaccacagugaucacucccauguugagacauaccauugaaaacagcacagccaaugucucucuggcggcuaucgccaaccaggcaguaguguuaaugggccuagacaaaggauggccaauaucaaagauggaucugggcguuccucuccuugcccuggggugcuacucccaggugaaccccuugacccugacugcugccguccuccugcuuauuacgcacuacgcaaucaucggaccgggcuuacaggcuaaagccacaagggaggcgcaaaagcggaccgccgcagguauuaugaagaauccaacuguggacgggaucaugaccauagaucuggacccugucauuuaugauaguaaauucgagaagcagcucggacaggugauguugcugguucuaugugcugugcagcugcuccuuaugcgcacaagcugggcccugugcgaagcauugacucuggcuaccggccccaucacaacgcucugggaggguucgccaggcaaauuuuggaacaccacuauugccguaucuauggccaauaucuucagaggguccuaccuggcgggagcuggcuuagcauuuagcauaaugaagucaguggggacaggaaaaaggggcaccgguagucaaggggaaacucuuggagagaaguggaagaaaaagcugaaccagcucucucggaaagaauucgaccuauauaagaaauccggcaucacagaggucgaucgaaccgaggccaaggaaggucugaaaagaggcgagauuacgcaucacgcuguuagccgcgggucagccaaguugcagugguuuguggaaaggaauauggucauccccgagggacgggugauugaccugggcugugggcguggaggcuggaguuacuauugcgcaggucucaagaaaguaaccgaagugagaggguacacaaagggaggcccuggccacgaggagccgguucccaugagcacuuauggguggaacaucgugaaacuuauguccggaaaggaugucuucuaccugccaccugaaaaaugugacaccuugcugugcgauauuggugagucuagccccuccccuacaguggaagagucaaggacuauccgcguccucaagaugguggagccaugguuaaagaauaaccaguucuguauaaaaguucugaaucccuacaugccuaccguaauugaacaucuugagcggcugcaacgaaagcacggcgggaugcuagugagaaacccacucucuaggaauaguacacaugaaauguauuggaucucgaacggaaccggcaauaucgucgccagcgugaacaugguuucccgccuguugcugaaucgguuuacuaugacgcacagacgucccacaauugagaaagacguggaucucggugcugggaccaggcacgucaacgcggaaccggagacuccuaacauggacgugauaggagagcggaucaagcgcauuaaagaagagcauaauucuaccuggcacuacgacgaugaaaacccauauaagacaugggccuaccauggcucauaugagguaaaggcaacgggcagcgcuuccaguaugaucaauggggugguuaaacuucugaccaagcccugggacgucgugccuauggugacucagauggccaugacagauaccacuccauucggacagcaacgagucuuuaaagaaaagguugacacaagaacccccaggucuaugccggguacacggcgcgugaugggcauuacugcagagugguuauggagaacccuggggaggaacaaaaagccucgauugugcacgcgggaggaauucaccaagaaaguacguacaaaugccgcuaugggagccguguuuacugaggaaaaccagugggauagcgcgaaggcagccgucgaggacgaagauuucuggaaacucguggacagagagcgcgagcugcacaagcuaggcaaaugugguucaugcguuuacaauaugauggggaagagggaaaaaaagcuuggagaguuuggcaaggcuaaaggcucccgggccaucugguauauguggcugggggcaagauaccucgaauucgaggcucugggauuuuugaacgaggaucauugguucagucgcgaaaauagcuacucugguguggagggcgaagggcugcacaagcucggauauauacuuagggacaucuccaaaauucccggcggugccauguacgcugaugacaccgccgggugggacacacgaaucacugaggaugaccugcacaacgaagagaagauuacccagcagauggauccagagcaucggcaauuagcaaaugcgaucuuuaaacugacguaucagaacaaggucgugaagguacagagaccuacacccaccggaacuguuauggacauaauuucaaggaaagaucagcgcggcagcggccaaguggggacauacggauugaauaccuucacuaacauggaagcccagcucauccgucagauggagggugaaggcguccugucgaaggcugaccuagagaauccacaccuucccgaaaaaaagaucacccaguggcuggagacaaaagggguggagcggcucaagagaauggccauuucuggagaugacugcguggucaagccuauagaugacagguuugcaaacgcucuguuggccuuaaacgauaugggcaaaguucgcaaggacaucccacaauggcagccgaguaaagguuggcaugauuggcagcaggugcccuucuguucccaccacuuccaugaacugauuaugaaggacgggcgaaaacucguagugccuugccggccacaagacgagcuuaucggaagagcaaggauuagccagggcgccggcuggucacugcgcgaaacggcgugucuagggaaggcuuaugcccagauguggucccugauguacuuucacagacgggaucucagguuggcaucuaaugccaucugcagcgcuguccccgugcauuggguuccuaccagucguacuacaugguccauacacgcccaucaccaauggaugaccacugaggacaugcugacaguguggaaccgagucuggaucgaagauaauccauggauggaggacaagacccccgugacgacaugggagaacguaccuuaucuuggaaaacgcgaagaucaguggugugguagccugauuggccucaccucuagagcaacuugggcucagaauaucccgaccgccauucagcaaguucggucauuaaucgggaacgaggaauuccuggacuacaugccaaguaugaagagguuucgcaaagaggaggaauccgagggagcgauuugguga

SEQ ID NO: 15111 - RNA, 9873 nt, Artificial Sequence
  derived and/or modified CDS sequence (opt3) from DENV-3__KT726347__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacuggcgaugaaaaacaaggccuggauggugcauagacagugguuuuucgaucucccccugccuuggaccagcggggcaacaaccgaaacuccaacauggaauaggaaagagcuucugguaacguuuaagaacgcucacgccaaaaagcaagaaguuguggucuugggcucccaggagggagcuaugcacaccgcccucacuggcgcaacagaaauucagaauucagggggaaccaguauauucgccggucaucugaagugucgguuaaaaauggacaagcuggagcuaaaaggcaugagcuacgcuaugugcacaaacacuuuugugcucaagaaagaggucucugaaacccagcacgggacgauccugauuaagguggaguacaagggagaagauguucccuguaaaaucccuuucuccaccgaggacggccaagguaaggcgcauaacgggcgucuuauaacagcaaauccagugguaacuaaaaaggaggaacccgucaacauugaggccgaaccgccuuucggcgagucaaauaucgugaucggaauuggcgauaacgcuuugaaaaucaauugguauaagaaggggagcaguauuggaaaaauguuugaagccaccgcacgcggugccagaaggauggcuauacugggcgacacagccugggauuucgggucuguuggaggcgugcucaacucccuggguaagaugguccaccagaucuuugggagcgcauacacugcgcuuuucucgggcgugucuuggguaaugaaaauuggaaucggcgugcuguugaccuggaucgggcucaauuccaagaacacgucaaugaguuuuagcugcauugcuauaggaaucauuacacuguauuuaggcgccguuguccaggcagacauggguugugugaucaauuggaaagggaaggagcugaagugcggauccggcauuuucgugaccaacgagguccauacuuggacagaacaguacaaauuucaagccgauucucccaagcggcuagcuaccgccaucgcaggugcuugggagaauggcguuugugggauacgaagcacuacccgcauggaaaaccuccuguggaaacagaucgccaaugagcuuaacuauauuuugugggaaaauaacaucaagcugacaguggugguaggagacauuaucggcguccucgagcaggggaaaagaacgcugaccccacagccuauggaguuaaaguacucauggaaaacuuggggaaaggcgaagauagugacagccgaaacccaaaacaguuccuucauuaucgauggccccaauacaccagagugccccagcgcuucuagggcauggaacguuugggaaguggaggacuaugguuuuggggucuucacuaccaauauuuggcugaaacuucgggaaguguacacgcaguugugugaccaccgccucaugucagccgcuguuaaggaugagagagccgugcacgcagacaugggauacuggaucgagagucagaaaaacggcagcuggaagcuggaaaaagcgucccuaauagagguaaagacaugcaccuggccuaagucucauacucuguggucgaaugguguccucgaaagcgauaugaucauuccaaaaucccuggccggcccgaucucacagcacaaccauaggcccggguaucacacccaaacagcuggaccuuggcaccuuggcaaguuggagcuggacuuuaauuacugcgaggggacuaccguggugauuacagaaaacuguggaacgcguggcccaaguuuacggaccacuacagucucugguaaacucauccaugaguggugcugucgaagcugcacccugcccccucuuagauauaugggggaagauggauguugguacggcauggagauaaggccaauuuccgaaaaggaggagaauaugguuaaaucacuggugagcgccgguucuggcaagguagacaacuucacuauggggguguugugccucgcaauccuguuugaagaggucaugcgcggaaaguucggcaaaaagcacaugaucgcugggguguucuuuacauucguucuacugcucuccggacagauuaccuggcgggauauggcccauacgcugaucaugauuggcaguaaugcaagcgacagaauggguaugggggugacuuaucuugccuugauagcuaccuuuaaaauccagcccuuccuggcguuaggauuuuuccucaggaagcugacaucucgcgaaaaccuucugcuaggcgucggccucgccauggcaaccacucugcaauugccggaggauauugaacagauggcuaaugggaucgcccugggauuaauggcccucaaacugauuacacaguuugagaccuaccagcuuuggacagcucugaucuccuugacuuguucaaacaccauauucacgcucacaguggcauggcgaaccgccacucugauccuagcggguguuagucugcuuccugugugccaaagcucguccaugcggaagaccgacuggcucccaauggcugucgccgcaaugggcguacccccucugcccuuguuuauuuucucucugaaggauacauuaaaacguagaagcuggccacucaaugagggggugauggccguuggacuggugucaauccuugcuaguucccuguugaggaacgacgucccuauggcaggcccccucguggccggugggcugcuaauugcguguuauguaaucacuggaaccucugcugaucugacgguggaaaaggccgcagacauaacaugggaggaagaggccgaacagaccggcgucagccacaaccuuaugauuacuguugacgaugacggcacaaugcgcaucaaagaugacgagaccgagaauauccucacugugcuguugaagacagcuuuacugauuguguccgggauauuuccauacucaaucccggccacccuccuggucuggcauacguggcagaaacagacucaacggagcggagugcuuugggauguuccuagucccccagaaacccagaaggcagagcuggaagaggguguauacagaauuaaacagcagggcaucuucgggaagacacaagugggagucggcgugcagaaggaggguguuuuucacaccauguggcacgugacaaggggggcugucuugacucauaacggaaaacgacuagaacccaauugggccucugugaagaaagaccugauuuccuauggcggcggguggcgccucagcgcgcaguggcaaaagggagaggaaguacaggucaucgccguggagccugguaaaaacccaaagaauuuccagaccaugcccggcacguuccagacaacuaccggggaaauaggagcaaucgcucuggauuuuaagccuggcacaucggguucaccgauuaucaaccgggaggggaaaguugugggacuuuacggcaauggcgucgugaccaagaacgggggauauguuucugguauugcccaaacuaaugcugagccagacggccccaccccugaauuagaggaagagauguucaaaaagagaaaccugacaaucauggaucuccacccagggaguggaaaaacgaggaaguacuugcccgcaauagugcgugaagccauuaagcgccggcugagaacucucauccuggccccuaccagggucguggcugcggagauggaggaagcacuuaaaggccugccgauccgauaucagacaaccgccacuaaguccgagcauacaggucgggaaauuguagacuugaugugccacgcuaccuuuacgaugcgccuacugagccccgugagaguuccaaauuacaaccucaucauaauggaugaggcccauuucacugacccugcaucuauugccgcuaggggguauaucagcacacgggucggaaugggcgaagcggccgcaauuuuuaugaccgcuacccccccaggcacugccgaugcauucccucaguccaaugcccccauccaggacgaggagcgagacauaccagaaagaucauggaacagugggaaugaguggauuacagauuuugcuggaaaaaccgugugguucgugccgagcaucaaggccgguaacgacaucgcgaacuguuuacgcaaaaauggcaagaaggucauucaacugucuaggaaaacauuugauacugaauaccagaagacgaaacuuaacgacugggauuucguagugaccacagacaucuccgagaugggggcaaauuuuaaggccgaucguguuauugacccucggagaugccugaaacccgugauacucacugauggaccagagagggucaucuuggcuggccccaugccugugaccgccgcuucagcagcccagcgccgagguagaguugggcggaacccacagaaggaaaaugaccaauacauuuucacaggccagccccugaacaaugaugaggaccacgcucacuggaccgaagccaagaugcuccuggacaacaucaauacuccugagggaaucauuccggcacuuuucgaaccagagagggagaaaagugcggccauagauggcgaauaucgccuaaagggggagagccguaaaacguuuguggaacugaugagacggggagacuugcccgucugguuagcucauaagguggccuccgaggguaucaaauacaccgauaggaaguggugcuucgacggccagcgcaacaaucagauucuggaagagaacauggauguagagaucuggacaaaagaaggggagaagaagaaacuccgaccuagauggcuggacgcacggacuuauucugauccccuugcucugaaggaauuuaaagacuucgccgcaggaaggaagucgauugcccucgauuuggugaccgagaucggccgcguuccaagccaccuggcucauagaacaaggaaugcgcuagacaaccuggucaugcuccacaccucagaacacggugggcgggccuaccgucaugcaguggaggagcuuccugaaacuauggagacacuguuauugcugggccucaugauacugcuuacgggaggcgcuaugcuguuucucaucuccgggaaaggaauugguaagaccaguaucggcuugauuugugugaucgccucuagcgggaugcuguggauggccgaaauacccuuacaauggauugcauccgcuaucguccuagaguucuuuaugaugguucugcucauuccagagccugaaaagcagcgcacuccgcaggauaaucaacuugccuaugugguaaucggaauacugacauuggcggcuaucauugccgcaaacgagaugggccugcucgaaaccaccaaacgagaccuggguaugucaaaggagcccgggguggucucuccaacaagcuaccuugauguggaccuccacccugccagugcuuggacucuguaugcaguugccacgaccgugaucacacccauguugagacauacuauugaaaauuccaccgcgaacgucagccuggcugccaucgcaaaccaggccguaguguuaaugggccuagacaaaggauggccaauaucuaagauggaucugggcguuccucuccuugcucuggggugcuacucacaggugaaucccuugacacugaccgccgcaguccuccugcuuauuacucacuacgcuaucaucggaccgggcuuacaggccaaagcgacgagggaggcccaaaagcggacagcagcugguauuaugaagaacccaaccguggacgggaucaugacuauagaucuggacccugucauuuaugauuccaaauucgagaagcagcucggacaggugauguugcugguucuaugugccgugcagcugcuccuuaugcgcaccaguugggcacugugcgaagcuuugacacuggccacuggccccaucaccacacucugggaggguagcccaggcaaauuuuggaauacgaccauugccguaucgauggcgaacaucuucagagggucuuaccuggcuggagcaggcuuagccuuuuccauaaugaagagcguggggacuggaaaaaggggcacagguucacaaggggaaacccuuggagagaaguggaagaaaaagcugaaucagcucagucggaaagaauucgaccuauauaagaaaucuggcaucacugaggucgaucgaacagaggcuaaggaaggucugaaaagaggcgagauuacccaucacgccguuucccgcgggagcgcaaaguugcagugguuuguggaaaggaacauggucauccccgagggacgggugauugaccugggcugugggcguggaggcuggucauacuauugcgccggucucaagaaaguaacggaagugagaggguacaccaagggaggcccuggccacgaggagccgguucccaugaguacauauggguggaauaucgugaaacuuaugagcggaaaggaugucuucuaccugccaccugaaaaaugugacacuuugcugugcgauauuggugaguccucucccagcccuaccguggaagaguccaggacaauccgcguccucaagaugguggagccaugguuaaagaacaaucaguucuguauaaaaguucugaaccccuacaugccuacuguaauugaacaucuugagcggcugcaacgaaagcacggcgggaugcuagugagaaauccacucucaaggaacucuacccaugaaauguauuggaucaguaauggaacaggcaacaucgucgcuucggugaauaugguuagccgccuguugcugaaccgguuuaccaugacucacagacgucccacgauugagaaagacguggaucucggugcggggacaaggcacgucaacgccgaaccggagaccccuaauauggacgugauaggagagcggaucaagcgcauuaaagaagagcauaacuccacuuggcacuacgacgaugaaaauccauauaagaccugggcauaccauggcucuuaugagguaaaggcuacaggcucagccagcuccaugaucaacggggugguuaaacuucugacgaagcccugggacgucgugccuauggugacccagauggcaaugacugauacaaccccauucggacagcaacgagucuuuaaagaaaagguugacacuagaacacccaggaguaugccggguacccggcgcgugaugggcauuacagccgagugguuauggagaacucuggggaggaauaaaaagccucgauugugcacccgggaggaauucacgaagaaaguacguaccaacgcugccaugggagcgguguuuacagaggaaaaucagugggauucugcaaaggccgcugucgaggacgaagauuucuggaaacucguggacagagagcgcgagcugcacaagcuaggcaaaugugguagcugcguuuacaacaugauggggaagagggaaaaaaagcuuggagaguuuggcaaggccaaaggcucacgggcaaucugguauauguggcugggggcuagauaccucgaauucgaggcccugggauuuuugaaugaggaucauugguucucccgcgaaaacaguuacagcgguguggagggcgaagggcugcacaagcucggauauauacuuagggacaucucuaaaauucccggcggugcuauguacgccgaugacacugcagggugggacacccgaaucacagaggaugaccugcacaaugaagagaagauuacucagcagauggauccagagcaucggcaauuagcgaacgccaucuuuaaacugaccuaucagaauaaggucgugaagguacagagaccuacgcccacaggaaccguuauggacauaauuuccaggaaagaucagcgcggcucaggccaaguggggacuuacggauugaacacauucaccaauauggaagcucagcucauccgucagauggagggugaaggcguccugagcaaggccgaccuagagaacccacaccuucccgaaaaaaagaucacucaguggcuggagaccaaagggguggagcggcucaagagaauggcaauuucgggagaugacugcguggucaagccuauagaugacagguuugcuaacgcccuguuggcauuaaaugauaugggcaaaguucgcaaggacaucccacaauggcagccgucuaaagguuggcaugauuggcagcaggugcccuucuguagucaccacuuccaugaacugauuaugaaggacgggcgaaaacucguagugccuugccggccacaagacgagcuuaucggaagagccaggauuucccagggcgcgggcuggagccugcgcgaaacagcuugucuagggaaggccuaugcacagauguggucacugauguacuuucacagacgggaucucagguuggccuccaacgcuaucugcucugccguccccgugcauuggguuccuacgagccguaccacuuggaguauacacgcacaucaccaauggaugacaaccgaggacaugcugacuguguggaaucgagucuggaucgaagauaacccauggauggaggacaagacacccgugaccacgugggagaauguaccuuaucuuggaaaacgcgaagaucaguggugugguucccugauuggccucacaagcagagcuaccugggcccagaacaucccgacugcgauucagcaaguucggucuuuaaucgggaaugaggaauuccuggacuacaugccaucaaugaagagguuucgcaaagaggaggaaagugagggagcuauuugguga

SEQ ID NO: 15112 - RNA, 9873 nt, Artificial Sequence
  derived and/or modified CDS sequence (opt3) from DENV-3__KT726352__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucagaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagauguucccuguaaaaucccuuucuccacagaggacggccaagguaaggcucauaacgggcgucuuauaacugcgaauccagugguaaccaaaaaggaggaacccgucaacauugaggcagaaccgccuuucggcgagucaaauaucgugaucggaauuggcgauaacgccuugaaaaucaauugguauaagaaggggagcaguauuggaaaaauguuugaagcuacagcccgcggugcaagaaggauggccauacugggcgacacugcuugggauuucgggucuguuggaggcgugcucaacucccuggguaagaugguccaccagaucuuugggagcgccuacaccgcacuuuucucgggcgugucuuggguaaugaaaauuggaaucggcgugcuguugacguggaucgggcucaauuccaagaacacaucaaugaguuuuagcugcauugcgauaggaaucauuacccuguauuuaggcgcuguuguccaggccgacauggguugugugaucaauuggaaagggaaggagcugaagugcggauccggcauuuucgugacuaacgagguccauacauggaccgaacaguacaaauuucaagcagauucucccaagcggcuagccacugcuaucgccggugcaugggagaauggcguuugugggauacgaagcaccacacgcauggaaaaccuccuguggaaacagaucgcuaaugagcuuaacuauauuuugugggaaaauaacaucaagcugacgguggugguaggagacauuaucggcguccucgagcaggggaaaagaacccugacuccacagccuauggaguuaaaguacucauggaaaacauggggaaaggccaagauagugaccgcggaaacacaaaacaguuccuucauuaucgauggccccaauacuccagagugccccagcgccucuagggcuuggaacguuugggaaguggaggacuaugguuuuggggucuucaccacgaauauuuggcugaaacuucgggaaguguacacacaguugugugaccaccgccucaugucagcagccguuaaggaugagagagcugugcacgccgacaugggauacuggaucgagagucagaaaaacggcagcuggaagcuggaaaaagcaucccuaauagagguaaagaccugcacuuggccuaagucucauacccuguggucgaaugguguccucgaaagcgauaugaucauuccaaaaucccuggcgggcccgaucucacagcacaaccauaggcccggguaucacacacaaacugccggaccuuggcaccuuggcaaguuggagcuggacuuuaauuacugcgaggggaccacaguggugauuacggaaaacuguggaacccguggcccaaguuuacggacuacaaccgucucugguaaacucauccaugaguggugcugucgaagcugcacucugcccccucuuagauauaugggggaagauggauguugguacggcauggagauaaggccaauuuccgaaaaggaggagaauaugguuaaaucacuggugagcgcugguucuggcaagguagacaacuucacaauggggguguugugccucgccauccuguuugaagaggucaugcgcggaaaguucggcaaaaagcacaugaucgcagggguguucuuuaccuucguucuacugcucuccggacagauuacguggcgggauauggcucauacucugaucaugauuggcaguaaugccagcgacagaauggguaugggggugaccuaucuugcauugauagccacauuuaaaauccagcccuuccuggcuuuaggauuuuuccucaggaagcugaccucucgcgaaaaccuucugcuaggcgucggccucgcgauggccacuacacugcaauugccggaggauauugaacagauggcaaaugggaucgcucugggauuaauggcccucaaacugauuacccaguuugagacauaccagcuuuggacugcccugaucuccuugaccuguucaaacacgauauucacacucaccguggcuuggcgaacugcaacccugauccuagccgguguuagucugcuuccugugugccaaagcucguccaugcggaagacagacuggcucccaauggcggucgcugccaugggcguacccccucugcccuuguuuauuuucucucugaaggauacuuuaaaacguagaagcuggccacucaaugagggggugauggcaguuggacuggugucaauccuugccaguucccuguugaggaacgacgucccuauggcuggcccccucguggcaggugggcugcuaauugccuguuauguaaucaccggaacgucugcggaucugacaguggaaaaggcugccgacauaaccugggaggaagaggcagaacagacuggcgucagccacaaccuuaugauuacaguugacgaugacggcaccaugcgcaucaaagaugacgagacugagaauauccucacagugcuguugaagaccgccuuacugauuguguccgggauauuuccauacucaaucccggcuacgcuccuggucuggcauacuuggcagaaacagacccaacggagcggagugcuuugggauguuccuagucccccagaaacacagaaggccgagcuggaagaggguguauacagaauuaaacagcagggcaucuucgggaagacccaagugggagucggcgugcagaaggaggguguuuuucacacaauguggcacgugacuaggggggcagucuugacccauaacggaaaacgacuagaacccaauugggcuucugugaagaaagaccugauuuccuauggcggcggguggcgccucagcgcccaguggcaaaagggagaggaaguacaggucaucgcgguggagccugguaaaaacccaaagaauuuccagacgaugcccggcacauuccagacuaccacaggggaaauaggagccaucgcacuggauuuuaagccuggcaccucggguucaccgauuaucaaccgggaggggaaaguugugggacuuuacggcaauggcgucgugacuaagaacgggggauauguuucugguauugcucaaaccaaugccgagccagacggccccacaccugaauuagaggaagagauguucaaaaagagaaaccugacgaucauggaucuccacccagggaguggaaaaacuaggaaguacuugcccgcuauagugcgugaagcaauuaagcgccggcugagaacccucauccuggccccuacaagggucguggccgcugagauggaggaagcgcuuaaaggccugccgauccgauaucagaccacugcaacaaaguccgagcauaccggucgggaaauuguagacuugaugugccacgccacguuuacuaugcgccuacugagccccgugagaguuccaaauuacaaccucaucauaauggaugaggcucauuucacagacccugccucuauugcagccaggggguauaucagcacccgggucggaaugggcgaagcugcggccauuuuuaugaccgcaacucccccaggcacagcugaugccuucccucaguccaaugcacccauccaggacgaggagcgagacauaccagaaagaucauggaacagugggaaugaguggauuaccgauuuugccggaaaaacagugugguucgugccgagcaucaaggcugguaacgacaucgccaacuguuuacgcaaaaauggcaagaaggucauucaacugucuaggaaaacuuuugauacggaauaccagaagaccaaacuuaacgacugggauuucguagugacaacugacaucuccgagaugggggcgaauuuuaaggcagaucguguuauugacccucggagaugccugaaacccgugauacucaccgauggaccagagagggucaucuuggccggccccaugccugugacagcugccucagcugcacagcgccgagguagaguugggcggaacccacagaaggaaaaugaccaauacauuuucaccggccagccccugaacaaugaugaggaccacgcccacuggacugaagcuaagaugcuccuggacaacaucaauacgccugagggaaucauuccggcccuuuucgaaccagagagggagaaaagugcagcgauagauggcgaauaucgccuaaagggggagagccguaaaaccuuuguggaacugaugagacggggagacuugcccgucugguuagcccauaagguggcuuccgaggguaucaaauacacagauaggaaguggugcuucgacggccagcgcaacaaucagauucuggaagagaacauggauguagagaucuggacuaaagaaggggagaagaagaaacuccgaccuagauggcuggacgcccggaccuauucugauccccuugcacugaaggaauuuaaagacuucgcugccggaaggaagucgauugcacucgauuuggugacagagaucggccgcguuccaagccaccuggcccauagaaccaggaaugcucuagacaaccuggucaugcuccacacuucagaacacggugggcgggcguaccgucaugccguggaggagcuuccugaaacaauggagacgcuguuauugcugggccucaugauacugcuuaccggaggcgcaaugcuguuucucaucuccgggaaaggaauugguaagacuaguaucggcuugauuugugugaucgcuucuagcgggaugcuguggauggccgaaauacccuuacaauggauugccuccgcaaucguccuagaguucuuuaugaugguucugcucauuccagagccugaaaagcagcgcacaccgcaggauaaucaacuugcuuaugugguaaucggaauacugaccuuggccgcgaucauugcugccaacgagaugggccugcucgaaaccacaaaacgagaccuggguaugucaaaggagcccgggguggucucuccaacuagcuaccuugauguggaccuccacccugcaagugccuggacgcuguaugcuguugcaaccacagugaucacucccauguugagacauaccauugaaaauuccacagccaacgucagccuggcggcuaucgccaaccaggcaguaguguuaaugggccuagacaaaggauggccaauaucuaagauggaucugggcguuccucuccuugcccuggggugcuacucacaggugaaucccuugacccugacugcugccguccuccugcuuauuacgcacuacgcaaucaucggaccgggcuuacaggcuaaagccacaagggaggcgcaaaagcggaccgccgcagguauuaugaagaacccaacuguggacgggaucaugaccauagaucuggacccugucauuuaugauuccaaauucgagaagcagcucggacaggugauguugcugguucuaugugcugugcagcugcuccuuaugcgcacaaguugggcccugugcgaagcauugacucuggcuaccggccccaucacaacgcucugggaggguagcccaggcaaauuuuggaauaccacuauugccguaucgauggccaacaucuucagagggucuuaccuggcgggagcuggcuuagcauuuuccauaaugaagagcguggggacaggaaaaaggggcaccgguucacaaggggaaacucuuggagagaaguggaagaaaaagcugaaucagcucagucggaaagaauucgaccuauauaagaaaucuggcaucacagaggucgaucgaaccgaggccaaggaaggucugaaaagaggcgagauuacgcaucacgcuguuucccgcgggagcgccaaguugcagugguuuguggaaaggaacauggucauccccgagggacgggugauugaccugggcugugggcguggaggcuggucauacuauugcgcaggucucaagaaaguaaccgaagugagaggguacacaaagggaggcccuggccacgaggagccgguucccaugaguacuuauggguggaauaucgugaaacuuaugagcggaaaggaugucuucuaccugccaccugaaaaaugugacaccuugcugugcgauauuggugaguccucucccagcccuacaguggaagaguccaggacuauccgcguccucaagaugguggagccaugguuaaagaacaaucaguucuguauaaaaguucugaaccccuacaugccuaccguaauugaacaucuugagcggcugcaacgaaagcacggcgggaugcuagugagaaauccacucucaaggaacucuacacaugaaauguauuggaucaguaauggaaccggcaacaucgucgccucggugaauaugguuagccgccuguugcugaaccgguuuacuaugacgcacagacgucccgcuauugagaaagacguggaucucggugcggggacaaggcacgucaacgccgaaccggagaccccuaauauggacgugauaggagagcggaucaagcgcauuaaagaagagcauaacuccacuuggcacuacgacgaugaaaauccauauaagaccugggcauaccauggcucuuaugagguaaaggcuacaggcucagccagcuccaugaucaacggggugguuaaacuucugacgaagcccugggacgucgugccuauggugacccagauggcaaugacugauacaaccccauucggacagcaacgagucuuuaaagaaaagguugacacuagaacacccaggaguaugccggguacccggcgcgugaugggcauuacagccgagugguuauggagaacucuggggaggaauaaaaagccucgauugugcacccgggaggaauucacgaagaaaguacguaccaacgcugccaugggagcgguguuuacagaggaaaaucagugggauucugcaaaggccgcugucgaggacgaagauuucuggaaacucguggacagagagcgcgagcugcacaagcuaggcaaaugugguagcugcguuuacaacaugauggggaagagggaaaaaaagcuuggagaguuuggcaaggccaaaggcucacgggcaaucugguauauguggcugggggcuagauaccucgaauucgaggcccugggauuuuugaaugaggaucauugguucucccgcgaaaacaguuacagcgguguggagggcgaagggcugcacaagcucggauauauacuuagggacaucucuaaaauucccggcggugcuauguacgccgaugacacugcagggugggacacccgaaucacagaggaugaccugcacaaugaagagaagauuacucagcagauggauccagagcaucggcaauuagcgaacgccaucuuuaaacugaccuaucagaauaaggucgugaagguacagagaccuacgcccacaggaaccguuauggacauaauuuccaggaaagaucagcgcggcucaggccaaguggggacuuacggauugaacacauucaccaauauggaagcucagcucauccgucagauggagggugaaggcguccugagcaaggccgaccuagagaacccacaccuucccgaaaaaaagaucacucaguggcuggagaccaaagggguggagcggcucaagagaauggcaauuucgggagaugacugcguggucaagccuauagaugacagguuugcuaacgcccuguuggcauuaaaugauaugggcaaaguucgcaaggacaucccacaauggcagccgucuaaagguuggcaugauuggcagcaggugcccuucuguagucaccacuuccaugaacugauuaugaaggacgggcgaaaacucguagugccuugccggccacaagacgagcuuaucggaagagccaggauuucccagggcgcgggcuggagccugcgcgaaacagcuugucuagggaaggccuaugcacagauguggucacugauguacuuucacagacgggaucucagguuggccuccaacgcuaucugcucugccguccccgugcauuggguuccuacgagccguaccacuuggaguauacacgcacaucaccaauggaugacaaccgaggacaugcugacuguguggaaucgagucuggaucgaagauaacccauggauggaggacaagacacccgugaccacgugggagaauguaccuuaucuuggaaaacgcgaagaucaguggugugguucccugauuggccucacaagcagagcuaccugggcccagaacaucccgacugcgauucagcaaguucggucuuuaaucgggaaugaggaauuccuggacuacaugccaucaaugaagagguuucgcaaagaggaggaaagugagggagcuauuugguga

SEQ ID NO: 15113 - RNA, 9873 nt, Artificial Sequence
  derived and/or modified CDS sequence (opt3) from DENV-3__KT726356__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucagaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagauguucccuguaaaaucccuuucuccacagaggacggccaagguaaggcucauaacgggcgucuuauaacugcgaauccagugguaaccaaaaaggaggaacccgucaacauugaggcagaaccgccuuucggcgagucaaauaucgugaucggaauuggcgauaacgccuugaaaaucaauugguauaagaaggggagcaguauuggaaaaauguuugaagcuacagcccgcggugcaagaaggauggccauacugggcgacacugcuugggauuucgggucuguuggaggcgugcucaacucccuggguaagaugguccaccagaucuuugggagcgccuacaccgcacuuuucucgggcgugucuuggguaaugaaaauuggaaucggcgugcuguugacguggaucgggcucaauuccaagaacacaucaaugaguuuuagcugcauugcgauaggaaucauuacccuguauuuaggcgcuguuguccaggccgacauggguugugugaucaauuggaaagggaaggagcugaagugcggauccggcauuuucgugacuaacgagguccauacauggaccgaacaguacaaauuucaagcagauucucccaagcggcuagccacugcuaucgccggugcaugggagaauggcguuugugggauacgaagcaccacacgcauggaaaaccuccuguggaaacagaucgcuaaugagcuuaacuauauuuugugggaaaauaacaucaagcugacgguggugguaggagacauuaucggcguccucgagcaggggaaaagaacccugacuccacagccuauggaguuaaaguacucauggaaaacauggggaaaggccaagauagugaccgcggaaacacaaaacaguuccuucauuaucgauggccccaauacuccagagugccccagcgccucuagggcuuggaacguuugggaaguggaggacuaugguuuuggggucuucaccacgaauauuuggcugaaacuucgggaaguguacacacaguugugugaccaccgccucaugucagcagccguuaaggaugagagagcugugcacgccgacaugggauacuggaucgagagucagaaaaacggcagcuggaagcuggaaaaagcaucccuaauagagguaaagaccugcacuuggccuaagucucauacccuguggucgaaugguguccucgaaagcgauaugaucauuccaaaaucccuggcgggcccgaucucacagcacaaccauaggcccggguaucacacacaaacugccggaccuuggcaccuuggcaaguuggagcuggacuuuaauuacugcgaggggaccacaguggugauuacggaaaacuguggaacccguggcccaaguuuacggacuacaaccgucucugguaaacucauccaugaguggugcugucgaagcugcacucugcccccucuuagauauaugggggaagauggauguugguacggcauggagauaaggccaauuuccgaaaaggaggagaauaugguuaaaucacuggugagcgcugguucuggcaagguagacaacuucacaauggggguguugugccucgccauccuguuugaagaggucaugcgcggaaaguucggcaaaaagcacaugaucgcagggguguucuuuaccuucguucuacugcucuccggacagauuacguggcgggauauggcucauacucugaucaugauuggcaguaaugccagcgacagaauggguaugggggugaccuaucuugcauugauagccacauuuaaaauccagcccuuccuggcuuuaggauuuuuccucaggaagcugaccucucgcgaaaaccuucugcuaggcgucggccucgcgauggccacuacacugcaauugccggaggauauugaacagauggcaaaugggaucgcucugggauuaauggcccucaaacugauuacccaguuugagacauaccagcuuuggacugcccugaucuccuugaccuguucaaacacgauauucacacucaccguggcuuggcgaacugcaacccugauccuagccgguguuagucugcuuccugugugccaaagcucguccaugcggaagacagacuggcucccaauggcggucgcugccaugggcguacccccucugcccuuguuuauuuucucucugaaggauacuuuaaaacguagaagcuggccacucaaugagggggugauggcaguuggacuggugucaauccuugccaguucccuguugaggaacgacgucccuauggcuggcccccuccuggcaggugggcuacugauugccuguuaugugaucaccggaacgucugcggaucuuacaguagaaaaggcugccgacauaaccugggaggaagaggcagaacagacuggcgugagccacaaccucaugauuacagucgacgaugacggcaccaugcgcaucaaagaugacgagacugagaauauccugacaguuuuguuaaagaccgcccugcucauuguguccgggauauuuccauacucaaucccggcuacgcugcuuguguggcauacuuggcagaaacagacccaacggagcggaguccugugggaugugccuagucccccagaaacacagaaggccgaguuggaagaggguguuuacagaauuaaacagcagggcaucuucgggaagacccaaguaggagugggcguccagaaggaggguguguuucacacaauguggcacguuacuaggggggcagugcuaacccauaacggaaaacgacuggaacccaauugggcuucugucaagaaagaccucauuuccuauggcggcggguggcgccugagcgcccaguggcaaaagggagaggaagugcagguaaucgcggucgagccugguaaaaacccaaagaauuuccagacgaugcccggcacauuccagacuaccacaggggaaauaggagccaucgcacuugauuuuaagccuggcaccucggguucaccgauuaucaaccgggaggggaaagugguuggauuauacggcaauggcguggucacuaagaacgggggauaugugucugguauugcucaaaccaaugccgagccagacggccccacaccugaacuggaggaagagauguucaaaaagagaaaccucacgaucauggauuugcacccagggaguggaaaaacuaggaaguaccugcccgcuauaguucgugaagcaauuaagcgccggcucagaacccugauccuugccccuacaaggguggucgccgcugagauggaggaagcgcugaaaggcuugccgauccgauaucagaccacugcaacaaaguccgagcauaccggucgggaaauuguggaccuaaugugccacgccacguuuacuaugcgccugcucagccccguaagagugccaaauuacaacuuaaucauaauggaugaggcucauuucacagacccugccucuauugcagccaggggguauaucagcacccggguuggaaugggcgaagcugcggccauuuuuaugaccgcaacucccccaggcacagcugaugccuucccucaguccaaugcacccauccaggacgaggagcgagacauaccagaaagaucauggaacagugggaaugaguggauuaccgauuuugccggaaaaacagucugguucgugccgagcaucaaggcugguaacgacaucgccaacugucugcgcaaaaauggcaagaaggugauucaacuuucuaggaaaacuuuugauacggaauaccagaagaccaaacugaacgacugggauuucgucguaacaacugacaucuccgagaugggggcgaauuuuaaggcagaucgugugauugacccucggagaugccucaaacccguuauauugaccgauggaccagagagggugauccuggccggccccaugccugucacagcugccucagcugcacagcgccgagguagaguggggcggaacccacagaaggaaaaugaccaauacauuuucaccggccagccccucaacaaugaugaggaccacgcccacuggacugaagcuaagaugcugcuugacaacaucaauacgccugagggaaucauuccggcccuauucgaaccagagagggagaaaagugcagcgauagauggcgaauaucgccugaagggggagagccguaaaaccuuuguugaauugaugagacggggagacuuacccguguggcuggcccauaaggucgcuuccgaggguaucaaauacacagauaggaaguggugcuucgacggccagcgcaacaaucagauucucgaagagaacauggauguggagaucuggacuaaagaaggggagaagaagaaacugcgaccuagauggcuugacgcccggaccuauucugauccccuggcacucaaggaauuuaaagacuucgcugccggaaggaagucgauugcauuggaucugguaacagagaucggccgcgugccaagccaccuagcccauagaaccaggaaugcucuggacaaccucguuaugcuucacacuucagaacacggugggcgggcguaccgucaugccgucgaggagcugccugaaacaauggagacguuauugcugcucggccugaugauacuucugaccggaggcgcaaugcucuuuuugaucuccgggaaaggaauugguaagacuaguaucggccugauuugugugaucgcuucuagcgggauguuauggauggccgaaauaccccuacaauggauugccuccgcaaucgugcuggaguucuuuaugaugguccuccuuauuccagagccugaaaagcagcgcacaccgcaggauaaucaacuggcuuauguugugaucggaauauugacccuggccgcgaucauugcugccaacgagaugggccuccuggaaaccacaaaacgagaccuugguaugucaaaggagcccgggguagugucuccaacuagcuaccucgaugucgaccugcacccugcaagugccuggacguuguaugcuguggcaaccacaguuaucacucccaugcugagacauaccauugaaaauuccacagccaacgugagcuuagcggcuaucgccaaccaggcagucguacuaaugggccuggacaaaggauggccaauaucuaagauggaucucggcgugccucuucuggccuuggggugcuacucacagguuaauccccugacccucacugcugccgugcugcuuuuaauuacgcacuacgcaaucaucggaccgggccugcaggcuaaagccacaagggaggcgcaaaagcggaccgccgcagguauuaugaagaacccaacugucgacgggaucaugaccauagaucucgacccugugauuuaugauuccaaauucgagaagcaguugggacaggucaugcugcuagugcugugugcuguucagcuccuucugaugcgcacaaguugggccuugugcgaagcacugacucucgcuaccggccccaucacaacgcugugggaggguagcccaggcaaauuuuggaauaccacuauugccgugucgauggccaacaucuucagagggucuuacuuagcgggagcuggccuugcauuuuccauaaugaagagcguagggacaggaaaaaggggcaccgguucacaaggggaaacucugggagagaaguggaagaaaaagcucaaucagcuaagucggaaagaauucgaccuguauaagaaaucuggcaucacagagguggaucgaaccgaggccaaggaagguuugaaaagaggcgagauuacgcaucacgcugucucccgcgggagcgccaagcugcagugguuuguugaaaggaacauggugauccccgagggacgggucauugaccucggcugugggcguggaggcuggucauacuauugcgcaggucuuaagaaagugaccgaaguaagaggguacacaaagggaggcccuggccacgaggagccggugcccaugaguacuuauggguggaauaucguuaaacugaugagcggaaaggauguguucuacuugccaccugaaaaaugugacacccugcucugcgauauuggugaguccucucccagcccuacagucgaagaguccaggacuauccgcguguuaaagauggucgagccauggcugaagaacaaucaguucuguauaaaagugcuuaaccccuacaugccuaccguuauugaacaucuggagcggcuacaacgaaagcacggcgggaugcucguaagaaauccacugucaaggaacucuacacaugaaauguauuggaucaguaauggaaccggcaacaucguggccucggucaauauggugagccgcuugcugcucaaccgguuuacuaugacguacagacgucccacaauugagaaagacguugaucuuggugcugggaccaggcacgugaacgcggaaccggagacuccuaauauggacgucauaggagagcggaucaagcgcauuaaagaagagcacaacuccaccuggcauuaugacgaugaaaauccauacaagacaugggccuaucacggcucuuacgaggugaaggcaacgggcucagcuagcuccaugaucaacgggguagugaaacuguuaaccaagcccugggacguugucccuauggugacucagauggccaugacagauaccacuccauucggacagcaacgaguguuuaaagaaaaggucgacacaagaacccccaggaguaugccggguacacggcgcguuaugggcauuacugcagaguggcuguggagaaccuuggggaggaauaaaaagccucgacucugcacgcgggaggaauucaccaagaaagugcguacaaacgccgcuaugggagccguauuuacugaggaaaaucagugggauucugcgaaggcagccguggaggacgaagauuucuggaaacuggucgacagagagcgcgagcuacauaagcuuggcaaaugugguagcugcguguauaacaugauggggaagagggaaaaaaagcugggagaguuuggcaaggcuaaaggcucacgggccaucugguacauguggcucggggcaagauaccuggaauucgaggcuuugggauuucugaaugaggaucacugguucucccgcgaaaacaguuauagcgguguugagggcgaagggcuccauaagcuuggauacauacugagggacaucucuaaaauucccggcggugccauguaugcugaugacaccgccgggugggacacacgaaucacugaggaugacuuacacaaugaagagaagauuacccagcagauggauccagagcaccggcaacuggcaaacgcgaucuuuaaauugacguaccagaauaagguggucaaggugcagagaccuacacccaccggaacuguaauggacauaauuuccaggaaagaucagcgcggcucaggccaaguugggacauauggacucaacaccuucacuaauauggaagcccagcugauccgucagauggagggugaaggcgugcuaagcaaggcugaccuugagaacccacaucugcccgaaaaaaagaucacccaguggcucgagacaaaaggggucgagcggcugaagagaauggccauuucgggagaugacugcguggugaagccuauagaugacagguuugcaaacgcuuuguuagcccugaaugauaugggcaaaguccgcaaggacaucccacaauggcagccgucuaaagguuggcacgauuggcagcagguucccuucuguagucaucacuuccacgaacucauuaugaaggacgggcgaaaacuugugguaccuugccggccacaagacgagcugaucggaagagcaaggauuucccagggcgccggcuggagccuacgcgaaacggcgugucuggggaaggcuuacgcccagauguggucacucauguauuuucauagacgggauuugaggcuggcauccaacgccaucugcucugcugugcccguccacugggugccuaccagccguacuacauggaguauacaugcccaccaucaauggaugaccacugaggacaugcuuacaguuuggaaucgaguguggaucgaagauaacccauggauggaggacaagacccccgucacgacaugggagaaugugccuuaccugggaaaacgcgaagaucaguggugugguucccucauuggcuuaaccagcagagcaacuugggcucagaacaucccgaccgccauucagcaaguacggucucugaucgggaaugaggaauucuuggacuacaugccaucaaugaagagguuucgcaaagaggaggaaagugagggagcgauuugguga

SEQ ID NO: 15114 - RNA, 9873 nt, Artificial Sequence
  derived and/or modified CDS sequence (opt3) from DENV-3__KT726342__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucagaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagauguucccuguaaaaucccuuucuccacagaggacggccaagguaaggcucauaacgggcgucuuauaacugcgaauccagugguaaccaaaaaggaggaacccgucaacauugaggcagaaccgccuuucggcgagucaaauaucgugaucggaauuggcgauaacgccuugaaaaucaauugguauaagaaggggagcaguauuggaaaaauguuugaagcuacagcccgcggugcaagaaggauggccauacugggcgacacugcuugggauuucgggucuguuggaggcgugcucaacucccuggguaagaugguccaccagaucuuugggagcgccuacaccgcacuuuucucgggcgugucuuggguaaugaaaauuggaaucggcgugcuguugacguggaucgggcucaauuccaagaacacaucaaugaguuuuagcugcauugcgauaggaaucauuacccuguauuuaggcgcuguuguccaggccgacauggguugugugaucaauuggaaagggaaggagcugaagugcggauccggcauuuucgugacuaacgagguccauacauggaccgaacaguacaaauuucaagcagauucucccaagcggcuagccacugcuaucgccggugcaugggagaauggcguuugugggauacgaagcaccacacgcauggaaaaccuccuguggaaacagaucgcuaaugagcuuaacuauauuuugugggaaaauaacaucaagcugacgguggugguaggagacauuaucggcguccucgagcaggggaaaagaacccugacuccacagccuauggaguuaaaguacucauggaaaacauggggaaaggccaagauagugaccgcggaaacacaaaacaguuccuucauuaucgauggccccaauacuccagagugccccagcgccucuagggcuuggaacguuugggaaguggaggacuaugguuuuggggucuucaccacgaauauuuggcugaaacuucgggaaguguacacacaguugugugaccaccgccucaugucagcagccguuaaggaugagagagcugugcacgccgacaugggauacuggaucgagagucagaaaaacggcagcuggaagcuggaaaaagcaucccuaauagagguaaagaccugcacuuggccuaagucucauacccuguggucgaaugguguccucgaaagcgauaugaucauuccaaaaucccuggcgggcccgaucucacagcacaaccauaggcccggguaucacacacaaacugccggaccuuggcaccuuggcaaguuggagcuggacuuuaauuacugcgaggggaccacaguggugauuacggaaaacuguggaacccguggcccaaguuuacggacuacaaccgucucugguaaacucauccaugaguggugcugucgaagcugcacucugcccccucuuagauauaugggggaagauggauguugguacggcauggagauaaggccaauuuccgaaaaggaggagaauaugguuaaaucacuggugagcgcugguucuggcaagguagacaacuucacaauggggguguugugccucgccauccuguuugaagaggucaugcgcggaaaguucggcaaaaagcacaugaucgcagggguguucuuuaccuucguucuacugcucuccggacagauuacguggcgggauauggcucauacucugaucaugauuggcaguaaugccagcgacagaauggguaugggggugaccuaucuugcauugauagccacauuuaaaauccagcccuuccuggcuuuaggauuuuuccucaggaagcugaccucucgcgaaaaccuucugcuaggcgucggccucgcgauggccacuacacugcaauugccggaggauauugaacagauggcaaaugggaucgcucugggauuaauggcccucaaacugauuacccaguuugagacauaccagcuuuggacugcccugaucuccuugaccuguucaaacacgauauucacacucaccguggcuuggcgaacugcaacccugauccuagccgguguuagucugcuuccugugugccaaagcucguccaugcggaagacagacuggcucccaauggcggucgcugccaugggcguacccccucugcccuuguuuauuuucucucugaaggauacuuuaaaacguagaagcuggccacucaaugagggggugauggcaguuggacuggugucaauccuugccaguucccuguugaggaacgacgucccuauggcuggcccccucguggcaggugggcugcuaauugccuguuauguaaucaccggaacgucugcggaucugacaguggaaaaggcugccgacauaaccugggaggaagaggcagaacagacuggcgucagccacaaccuuaugauuacaguugacgaugacggcaccaugcgcaucaaagaugacgagacugagaauauccucacagugcuguugaagaccgccuuacugauuguguccgggauauuuccauacucaaucccggcuacgcuccuggucuggcauacuuggcagaaacagacccaacggagcggagugcuuugggauguuccuagucccccagaaacacagaaggccgagcuggaagaggguguauacagaauuaaacagcagggcaucuucgggaagacccaagugggagucggcgugcagaaggaggguguuuuucacacaauguggcacgugacuaggggggcagucuugacccauaacggaaaacgacuagaacccaauugggcuucugugaagaaagaccugauuuccuauggcggcggguggcgccucagcgcccaguggcaaaagggagaggaaguacaggucaucgcgguggagccugguaaaaacccaaagaauuuccagacgaugcccggcacauuccagacuaccacaggggaaauaggagccaucgcacuggauuuuaagccuggcaccucggguucaccgauuaucaaccgggaggggaaaguugugggacuuuacggcaauggcgucgugacuaagaacgggggauauguuucugguauugcucaaaccaaugccgagccagacggccccacaccugaauuagaggaagagauguucaaaaagagaaaccugacgaucauggaucuccacccagggaguggaaaaacuaggaaguacuugcccgcuauagugcgugaagcaauuaagcgccggcugagaacccucauccuggccccuacaagggucguggccgcugagauggaggaagcgcuuaaaggccugccgauccgauaucagaccacugcaacaaaguccgagcauaccggucgggaaauuguagacuugaugugccacgccacguuuacuaugcgccuacugagccccgugagaguuccaaauuacaaccucaucauaauggaugaggcucauuucacagacccugccucuauugcagccaggggguauaucagcacccgggucggaaugggcgaagcugcggccauuuuuaugaccgcaacucccccaggcacagcugaugccuucccucaguccaaugcacccauccaggacgaggagcgagacauaccagaaagaucauggaacagugggaaugaguggauuaccgauuuugccggaaaaacagugugguucgugccgagcaucaaggcugguaacgacaucgccaacuguuuacgcaaaaauggcaagaaggucauucaacugucuaggaaaacuuuugauacggaauaccagaagaccaaacuuaacgacugggauuucguagugacaacugacaucuccgagaugggggcgaauuuuaaggcagaucguguuauugacccucggagaugccugaaacccgugauacucaccgauggaccagagagggucaucuuggccggccccaugccugugacagcugccucagcugcacagcgccgagguagaguugggcggaacccacagaaggaaaaugaccaauacauuuucaccggccagccccugaacaaugaugaggaccacgcccacuggacugaagcuaagaugcuccuggacaacaucaauacgccugagggaaucauuccggcccuuuucgaaccagagagggagaaaagugcagcgauagauggcgaauaucgccuaaagggggagagccguaaaaccuuuguggaacugaugagacggggagacuugcccgucugguuagcccauaagguggcuuccgaggguaucaaauacacagauaggaaguggugcuucgacggccagcgcaacaaucagauucuggaagagaacauggauguagagaucuggacuaaagaaggggagaagaagaaacuccgaccuagauggcuggacgcccggaccuauucugauccccuugcacugaaggaauuuaaagacuucgcugccggaaggaagucgauugcacucgauuuggugacagagaucggccgcguuccaagccaccuggcccauagaaccaggaaugcucuagacaaccuggucaugcuccacacuucagaacacggugggcgggcguaccgucaugccguggaggagcuuccugaaacaauggagacgcuguuauugcugggccucaugauacugcuuaccggaggcgcaaugcuguuucucaucuccgggaaaggaauugguaagacuaguaucggcuugauuugugugaucgcuucuagcgggaugcuguggauggccgaaauacccuuacaauggauugccuccgcaaucguccuagaguucuuuaugaugguucugcucauuccagagccugaaaagcagcgcacaccgcaggauaaucaacuugcuuaugugguaaucggaauacugaccuuggccgcgaucauugcugccaacgagaugggccugcucgaaaccacaaaacgagaccuggguaugucaaaggagcccgggguggucucuccaacuagcuaccuugauguggaccuccacccugcaagugccuggacgcuguaugcuguugcaaccacagugaucacucccauguugagacauaccauugaaaauuccacagccaacgucagccuggcggcuaucgccaaccaggcaguaguguuaaugggccuagacaaaggauggccaauaucuaagauggaucugggcguuccucuccuugcccuggggugcuacucacaggugaaucccuugacccugacugcugccguccuccugcuuauuacgcacuacgcaaucaucggaccgggcuuacaggcuaaagccacaagggaggcgcaaaagcggaccgccgcagguauuaugaagaacccaacuguggacgggaucaugaccauagaucuggacccugucauuuaugauuccaaauucgagaagcagcucggacaggugauguugcugguucuaugugcugugcagcugcuccuuaugcgcacaaguugggcccugugcgaagcauugacucuggcuaccggccccaucacaacgcucugggaggguagcccaggcaaauuuuggaauaccacuauugccguaucgauggccaacaucuucagagggucuuaccuggcgggagcuggcuuagcauuuuccauaaugaagagcguggggacaggaaaaaggggcaccgguucacaaggggaaacucuuggagagaaguggaagaaaaagcugaaucagcucagucggaaagaauucgaccuauauaagaaaucuggcaucacagaggucgaucgaaccgaggccaaggaaggucugaaaagaggcgagauuacgcaucacgcuguuucccgcgggagcgccaaguugcagugguuuguggaaaggaacauggucauccccgagggacgggugauugaccugggcugugggcguggaggcuggucauacuauugcgcaggucucaagaaaguaaccgaagugagaggguacacaaagggaggcccuggccacgaggagccgguucccaugaguacuuauggguggaauaucgugaaacuuaugagcggaaaggaugucuucuaccugccaccugaaaaaugugacaccuugcugugcgauauuggugaguccucucccagcccuacaguggaagaguccaggacuauccgcguccucaagaugguggagccaugguuaaagaacaaucaguucuguauaaaaguucugaaccccuacaugccuaccguaauugaacaucuugagcggcugcaacgaaagcacggcgggaugcuagugagaaauccacucucaaggaacucuacacaugaaauguauuggaucaguaauggaaccggcaacaucgucgccucggugaauaugguuagccgccuguugcugaaccgguuuacuaugacgcacagacgucccacaauugagaaagacguggaucucggugcugggaccaggcacgucaacgcggaaccggagacuccuaauauggacgugauaggagagcggaucaagcgcauuaaagaagagcauaacuccaccuggcacuacgacgaugaaaauccauauaagacaugggccuaccauggcucuuaugagguaaaggcaacgggcucagcuagcuccaugaucaacggggugguuaaacuucugaccaagcccugggacgucgugccuauggugacucagauggccaugacagauaccacuccauucggacagcaacgagucuuuaaagaaaagguugacacaagaacccccaggaguaugccggguacacggcgcgugaugggcauuacugcagagugguuauggagaacccuggggaggaauaaaaagccucgauugugcacgcgggaggaauucaccaagaaaguacguacaaacgccgcuaugggagccguguuuacugaggaaaaucagugggauucugcgaaggcagccgucgaggacgaagauuucuggaaacucguggacagagagcgcgagcugcacaagcuaggcaaaugugguagcugcguuuacaacaugauggggaagagggaaaaaaagcuuggagaguuuggcaaggcuaaaggcucacgggccaucugguauauguggcugggggcaagauaccucgaauucgaggcucugggauuuuugaaugaggaucauugguucucccgcgaaaacaguuacagcgguguggagggcgaagggcugcacaagcucggauauauacuuagggacaucucuaaaauucccggcggugccauguacgcugaugacaccgccgggugggacacacgaaucacugaggaugaccugcacaaugaagagaagauuacccagcagauggauccagagcaucggcaauuagcaaacgcgaucuuuaaacugacguaucagaauaaggucgugaagguacagagaccuacacccaccggaacuguuauggacauaauuuccaggaaagaucagcgcggcucaggccaaguggggacauacggauugaacaccuucacuaauauggaagcccagcucauccgucagauggagggugaaggcguccugagcaaggcugaccuagagaacccacaccuucccgaaaaaaagaucacccaguggcuggagacaaaagggguggagcggcucaagagaauggccauuucgggagaugacugcguggucaagccuauagaugacagguuugcaaacgcucuguuggccuuaaaugauaugggcaaaguucgcaaggacaucccacaauggcagccgucuaaagguuggcaugauuggcagcaggugcccuucuguagucaccacuuccaugaacugauuaugaaggacgggcgaaaacucguagugccuugccggccacaagacgagcuuaucggaagagcaaggauuucccagggcgccggcuggagccugcgcgaaacggcgugucuagggaaggcuuaugcccagauguggucacugauguacuuucacagacgggaucucagguuggcauccaacgccaucugcucugcuguccccgugcauuggguuccuaccagccguacuacauggaguauacacgcccaucaccaauggaugaccacugaggacaugcugacaguguggaaucgagucuggaucgaagauaacccauggauggaggacaagacccccgugacgacaugggagaauguaccuuaucuuggaaaacgcgaagaucaguggugugguucccugauuggccucaccagcagagcaacuugggcucagaacaucccgaccgccauucagcaaguucggucuuuaaucgggaaugaggaauuccuggacuacaugccaucaaugaagagguuucgcaaagaggaggaaagugagggagcgauuugguga

SEQ ID NO: 15115 - RNA, 9873 nt, Artificial Sequence
  derived and/or modified CDS sequence (opt3) from DENV-3__KT726343__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucagaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagaugcucccuguaaaaucccuuucuccacagaggacggccaagguaaggcgcauaacgggcgucuuauaacugcaaauccaguugugaccaaaaaggaggaacccguaaacauugaggccgaaccgccuuucggcgagucaaauaucgucaucggaauuggcgauaacgcuuugaaaaucaauugguauaagaaggggagcaguauuggaaaaauguuugaagccacagcacgcggugccagaaggauggcuauacugggcgacacugccugggauuucgggucugugggaggcguucucaacucccuggguaagauggugcaccagaucuuugggagcgcauacaccgcgcuuuucucgggcgucucuugggugaugaaaauuggaaucggcguacuguugacguggaucgggcucaauuccaagaacacaucaaugaguuuuagcugcauugcuauaggaaucauuacccuguauuuaggcgccgugguucaggcagacauggguugugucaucaauuggaaagggaaggagcugaagugcggauccggcauuuucgugacuaacgaggugcauacauggaccgaacaguacaaauuucaagccgauucucccaagcggcuagcuacugccaucgcaggugcuugggagaauggcgucugugggauacgaagcaccacacgcauggaaaaccuccuguggaaacagaucgccaaugagcuuaacuauauuuugugggaaaauaacaucaagcugacgguuguggugggagacauuaucggcguacucgagcaggggaaaagaacccugacuccacagccuauggaguuaaaguacucauggaaaacauggggaaaggcgaagauagucaccgccgaaacacaaaacaguuccuucauuaucgauggccccaauacuccagagugccccagcgcuucuagggcauggaacgugugggaaguugaggacuaugguuuugggguguucaccacgaauauuuggcugaaacuucgggaagucuacacacaguugugugaccaccgccucaugucagccgcugugaaggaugagagagccguucacgcagacaugggauacuggaucgagagucagaaaaacggcagcuggaagcuggaaaaagcgucccuaauagaggugaagaccugcacuuggccuaagucucauacccuguggucgaaugguguacucgaaagcgauaugaucauuccaaaaucccuggccggcccgaucucacagcacaaccauaggcccggguaucacacacaaacugcuggaccuuggcaccuuggcaaguuggagcuggacuuuaauuacugcgaggggaccacagucgugauuacggaaaacuguggaacccguggcccaaguuuacggacuacaaccgugucugguaaacucauccaugaguggugcugucgaagcugcacucugcccccucuuagauauaugggggaagauggauguugguacggcauggagauaaggccaauuuccgaaaaggaggagaauauggucaaaucacugguuagcgccgguucuggcaagguggacaacuucacaauggggguauugugccucgcaauccuguuugaagaggugaugcgcggaaaguucggcaaaaagcacaugaucgcuggggucuucuuuaccuucgugcuacugcucuccggacagauuacguggcgggauauggcccauacucugaucaugauuggcaguaaugcaagcgacagaauggguauggggguuaccuaucuugccuugauagcuacauuuaaaauccagcccuuccuggcguuaggauuuuuccucaggaagcugaccucucgcgaaaaccuucugcuaggcgugggccucgccauggcaacuacacugcaauugccggaggauauugaacagauggcuaaugggaucgcccugggauuaauggcccucaaacugauuacccaguuugagacauaccagcuuuggacugcucugaucuccuugaccuguucaaacacgauauucacacucaccgucgcauggcgaacugccacccugauccuagcgggugugagucugcuuccuguuugccaaagcucguccaugcggaagacagacuggcucccaauggcuguggccgcaaugggcguccccccucugcccuuguuuauuuucucucugaaggauacuuuaaaacguagaagcuggccacucaaugaggggguaauggccgugggacugguuucaauccuugcuaguucccuguugaggaacgacgugccuauggcaggcccccucgucgccggugggcugcuaauugcguguuaugugaucaccggaacgucugcugaucugacaguagaaaaggccgcagacauaaccugggaggaagaggccgaacagacuggcgugagccacaaccuuaugauuacagucgacgaugacggcaccaugcgcaucaaagaugacgagacugagaauauccucacaguucuguugaagaccgcuuuacugauuguguccgggauauuuccauacucaaucccggccacgcuccugguguggcauacuuggcagaaacagacccaacggagcggaguccuuugggaugugccuagucccccagaaacacagaaggcagagcuggaagaggguguuuacagaauuaaacagcagggcaucuucgggaagacccaaguaggagugggcguccagaaggaggguguguuucacacaauguggcacguuacuaggggggcuguguugacccauaacggaaaacgacuagaacccaauugggccucugucaagaaagaccugauuuccuauggcggcggguggcgccucagcgcgcaguggcaaaagggagaggaagugcagguaaucgccgucgagccugguaaaaacccaaagaauuuccagacgaugcccggcacauuccagacuaccacaggggaaauaggagcaaucgcucuggauuuuaagccuggcaccucggguucaccgauuaucaaccgggaggggaaagugguuggacuuuacggcaauggcguggucacuaagaacgggggauaugugucugguauugcccaaaccaaugcugagccagacggccccacaccugaauuagaggaagagauguucaaaaagagaaaccugacgaucauggaucuccacccagggaguggaaaaacuaggaaguacuugcccgcaauaguucgugaagccauuaagcgccggcugagaacccucauccuggccccuacaaggguggucgcugcggagauggaggaagcacuuaaaggccugccgauccgauaucagaccacugccacaaaguccgagcauaccggucgggaaauuguggacuugaugugccacgcuacguuuacuaugcgccuacugagccccguaagagugccaaauuacaaccucaucauaauggaugaggcccauuucacagacccugcaucuauugccgcuaggggguauaucagcacccggguuggaaugggcgaagcggccgcaauuuuuaugaccgcuacucccccaggcacagccgaugcauucccucaguccaaugcccccauccaggacgaggagcgagacauaccagaaagaucauggaacagugggaaugaguggauuaccgauuuugcuggaaaaacagucugguucgugccgagcaucaaggccgguaacgacaucgcgaacuguuuacgcaaaaauggcaagaaggugauucaacugucuaggaaaacuuuugauacggaauaccagaagaccaaacuuaacgacugggauuucgucguaacaacugacaucuccgagaugggggcaaauuuuaaggccgaucgugugauugacccucggagaugccugaaacccguuauacucaccgauggaccagagagggugaucuuggcuggccccaugccugucacagccgcuucagcagcccagcgccgagguagaguggggcggaacccacagaaggaaaaugaccaauacauuuucaccggccagccccugaacaaugaugaggaccacgcucacuggacugaagccaagaugcuccuggacaacaucaauacgccugagggaaucauuccggcacuuuucgaaccagagagggagaaaagugcggccauagauggcgaauaucgccuaaagggggagagccguaaaaccuuuguugaacugaugagacggggagacuugcccgugugguuagcucauaaggucgccuccgaggguaucaaauacacagauaggaaguggugcuucgacggccagcgcaacaaucagauucuggaagagaacauggauguggagaucuggacuaaagaaggggagaagaagaaacuccgaccuagauggcuggacgcacggaccuauucugauccccuugcucugaaggaauuuaaagacuucgccgcaggaaggaagucgauugcccucgauuugguaacagagaucggccgcgugccaagccaccuggcucauagaaccaggaaugcgcuagacaaccugguuaugcuccacacuucagaacacggugggcgggccuaccgucaugcagucgaggagcuuccugaaacaauggagacgcuguuauugcugggccucaugauacugcuuaccggaggcgcuaugcuguuucucaucuccgggaaaggaauugguaagacuaguaucggcuugauuugugugaucgccucuagcgggaugcuguggauggccgaaauacccuuacaauggauugcauccgcuaucgugcuagaguucuuuaugaugguccugcucauuccagagccugaaaagcagcgcacaccgcaggauaaucaacuugccuauguugugaucggaauacugaccuuggcggcuaucauugccgcaaacgagaugggccugcucgaaaccacaaaacgagaccuggguaugucaaaggagcccgggguagugucuccaacuagcuaccuugaugucgaccuccacccugccagugcuuggacgcuguaugcaguggccaccacaguuaucacucccauguugagacauaccauugaaaauuccacagcgaacgugagccuggcugccaucgcaaaccaggccgucguauuaaugggccuagacaaaggauggccaauaucuaagauggaucugggcgugccucuccuugcucuggggugcuacucacagguuaaucccuugacccugacugccgcagugcuccugcuuauuacgcacuacgcuaucaucggaccgggcuuacaggccaaagcgacaagggaggcccaaaagcggaccgcagcugguauuaugaagaacccaacugucgacgggaucaugaccauagaucuggacccugugauuuaugauuccaaauucgagaagcagcucggacaggucauguugcuggugcuaugugccguucagcugcuccuuaugcgcacaaguugggcacugugcgaagcuuugacucuggccaccggccccaucacaacgcucugggaggguagcccaggcaaauuuuggaauaccacuauugccgugucgauggcgaacaucuucagagggucuuaccuggcuggagcaggcuuagccuuuuccauaaugaagagcguagggacaggaaaaaggggcaccgguucacaaggggaaacucuuggagagaaguggaagaaaaagcugaaucagcucagucggaaagaauucgaccuauauaagaaaucuggcaucacagagguggaucgaaccgaggcuaaggaaggucugaaaagaggcgagauuacgcaucacgccgucucccgcgggagcgcaaaguugcagugguuuguugaaaggaacauggugauccccgagggacgggucauugaccugggcugugggcguggaggcuggucauacuauugcgccggucucaagaaagugaccgaaguaagaggguacacaaagggaggcccuggccacgaggagccggugcccaugaguacuuauggguggaauaucguuaaacuuaugagcggaaaggauguguucuaccugccaccugaaaaaugugacaccuugcugugcgauauuggugaguccucucccagcccuacagucgaagaguccaggacuauccgcgugcucaagauggucgagccaugguuaaagaacaaucaguucuguauaaaagugcugaaccccuacaugccuaccguuauugaacaucuugagcggcugcaacgaaagcacggcgggaugcuaguaagaaauccacucucaaggaacucuacacaugaaauguauuggaucaguaauggaaccggcaacaucguggcuucggucaauauggugagccgccuguugcugaaccgguuuacuaugacgcacagacgucccacaauugagaaagacguugaucucggugcggggaccaggcacgugaacgccgaaccggagacuccuaauauggacgucauaggagagcggaucaagcgcauuaaagaagagcauaacuccaccuggcacuacgacgaugaaaauccauauaagacaugggcauaccauggcucuuaugaggugaaggcuacgggcucagccagcuccaugaucaacgggguagugaaacuucugaccaagcccugggacguugucccuauggugacucagauggcaaugacagauaccacuccauucggacagcaacgaguguuuaaagaaaaggucgacacaagaacccccaggaguaugccggguacacggcgcguuaugggcauuacugccgagugguuauggagaacccuggggaggaauaaaaagccucgauugugcacgcgggaggaauucaccaagaaagugcguacaaacgcugccaugggagcgguauuuacugaggaaaaucagugggauucugcaaaggccgcuguggaggacgaagauuucuggaaacucgucgacagagagcgcgagcugcacaagcuaggcaaaugugguagcugcguguacaacaugauggggaagagggaaaaaaagcuuggagaguuuggcaaggccaaaggcucacgggcaaucugguauauguggcugggggcuagauaccucgaauucgaggcccugggauuuuugaaugaggaucauugguucucccgcgaaaacaguuacagcgguguugagggcgaagggcugcacaagcucggauauauacuuagggacaucucuaaaauucccggcggugcuauguacgccgaugacaccgcagggugggacacacgaaucacugaggaugaccugcacaaugaagagaagauuacccagcagauggauccagagcaucggcaauuagcgaacgccaucuuuaaacugacguaucagaauaagguggucaaggugcagagaccuacacccaccggaacuguaauggacauaauuuccaggaaagaucagcgcggcucaggccaaguugggacauacggauugaacaccuucacuaauauggaagcucagcucauccgucagauggagggugaaggcgugcugagcaaggccgaccuagagaacccacaccuucccgaaaaaaagaucacccaguggcuggagacaaaaggggucgagcggcucaagagaauggcaauuucgggagaugacugcguggugaagccuauagaugacagguuugcuaacgcccuguuggcauuaaaugauaugggcaaaguccgcaaggacaucccacaauggcagccgucuaaagguuggcaugauuggcagcagguucccuucuguagucaccacuuccaugaacugauuaugaaggacgggcgaaaacucgugguaccuugccggccacaagacgagcuuaucggaagagccaggauuucccagggcgcgggcuggagccugcgcgaaacggcuugucuagggaaggccuaugcacagauguggucacugauguacuuucacagacgggaucucagguuggccuccaacgcuaucugcucugccgugcccguccauugggugccuaccagccguacuacauggaguauacacgcacaucaccaauggaugaccacugaggacaugcugacaguuuggaaucgaguguggaucgaagauaacccauggauggaggacaagacccccgucacgacaugggagaaugugccuuaucuuggaaaacgcgaagaucaguggugugguucccugauuggccucaccagcagagcuacuugggcccagaacaucccgaccgcgauucagcaaguacggucuuuaaucgggaaugaggaauuccuggacuacaugccaucaaugaagagguuucgcaaagaggaggaaagugagggagcuauuugguga

SEQ ID NO: 15116 - RNA, 9873 nt, Artificial Sequence
  derived and/or modified CDS sequence (opt3) from DENV-3__KT726351__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucagaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagauguucccuguaaaaucccuuucuccacagaggacggccaagguaaggcucauaacgggcgucuuauaacugcgaauccagugguaaccaaaaaggaggaacccgucaacauugaggcagaaccgccuuucggcgagucaaauaucgugaucggaauuggcgauaacgccuugaaaaucaauugguauaagaaggggagcaguauuggaaaaauguuugaagcuacagcccgcggugcaagaaggauggccauacugggcgacacugcuugggauuucgggucuguuggaggcgugcucaacucccuggguaagaugguccaccagaucuuugggagcgccuacaccgcacuuuucucgggcgugucuuggguaaugaaaauuggaaucggcgugcuguugacguggaucgggcucaauuccaagaacacaucaaugaguuuuagcugcauugcgauaggaaucauuacccuguauuuaggcgcuguuguccaggccgacauggguugugugaucaauuggaaagggaaggagcugaagugcggauccggcauuuucgugacuaacgagguccauacauggaccgaacaguacaaauuucaagcagauucucccaagcggcuagccacugcuaucgccggugcaugggagaauggcguuugugggauacgaagcaccacacgcauggaaaaccuccuguggaaacagaucgcuaaugagcuuaacuauauuuugugggaaaauaacaucaagcugacgguggugguaggagacauuaucggcguccucgagcaggggaaaagaacccugacuccacagccuauggaguuaaaguacucauggaaaacauggggaaaggccaagauagugaccgcggaaacacaaaacaguuccuucauuaucgauggccccaauacuccagagugccccagcgccucuagggcuuggaacguuugggaaguggaggacuaugguuuuggggucuucaccacgaauauuuggcugaaacuucgggaaguguacacacaguugugugaccaccgccucaugucagcagccguuaaggaugagagagcugugcacgccgacaugggauacuggaucgagagucagaaaaacggcagcuggaagcuggaaaaagcaucccuaauagagguaaagaccugcacuuggccuaagucucauacccuguggucgaaugguguccucgaaagcgauaugaucauuccaaaaucccuggcgggcccgaucucacagcacaaccauaggcccggguaucacacacaaacugccggaccuuggcaccuuggcaaguuggagcuggacuuuaauuacugcgaggggaccacaguggugauuacggaaaacuguggaacccguggcccaaguuuacggacuacaaccgucucugguaaacucauccaugaguggugcugucgaagcugcacucugcccccucuuagauauaugggggaagauggauguugguacggcauggagauaaggccaauuuccgaaaaggaggagaauaugguuaaaucacuggugagcgcugguucuggcaagguagacaacuucacaauggggguguugugccucgccauccuguuugaagaggucaugcgcggaaaguucggcaaaaagcacaugaucgcagggguguucuuuaccuucguucuacugcucuccggacagauuacguggcgggauauggcucauacucugaucaugauuggcaguaaugccagcgacagaauggguaugggggugaccuaucuugcauugauagccacauuuaaaauccagcccuuccuggcuuuaggauuuuuccucaggaagcugaccucucgcgaaaaccuucugcuaggcgucggccucgcgauggccacuacacugcaauugccggaggauauugaacagauggcaaaugggaucgcucugggauuaauggcccucaaacugauuacccaguuugagacauaccagcuuuggacugcccugaucuccuugaccuguucaaacacgauauucacacucaccguggcuuggcgaacugcaacccugauccuagccgguguuagucugcuuccugugugccaaagcucguccaugcggaagacagacuggcucccaauggcggucgcugccaugggcguacccccucugcccuuguuuauuuucucucugaaggauacuuuaaaacguagaagcuggccacucaaugagggggugauggcaguuggacuggugucaauccuugccaguucccuguugaggaacgacgucccuauggcuggcccccucguggcaggugggcugcuaauugccuguuauguaaucaccggaacgucugcggaucugacaguggaaaaggcugccgacauaaccugggaggaagaggcagaacagacuggcgucagccacaaccuuaugauuacaguugacgaugacggcaccaugcgcaucaaagaugacgagacugagaauauccucacagugcuguugaagaccgccuuacugauuguguccgggauauuuccauacucaaucccggcuacgcuccuggucuggcauacuuggcagaaacagacccaacggagcggagugcuuugggauguuccuagucccccagaaacacagaaggccgagcuggaagaggguguauacagaauuaaacagcagggcaucuucgggaagacccaagugggagucggcgugcagaaggaggguguuuuucacacaauguggcacgugacuaggggggcagucuugacccauaacggaaaacgacuagaacccaauugggcuucugugaagaaagaccugauuuccuauggcggcggguggcgccucagcgcccaguggcaaaagggagaggaaguacaggucaucgcgguggagccugguaaaaacccaaagaauuuccagacgaugcccggcacauuccagacuaccacaggggaaauaggagccaucgcacuggauuuuaagccuggcaccucggguucaccgauuaucaaccgggaggggaaaguugugggacuuuacggcaauggcgucgugacuaagaacgggggauauguuucugguauugcucaaaccaaugccgagccagacggccccacaccugaauuagaggaagagauguucaaaaagagaaaccugacgaucauggaucuccacccagggaguggaaaaacuaggaaguacuugcccgcuauagugcgugaagcaauuaagcgccggcugagaacccucauccuggccccuacaagggucguggccgcugagauggaggaagcgcuuaaaggccugccgauccgauaucagaccacugcaacaaaguccgagcauaccggucgggaaauuguagacuugaugugccacgccacguuuacuaugcgccuacugagccccgugagaguuccaaauuacaaccucaucauaauggaugaggcucauuucacagacccugccucuauugcagccaggggguauaucagcacccgggucggaaugggcgaagcugcggccauuuuuaugaccgcaacucccccaggcacagcugaugccuucccucaguccaaugcacccauccaggacgaggagcgagacauaccagaaagaucauggaacagugggaaugaguggauuaccgauuuugccggaaaaacagugugguucgugccgagcaucaaggcugguaacgacaucgccaacuguuuacgcaaaaauggcaagaaggucauucaacugucuaggaaaacuuuugauacggaauaccagaagaccaaacuuaacgacugggauuucguagugacaacugacaucuccgagaugggggcgaauuuuaaggcagaucguguuauugacccucggagaugccugaaacccgugauacucaccgauggaccagagagggucaucuuggccggccccaugccugugacagcugccucagcugcacagcgccgagguagaguugggcggaacccacagaaggaaaaugaccaauacauuuucaccggccagccccugaacaaugaugaggaccacgcccacuggacugaagcuaagaugcuccuggacaacaucaauacgccugagggaaucauuccggcccuuuucgaaccagagagggagaaaagugcagcgauagauggcgaauaucgccuaaagggggagagccguaaaaccuuuguggaacugaugagacggggagacuugcccgucugguuagcccauaagguggcuuccgaggguaucaaauacacagauaggaaguggugcuucgacggccagcgcaacaaucagauucuggaagagaacauggauguagagaucuggacuaaagaaggggagaagaagaaacuccgaccuagauggcuggacgcccggaccuauucugauccccuugcacugaaggaauuuaaagacuucgcugccggaaggaagucgauugcacucgauuuggugacagagaucggccgcguuccaagccaccuggcccauagaaccaggaaugcucuagacaaccuggucaugcuccacacuucagaacacggugggcgggcguaccgucaugccguggaggagcuuccugaaacaauggagacgcuguuauugcugggccucaugauacugcuuaccggaggcgcaaugcuguuucucaucuccgggaaaggaauugguaagacuaguaucggcuugauuugugugaucgcuucuagcgggaugcuguggauggccgaaauacccuuacaauggauugccuccgcaaucguccuagaguucuuuaugaugguucugcucauuccagagccugaaaagcagcgcacaccgcaggauaaucaacuugcuuaugugguaaucggaauacugaccuuggccgcgaucauugcugccaacgagaugggccugcucgaaaccacaaaacgagaccuggguaugucaaaggagcccgggguggucucuccaacuagcuaccuugauguggaccuccacccugcaagugccuggacgcuguaugcuguugcaaccacagugaucacucccauguugagacauaccauugaaaauuccacagccaacgucagccuggcggcuaucgccaaccaggcaguaguguuaaugggccuagacaaaggauggccaauaucuaagauggaucugggcguuccucuccuugcccuggggugcuacucacaggugaaucccuugacccugacugcugccguccuccugcuuauuacgcacuacgcaaucaucggaccgggcuuacaggcuaaagccacaagggaggcgcaaaagcggaccgccgcagguauuaugaagaacccaacuguggacgggaucaugaccauagaucuggacccugucauuuaugauuccaaauucgagaagcagcucggacaggugauguugcugguucuaugugcugugcagcugcuccuuaugcgcacaaguugggcccugugcgaagcauugacucuggcuaccggccccaucacaacgcucugggaggguagcccaggcaaauuuuggaauaccacuauugccguaucgauggccaacaucuucagagggucuuaccuggcgggagcuggcuuagcauuuuccauaaugaagagcguggggacaggaaaaaggggcaccgguucacaaggggaaacucuuggagagaaguggaagaaaaagcugaaucagcucagucggaaagaauucgaccuauauaagaaaucuggcaucacagaggucgaucgaaccgaggccaaggaaggucugaaaagaggcgagauuacgcaucacgcuguuucccgcgggagcgccaaguugcagugguuuguggaaaggaacauggucauccccgagggacgggugauugaccugggcugugggcguggaggcuggucauacuauugcgcaggucucaagaaaguaaccgaagugagaggguacacaaagggaggcccuggccacgaggagccgguucccaugaguacuuauggguggaauaucgugaaacuuaugagcggaaaggaugucuucuaccugccaccugaaaaaugugacaccuugcugugcgauauuggugaguccucucccagcccuacaguggaagaguccaggacuauccgcguccucaagaugguggagccaugguuaaagaacaaucaguucuguauaaaaguucugaaccccuacaugccuaccguaauugaacaucuugagcggcugcaacgaaagcacggcgggaugcuagugagaaauccacucucaaggaacucuacacaugaaauguauuggaucaguaauggaaccggcaacaucgucgccucggugaauaugguuagccgccuguugcugaaccgguuuacuaugacgcacagacgucccacaauugagaaagacguggaucucggugcugggaccaggcacgucaacgcggaaccggagacuccuaauauggacgugauaggagagcggaucaagcgcauuaaagaagagcauaacuccaccuggcacuacgacgaugaaaauccauauaagacaugggccuaccauggcucuuaugagguaaaggcaacgggcucagcuagcuccaugaucaacggggugguuaaacuucugaccaagcccugggacgucgugccuauggugacucagauggccaugacagauaccacuccauucggacagcaacgagucuuuaaagaaaagguugacacaagaacccccaggaguaugccggguacacggaaagugaugggcauuacugcagagugguuauggcgcacccuggggagaaauaagaagccuagguugugcacgcgagaggaauucaccaaaaagguacggacaaacgccgcuaugggagccguguuuacugaggaaaaucagugggauucugcgaaagcagccgucgaggacgaagauuucuggaagcucguggaccgugagagagagcugcacaaacuaggcaagugugguagcugcguuuacaacaugauggggaaacgcgaaaagaagcuuggagaguuuggcaaagcuaagggcucaagggccaucugguauauguggcugggggcacgguaccucgaauucgaggcucugggauuuuugaaugaggaucauugguucuccagagaaaacaguuacagcgguguggagggcgaagggcugcacaaacucggauauauacuucgcgacaucucuaagauucccggcggugccauguacgcugaugacaccgccgggugggacacaaggaucacugaggaugaccugcacaaugaagagaaaauuacccagcagauggauccagagcaucgacaauuagcaaacgcgaucuuuaagcugacguaucagaauaaggucgugaaaguacagcggccuacacccaccggaacuguuauggacauaauuuccagaaaggaucagaggggcucaggccaaguggggacauacggauugaacaccuucacuaauauggaagcccagcucauccgccagauggagggugaaggcguccugagcaaagcugaccuagagaacccacaccuucccgaaaagaaaaucacccaguggcuggagacaaaggggguggagcgucucaagcggauggccauuucgggagaugacugcguggucaaaccuauagaugacagauuugcaaacgcucuguuggccuuaaaugauaugggcaagguuaggaaagacaucccacaauggcagccgucuaaggguuggcaugauuggcagcaggugcccuucuguagucaccacuuccaugaacugauuaugaaagacgggcgcaagcucguagugccuugccgaccacaagacgagcuuaucggacgggcaagaauuucccagggcgccggcuggagccugagggaaacggcgugucuagggaaggcuuaugcccagauguggucacugauguacuuucaccgcagagaucuccgguuggcauccaacgccaucugcucugcuguccccgugcauuggguuccuaccagcaggacuacauggaguauacacgcccaucaccaauggaugaccacugaggacaugcugacaguguggaaucgugucuggaucgaagauaacccauggauggaggacaaaacccccgugacgacaugggagaauguaccuuaucuuggaaagcgagaagaucaguggugugguucccugauuggccucaccagccgcgcaacuugggcucagaacaucccgaccgccauucagcaaguuagaucuuuaaucgggaaugaggaauuccuggacuacaugccaucaaugaaacgguuuaggaaggaggaggaaagugagggagcgauuugguga

SEQ ID NO: 15117 - RNA, 9873 nt, Artificial Sequence
  derived and/or modified CDS sequence (opt3) from DENV-3__KT726360__SS-prME
accagccugugccucaugaugauccuucccgcagcucuggcauuccacuugacuuccagagacggcgagccuaggaugauuguggggaagaacgaacggggaaagucuuuacuguuuaagacugccucagguauaaauauguguacgcuaaucgcgauggaucucggcgagaugugcgacgauaccgucacauacaaguguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccagacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucagcuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucaaaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagauguucccuguaaaaucccuuucuccacagaggacggccaagguaaggcucauaacgggcgucuuauaacugcgaauccagugguaaccaaaaaggaggaacccgucaacauugaggcagaaccgccuuucggcgagucaaauaucgugaucggaauuggcgauaacgccuugaaaaucaauugguauaagaaggggagcaguauuggaaaaauguuugaagcuacagcccgcggugcaagaaggauggccauacugggcgacacugcuugggauuucgggucuguuggaggcgugcucaacucccuggguaagaugguccaccagaucuuugggagcgccuacaccgcacuuuucucgggcgugucuuggguaaugaaaauuggaaucggcgugcuguugacguggaucgggcucaauuccaagaacacaucaaugaguuuuagcugcauugcgauaggaaucauuacccuguauuuaggcgcuguuguccaggccgacauggguugugugaucaauuggaaagggaaggagcugaagugcggauccggcauuuucgugacuaacgagguccauacauggaccgaacaguacaaauuucaagcagauucucccaagcggcuagccacugcuaucgccggugcaugggagaauggcguuugugggauacgaagcaccacacgcauggaaaaccuccuguggaaacagaucgcuaaugagcuuaacuauauuuugugggaaaauaacaucaagcugacgguggugguaggagacauuaucggcguccucgagcaggggaaaagaacccugacuccacagccuauggaguuaaaguacucauggaaaacauggggaaaggccaagauagugaccgcggaaacacaaaacaguuccuucauuaucgauggccccaauacuccagagugccccagcgccucuagggcuuggaacguuugggaaguggaggacuaugguuuuggggucuucaccacgaauauuuggcugaaacuucgggaaguguacacacaguugugugaccaccgccucaugucagcagccguuaaggaugagagagcugugcacgccgacaugggauacuggaucgagagucagaaaaacggcagcuggaagcuggaaaaagcaucccuaauagagguaaagaccugcacuuggccuaagucucauacccuguggucgaaugguguccucgaaagcgauaugaucauuccaaaaucccuggcgggcccgaucucacagcacaaccauaggcccggguaucacacacaaacugccggaccuuggcaccuuggcaaguuggagcuggacuuuaauuacugcgaggggaccacaguggugauuacggaaaacuguggaacccguggcccaaguuuacggacuacaaccgucucugguaaacucauccaugaguggugcugucgaagcugcacucugcccccucuuagauauaugggggaagauggauguugguacggcauggagauaaggccaauuuccgaaaaggaggagaauaugguuaaaucacuggugagcgcugguucuggcaagguagacaacuucacaauggggguguugugccucgccauccuguuugaagaggucaugcgcggaaaguucggcaaaaagcacaugaucgcagggguguucuuuaccuucguucuacugcucuccggacagauuacguggcgggauauggcucauacucugaucaugauuggcaguaaugccagcgacagaauggguaugggggugaccuaucuugcauugauagccacauuuaaaauccagcccuuccuggcuuuaggauuuuuccucaggaagcugaccucucgcgaaaaccuucugcuaggcgucggccucgcgauggccacuacacugcaauugccggaggauauugaacagauggcaaaugggaucgcucugggauuaauggcccucaaacugauuacccaguuugagacauaccagcuuuggacugcccugaucuccuugaccuguucaaacacgauauucacacucaccguggcuuggcgaacugcaacccugauccuagccgguguuagucugcuuccugugugccaaagcucguccaugcggaagacagacuggcucccaauggcggucgcugccaugggcguacccccucugcccuuguuuauuuucucucugaaggauacuuuaaaacguagaagcuggccacucaaugagggggugauggcaguuggacuggugucaauccuugccaguucccuguugaggaacgacgucccuauggcuggcccccucguggccggugggcugcuaauugccuguuauguaaucaccggaacgucugcggaucugacaguggaaaaggcugccgacauaaccugggaggaagaggcagaacagacuggcgucagccacaaccuuaugauuacaguugacgaugacggcaccaugcgcaucaaagaugacgagacugagaauauccucacagugcuguugaagaccgccuuacugauuguguccgggauauuuccauacucaaucccggcuacgcuccuggucuggcauacuuggcagaaacagacccaacggagcggagugcuuugggauguuccuagucccccagaaacacagaaggccgagcuggaagaggguguauacagaauuaaacagcagggcaucuucgggaagacccaagugggagucggcgugcagaaggaggguguuuuucacacaauguggcacgugacuagaggggcagucuugacccauaacggaaaacgacuagaacccaauugggcuucugugaagaaagaccugauuuccuauggcggcggguggcgccucagcgcccaguggcaaaagggagaggaaguacaggucaucgcgguggagccugguaaaaacccaaagaauuuccagacgaugcccggcacauuccagacuaccacaggggaaauaggagccaucgcacuggauuuuaagccuggcaccucggguucaccgauuaucaaccgggaggggaaaguugugggacuuuacggcaauggcgucgugacuaagaacgggggauauguuucugguauugcucaaaccaaugccgagccagacggccccacaccugaauuagaggaagagauguucaaaaagagaaaccugacgaucauggaucuccacccagggaguggaaaaacuaggaaguacuugcccgcuauagugcgugaagcaauuaagcgccggcugagaacccucauccuggccccuacaagggucguggccgcugagauggaggaagcgcuuaaaggccugccgauccgauaucagaccacugcaacaaaguccgagcauaccggucgggaaauuguagacuugaugugccacgccacguuuacuaugcgccuacugagccccgugagaguuccaaauuacaaccucaucauaauggaugaggcucauuucacagacccugccucuauugcagccaggggguauaucagcacccgggucggaaugggcgaagcugcggccauuuuuaugaccgcaacucccccaggcacagcugaugccuucccucaguccaaugcacccauccaggacgaggagcgagacauaccagaaagaucauggaacagugggaaugaguggauuaccgauuuugccggaaaaacagugugguucgugccgagcaucaaggcugguaacgacaucgccaacuguuuacgcaaaaauggcaagaaggucauucaacugucuaggaaaacuuuugauacggaauaccagaagaccaaacuuaacgacugggauuucguagugacaacugacaucuccgagaugggggcgaauuuuaaggcagaucguguuauugacccucggagaugccugaaacccgugauacucaccgauggaccagagagggucaucuuggccggccccaugccugugacagcugccucagcugcacagcgccgagguagaguugggcggaacccacagaaggaaaaugaccaauacauuuucaccggccagccccugaacaaugaugaggaccacgcccacuggacugaagcuaagaugcuccuggacaacaucaauacgccugagggaaucauuccggcccuuuucgaaccagagagggagaaaagugcagcgauagauggcgaauaucgccuaaagggggagagccguaaaaccuuuguggaacugaugagacggggagacuugcccgucugguuagcccauaagguggcuuccgaggguaucaaauacacagauaggaaguggugcuucgacggccagcgcaacaaucagauucuggaagagaacauggauguagagaucuggacuaaagaaggggagaagaagaaacuccgaccuagauggcuggacgcccggaccuauucugauccccuugcacugaaggaauuuaaagacuucgcugccggaaggaagucgauugcacucgauuuggugacagagaucggccgcguuccaagccaccuggcccauagaaccaggaaugcucuagacaaccuggucaugcuccacacuucagaacacggugggcgggcguaccgucaugccguggaggagcuuccugaaacaauggagacgcuguuauugcugggccucaugauacugcuuaccggaggcgcaaugcuguuucucaucuccgggaaaggaauugguaagacaaguaucggcuugauuugugugaucgcuucuagcgggaugcuguggauggccgaaauacccuuacaauggauugccuccgcaaucguccuagaguucuuuaugaugguucugcucauuccagagccugaaaagcagcgcacaccgcaggauaaucaacuugcuuaugugguaaucggaauacugaccuuggccgcgaucauugcugccaacgagaugggccugcucgaaaccacaaaacgagaccuggguaugucaaaggaucccgggguggucucuccaacuagcuaccuugacguggaccuccacccugcaagugccuggacgcuguaugcuguugcaaccacagugaucacucccauguugagacauaccauugaaaauuccacagccaacgucagccuggcggcuaucgccaaccaggcaguaguguuaaugggccuagauaaaggauggccaauaucuaagauggaccugggcguuccucuccuugcccuggggugcuacucacaggugaaucccuugacccugacugcugccguccuccugcuuauuacgcacuacgcaaucaucggaccgggcuuacaggcuaaagccacaagggaagcgcaaaagcggaccgccgcagguauuaugaagaacccaacuguggaugggaucaugaccauagaccuggauccugucauuuaugacuccaaauucgagaagcagcucggacaggugauguugcugguucuaugugcugugcagcugcuccuuaugcgcacaaguugggcccugugcgaggcauugacucuggcuaccggccccaucacaacgcucugggaagguagcccaggcaaauuuuggaauaccacuauugccguaucgauggccaacaucuucagagggucuuaccuggcgggagcuggcuuagcauuuuccauaaugaaaagcguggggacaggaaaaaggggcaccgguucacaaggggagacucuuggagaaaaguggaagaaaaagcugaaucagcucagucggaaagaguucgaucuauauaagaaaucuggcaucacagaagucgaccgaaccgaggccaaggagggucugaaaagaggcgaaauuacgcaucacgcuguuucccgcgggagcgccaaguugcagugguuuguggagaggaacauggucauccccgaaggacgggugauugaucugggcugugggcguggaggcuggucauacuauugcgcaggucucaagaaaguaaccgaggugagaggguacacaaagggaggcccuggccacgaggagccgguucccaugaguacuuauggguggaauaucgugaaacuuaugagcggaaaggacgucuucuaccugccaccugagaaaugugauaccuugcugugcgacauuggugaauccucucccagcccuacaguggaggaauccaggacuauccgcguccucaagaugguggagccaugguuaaagaacaaucaguucuguauaaaaguucugaaccccuacaugccuaccguaauugagcaucuugaacggcugcaacgaaagcacggcgggaugcuagugagaaauccacucucaaggaacucuacacaugagauguauuggaucaguaauggaaccggcaacaucgucgccucggugaauaugguuagccgccuguugcugaaccgguuuacuaugacgcacagacgucccacaauugaaaaagauguggaccucggugcugggaccaggcacgucaacgcggagccggaaacuccuaauauggacgugauaggagagcggaucaagcgcauuaaagaggaacauaacuccaccuggcacuacgaugacgagaauccauauaagacaugggccuaccauggcucuuaugaaguaaaggcaacgggcucagcuagcuccaugaucaacggggugguuaaacuucugaccaagcccugggaugucgugccuauggugacucagauggccaugacagacaccacuccauucggacagcaacgagucuuuaaagagaagguugauacaagaacccccaggaguaugccggguacacggcgcgugaugggcauuacugcagaaugguuauggagaacccuggggaggaauaaaaagccucgauugugcacgcgggaggaguucaccaagaaaguacguacaaacgccgcuaugggagccguguuuacugaagagaaucagugggacucugcgaaggcagccgucgaagaugaggacuucuggaaacucguggauagagaacgcgagcugcacaagcuaggcaaaugugguagcugcguuuacaacaugauggggaagagggagaagaaacuuggagaauuuggcaaagcuaaaggcucacgggccaucugguauauguggcugggggcaagauaccucgaguucgaagcucugggauuuuugaaugaggaccauugguucucccgcgagaacaguuacagcgguguggaaggcgaggggcugcacaagcucggauauauacuuagggauaucucuaaaauucccggcggugccauguacgcugacgacaccgccgggugggauacacgaaucacugaagacgaucugcacaaugaggaaaagauuacccagcagauggacccagagcaucggcaauuagcaaacgcgaucuuuaaacugacguaucagaauaaggucgugaagguacagagaccuacacccaccggaacuguuauggauauaauuuccaggaaagaccagcgcggcucaggccaaguggggacauacggauugaacaccuucacuaauauggaggcccagcucauccgucagauggaaggugagggcguccugagcaaggcugaucuagaaaacccacaccuucccgagaaaaagaucacccaguggcuggaaacaaaagggguggagcggcucaagagaauggccauuucgggagacgauugcguggucaagccuauagacgauagguuugcaaacgcucuguuggccuuaaaugacaugggcaaaguucgcaaggauaucccacaauggcagccgucuaaagguuggcaugacuggcaacaggugcccuucuguagucaccacuuccaugagcugauuaugaaggacgggcgaaaacucguagugccuugccggccacaagaugaacuuaucggaagggcaaggauuucccagggcgccggcuggagccugcgcgagacggcgugucuagggaaggcuuaugcccagauguggucacugauguacuuucacagacgggaccucagguuggcauccaacgccaucugcucugcuguccccgugcauuggguuccuaccagccguacuacauggaguauacacgcccaucaccaauggaugaccacugaagauaugcugacaguguggaaucgagucuggaucgaggacaacccauggauggaagauaagacccccgugacgacaugggagaauguaccuuaucuuggaaaacgcgaggaccaguggugugguucccugauuggccucaccagcagagcaacuugggcucagaacaucccgaccgccauucagcaaguucggucuuuaaucgggaaugaagaguuccuggauuacaugccaucaaugaagagguuucgcaaagaagaggagagugaaggagcgauuugguga

SEQ ID NO: 15118 - RNA, 9873 nt, Artificial Sequence
  derived and/or modified CDS sequence (opt3) from DENV-3__KF041259__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuaacgaaguugagccggaagacaucgauugcugguguaaucugacuaguaccugggugacauaugggaccugcaaccaggcuggagagcaccgccgagacaagcguagcguagcccuugcaccccaugugggcaugggucuggauacuagaacacaaaccuggauguccgccgagggggcuuggaggcaggucgaaaaaguggagacgugggcauugcggcacccuggauucacuauucucgcccuguuucuggcucauuacaucggcaccucucucacacagaagguugugauauucaucuuacugaugcuugucacuccaucgaugaccaugcgcugugugggcguagggaauagagacuuuguugaaggauugucaggugccacauggguggaugucgugcuggagcacggcgggugcgugaccacgauggcgaagaacaaacccacucuagacauugagcuccagaagacagaagcaacccaacuggccacucuuaggaaacuguguaucgagggaaagauuacaaauaucaccacggauagccggugcccuacccagggcgaagcugucuugccagaggaacaggaccagaacuauguuuguaaacacacauacguggaucgcgguugggggaauggaugcggccucuucggcaaggggagucugguaacuugcgccaaguuucaauguuuagagcccauagagggaaaagugguccaguaugaaaaccugaaguacaccgugauuaucacaguucauacuggugaccagcaccaggugggcaaugagacccaaggggucacagcagaaauuaccccucaggcuuccacuacggaggccauccucccagaauauggaacacuuggccuggagugcucuccgcgaaccgguuuggacuucaacgagaugauccuacugacuaugaaaaauaaggcguggauggugcauagacagugguuuuucgaucucccccugccuuggaccagcggggccacaaccgaaacuccaacauggaacaggaaagagcuucugguaacguuuaagaaugcacacgcuaaaaagcaagaaguuguggucuugggcucccaggagggagccaugcacaccgcucucacuggcgccacagaaauucagaacucagggggaaccaguauauucgcaggucaucugaagugucgguuaaaaauggacaagcuggagcuaaaaggcaugagcuacgccaugugcacaaacacuuuugugcucaagaaagaggucucugaaacccagcacgggacgauccugauuaagguggaguacaagggagaagaugcucccuguaaaaucccuuucuccaccgaggacggccaagguaaggcgcauaaugggcgucuuauaacagcaaacccaguugugacuaaaaaggaggaacccguaaauauugaggccgaaccgccuuucggcgagucaaacaucgucaucggaauuggcgauaaugcuuugaaaaucaacugguauaagaaggggagcaguauuggaaaaauguuugaagccaccgcacgcggugccagaaggauggcuauacugggcgacacagccugggauuucgggucugugggaggcguucucaauucccuggguaagauggugcaccagaucuuugggagcgcauacacugcgcuuuucucgggcgucucuugggugaugaaaauuggaaucggcguacuguugaccuggaucgggcucaacuccaagaauacgucaaugaguuuuagcugcauugcuauaggaaucauuacacuguauuuaggcgccgugguucaggcagacauggguugugucaucaacuggaaagggaaggagcugaagugcggauccggcauuuucgugaccaaugaggugcauacuuggacagaacaguacaaauuucaagccgauucucccaagcggcuagcuaccgccaucgcaggugcuugggagaacggcgucugugggauacgaagcacuacccgcauggaaaaucuccuguggaaacagaucgccaacgagcuuaauuauauuuugugggaaaacaacaucaagcugacaguuguggugggagacacgauuggcguacucgagcaggggaaaagaacccugacuccacagccuauggaguuaaaguacucauggaaaacauggggaaaggcgaagaucgucaccgccgaaacacaaaauaguuccuucauaauugauggccccaacacuccagagugccccagcgcuucuagggcauggaaugugugggaaguugaggacuaugguuuugggguguucaccacgaacaucuggcugaaacuucgggaagucuacacacagaugugugaccaccgcuugaugucagccgcugugaaggaugagagagccguucacgcagacaugggauacuggauugagagucagaaaaauggcagcuggaagcucgaaaaagcgucccugaucgaggugaagaccugcacuuggccuaagucucauacccuauggucgaacgguguacuggaaagcgauaugauaaucccaaaaucccucgccggcccgauuucacagcacaauuauaggcccggguaccauacacaaacugcuggaccuuggcaccugggccgucuugaguuggacuuuaacuauugcgaggggaccacagucgugaucacggaaaauuguggaacccggggcccaagucugcgaacuacaaccgugucugguaaguuaauucacgaguggugcuguagaagcugcacucuccccccucugagguacaugggggaagauggauguugguauggcauggagauccgcccaauauccgaaaaagaggagaacauggucaagucacuuguuagcgccgguucuggcaaaguggacaauuucacaauggggguacugugcuuggcaauucucuuugaagaggugaugcggggaaaguucggcaagaaacauaugaucgcuggggucuucuuuaccuucgugcugcuacuguccggacagaucacguggagagauauggcccacacucucauuaugaucggcaguaacgcaagcgacaggauggguauggggguuaccuaccuggcccuuauugcuacauuuaagauacagcccuucuuggcgcugggauuuuucuuacgcaaacucaccucucgagaaaaucugcuucugggcgugggccuagccauggcaacuacacuccaacugccggaggauaucgaacagauggcuaacgggauugccuugggacugauggccuuaaagcucaucacccaguuugagacauaucagcuguggacugcucuuauuucccugaccuguucaaauacgaucuucacauugaccgucgcauggcggacugccacccucauacuggcgggugugagucuacugccuguuugccaaagcucguccaugcguaaaacagacuggcuuccaaugacuguggcugccaugggcguccccccucucccccuguuuaucuucucuuugaaggauacccugaagagaaggagcuggccauuaaacgaggggguaauggcagugggacucguuucaauucuggccaguucccuucugcgcaacgacgugccuauggcuggccccuuggucgcaggugggcuccugaucgccuguuacgugauuacgggaacaucugcggaucuaaccguagaaaaagcugccgacgugacuugggaggaagaggcagaacagacaggcgucagccauaaucugaugaucaccguugacgaugacggcacuaugcggauaaaggaugacgagacagagaacauucuuaccgugcuccugaaaacggccuuguuaaucguguccgggaucuuuccauacucaauuccggcuacucugcucgucuggcacaccuggcagaagcagacacaaagaagcggagugcugugggauguuccuagucccccagaaacccagaaagccgagcuugaagaggguguauauaggauaaagcagcagggcauccuggggaaaacacaagugggagucggcgugcagaaggaggguguuuuccauacuauguggcacgugacccgaggggcagucuugacgcacaauggaaagcgccuagaacccaacugggcuucugugaaaaaggaccugauuuccuacggcggcggguggcggcucagcgcccaguggcaaaaaggagaggaaguacaggucaucgcgguggagccugguaagaauccaaaaaacuuucagacaaugcccggcacuuuccagaccacaaccggggaaauuggagccaucgcacuggauuucaagccuggcacuucggguucaccgauaaucaauagagaggggaagguugugggacuuuauggcaacggcgucgugaccaaaaaugggggauacguuucugguauugcucaaacaaacgccgagccagacggccccacgccugaauuagaggaagagauguuuaagaaaaggaaucugacuaucauggaucuccauccagggaguggaaagacccguaaauauuugcccgcuauugugcgcgaagcaaucaagcggagacugaggacacucauacuggccccuacccgagucguggccgcugagauggaggaagcgcuuaagggccugccgauucgguaccagacuacagcaaccaaauccgagcacacgggucgcgaaaucguagacuugaugugccaugccacuuucacaaugagacuacugagccccgugaggguuccaaacuauaaucucaucauuauggaugaggcucacuuuaccgacccugccucuaucgcagcccggggguacauaagcacccgagucggaaugggcgaagcugcggccauuuucaugacugcaacacccccaggcaccgcugaugccuuuccucaguccaacgcacccauccaggacgaggagagagacauuccagaacgcucauggaauagugggaacgaguggaucacagauuucgccggaaagacugugugguuugugccgagcauaaaagcugguaacgacauugccaauuguuuaaggaagaacggcaaaaaggucauccaacugucucguaagacguucgauaccgaauaccagaaaacaaagcuuaaugacugggauuuuguagugacuaccgacaucuccgagaugggggcgaacuucaaagcagaucggguuauugacccuagaaggugccugaagcccgugauccucacagauggaccagagcgcgucauuuuggccggccccaugccugugaccgcugccucagcugcacagcgaagaggucggguugggaggaauccacagaaagaaaacgaccaauauauauuuacuggccagccccugaauaacgaugaggaccaugcccacuggacggaagcuaagaugcuccuggacaauaucaacaccccugagggaauuaucccggcccuuuucgaaccagagcgcgagaagagugcagcgaucgauggcgaauaccgucuaaaaggggagagcagaaagacauucguggaacugaugcggaggggagacuugcccgucugguuagcccacaaaguggcuuccgaggguauuaaguauacugaucgcaaauggugcuuugacggccagcgaaauaaccagauacuggaagagaauauggauguagagaucuggaccaaggaaggggagaaaagaaagcuccggccuagguggcuggacgcccgcacauacucugauccccuugcacugaaggaauucaaagacuuugcugccggaagaaagucgauugcacucgauuuggugaccgagaucggcaggguuccaagccaucuggcccaccggacucguaacgcucuagacaaucuggucaugcuccauacaucagaacacggugggcgcgcguaucgacacgccguggaggagcuuccugaaacgauggagacccuguuauugcugggccucaugauucugcuuacuggaggcgcaaugcuguuccucaucuccgggaaaggaauagguaagacaaguaucggcuugauuugugugaucgcuucuagcgggaugcuguggauggccgaaauucccuuacaauggaucgccuccgcaauaguccuagaguuuuucaugaugguucugcucauuccagagccugaaaaacagagaaccccgcaggauaaccaacuugcuuacgugguaaucggaauucugaccuuggccgcgaucauagcugccaaugagaugggccugcucgaaacaacuaagagggaccuggguaugucaaaggagcccgggguggucucuccaacgagcuaucuugauguggaccuccauccugcaagugccuggacccuguacgcuguugcaacaacugugaucacccccauguugcggcacacaauugaaaacuccaccgccaacgucagccuggcggcuaucgccaaucaggcaguaguguuaaugggccuagacaaaggauggccaauuucuaagauggaucugggcguuccucuccuugcccuggggugcuacucacaggugaaccccuugacucugacggcugccguccuccugcuuaucacacauuaugcaauaauuggaccgggcuuacaggcuaaagccacccgcgaggcgcaaaagagaacugccgcagguaucaugaaaaauccaaccguggacgggaucauuacaaucgaucuggacccugucauauacgauuccaaguuugagaagcagcucggacaggugauguugcugguucuaugugcugugcagcugcuccuuaugaggacuaguugggcccugugcgaagcauugacccuggcuacaggccccauuacgacccucugggaggguagcccaggcaaauucuggaacacuacaaucgccguaucgauggccaauauuuuucgggggucuuaucuggcgggagcuggcuuagcauucuccaucaugaagagcguggggaccggaaaacgaggcacugguucacaaggggaaacacuuggagagaaguggaaaaagaagcugaaccagcucaguagaaaagaauuugaccuauacaagaaaucuggcauaaccgaggucgaucgcacggaggccaaggaaggucugaaaaggggcgagaccacacaccaugcuguuucccgggggagcgccaaguugcagugguucguggaacguaauauggucauccccgagggaagagugauugaccugggcugugggaggggaggcuggucauauuacugcgcaggucucaaaaagguaacugaagugcgcggguauaccaagggaggcccuggccacgaggagccgguucccaugaguacauacggguggaacaucgugaaacuuaugagcggaaaggaugucuuuuaccugccaccugaaaaaugugacacuuugcugugcgauauuggugaguccucucccagcccuaccguggaagagucccggacaauccgaguccucaagaugguggagccaugguuaaaaaauaaccaguucuguauuaagguucugaaucccuauaugccugccguaaucgaacaccuugagagacugcaaaggaagcauggcgggaugcuagugcgcaacccacucucacggaauucuacccacgaaauguacuggauaaguaacggaacuggcaauauugucucgagcgugaacaugguuuccagacuguugcugaaccguuucaaaaugacgcauaggcggcccacaaucgagaaggacguggaucucggugcugggacccgccacgucaaugcggaaccggagacuccuaacauggacgugaucggagagcgaauuaaaagaauaaaggaagagcacaauucuaccuggcauuaugacgaugaaaacccauacaaaacaugggccuaucacggcucauacgagguaaaggcaacgggcagcgcuuccaguaugaucaauggggugguuaagcuucugaccaaacccugggacgucgugccuauggugacucagauggccaugacagauaccacuccauuuggacagcaaagggucuucaaggaaaaaguugacacacggaccccccgcccgaugccugguacaagaaaggugauggagauuacugcagagugguuauggaggacccugggccgaaacaaacggccccguuugugcacgagagaagaguuuaccaagaagguacgcacaaaugccgcuaugggggccguguucacugaagagaaccagugggauucugcgaaagcagccgucgaagacgaggaguuuuggaagcucguggauagggaacgggagcugcauaaacuaggaaaguguggcagcugcguuuauaauaugauggguaaaagagaaaagaaacuuggggaguucggaaaggcuaagggcucacgcgccaucugguacauguggcugggcgcaagguaccucgaguuugaagcucugggguucuugaacgaggaccacugguuuucccgagaaaauaguuauagcggaguggagggugaaggccugcauaaacucggguacauucuucgggauaucucuaagauaccaggaggcgccauguaugcugacgauaccgccgguugggacacaagaaucacugaggacgaucugcacaacgaggaaaaaauuacccagcagauggacccugagcacagguuacuggcaaaugcgaucuucaaguugacguaccaaaacaaagucgugaagguacagcgccccacaccaaccgggacuguuauggauauuaucucccguaaggaccagcggggaucaggccaggugggcacauaugggcucaauaccuuuacuaacauggaagcccaacuggucagacagauggagggagaaggugugcuaagcaaagcugaucuugagaacccccaucugccugagaagaaaauaacccaguggcucgaaacaaagggcguggagaggcugaaacgcauggccauuucgggggacgauugcgucguuaagccaaucgacgaucgauucgcaaaugcuuuguuagcccugaacgacaugggaaaggugcggaaagauaucccgcaguggcaacccucuaagggcuggcacgacuggcagcagguaccuuuuuguagucaucacuuccacgaacucauuaugaaagaugguagaaagcuuguggucccaugcaggccccaggacgagcugauagggcgcgcaagaaucucccaaggagccggcuggagccuacgggaaacggcgugucugggcaaagcuuacgcccagauguggucacucauguauuuccauaggcgugacuugcgacuggcauccaaugccauuugcucugcugugccuguucacugggugccaaccagccgcacuacauggaguauccaugcccaccaucaguggaugaccacugaggauaugcuuacagucuggaacagaguguggauugaggacaaucccuggauggaagauaagaccccuguaacgacaugggagaacguuccguaccuggggaagcgggaagaccaaugguguggaucccucaucgguuuaaccagcagggcaacuugggcucagaauauaccaaccgccauccagcaggugcgcucucugauuggcaacgaggaguuuuuggauuacaugcccucaaugaaaagauuccggaaggaagaggaacuggagggggcgaucugguga

SEQ ID NO: 15119 - RNA, 9873 nt, Artificial Sequence
  derived and/or modified CDS sequence (opt3) from DENV-3__KF041258__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucagaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagaugcucccuguaaaaucccuuucuccacagaggacggccaagguaaggcgcauaacgggcgucuuauaacugcaaauccaguugugaccaaaaaggaggaacccguaaacauugaggccgaaccgccuuucggcgagucaaauaucgucaucggaauuggcgauaacgcuuugaaaaucaauugguauaagaaggggagcaguauuggaaaaauguuugaagccacagcacgcggugccagaaggauggcuauacugggcgacacugccugggauuucgggucugugggaggcguucucaacucccuggguaagauggugcaccagaucuuugggagcgcauacaccgcgcuuuucucgggcgucucuugggugaugaaaauuggaaucggcguacuguugacguggaucgggcucaauuccaagaacacaucaaugaguuuuagcugcauugcuauaggaaucauuacccuguauuuaggcgccgugguucaggcagacauggguugugucaucaauuggaaagggaaggagcugaagugcggauccggcauuuucgugacuaacgaggugcauacauggaccgaacaguacaaauuucaagccgauucucccaagcggcuagcuacugccaucgcaggugcuugggagaauggcgucugugggauacgaagcaccacacgcauggaaaaccuccuguggaaacagaucgccaaugagcuuaacuauauuuugugggaaaauaacaucaagcugacgguuguggugggagacaccauuggcguacucgagcaggggaaaagaacucugacaccacagccuauggaguuaaaguacucauggaaaaccuggggaaaggcgaagaucgucacagccgaaacucaaaacaguuccuucauaauugauggccccaauaccccagagugccccagcgcuucuagggcauggaacgugugggaaguugaggacuaugguuuugggguguucacgacaaauaucuggcugaaacuucgggaagucuacacccagaugugugaccaccgcuugaugucagccgcugugaaggaugagagagccguucacgcagacaugggauacuggauugagagucagaaaaacggcagcuggaagcucgaaaaagcgucccugaucgaggugaagacuugcaccuggccuaagucucauacacuauggucgaaugguguacuggaaagcgauaugauaaucccaaaaucccucgccggcccgauuucacagcacaacuauaggcccggguaccauacucaaaccgcuggaccuuggcaccugggcaagcuugaguuggacuuuaauuauugcgaggggacaacggucgugaucaccgaaaacuguggaacucguggcccaagucugcggacaaccacugugucugguaaauuaauucacgaguggugcugucgaagcugcacacuccccccucugagauacaugggggaagauggauguugguauggcauggagaucaggccaauauccgaaaaggaggagaauauggucaaaucacuuguuagcgccgguucuggcaagguggacaacuucaccauggggguacugugcuuggcaauucucuuugaagaggugaugcgcggaaaguucggcaaaaagcauaugaucgcuggggucuucuuuacguucgugcugcuacuguccggacagaucacuuggcgggauauggcccacacccucauuaugaucggcaguaaugcaagcgacagaauggguauggggguuacauaccuggcccuuauugcuaccuuuaaaauacagcccuucuuggcgcugggauuuuucuuaaggaagcucacuucucgcgaaaaccugcuucugggcgugggccuagccauggcaacaacccuccaacugccggaggauaucgaacagauggcuaaugggauugccuugggacugauggccuuaaaacucaugacacaguuugagacuuaucagcuguggaccgcucuuaucucccugacguguucaaacacaauuuucaccuugacugucgcauggcgaaccgccacacucauccuggcgggugugagucuacugccuguuugccaaagcucguccaugcggaagacugacuggcuuccaaugaccguggcugccaugggcguccccccucucccccuguuuauauucucuuugaaggauacgcugaaacguagaagcuggccauuaaaugaggggguaauggcagugggacucguuucaauccuggccaguucccuucugaggaacgacgugccuauggcuggccccuuggucgcaggugggcuccugauugccuguuacgugaucacaggaaccucugcggaucuaacuguagaaaaggcugccgacgugacaugggaggaagaggcagaacagaccggcgucagccauaaccugaugauuacuguugacgaugacggcacaaugcgcaucaaagaugacgagaccgagaauauacuuacggugcuccugaagacugccuuguuaauuguguccgggaucuuuccauacucaaucccggcuacccugcucgucuggcacacauggcagaaacagacccaacggagcggagugcugugggauguuccuagucccccagaaacacagaaggccgagcuugaagaggguguauauagaauuaaacagcagggcauacuggggaagacucaagugggagucggcgugcagaaggaggguguuuuccauaccauguggcacgugacgaggggggcagucuugacacacaacggaaaacgacuagaacccaauugggcuucugugaagaaagaccugaucuccuacggcggcggguggcgccucagcgcccaguggcaaaagggagaggaaguacaggucauugcgguggagccugguaaaaacccaaagaauuuucagacuaugcccggcaccuuccagacaaccacuggggaaaucggagccauugcacuggauuucaagccuggcaccucggguucaccgaucauaaaccgggaggggaaaguugugggacuuuauggcaauggcgucgugacaaagaacgggggauacguuucugguaucgcucaaacgaaugccgagccagacggccccacuccugaauuagaggaagagauguuuaaaaagagaaaccugaccauuauggaucuccauccagggaguggaaaaacaaggaaguauuugcccgcuaucgugcgugaagcaauuaagcgccggcugagaacccucauccuggccccuacuagggucguggccgcugagauggaggaagcgcuuaaaggccugccgauacgauaccagacaaccgcaacgaaguccgagcacacuggucgggaaauuguagacuugaugugccaugccacauucaccaugcgccuacugagccccgugagaguuccaaauuauaaccucaucaucauggaugaggcucacuuuaccgacccugccucuauugcagccaggggguacaucagcacucgggucggaaugggcgaagcugcggccauauucaugacagcaacccccccaggcacagcugaugccuuuccucaguccaaugcacccauucaggacgaggagcgagacaucccagaaagaucauggaacagugggaaugaguggauuacugauuucgccggaaaaacggugugguuugugccgagcaucaaggcugguaacgacauagccaacuguuuacgcaaaaauggcaagaaggucauucaacugucuaggaaaaccuucgauacagaauaccagaagacuaaacuuaacgacugggauuuuguagugaccacagacaucuccgagaugggggcgaauuucaaggcagaucguguuaucgacccucggagaugccugaaacccgugauucucaccgauggaccagagagggucaucuuggccggccccaugccugugacugcugccucagcugcacagcgccgagguagaguugggcggaacccacagaaggaaaaugaccaauauauuuuuacgggccagccccugaacaaugaugaggaccaugcccacuggaccgaagcuaagaugcuccuggacaacauaaauacaccugagggaaucauuccggcccuuuucgaaccagagagggagaaaagugcagcgaucgauggcgaauaccgccuaaagggggagagccguaaaacuuucguggaacugaugagacggggagacuugcccgucugguuagcccacaagguggcuuccgaggguaucaaauauaccgauaggaaguggugcuuugacggccagcgcaacaaucagauucuggaagagaacauggauguagagauauggacaaaagaaggggagaagcgaaagcucagaccucgguggcuggacgccaggaccuacucugauccccuugcacugaaagaauucaaggacuuugcugccggacgcaaaucgaucgcacucgauuuggugacugagauuggcagaguuccaagccaucuggcccacaggacacggaaugcucuagacaaccuggucaugcuccauacgucagaacacggugggcgugcguaucgccacgccguggaggagcuuccugaaaccauggagacucuguuauugcugggccucaugauccugcuuacaggaggcgcaaugcuguuccucauuuccgggaagggaaucgguaaaaccaguauaggcuugaucugugugauugcuucuagcgggaugcuguggauggccgaaauccccuuacaauggauugccuccgcaaucguccuagaguuuuucaugaugguucugcucauaccagagccugaaaagcagcgaaccccgcaggauaaucaacuugcuuacgugguaauuggaauccugacauuggccgcgauuaucgcugccaacgagaugggccugcucgaaacuacgaagagagaccuggguaugucaaaagagcccgggguggucucuccaaccagcuaucuugauguggaccuccauccugcaagugccuggacacuguacgcuguugcaacuaccgugauaacacccauguugaggcacaccaucgaaaauuccacugccaacgucagccuggcggcuauugccaaccaggcaguaguguuaaugggccuagacaagggauggccaaucucuaaaauggaucugggcguuccucuccuugcccuggggugcuacucacaggugaaucccuugacgcugacagcugccguccuccugcuuauuacccauuaugcaaucauaggaccgggcuuacaggcuaaggccacucgggaggcgcaaaaacgcaccgccgcagguauuaugaagaacccaacaguggacgggaucaucacuauugaucuggacccugucaucuacgauuccaaguuugagaaacagcucggacaggugauguugcugguucuaugugcugugcagcugcuccuuaugagaaccaguugggcccugugcgaagcauugacacuggcuacgggccccauaaccacucucugggaggguagcccaggcaaguucuggaauacaaccauugccguaucgauggccaacaucuuuagggggucuuaucuggcgggagcuggcuuagcauucuccauuaugaaaagcguggggacuggaaagcggggcacagguucacaaggggaaacccuuggagagaaauggaagaagaaacugaaucagcucagucgaaaggaauuugaccuauacaaaaagucuggcaucacggaggucgauagaaccgaggccaaagaaggucugaagcgcggcgagacaacucaccaugcuguuuccagggggagcgccaaauugcagugguucguggaacggaacauggucauacccgagggacgugugaucgaccugggcugugggagaggaggcuggucauauuacugcgcaggucucaagaagguaaccgaagugaggggguauacaaaaggaggcccuggccacgaggagccgguucccaugaguacuuacggguggaauauugugaagcuuaugagcggaaaagaugucuuuuaccugccaccugaaaagugugacaccuugcugugcgauaucggugaguccucucccagcccuacaguggaagagucccgcaccauucggguccucaaaaugguggagccaugguuaaagaacaaucaguucuguaucaagguucugaaccccuauaugccugccguaauugaacaccuugagcgacugcaaagaaaacauggcgggaugcuagugaggaauccacucucacgcaacucuacucacgaaauguacuggaucaguaauggaacgggcaacauagucucgagcgugaauaugguuucccggcuguugcugaacagauucacaaugacccaucguaggcccacuauugagaaggacguggaucucggugcugggacccggcacgucaacgcggaaccggagacaccuaauauggacgugaucggagagcgcaucaaacgaauuaaggaagagcacaacucuacguggcauuaugacgaugaaaauccauacaaaaccugggccuaucacggcucauacgagguaaaggcaacuggcagcgcuuccaguaugauaaacggggugguuaagcuucugacaaaacccugggacgucgugccuauggugacccagauggccaugacugauacaaccccauuuggacagcaaagagucuucaaggaaaaaguugacacaaggacuccccggccgaugccugguacccgcaaggugauggagaucacggcagagugguuauggagaacccugggcaggaauaaacgaccccgguugugcacacgugaagaguuuacuaagaagguaagaaccaacgccgcuaugggggccguguucacagaagagaaucagugggauucugcgaaagcagccgucgaagacgaggaguuuuggaagcucguggaucgcgaaagggagcugcauaaacuaggaaaguguggcagcugcguuuauaacaugauggguaaacgggaaaagaaacuuggggaguucggaaaggcuaagggcucaagagccauuugguacauguggcugggcgcacgcuaccucgaguuugaagcucugggguucuugaaugaggaccacugguuuuccagggaaaacaguuauagcggaguggagggugaaggccugcauaaacucggguacguccuucgagauaucucuaagauuccaggaggcgccauguaugcugacgauacugccgguugggacacccggaucacggaggacgaucugcacaaugaggaaaaaauaacacagcagauggacccugagcacagauuacuggcaaacgcgaucuucaaguugaccuaccaaaauaaagugguaaagguucagaggcccacuccaacagggaccgugauggauauuaucucccgcaaggaccagcguggaucaggccaggucggcacuuaugggcucaacaccuuuacaaauauggaagcccaacuggugcggcagauggagggagaaggugugcuaagcaaagcugaucuugagaacccccaucugccugagaagaaaauuacgcaguggcucgaaaccaagggcgucgagagacugaaaaggauggccaucucgggggacgauugcguugugaagccaauagacgaucgcuucgcaaacgcuuuguuagcccugaaugacaugggaaagguacgaaaagauauuccgcaguggcaacccucuaagggcuggcacgacuggcagcaggugccuuuuuguagucaucacuuccacgaacucaucaugaaagauggucggaagcuugucgugccaugcagaccccaggacgagcugaucgggagggcacgcauuucccaaggagccggcuggagccuaagagaaacugcgugucugggcaaagcuuacgcccagauguggucacucauguauuuccaucggagggacuugcgucuggcauccaacgccauaugcucugcuguuccugugcacugggucccaacaagccgaaccacuuggaguauccaugcccaccaucaguggaugacaaccgaggauaugcuuacgguguggaaucgcguauggauugaggacaaccccuggauggaagauaagacaccuguuaccacuugggagaaugugccguaccuggggaagagagaagaccaaugguguggaucccucaucgguuuaaccagccgggcaacaugggcucagaacauuccaacugccauccagcaggucaggucucugauaggcaaugaggaguuuuuggauuacaugcccucaaugaaacgcuucagaaaggaagaggaacuggagggggcgaucugguga

SEQ ID NO: 15120 - RNA, 9873 nt, Artificial Sequence
  derived and/or modified CDS sequence (opt3) from DENV-3__KF041257__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucagaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagaugcucccuguaaaaucccuuucuccacagaggacggccaagguaaggcgcauaacgggcgucuuauaacugcaaauccaguugugaccaaaaaggaggaacccguaaacauugaggccgaaccgccuuucggcgagucaaauaucgucaucggaauuggcgauaacgcuuugaaaaucaauugguauaagaaggggagcaguauuggaaaaauguuugaagccacagcacgcggugccagaaggauggcuauacugggcgacacugccugggauuucgggucugugggaggcguucucaacucccuggguaagauggugcaccagaucuuugggagcgcauacaccgcgcuuuucucgggcgucucuugggugaugaaaauuggaaucggcguacuguugacguggaucgggcucaauuccaagaacacaucaaugaguuuuagcugcauugcuauaggaaucauuacccuguauuuaggcgccgugguucaggcagacauggguugugucaucaauuggaaagggaaggagcugaagugcggauccggcauuuucgugacuaacgaggugcauacauggaccgaacaguacaaauuucaagccgauucucccaagcggcuagcuacugccaucgcaggugcuugggagaauggcgucugugggauacgaagcaccacacgcauggaaaaccuccuguggaaacagaucgccaaugagcuuaacuauauuuugugggaaaauaacaucaagcugacgguuguggugggagacaccauuggcguacucgagcaggggaaaagaacucugacaccacagccuauggaguuaaaguacucauggaaaaccuggggaaaggcgaagaucgucacagccgaaacucaaaacaguuccuucauaauugauggccccaauaccccagagugccccagcgcuucuagggcauggaacgugugggaaguugaggacuaugguuuugggguguucacgacaaauaucuggcugaaacuucgggaagucuacacccagaugugugaccaccgcuugaugucagccgcugugaaggaugagagagccguucacgcagacaugggauacuggauugagagucagaaaaacggcagcuggaagcucgaaaaagcgucccugaucgaggugaagacuugcaccuggccuaagucucauacacuauggucgaaugguguacuggaaagcgauaugauaaucccaaaaucccucgccggcccgauuucacagcacaacuauaggcccggguaccauacucaaaccgcuggaccuuggcaccugggcaagcuugaguuggacuuuaauuauugcgaggggacaacggucgugaucaccgaaaacuguggaacucguggcccaagucugcggacaaccacugugucugguaaauuaauucacgaguggugcugucgaagcugcacacuccccccucugagauacaugggggaagauggauguugguauggcauggagaucaggccaauauccgaaaaggaggagaauauggucaaaucacuuguuagcgccgguucuggcaagguggacaacuucaccauggggguacugugcuuggcaauucucuuugaagaggugaugcgcggaaaguucggcaaaaagcauaugaucgcuggggucuucuuuacguucgugcugcuacuguccggacagaucacuuggcgggauauggcccacacccucauuaugaucggcaguaaugcaagcgacagaauggguauggggguuacauaccuggcccuuauugcuaccuuuaaaauacagcccuucuuggcgcugggauuuuucuuaaggaagcucacuucucgcgaaaaccugcuucugggcgugggccuagccauggcaacaacccuccaacugccggaggauaucgaacagauggcuaaugggauugccuugggacugauggccuuaaaacucaucacacaguuugagacuuaucagcuguggaccgcucuuauuucccugacguguucaaacacaaucuucaccuugacugucgcauggcgaaccgccacacucauacuggcgggugugagucuacugccuguuugccaaagcucguccaugcggaagacugacuggcuuccaaugaccguggcugccaugggcguccccccucucccccuguuuaucuucucuuugaaggauacgcugaaacguagaagcuggccauuaaaugaggggguaauggcagugggacucguuucaauucuggccaguucccuucugaggaacgacgugccuauggcuggccccuuggucgcaggugggcuccugaucgccuguuacgugauuacaggaaccucugcggaucuaacuguagaaaaggcugccgacgugacaugggaggaagaggcagaacagaccggcgucagccauaaccugaugaucacuguugacgaugacggcacaaugcgcauaaaagaugacgagaccgagaauauucuuacggugcuccugaagacugccuuguuaaucguguccgggaucuuuccauacucaauuccggcuacccugcucgucuggcacacauggcagaaacagacccaacggagcggagugcugugggauguuccuagucccccagaaacacagaaggccgagcuugaagaggguguauauagaauaaaacagcagggcauccuggggaagacucaagugggagucggcgugcagaaggaggguguuuuccauaccauguggcacgugacgaggggggcagucuugacacacaacggaaaacgacuagaacccaauugggcuucugugaagaaagaccugauuuccuacggcggcggguggcgccucagcgcccaguggcaaaagggagaggaaguacaggucaucgcgguggagccugguaaaaacccaaagaauuuucagacuaugcccggcaccuuccagacaaccacuggggaaauuggagccaucgcacuggauuucaagccuggcaccucggguucaccgauaaucaaccgggaggggaaaguugugggacuuuauggcaauggcgucgugacaaagaacgggggauacguuucugguauugcucaaacgaaugccgagccagacggccccacuccugaauuagaggaagagauguuuaaaaagagaaaccugaccaucauggaucuccauccagggaguggaaaaacaaggaaguauuugcccgcuauugugcgugaagcaaucaagcgccggcugagaacccucauacuggccccuacuagggucguggccgcugagauggaggaagcgcuuaaaggccugccgauucgauaccagacaaccgcaacgaaguccgagcacacuggucgggaaaucguagacuugaugugccaugccacauucaccaugcgccuacugagccccgugagaguuccaaauuauaaccucaucauuauggaugaggcucacuuuaccgacccugccucuaucgcagccaggggguacauaagcacucgggucggaaugggcgaagcugcggccauuuucaugacagcaacccccccaggcacagcugaugccuuuccucaguccaaugcacccauccaggacgaggagcgagacauuccagaaagaucauggaacagugggaaugaguggaucacugauuucgccggaaaaacggugugguuugugccgagcauaaaggcugguaacgacauugccaacuguuuacgcaaaaauggcaagaaggucauccaacugucuaggaaaaccuucgauacagaauaccagaagacuaaacuuaacgacugggauuuuguagugaccacagacaucuccgagaugggggcgaauuucaaggcagaucguguuauugacccucggagaugccugaaacccgugauccucaccgauggaccagagagggucauuuuggccggccccaugccugugacugcugccucagcugcacagcgccgagguagaguugggcggaacccacagaaggaaaaugaccaauauauauuuacgggccagccccugaacaaugaugaggaccaugcccacuggaccgaagcuaagaugcuccuggacaacaucaauacaccugagggaauuaucccggcccuuuucgaaccagagagggagaaaagugcagcgaucgauggcgaauaccgccuaaagggggagagccguaaaacuuucguggaacugaugagacggggagacuugcccgucugguuagcccacaagguggcuuccgaggguauuaaauauaccgauaggaaguggugcuuugacggccagcgcaacaaucagauacuggaagagaacauggauguagagaucuggacaaaagaaggggagaagcgaaagcucagaccucgguggcuggacgccaggaccuacucugauccccuugcacugaaagaauucaaggacuuugcugccggacgcaaaucgauugcacucgauuuggugacugagaucggcagaguuccaagccaucuggcccacaggacacggaaugcucuagacaaccuggucaugcuccauacgucagaacacggugggcgugcguaucgccacgccguggaggagcuuccugaaaccauggagacucuguuauugcugggccucaugauucugcuuacaggaggcgcaaugcuguuccucaucuccgggaagggaauagguaaaaccaguaucggcuugauuugugugaucgcuucuagcgggaugcuguggauggccgaaauucccuuacaauggaucgccuccgcaauaguccuagaguuuuucaugaugguucugcucauuccagagccugaaaagcagcgaaccccgcaggauaaucaacuugcuuacgugguaaucggaauucugacauuggccgcgaucauagcugccaacgagaugggccugcucgaaacuacgaagagagaccuggguaugucaaaagagcccgggguggucucuccaaccagcuaucuugauguggaccuccauccugcaagugccuggacacuguacgcuguugcaacuaccgugaucacacccauguugaggcacaccauugaaaauuccacugccaacgucagccuggcggcuaucgccaaccaggcaguaguguuaaugggccuagacaagggauggccaauuucuaaaauggaucugggcguuccucuccuugcccuggggugcuacucacaggugaaucccuugacgcugacagcugccguccuccugcuuaucacccauuaugcaauaauuggaccgggcuuacaggcuaaggccacucgggaggcgcaaaaacgcaccgccgcagguaucaugaagaacccaacaguggacgggaucauuacuaucgaucuggacccugucauauacgauuccaaguuugagaaacagcucggacaggugauguugcugguucuaugugcugugcagcugcuccuuaugagaaccaguugggcccugugcgaagcauugacacuggcuacgggccccauuaccacucucugggaggguagcccaggcaaguucuggaauacaaccaucgccguaucgauggccaacauuuuuagggggucuuaucuggcgggagcuggcuuagcauucuccaucaugaaaagcguggggacuggaaagcggggcacagguucacaaggggaaacccuucgagagaaauggaagaagaaacugaaucagcucaguagaaaggaauuugaccuauacaaaaagucuggaauaacggaggucgaucgcaccgaggccaaagaaggccugaagaggggugagacaacucaccaugcuguuucccggggcagcgccaaauugcagugguucguggaacguaacauggucauccccgaggggagagugauugaccugggauguggcagggggggauggucauauuacugcgcaggccucaagaagguaaccgaagugcgcgguuauacaaaagggggaccuggccacgaggagccgguucccaugaguacuuacggcuggaauaucgugaagcuuaugagcgggaaagaugucuuuuaccugccaccugaaaagugugacaccuugcugugcgauauuggagaguccucucccagcccuacaguggaagagucccggaccauccgaguccucaaaaugguggagccaugguuaaagaacaaucaguucuguauuaagguucugaaccccuauaugccugccguaaucgaacaccuugagagacugcaaaggaaacaugguggcaugcuagugcgcaauccacucucacggaacucuacucacgaaauguacuggauaaguaaugggacgggaaacauugucucgagcgugaauaugguuuccagacuguugcugaaccguuucacaaugacccauaggcggcccacuaucgagaaggacguggaucucggcgcugguacccgccacgucaacgcggaaccggagacaccuaauauggacgugaucggggagcgaauuaaaagaauaaaggaagagcacaacucuacguggcauuaugacgaugaaaauccauacaaaaccugggccuaucacggaucauacgagguaaaggcaacuggcagcgcuuccaguaugaucaacggcgugguuaagcuucugacaaaacccugggacgucgugccuauggugacccagauggccaugacugauacaaccccauuugggcagcaaagggucuucaaggaaaaaguugacacacggacuccccgcccgaugccuggaaccagaaaggugauggagauuacggcagagugguuauggaggacccugggucgaaauaaacggccccguuugugcacaagagaagaguuuacuaagaagguacgcaccaacgccgcuaugggcgccguguucacagaagagaaucagugggauucugcgaaagcagccgucgaagacgaggaguuuuggaagcucguggauagggaacgggagcugcauaaacuagggaaguguggaagcugcguuuauaacaugaugggcaaaagagaaaagaaacuuggugaguucgggaaggcuaagggaucacgcgccaucugguacauguggcugggcgcaagguaccucgaguuugaagcucugggcuucuugaaugaggaccacugguuuucccgagaaaacaguuauagcgggguggagggagaaggucugcauaaacucggcuacauucuucgggauaucucuaagauaccagggggagccauguaugcugacgauacugccggcugggacaccagaaucacggaggacgaucugcacaaugaggaaaaaauuacacagcagauggacccugagcacagguuacuggcaaacgcgaucuucaaguugaccuaccaaaauaaagucgugaagguacagcgccccacuccaacagguaccguuauggauauuaucucccguaaggaccagcgggggucaggacaggugggcacuuauggccucaacaccuuuacaaauauggaagcccaacuggucagacagauggagggggaaggagugcuaagcaaagcugaucuugagaacccccaucugccugagaagaaaauaacgcaguggcucgaaaccaaggguguggagaggcugaaacgcauggccauuucgggcgacgauugcgucguuaagccaaucgacgaucgauucgcaaacgcuuuguuagcccugaaugacauggggaaggugcggaaagauaucccgcaguggcaacccucuaagggauggcacgacuggcagcagguaccuuuuuguagucaucacuuccacgaacucauuaugaaagauggcagaaagcuuguggucccaugcaggccccaggacgagcugauaggucgcgcaagaaucucccaaggggccggauggagccuacgggaaacugcgugucugggcaaagcuuacgcccagauguggucacucauguauuuccauaggcgugacuugcgacuggcauccaacgccauuugcucugcugugccuguucacugggugccaacaagccgcaccacuuggaguauccaugcccaccaucaguggaugacaaccgaggauaugcuuacggucuggaauagaguguggauugaggacaaccccuggauggaagauaagacaccuguaaccacuugggagaauguuccguaccugggcaagcgggaagaccaauggugugggucccucaucggauuaaccagcagggcaacaugggcucagaacauaccaacugccauccagcaggugcgcucucugauugguaaugaggaguuuuuggauuacaugcccucaaugaaaagauuccggaaggaagaggaacuggagggcgcgaucugguga

SEQ ID NO: 15121 - RNA, 9873 nt, Artificial Sequence
  derived and/or modified CDS sequence (opt3) from DENV-3__KF041255__SS-prME
accagccugugccucaugaugauccuucccgccgcucuggcauuccacuugacauccagaaacggcgagccuaggaugauuguggggaagaaugaacggggaaaaucuuuacuguuuaagacugccucagguauaaacauguguacgcuaaucgcgauggaccucggcgagaugugcgaugacaccgucacauacaaauguccacauauuacugaaguugagccggaagauaucgacugcugguguaaucugaccaguacaugggugaccuaugggacuugcaaccaggcuggagagcaccgccgagauaagcguagcguagcccuugcaccccaugugggcaugggucuggacacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaauagagauuuuguugaaggauugucaggugccaccuggguggacgucgugcuggagcacggcgggugcgugacgacuauggcgaagaacaaacccacacuagauauugagcuccagaagaccgaagcaacucaacuggccacacuuaggaaacuguguaucgagggaaagauuaccaauaucacgaccgacagccggugcccuacacagggcgaagcugucuugccagaggaacaggaucagaacuauguuuguaaacacacuuacguggaccgcgguugggggaauggaugcggccucuucggcaaggggagucugguaaccugcgccaaguuucaauguuuagagcccauagagggaaaagugguccaguaugaaaaccugaaguacacagugauuaucacuguucauaccggugaucagcaccaggugggcaaugagacacaaggggucaccgcagaaauuacuccucaggcuuccacgacagaggccauccucccagaauauggaacccuuggccuggagugcucuccgcgaacugguuuggacuucaacgagaugauccuacugaccaugaaaaauaaggcguggauggugcauagacagugguuuuucgaccucccccugccuuggacaagcggggccaccacugaaacaccaacguggaacaggaaagagcuucugguaaccuuuaagaaugcacacgcuaaaaagcaagaaguuguggucuugggcucccaggagggagccaugcacacugcucucacaggcgccaccgaaauucagaacucagggggaacaaguauauucgcaggucaucugaagugucgguuaaaaauggauaagcuggagcuaaaaggcaugagcuacgccaugugcacuaacaccuuugugcucaagaaagaggucucugaaacgcagcacgggaccauccugauuaagguggaguacaagggagaagacgcucccuguaaaaucccuuucuccacagaggauggccaagguaaggcgcauaaugggcgucuuauaacugcaaacccaguugugaccaaaaaggaggaacccguaaauauugaggccgaaccgccuuucggcgagucaaacaucgucaucggaauuggcgacaaugcuuugaaaaucaacugguauaagaaggggagcaguauuggaaaaauguuugaagccacagcacgcggugccagaaggauggcuauacugggcgauacugccugggacuucgggucugugggaggcguucucaauucccuggguaagauggugcaccagaucuuugggagcgcauacaccgcgcuuuucucgggcgucucuugggugaugaaaauuggaaucggcguacuguugacguggaucgggcucaacuccaagaauacaucaaugaguuuuagcugcauugcuauaggaaucauuacccuguauuuaggcgccgugguucaggcagauauggguugugucaucaacuggaaagggaaggagcugaagugcggauccggcauuuucgugacuaaugaggugcauacauggaccgaacaguacaaauuucaagccgacucucccaagcggcuagcuacugccaucgcaggugcuugggagaacggcgucugugggauacgaagcaccacacgcauggaaaaucuccuguggaaacagaucgccaacgagcuuaauuauauuuugugggaaaacaacaucaagcugacgguuguggugggagauaccauuggcguacucgagcaggggaaaagaacucugacaccacagccuauggaguuaaaguacucauggaaaaccuggggaaaggcgaagaucgucacagccgaaacucaaaauaguuccuucauaauugacggccccaacaccccagagugccccagcgcuucuagggcauggaaugugugggaaguugaggauuaugguuuugggguguucacgacaaacaucuggcugaaacuucgggaagucuacacccagaugugugaccaccgcuugaugucagccgcugugaaggacgagagagccguucacgcagauaugggauacuggauugagagucagaaaaauggcagcuggaagcucgaaaaagcgucccugaucgaggugaagacuugcaccuggccuaagucucauacacuauggucgaacgguguacuggaaagcgacaugauaaucccaaaaucccucgccggcccgauuucacagcacaauuauaggcccggguaccauacucaaaccgcuggaccuuggcaccugggcaagcuugaguuggauuuuaacuauugcgaggggacaacggucgugaucaccgaaaauuguggaacucguggcccaagucugcggacaaccacugugucugguaaauuaauucacgaguggugcugucgaagcugcacacuccccccucugagauacaugggggaagacggauguugguauggcauggagaucaggccaauauccgaaaaggaggagaacauggucaaaucacuuguuagcgccgguucuggcaagguggauaauuucaccauggggguacugugcuuggcaauucucuuugaagaggugaugcgcggaaaguucggcaaaaagcauaugaucgcuggggucuucuuuacguucgugcugcuacuguccggacagaucacuuggcgggacauggcccacacccucauuaugaucggcaguaacgcaagcgauagaauggguauggggguuacauaccuggcccuuauugcuaccuuuaaaauacagcccuucuuggcgcugggauuuuucuuaaggaagcucacuucucgcgaaaaucugcuucugggcgugggccuagccauggcaacaacccuccaacugccggaggacaucgaacagauggcuaacgggauugccuugggacugauggccuuaaaacucaucacacaguuugagacuuaucagcuguggaccgcucuuauuucccugacguguucaaauacaaucuucaccuugacugucgcauggcgaaccgccacacucauacuggcgggugugagucuacugccuguuugccaaagcucguccaugcggaagacugauuggcuuccaaugaccguggcugccaugggcguccccccucucccccuguuuaucuucucuuugaaggacacgcugaaacguagaagcuggccauuaaacgaggggguaauggcagugggacucguuucaauucuggccaguucccuucugaggaacgaugugccuauggcuggccccuuggucgcaggugggcuccugaucgccuguuacgugauuacaggaaccucugcggaccuaacuguagaaaaggcugccgaugugacaugggaggaagaggcagaacagaccggcgucagccauaaucugaugaucacuguugacgacgauggcacaaugcgcauaaaagacgaugagaccgagaacauucuuacggugcuccugaagacugccuuguuaaucguguccgggaucuuuccauacucaauuccggcuacccugcucgucuggcacacauggcagaaacagacccaacggagcggagugcugugggacguuccuagucccccagaaacacagaaggccgagcuugaagaggguguauauagaauaaaacagcagggcauccuggggaagacucaagugggagucggcgugcagaaggaggguguuuuccauaccauguggcacgugacgaggggggcagucuugacacacaauggaaaacgacuagaacccaacugggcuucugugaagaaagaucugauuuccuacggcggcggguggcgccucagcgcccaguggcaaaagggagaggaaguacaggucaucgcgguggagccugguaaaaauccaaagaacuuucagacuaugcccggcaccuuccagacaaccacuggggaaauuggagccaucgcacuggacuucaagccuggcaccucggguucaccgauaaucaaucgggaggggaaaguugugggacuuuauggcaacggcgucgugacaaagaaugggggauacguuucugguauugcucaaacgaacgccgagccagauggccccacuccugaauuagaggaagagauguuuaaaaagagaaaucugaccaucauggaccuccauccagggaguggaaaaacaaggaaguauuugcccgcuauugugcgugaagcaaucaagcgccggcugagaacccucauacuggccccuacuagggucguggccgcugagauggaggaagcgcuuaaaggccugccgauucgauaccagacaaccgcaacgaaguccgagcacacuggucgggaaaucguagauuugaugugccaugccacauucaccaugcgccuacugagccccgugagaguuccaaacuauaaucucaucauuauggacgaggcucacuuuaccgauccugccucuaucgcagccaggggguacauaagcacucgggucggaaugggcgaagcugcggccauuuucaugacagcaacccccccaggcacagcugacgccuuuccucaguccaacgcacccauccaggaugaggagcgagacauuccagaaagaucauggaauagugggaacgaguggaucacugacuucgccggaaaaacggugugguuugugccgagcauaaaggcugguaacgauauugccaauuguuuacgcaaaaacggcaagaaggucauccaacugucuaggaaaaccuucgacacagaauaccagaagacuaaacuuaaugauugggacuuuguagugaccacagauaucuccgagaugggggcgaacuucaaggcagaccguguuauugauccucggagaugccugaaacccgugauccucaccgacggaccagagagggucauuuuggccggccccaugccugugacugcugccucagcugcacagcgccgagguagaguugggcggaauccacagaaggaaaacgaucaauauauauuuacgggccagccccugaauaacgacgaggaucaugcccacuggaccgaagcuaagaugcuccuggacaauaucaacacaccugagggaauuaucccggcccuuuucgaaccagagagggagaaaagugcagcgaucgacggcgaauaccgccuaaagggggagagccguaaaacuuucguggaacugaugagacggggagauuugcccgucugguuagcccacaagguggcuuccgaggguauuaaauauaccgacaggaaguggugcuuugauggccagcgcaauaaccagauacuggaagagaauauggacguagagaucuggacaaaagaaggggagaagcgaaagcucagaccucgguggcuggaugccaggaccuacucugacccccuugcacugaaagaauucaaggauuuugcugccggacgcaaaucgauugcacucgacuuggugacugagaucggcagaguuccaagccaucuggcccacaggacacggaacgcucuagauaaucuggucaugcuccauacgucagaacacggugggcgugcguaucgccacgccguggaggagcuuccugaaaccauggagacucuguuauugcugggccucaugauucugcuuacaggaggcgcaaugcuguuccucaucuccgggaagggaauagguaaaaccaguaucggcuugauuugugugaucgcuucuagcgggaugcuguggauggccgaaauucccuuacaauggaucgccuccgcaauaguccuagaguuuuucaugaugguucugcucauuccagagccugaaaagcagcgaaccccgcaggacaaccaacuugcuuacgugguaaucggaauucugacauuggccgcgaucauagcugccaaugagaugggccugcucgaaacuacgaagagagaucuggguaugucaaaagagcccgggguggucucuccaaccagcuaucuugacguggaucuccauccugcaagugccuggacacuguacgcuguugcaacuaccgugaucacacccauguugaggcacaccauugaaaacuccacugccaacgucagccuggcggcuaucgccaaucaggcaguaguguuaaugggccuagacaagggauggccaauuucuaaaauggaccugggcguuccucuccuugcccuggggugcuacucacaggugaaccccuugacgcugacagcugccguccuccugcuuaucacccauuaugcaauaauuggaccgggcuuacaggcuaaggccacucgggaggcgcaaaaacgcaccgccgcagguaucaugaagaauccaacaguggaugggaucauuacuaucgaccuggauccugucauauacgacuccaaguuugagaaacagcucggacaggugauguugcugguucuaugugcugugcagcugcuccuuaugagaaccaguugggcccugugcgaagcauugacacuggcuacgggccccauuaccacucucugggaggguagcccaggcaaguucuggaacacaaccaucgccguaucgauggccaauauuuuuagggggucuuaucuggcgggagcuggcuuagcauucuccaucaugaaaagcguggggacuggaaagcggggcacagguucacaaggggaaacccuuggagagaaauggaagaagaaacugaaccagcucagucgaaaggaauuugaucuauacaaaaagucuggcauaacggaggucgacagaaccgaggccaaagaaggucugaagcgcggcgagacaacucaccaugcuguuuccagggggagcgccaaauugcagugguucguggaacggaauauggucauccccgagggacgugugauugaucugggcugugggagaggaggcuggucauauuacugcgcaggucucaagaagguaaccgaagugaggggguauacaaaaggaggcccuggccacgaggagccgguucccaugaguacuuacggguggaacaucgugaagcuuaugagcggaaaagacgucuuuuaccugccaccugaaaagugugauaccuugcugugcgacauuggugaguccucucccagcccuacaguggaagagucccgcaccauccggguccucaaaaugguggagccaugguuaaagaauaaccaguucuguauuaagguucugaaucccuauaugccugccguaaucgaacaccuugagcgacugcaaagaaaacauggcgggaugcuagugaggaacccacucucacgcaauucuacucacgaaauguacuggauaaguaacggaacgggcaauauugucucgagcgugaacaugguuucccggcuguugcugaacagauucaagaugacacaucguaggcccaccaucgagaaagauguggaccucggugcugggacucggcacgucaaugcggaaccggagaccccuaacauggaugugaucggagagcgcauuaagcgaauaaaagaagagcacaauucuacauggcauuaugacgacgaaaacccauacaagacgugggccuaucacggcucauacgagguaaaggcaaccggcagcgcuuccaguaugaucaauggggugguuaaacuucugacuaagcccugggaugucgugccuauggugacacagauggccaugaccgacacuacaccauuuggacagcaaagagucuucaaagaaaagguugauaccaggacaccccggccgaugccugguacucgcaaagugauggagauuaccgcagagugguuauggagaacgcugggcaggaacaagcgaccccgguugugcacccgugaagaguuuacaaagaaaguaagaacuaaugccgcuaugggggccguguucaccgaagagaaccagugggacucugcgaaggcagccgucgaagaugaggaguuuuggaaacucguggaccgcgaaagggagcugcauaagcuaggaaaauguggcagcugcguuuauaauaugauggguaagcgggaaaaaaagcuuggggaguucggaaaggcuaaaggcucaagagccaucugguacauguggcugggcgcacgcuaccucgaguuugaagcucugggguucuugaacgaggaucacugguuuuccagggaaaauaguuauagcggaguggagggugaaggccugcauaagcucggguacauucuucgagacaucucuaaaauaccaggaggcgccauguaugcugaugacacagccgguugggauacucggaucaccgaggacgaccugcacaacgaggaaaagauuacgcagcagauggauccugagcacagauuacuggcaaaugcgaucuucaaauugacauaccaaaacaaggucgugaagguacagaggcccaccccaacugggacaguuauggacauuaucucccgcaaagaucagcguggaucaggccaggugggcaccuaugggcucaauacuuuuaccaacauggaagcccaacugguccggcagauggagggagaaggugugcuaagcaaggcugaccuugagaacccccaucugccugagaaaaagauaacacaguggcucgaaacgaaaggcguggagagacugaagaggauggccauuucgggggaugacugcgucguuaagccaaucgaugaccgcuucgcaaaugcuuuguuagcccugaacgauaugggaaaagugcgaaaggacaucccgcaguggcaacccucuaaaggcuggcacgauuggcagcagguaccuuuuuguagucaucacuuccacgaacucauuaugaaggacggucggaaacuuguggucccaugcagaccccaggaugagcugauagggagggcacgcaucucccaaggagccggcuggagccuaagagaaaccgcgugucugggcaaggcuuacgcccagauguggucacucauguauuuccaucggagggacuugcgucuggcauccaaugccauuugcucugcugugccuguucacugggugccaacuagccgaacaaccuggaguauccaugcccaccaucaguggaugacuacagaggacaugcuuaccgucuggaaccgcguguggauugaggauaaucccuggauggaagacaagacgccuguaacaaccugggagaacguuccguaccuggggaaaagagaagaucaaugguguggaucccucaucgguuuaacuagccgggcaaccugggcucagaauauaccaacagccauccagcaggugaggucucugauuggcaacgaggaguuuuuggacuacaugcccucaaugaagcgcuucagaaaagaagaggaacuggagggggcgaucugguga

SEQ ID NO: 15122 - RNA, 9873 nt, Artificial Sequence
  derived and/or modified CDS sequence (opt3) from DENV-3__KF041256__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucagaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagaugcucccuguaaaaucccuuucuccacagaggacggccaagguaaggcgcauaacgggcgucuuauaacugcaaauccaguugugaccaaaaaggaggaacccguaaacauugaggccgaaccgccuuucggcgagucaaauaucgucaucggaauuggcgauaacgcuuugaaaaucaauugguauaagaaggggagcaguauuggaaaaauguuugaagccacagcacgcggugccagaaggauggcuauacugggcgacacugccugggauuucgggucugugggaggcguucucaacucccuggguaagauggugcaccagaucuuugggagcgcauacaccgcgcuuuucucgggcgucucuugggugaugaaaauuggaaucggcguacuguugacguggaucgggcucaauuccaagaacacaucaaugaguuuuagcugcauugcuauaggaaucauuacccuguauuuaggcgccgugguucaggcagacauggguugugucaucaauuggaaagggaaggagcugaagugcggauccggcauuuucgugacuaacgaggugcauacauggaccgaacaguacaaauuucaagccgauucucccaagcggcuagcuacugccaucgcaggugcuugggagaauggcgucugugggauacgaagcaccacacgcauggaaaaccuccuguggaaacagaucgccaaugagcuuaacuauauuuugugggaaaauaacaucaagcugacgguuguggugggagacaccauuggcguacucgagcaggggaaaagaacucugacaccacagccuauggaguuaaaguacucauggaaaaccuggggaaaggcgaagaucgucacagccgaaacucaaaacaguuccuucauaauugauggccccaauaccccagagugccccagcgcuucuagggcauggaacgugugggaaguugaggacuaugguuuugggguguucacgacaaauaucuggcugaaacuucgggaagucuacacccagaugugugaccaccgcuugaugucagccgcugugaaggaugagagagccguucacgcagacaugggauacuggauugagagucagaaaaacggcagcuggaagcucgaaaaagcgucccugaucgaggugaagacuugcaccuggccuaagucucauacacuauggucgaaugguguacuggaaagcgauaugauaaucccaaaaucccucgccggcccgauuucacagcacaacuauaggcccggguaccauacucaaaccgcuggaccuuggcaccugggcaagcuugaguuggacuuuaauuauugcgaggggacaacggucgugaucaccgaaaacuguggaacucguggcccaagucugcggacaaccacugugucugguaaauuaauucacgaguggugcugucgaagcugcacacuccccccucugagauacaugggggaagauggauguugguauggcauggagaucaggccaauauccgaaaaggaggagaauauggucaaaucacuuguuagcgccgguucuggcaagguggacaacuucaccauggggguacugugcuuggcaauucucuuugaagaggugaugcgcggaaaguucggcaaaaagcauaugaucgcuggggucuucuuuacguucgugcugcuacuguccggacagaucacuuggcgggauauggcccacacccucauuaugaucggcaguaaugcaagcgacagaauggguauggggguuacauaccuggcccuuauugcuaccuuuaaaauacagcccuucuuggcgcugggauuuuucuuaaggaagcucacuucucgcgaaaaccugcuucugggcgugggccuagccauggcaacaacccuccaacugccggaggauaucgaacagauggcuaaugggauugccuugggacugauggccuuaaaacucaucacacaguuugagacuuaucagcuguggaccgcucuuauuucccugacguguucaaacacaaucuucaccuugacugucgcauggcgaaccgccacacucauacuggcgggugugagucuacugccuguuugccaaagcucguccaugcggaagacugacuggcuuccaaugaccguggcugccaugggcguccccccucucccccuguuuaucuucucuuugaaggauacgcugaaacguagaagcuggccauuaaaugaggggguaauggcagugggacucguuucaauucuggccaguucccuucugaggaacgacgugccuauggcuggccccuuggucgcaggugggcuccugaucgccuguuacgugauuacaggaaccucugcggaucuaacuguagaaaaggcugccgacgugacaugggaggaagaggcagaacagaccggcgucagccauaaccugaugaucacuguugacgaugacggcacaaugcgcauaaaagaugacgagaccgagaauauucuuacggugcuccugaagacugccuuguuaaucguguccgggaucuuuccauacucaauuccggcuacccugcucgucuggcacacauggcagaaacagacccaacggagcggagugcugugggauguuccuagucccccagaaacacagaaggccgagcuugaagaggguguauauagaauaaaacagcagggcauccuggggaagacucaagugggagucggcgugcagaaggaggguguuuuccauaccauguggcacgugacgaggggggcagucuugacacacaacggaaaacgacuagaacccaauugggcuucugugaagaaagaccugauuuccuacggcggcggguggcgccucagcgcccaguggcaaaagggagaggaaguacaggucaucgcgguggagccugguaaaaacccaaagaauuuucagacuaugcccggcaccuuccagacaaccacuggggaaauuggagccaucgcacuggauuucaagccuggcaccucggguucaccgauaaucaaccgggaggggaaaguugugggacuuuauggcaauggcgucgugacaaagaacgggggauacguuucugguauugcucaaacgaaugccgagccagacggccccacuccugaauuagaggaagagauguuuaaaaagagaaaccugaccaucauggaucuccauccagggaguggaaaaacaaggaaguauuugcccgcuauugugcgugaagcaaucaagcgccggcugagaacccucauacuggccccuacuagggucguggccgcugagauggaggaagcgcuuaaaggccugccgauucgauaccagacaaccgcaacgaaguccgagcacacuggucgggaaaucguagacuugaugugccaugccacacuaaccaugcgccugcucagccccgugagaguuccaaauuauaacuuaaucauuauggaugaggcucacuucaccgacccugccucuaucgcagccaggggguacauaagcacucgggucggaaugggcgaagcugcggccauuuuuaugacagcaacccccccaggcacagcugaugccuucccucaguccaaugcacccauccaggacgaggagcgagacauuccagaaagaucauggaacagugggaaugaguggaucacugauuuugccggaaaaacggugugguucgugccgagcauaaaggcugguaacgacauugccaacugucugcgcaaaaauggcaagaaggucauccaacuuucuaggaaaaccuuugauacagaauaccagaagacuaaacugaacgacugggauuucguagugaccacagacaucuccgagaugggggcgaauuuuaaggcagaucguguuauugacccucggagaugccucaaacccgugaucuugaccgauggaccagagagggucauucuggccggccccaugccugugacugcugccucagcugcacagcgccgagguagaguugggcggaacccacagaaggaaaaugaccaauauauauucacgggccagccccucaacaaugaugaggaccaugcccacuggaccgaagcuaagaugcugcuugacaacaucaauacaccugagggaauuaucccggcccuauuugaaccagagagggagaaaagugcagcgaucgauggcgaauaccgccugaagggggagagccguaaaacuuucguggaauugaugagacggggagacuuacccgucuggcuggcccacaagguggcuuccgaggguauuaaauauaccgauaggaaguggugcuucgacggccagcgcaacaaucagauacucgaagagaacauggauguagagaucuggacaaaagaaggggagaagcgaaagcugagaccucgguggcuugacgccaggaccuacucugauccccuggcacucaaagaauuuaaggacuucgcugccggacgcaaaucgauugcauuggaucuggugacugagaucggcagaguuccaagccaucuagcccacaggacacggaaugcucuggacaaccucgucaugcuucauacgucagaacacggugggcgugcguaucgccacgccguggaggagcugccugaaaccauggagacuuuauugcugcucggccugaugauucuucugacaggaggcgcaaugcucuuuuugaucuccgggaagggaauagguaaaaccaguaucggccugauuugugugaucgcuucuagcgggauguuauggauggccgaaauuccccuacaauggaucgccuccgcaauaguccuggaguucuuuaugaugguucuccuuauuccagagccugaaaagcagcgaaccccgcaggauaaucaacuggcuuacgugguaaucggaauuuugacacuggccgcgaucauagcugccaacgagaugggccuccuggaaacuacgaagagagaccuugguaugucaaaagagcccgggguggucucuccaaccagcuaucucgauguggaccugcauccugcaagugccuggacauuguacgcuguugcaacuaccgugaucacacccaugcugaggcacaccauugaaaauuccacugccaacgucagcuuagcggcuaucgccaaccaggcaguagugcuaaugggccuggacaagggauggccaauuucuaaaauggaucucggcguuccucuucuggccuuggggugcuacucacaggugaauccccugacgcucacagcugccguccugcuuuuaaucacccauuaugcaauaauuggaccgggccugcaggcuaaggccacucgggaggcgcaaaaacgcaccgccgcagguaucaugaagaacccaacaguggacgggaucauuacuaucgaucucgacccugucauauacgauuccaaguucgagaaacaguugggacaggugaugcugcuaguucugugugcugugcagcuccuucugaugagaaccaguugggccuugugcgaagcacugacacucgcuacgggccccauuaccacucugugggaggguagcccaggcaaguuuuggaauacaaccaucgccguaucgauggccaacauuuucagggggucuuauuuagcgggagcuggccuugcauuuuccaucaugaaaagcguggggacuggaaagcggggcacagguucacaaggggaaacccugggagagaaauggaagaagaaacucaaucagcuaagucgaaaggaauucgaccuguacaaaaagucuggcauaacggaggucgauagaaccgaggccaaagaagguuugaagcgcggcgagacaacucaccaugcuguuuccagggggagcgccaaacugcagugguuuguggaacggaacauggucauccccgagggacgugugauugaccucggcugugggagaggaggcuggucauauuacugcgcaggucuuaagaagguaaccgaagugaggggguauacaaaaggaggcccuggccacgagaagccgguucccaugaguacuuacggguggaauaucgugaaacugaugagcggaaaggaugucuucuacuugccaccugagaaaugugacacccugcucugcgauauuggugaauccucucccagcccuacaguggaggaaucccgcaccauccgggucuuaaagaugguggagccauggcugaagaacaaucaguuuuguauuaaaguucuuaaccccuauaugccugccguaaucgagcaccuggaacgacuacaaagaaagcauggcgggaugcucgugaggaauccacugucacgcaacucuacucacgagauguacuggauaaguaauggaacgggcaacauugucucgagcgugaauaugguuucccgguugcugcucaacagauucaaaaugacacaucguaggcccaccaucgaaaaggacguggaucuuggugcugggacucggcacgucaacgcggagccggaaaccccuaauauggacgugaucggagagcgcauuaaacgaauaaaggaggaacacaacucuacauggcauuaugacgaugagaauccauacaagacgugggccuaucacggcucauacgaaguaaaagcaaccggcagcgcuuccaguaugaucaacggggugguuaagcuguuaacuaaacccugggacgucgugccuauggugacacagauggccaugaccgauacuacaccauucggacagcaaagagucuuuaaggagaaaguugacaccaggacaccccggccgaugccugguacucgcaaggugauggaaauuaccgcagaguggcuguggagaacguugggcaggaauaagcgaccccggcucugcacccgugaggaauucacaaaaaagguaagaacuaacgccgcuaugggggccguguuuaccgaggaaaaucagugggauucugcgaaagcagccgucgaggacgaagaguucuggaagcugguggaucgcgagagggaacuacauaaacuuggaaaguguggcagcugcguuuauaacaugauggguaaacgggagaagaagcugggggaauuuggaaaagcuaagggcucaagagccaucugguacauguggcucggcgcacgcuaccuggaguucgaggcuuugggguuucugaaugaagaccacugguucuccagggagaacaguuauagcggaguggaaggugagggccuccauaaacuuggguacauucugcgagauaucucuaagauaccaggaggcgccauguaugcugacgauacagccgguugggacacucggaucaccgaagacgauuuacacaaugaggagaaaauuacgcagcagauggacccugaacacagacuguuggcaaacgcgaucuuuaagcucacauaccaaaauaaggucgugaaaguacagaggcccaccccaacugggacaguuauggauauuaucucccgcaaggaccagcguggaucaggccaggugggcaccuaugggcugaacacuuucaccaauauggaggcccaacuaguccggcagauggaaggagagggugugcuuagcaaagcugaucuggaaaacccccaucucccugagaagaaaauaacacaguggcuggagacgaagggcguggaaagauugaagaggauggccauuucgggggacgauugcgucguuaaaccaaucgacgaucgcuuugcaaacgcuuuacuggcccucaaugacaugggaaaggugcgaaaagauaucccgcaguggcaacccucuaagggcuggcacgacuggcagcagguaccuuucuguagucaucacuuucacgagcuuauuaugaaagauggucggaagcugguggucccaugcagaccccaggacgaacuaauagggagggcacgcaucucccaaggagccggcuggagccugagagagaccgcgugucucggcaaggcuuacgcccagauguggucauugauguauuuccaucggagggaccugcgucuugcauccaacgccauuugcucugcugugccuauccacuggguuccaacuagccgaacaaccuggaguauucaugcccaccaucaguggaugacuacagaagauaugcugaccguguggaaucgcgucuggaucgaggacaaccccuggauggaggauaaaacgccugugacaaccugggaaaauguaccguaccucgggaagagagaggaccaaugguguggauccuuaauaggucugacuagccgggcaaccugggcucagaacaucccaacagccauucagcagguuaggucuuugaucggcaaugaagaguuccuggauuacaugcccucaaugaaacgcuuuagaaaggaggaagagcucgaaggggcgauuugguga

SEQ ID NO: 15123 - RNA, 9873 nt, Artificial Sequence
  derived and/or modified CDS sequence (opt3) from DENV-3__KF041254__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucagaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagaugcucccuguaaaaucccuuucuccacagaggacggccaagguaaggcgcauaacgggcgucuuauaacugcaaauccaguugugaccaaaaaggaggaacccguaaacauugaggccgaaccgccuuucggcgagucaaauaucgucaucggaauuggcgauaacgcuuugaaaaucaauugguauaagaaggggagcaguauuggaaaaauguuugaagccacagcacgcggugccagaaggauggcuauacugggcgacacugccugggauuucgggucugugggaggcguucucaacucccuggguaagauggugcaccagaucuuugggagcgcauacaccgcgcuuuucucgggcgucucuugggugaugaaaauuggaaucggcguacuguugacguggaucgggcucaauuccaagaacacaucaaugaguuuuagcugcauugcuauaggaaucauuacccuguauuuaggcgugguuguccaggccgacauggguugugugaucaauuggaaagggaaggagcugaagugcggauccggcauuuucgugacuaacgagguccauacauggaccgaacaguacaaauuucaagcagauucucccaagcggcuagccacugcuaucgccggugcaugggagaauggcguuugugggauacgaagcaccacacgcauggaaaaccuccuguggaaacagaucgcuaaugagcuuaacuauauuuugugggaaaauaacaucaagcugacgguggugguaggagacaccauuggcguccucgagcaggggaaaagaacucugacaccacagccuauggaguuaaaguacucauggaggaccuggggaaaagccaagaucgugacagcggaaacucaaaacaguuccuucauaauugauggccccaauaccccagagugccccagcgccucucgggcuuggaacguuugggaaguggaggacuaugguuuuggggucuucacgacaaauaucuggcugaagcuucgcgaaauguacacccagaugugugaccacagauugaugucagcagccgugaaagaugagagggcuguucacgccgacaugggauacuggauugagagucagaagaacggcagcuggaaacucgaaaaggcaucccugaucgaggugaaaacuugcaccuggccuaagucucauacacuauggucgaaugguguacuggaaagcgauaugauaaucccaaagucccucgcgggcccgauuucacagcacaacuaucgucccggguaccauacucaaaccgccggaccuuggcaccugggcaaacuugaguuggacuuuaauuauugcgaggggacaacggucgugaucaccgaaaacuguggaacucggggcccaagucugcgaacaaccacugugucugguaaguuaauucacgaguggugcuguagaagcugcacacuccccccucugagguacaugggggaagauggauguugguauggcauggagauccgcccaauauccgaaaaagaggagaauauggucaagucacuuguuagcgcugguucuggcaaaguggacaacuucaccauggggguacugugcuuggccauucucuuugaagaggugaugcggggaaaguucggcaagaaacauaugaucgcaggggucuucuuuacguucgugcugcuacuguccggacagaucacuuggagagauauggcucacacccucauuaugaucggcaguaaugccagcgacaggauggguauggggguuacauaccuggcacuuauugccaccuuuaagauacagcccuucuuggcucugggauuuuucuuacgcaaacucacuucucgagaaaaccugcuucugggcgugggccuagcgauggccacaacccuccaacugccggaggauaucgaacagauggcaaaugggauugcuuugggacugauggccuuaaagcucaucacacaguuugagacuuaucagcuguggaccgcccuuauuucccugacguguucaaacacaaucuucaccuugacugucgcuuggcggaccgcaacacucauacuggccggugugagucuacugccuguuugccaaagcucguccaugcguaaaacugacuggcuuccaaugaccguggcggcuaugggcguccccccucucccccuguuuaucuucucuuugaaggauacgcugaagagaaggagcuggccauuaaaugaggggguaauggccgugggacucguuucaauucuggcaaguucccuucugcgcaacgacgugccuauggccggccccuuggucgcuggugggcuccugaucgcauguuacgugauuacaggaaccucugccgaucuaacuguagaaaaagcggcugacgugacaugggaggaagaggccgaacagaccggcgucagccauaaccugaugaucacuguugacgaugacggcacaaugcggauaaaggaugacgagaccgagaauauucuuacggugcuccugaaaacugcauuguuaaucguguccgggaucuuuccauacucaauuccggccacccugcucgucuggcacacauggcagaagcagacccaaagaagcggagugcugugggauguuccuagucccccagaaacacagaaagcugagcuugaagaggguguauauaggauaaagcagcagggcauccuggggaaaacucaagugggagucggcgugcagaaggaggguguuuuccauaccauguggcacgugacgcgaggggccgucuugacacacaacggaaagcgccuagaacccaauugggcaucugugaaaaaggaccugauuuccuacggcggcggguggcggcucagcgcucaguggcaaaaaggagaggaaguacaggucaucgccguggagccugguaagaacccaaaaaauuuucagacuaugcccggcaccuuccagacaaccacuggggaaauuggagcgaucgcccuggauuucaagccuggcaccucggguucaccgauaaucaacagagaggggaagguugugggacuuuauggcaauggcgucgugacaaaaaacgggggauacguuucugguauugcacaaacgaaugcugagccagacggccccacuccugaauuagaggaagagauguuuaagaaaaggaaccugaccaucauggaucuccauccagggaguggaaagacacguaaauauuugcccgccauugugcgcgaagcuaucaagcggagacugaggacccucauacuggcaccuacucgagucguggccgccgagauggaggaagcucuuaagggccugccgauucgguaccagacaaccgcgacgaaauccgagcacacuggucgcgaaaucguagacuugaugugccaugcaacauucaccaugagacuacugagccccgugaggguuccaaauuauaaccucaucauuauggaugaggcccacuuuaccgacccugcuucuaucgccgcacggggguacauaagcacucgagucggaaugggcgaagccgcugcgauuuucaugacagccacccccccaggcacagcagaugcuuuuccucaguccaaugcccccauccaggacgaggagagagacauuccagaacgcucauggaacagugggaaugaguggaucacugauuucgcaggaaagacggugugguuugugccgagcauaaaagccgguaacgacauugcuaacuguuuaaggaagaauggcaaaaaggucauccaacugucucguaagaccuucgauacagaauaccagaaaacuaagcuuaacgacugggauuuuguagugaccacagacaucuccgagaugggggccaauuucaaagcggaucggguuauugacccuagaaggugccugaagcccgugauccucaccgauggaccagagcgcgucauuuuggcaggccccaugccugugacugccgcuucagccgcucagcgaagaggucggguugggaggaacccacagaaagaaaaugaccaauauauauuuacgggccagccccugaacaaugaugaggaccaugcacacuggaccgaagccaagaugcuccuggacaacaucaauacaccugagggaauuaucccggcucuuuucgaaccagagcgcgagaagagugccgcaaucgauggcgaauaccgucuaaaaggggagagcagaaagacuuucguggaacugaugcggaggggagacuugcccgucugguuagcgcacaaaguggccuccgaggguauuaaguauaccgaucgcaaauggugcuuugacggccagcgaaacaaucagauacuggaagagaacauggauguagagaucuggacaaaggaaggggagaaaagaaagcuccggccuagguggcuggacgcucgcaccuacucugauccccuugcccugaaggaauucaaagacuuugcagcuggaagaaagucgauugcccucgauuuggugacugagaucggcaggguuccaagccaucuggcacaccggacacguaaugcccuagacaaccuggucaugcuccauacgucagaacacggugggcgcgcuuaucgacacgcgguggaggagcuuccugaaaccauggagacucuguuauugcugggccucaugauucugcuuacaggaggcgccacccuguuccucaucuccgggaaaggaauagguaagaccaguaucggcuugauuugugugaucgcaucuagcgggaugcuguggauggcugaaauucccuuacaauggaucgccuccgccauaguccuagaguuuuucaugaugguucugcucauuccagagccugaaaaacagagaacaccgcaggauaaucaacuugcauacgugguaaucggaauucugacuuuggcugccaucauagcggcuaacgagaugggccugcucgaaacgaccaagagggaccuggguaugucaaaggagcccgggguggucucuccaacaagcuaucuugauguggaccuccauccugccagugcauggacucuguacgccguugcuaccacagugaucacccccauguugcggcacacuauugaaaauuccacggcaaacgucagccuggccgcgaucgcuaaccaggccguaguguuaaugggccuagacaaaggauggccaauuucuaagauggaucugggcguuccucuccuugcacuggggugcuacucacaggugaaucccuugacacugaccgccgcuguccuccugcuuaucacucauuaugccauaauuggaccgggcuuacaggcaaaagcuacccgcgaggcccaaaagagaacagcggccgguaucaugaaaaacccaacuguggacgggaucauuaccaucgaucuggacccugucauauacgauuccaaguuugagaagcagcucggacaggugauguugcugguucuaugugcagugcagcugcuccuuaugaggacaaguugggcucugugcgaagccuugacgcuggcaaccggccccauuacuacacucugggaggguagcccaggcaaauucuggaauaccacuaucgcuguaucgauggccaacauuuuucgggggucuuaucuggcccgagcgggauuagcuuucuccaucaugaagagcgugggcacagggaaaagaggaaccggcucacaaggugaaacgcuuggggagaaguggaaaaagaagcugaaucagcucagucgcaaagaauuugaccuauacaagaaaucuggaauaaccgaggucgauaggacagaggcaaaggaaggccugaaacggggugagacuacccaccaugccguuucccguggcagcgcuaaguugcagugguucguggaaagaaacauggucauccccgaggggagggugauugaccugggauguggccgcgggggauggucauauuacugcgccggccucaaaaagguaacagaagugcgggguuauacuaaggggggaccuggccacgaggagccgguucccaugaguaccuacggcuggaauaucgugaaacuuaugagcgggaaggaugucuuuuaccugccaccugaaaaaugugacacauugcugugcgauauuggagaguccucucccagcccuaccguggaagagucccgaacuaucagaguccucaagaugguggagccaugguuaaaaaacaaucaguucuguauuaagguucugaaccccuauaugccugcaguaaucgaacaccuugagaggcugcaacgcaagcaugguggcaugcuagugcggaauccacucucaagaaacucuacgcacgaaauguacuggauaaguaaugggacaggaaacauugucucgagcgugaauaugguuuccaaacuguugcugaaccguuucaccaugacucauaggcggcccaccaucgagaaggacguggaucucggcgccgguacacgccacgucaacgcugaaccggagacgccuaauauggacgugaucggggagcgaauuaaaagaauaaaggaagagcacaacucuaccuggcauuaugacgaugaaaauccauacaaaacuugggcguaucacggaucauacgagguaaaggccacaggcagcgcauccaguaugaucaacggcgugguuaagcuucugaccaaacccugggacgucgugccuauggugacucagauggcuaugacagauaccacaccauuugggcagcaaagggucuucaaggaaaaaguugacacucggaccccccgcccgaugccuggaacgagaaaggugauggagauuaccgccgagugguuauggaggacacugggucgaaauaaacggccccguuugugcacuagagaagaguuuaccaagaagguacgcacaaacgcagccaugggcgcuguguucacugaagagaaucagugggauucugccaaagcggcagucgaagacgaggaguuuuggaagcucguggauagggaacgggagcugcauaaacuagggaaguguggaagcugcguuuauaacaugaugggcaaaagagaaaagaaacuuggugaguucgggaaggccaagggaucacgcgcuaucugguacauguggcugggcgccagguaccucgaguuugaagcacugggcuucuugaaugaggaccacugguuuucccgagaaaacaguuauagcgggguggagggagaaggucugcauaaacucggcuacauucuucgggauaucucuaagauaccagggggagcuauguaugccgacgauaccgcuggcugggacacgagaaucacagaggacgaucugcacaaugaggaaaaaauuacccagcagauggacccugagcacagguuacuggccaacgcaaucuucaaguugacuuaccaaaauaaagucgugaagguacagcgccccacaccaaccgguacuguuauggauauuaucucccguaaggaccagcgggggucaggacaggugggcaccuauggccucaacacauuuacgaauauggaagcgcaacuggucagacagauggagggggaaggagugcuaagcaaagccgaucuugagaacccccaucugccugagaagaaaauaacccaguggcucgaaacuaaggguguggagaggcugaaacgcauggcuauuucgggcgacgauugcgucguuaagccaaucgacgaucgauucgccaacgcauuguuagcucugaaugacauggggaaggugcggaaagauaucccgcaguggcaacccucuaagggauggcacgacuggcagcagguaccuuuuuguagucaucacuuccacgaacucauuaugaaagauggcagaaagcuuguggucccaugcaggccccaggacgagcugauaggucgcgccagaaucucccaaggggcaggauggagccuacgggaaacagccugucugggcaaagcguacgcucagauguggucacucauguauuuccauaggcgugacuugcgacuggccuccaacgcaauuugcucugccgugccuguucacugggugccaaccagccgcacuacauggaguauccaugcucaccaucaguggaugaccacggaggauaugcuuacagucuggaauagaguguggauugaggacaaccccuggauggaagauaagaccccuguaacuaccugggagaauguuccguaccugggcaagcgggaagaccaauggugugggucccucaucggauuaacaagcagggccacuugggcacagaacauaccaaccgcuauccagcaggugcgcucucugauugguaaugaggaguuuuuggauuacaugcccucaaugaaaagauuccggaaggaagaggaacuggagggcgccaucugguga

SEQ ID NO: 15124 - RNA, 9873 nt, Artificial Sequence
  derived and/or modified CDS sequence (opt3) from DENV-3__KX380841__SS-prME
accagccugugccucaugaugauccuucccgcagcucuggcauuccacuugacauccagggacggcgagccuaggaugauuguggggaagaacgaacggggaaagucuuuacuguuuaagacugcaucagguauaaauauguguacgcucaucgcgauggaucucggcgagaugugcgacgauaccgucaccuacaaguguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccagacguggauguccgccgagggggcuuggaggcaggucgaaaagguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaagggauuaccgcagaaaucacuccucaggcuuccacgacagaggccauccucccagaauauggaacccuuggccuggagugcucuccgcgaacugguuuggacuucaaugagaugauucuacugaccaugaaaaacaaggcguggaugguccauagacagugguuuuucgaucucccccugccuuggacaagcggggccaccacugaaacaccaacguggaauaggaaagagcuucuggugaccuuuaagaacgcacacgcuaaaaagcaagaaguaguuguguugggcucccaggagggagccaugcacacugcucucacaggcgccaccgaaauacaaaauucagggggaacaaguaucuucgcaggucaucugaagugucgguuaaaaauggacaagcuggagcuaaaaggcaugagcuacgccaugugcacuaacaccuuuguccucaagaaagaggugucugaaacgcagcacgggaccauucugaucaaggucgaguacaagggagaagaugcucccuguaaaauaccuuucuccacagaggacggccaagguaaggcgcauaacgggcgucuuauuacugcaaauccagugguuaccaaaaaggaggaacccgugaacaucgaggccgaaccgccuuucggcgagucaaauaucguaauuggaaucggcgauaacgcuuugaaaauuaauugguauaagaaggggagcaguauaggaaaaauguuugaagccacagcacgcggugccagaaggauggcuauccugggcgacacugccugggauuucgggucugucggaggcgugcucaacucccuggguaagaugguucaccagauuuuugggagcgcauacaccgcgcuuuucucgggcgugucuugggucaugaaaaucggaaucggcgugcuguugacguggauugggcucaauuccaagaacacaucaaugaguuuuagcugcauagcuaucggaauuaucacccuguauuuaggcgccguagugcaggcagacauggguuguguuauuaauuggaaagggaaggagcugaagugcggauccggcaucuucgucacuaacgaggugcauacauggaccgaacaguacaaauuucaagccgauucucccaagcggcuagcuacugccauagccggugcuugggagaauggcgugugugggauccgaagcaccacacgcauggaaaaccuccuguggaaacagauugccaaugagcuuaacuauaucuugugggaaaauaacauuaagcugacggucguugugggagacaccaucggcgugcucgagcaggggaaaagaacucugacaccacagccuauggaguuaaaguacucauggaaaaccuggggaaaggcgaagauaguaacagccgaaacucaaaacaguuccuucauuaucgauggccccaauaccccagagugccccagcgcuucuagggcauggaacgucugggaaguggaggacuaugguuuugggguuuucacgacaaauauuuggcugaaacuucgggaaguguacacccagaugugugaccaccgcuugaugucagccgcugucaaggaugagagagccgugcacgcagacaugggauacuggaucgagagucagaaaaacggcagcuggaagcucgaaaaagcgucccugauagagguuaagacuugcaccuggccuaagucucauacacuauggucgaauggugugcuggaaagcgauaugaucauuccaaaaucccucgccggcccgaucucacagcacaacuauaggcccggguaccauacucaaaccgcuggaccuuggcaccugggcaaacuugaguuggacuuuaauuauugcgaggggacaacgguagucauuaccgaaaacuguggaacucguggcccaagucugcggacaaccacugugucugguaaauuaauccacgaguggugcugucgaagcugcacacuacccccucugagauacaugggggaagauggauguugguauggcauggagauaaggccaauuuccgaaaaggaggagaauauggugaaaucacuugucagcgccgguucuggcaagguugacaacuucaccaugggggugcugugcuuggcaauccucuuugaagagguaaugcgcggaaaguucggcaaaaagcauaugaucgcugggguguucuuuacguucguccugcuacuguccggacagauuacuuggcgggauauggcccacacccucaucaugauuggcaguaaugcaagcgacagaauggguaugggggugacauaccuggcccuuauagcuaccuuuaaaauccagcccuucuuggcgcugggauuuuucuuaaggaagcucacuucucgcgaaaaccugcuucugggcguuggccuagccauggcaacaacccuccaacugccggaggauauugaacagauggcuaaugggaucgccuugggacugauggccuuaaaacucauuacacaguuugagacuuaucagcuguggaccgcucuuaucucccugacguguucaaacacaauauucaccuugacuguggcauggcgaaccgccacacucauccuggcgggugucagucuacugccugugugccaaagcucguccaugcggaagacugacuggcuuccaaugaccguugcugccaugggcgugcccccucucccccuguuuauuuucucuuugaaggauacgcugaaacguagaagcuggccauuaaaugagggggucauggcaguaggacucgugucaauccuggccaguucccuucugaggaacgacguuccuauggcuggccccuugguggccggugggcuccugauugccuguuacgucaucacaggaaccucugcggaucuaacuguggaaaaggcugccgacguaacaugggaggaagaggcagaacagaccggcgugagccauaaccugaugauaacugucgacgaugacggcacaaugcgcauuaaagaugacgagaccgagaauauccuuacgguucuccugaagacugccuuguuaaucguguccgggauuuuuccauacucaauaccggcuacccugcucguguggcacacauggcagaaacagacccaacggagcggaguccugugggaugugccuagucccccagaaacacagaaggccgagcuugaagaggguguuuauagaaucaaacagcagggcauucuggggaagacucaaguaggagugggcguccagaaggacgguguguuccauaccauguggcacguuacgagaggggcaguguugacacacaacggaaaacgacuagagcccaauugggcuucugucaagaaagaucugaucuccuacggcggcggguggcgccucagcgcccaguggcaaaagggagaagaggugcagguaauugcggucgaaccugguaaaaacccaaagaauuuucagacuaugcccggcaccuuccagacaaccacuggggagaucggagccauagcacuggacuucaagccuggcaccucggguucaccgaucauuaaccgggaagggaaagugguuggacuuuauggcaauggcguggucacaaagaacgggggauacgugucugguaucgcucaaacgaaugccgagccagauggccccacuccugaguuagaagaggaaauguuuaaaaagagaaaccugaccauuauggaccuccauccagggaguggaaaaacaaggaaguauuugcccgcuaucguucgugaggcaauaaagcgccggcugagaacccucauucuggccccuacuaggguggucgccgcugaaauggaggaggcgcuuaaaggccugccgauccgauaccagacaaccgcaacgaaguccgaacacacuggucgggagaucguggauuugaugugccaugccacauucaccaugcgccuacugagccccguaagagugccaaauuauaaccucauuaucauggacgaagcucacuuuaccgauccugccucuauagcagccaggggguacauuagcacucggguuggaaugggcgaggcugcggccaucuucaugacagcaacacccccaggcacagcugacgccuuuccucaguccaaugcacccauucaggacgaggaacgagauaucccagagagaucauggaacagugggaaugaauggauaacugacuucgccggaaaaacggucugguuugugccgagcauuaaggcugguaacgauaucgccaacuguuuacgcaaaaauggcaagaaggugauccaacugucuaggaaaaccuucgacacagaguaccagaagacuaaacuuaacgauugggacuuugucguaaccacagauauuuccgaaaugggggcgaauuucaaggcagaccgugugaucgauccucggagaugccugaaacccguuauucucaccgacggaccagagagggugauauuggccggccccaugccugucacugcugccucagcugcacagcgccgagguagaguggggcggaacccacagaaggagaaugaucaauauaucuuuacgggccagccccugaacaaugacgaagaccaugcccacuggaccgaggcuaagaugcuccuggauaacauuaauacaccugaaggaaucaucccggcccuuuucgagccagaaagggagaaaagugcagcgauugacggcgaguaccgccuaaagggggaaagccguaaaacuuucguugagcugaugagacggggagauuugcccgugugguuagcccacaaggucgcuuccgaagguauaaaauauaccgacaggaaguggugcuuugauggccagcgcaacaaucagauccuggaggaaaacauggacguggagauuuggacaaaagagggggaaaagaagaaacuccgaccuagauggcuggaugcccggaccuacucugacccccuugcacugaaggaguucaaagauuuugcugccggaaggaagucgaucgcacucgacuugguaacugaaauuggccgcgugccaagccaucuggcccacagaacaaggaaugcucuagauaaccugguuaugcuccauacgucagagcacggugggcgggcguaucgucacgccgucgaggaacuuccugagaccauggaaacucuguuauugcugggccucaugauccugcuuacaggaggcgcaaugcuguuccucauauccgggaaaggaaucgguaagaccaguauuggcuugaucugugugauugcuucuagcgggaugcuguggauggccgagauccccuuacaauggauagccuccgcaauugugcuagaauuuuucaugaugguccugcucaucccagagccugagaagcagcgcaccccgcaggacaaucaacuugcuuacguugugauuggaauccugacaauggccgcgauaaucgcugccaacgaaaugggcuugcuggagacuacgaaacgagaucucgguaugucaaaggaacccgggguagugucuccaaccagcuaucuggacgucgaccuucauccugcaagugccuggacacucuacgcuguggcaacuaccguuauuacacccaugcugagacacaccaucgaaaauuccacugccaacgugagcuuggcggcuauugccaaccaggcagucguacugaugggcuuagauaaaggauggccaaucucuaagauggaccuaggcgugccucugcucgcccuugggugcuacucacagguuaauccccugacguugacagcugccgugcugcuccuggucacccauuaugcaauaauuggaccgggccuucaggcuaaagccacuagggaagcgcaaaagcggaccgccgcagguaucaugaagaacccaacaguggaugggaucauuacuaucgacuuagauccugucauauacgacuccaaauuugagaagcagcugggacaggugaugcucuugguucugugugcugugcagcuacugcucaugcgcaccaguugggcccuuugcgaggcacugacauuggcuacgggccccauuaccacucugugggaagguagcccaggcaaauucuggaauacaaccaucgccguaucgauggccaacauuuuuagagggucuuaucucgcgggagcuggccuggcauucuccaucaugaaaagcguggggacuggaaaaaggggcacagguucacaaggggagaccuuaggagaaaaguggaagaagaaacuuaaucagcugagucggaaagaguuugaucucuacaagaaaucuggcauaacggaagucgaccgaaccgaggccaaagagggucuaaaaagaggcgaaacaacucaccaugcuguuucccgcgggagcgccaagcugcagugguucguggagaggaacauggucauccccgaaggacgggugauugauuugggcugugggcguggaggcuggucauauuacugcgcaggucugaagaaaguaaccgaggugagaggguauacaaagggaggcccuggccacgaggaaccgguucccaugaguacuuacggguggaauaucgugaaacucaugagcggaaaggacgucuuuuaccuuccaccugagaaaugugauacccuguugugcgacauuggugaauccucucccagcccuacaguggaggaauccaggaccauccgcguccugaagaugguggagccauggcucaagaacaaucaguucuguauuaaaguuuuaaaccccuauaugccugccguaaucgagcaccuggaacggcuucaacgaaagcauggcgggaugcuggugagaaauccacuaucaaggaacucuacucacgagauguacuggauaaguaauggaacgggcaacauugucucgagcgugaauaugguuucccgccuccuguugaaccgguucacaaugacccauagacgucccacuaucgaaaaagauguggaccugggugcugggaccaggcacgucaacgcggagccggaaacaccuaauauggacgugaucggagagcggauuaagcgcauaaaagaggaacacaacucuacguggcauuaugaugacgagaauccauacaagaccugggccuaucacggcucauacgaaguaaaggcaacuggcagcgcuuccaguaugaucaacggggugguuaaacuccuuacaaagcccugggaugucgugccuauggugacccagauggccaugacugacacaaccccauuuggacagcaacgagucuucaaagagaagguugauacaagaacucccaggccgaugccugguacccggaaagugauggaaauuacggcagaguggcuguggcgcaccuuaggcagaaauaagaggccccgacugugcacacgggaggaauuuacuaagaaaguacguaccaacgccgcuaugggggccguguucacagaggaaaaucagugggacucugcgaaggcagccgucgaggaugaagaguuuuggaaauugguggacagagagcgcgaacuccauaagcugggaaaauguggcagcugcguuuauaacaugauggguaagagggagaaaaagcuaggggaguucggaaaggcuaaaggcucacgggccaucugguacauguggcuuggcgcaagauaccuggaguuugaggcucucggguuccugaaugaagaucacugguuuucccgcgagaacaguuauagcggaguggaaggugagggcuugcauaagcugggguacauucucagggacaucucuaaaauaccaggaggcgccauguaugcugaugacacugccgguugggacacccgaaucacggaagaugaccuucacaaugaggagaagauuacacagcagauggauccugaacaccggcuguuagcaaacgcgaucuucaaacugaccuaccaaaauaaggucgugaagguacagagacccacuccaacagggaccguuauggacauuaucuccaggaaagaucagcgcggaucaggccaggugggcacuuauggguugaacaccuuuacaaauauggaggcccaacucguccgucagauggaaggagagggugugcugagcaagacggaccuagaaaacccccaucuuccugagaaaaagauaacccaguggcuggagacuaaaggcguggaacggcucaagagaauggcuauuucgggggaugacugcgucguuaagccaaucgaugacagguucgccaacgcacuguuggcuuuaaaugauaugggaaaagugcgcaaggacaucccgcaguggcaacccucuaaaggcuggcacgauuggcagcagguaccuuuuuguagucaucacuuccacgagcugauuaugaaggacggucgaaaacucguggucccaugccggccccaggacgaacuuauagggagagccaggaucucccaaggagcaggcuggagccugcgcgagacagccugucuaggcaaggcguacgcucagauguggucacugauguauuuccauagacgggaucucagguuggccuccaacgcaauuugcucugccgugccuguucacugggugccaaccagccguacuacauggaguauccaugcucaccaucaguggaugaccacggaagacaugcugacagucuggaaucgaguguggauugaggauaaccccuggauggaggacaagaccccuaucacuaccugggaaaauguaccguaccuugggaaacgcgaggaucaaugguguggaucccugauaggucucacaagcagagccacuugggcacagaacaucccaaccgcuauucagcagguucggucuuuaaucggcaaugaagaguuucuggacuacaugcccucaaugaagagguuccgcaaagaggaagagagugaaggggccauuugguga

SEQ ID NO: 15125 - RNA, 9873 nt, Artificial Sequence
  derived and/or modified CDS sequence (opt3) from DENV-3__KX380842__SS-prME
accagccugugccucaugaugauccuucccgccgcucuggcauuccacuugacauccagggacggagagccuaggaugauuguggggaagaacgaacggggaaagucuuuacuguuuaagacugccucagguauaaauauguguacgcucaucgcgauggaucucggcgagaugugcgacgauaccgucaccuacaaguguccacauauuacugaaguugagccggaagacaucgauugcugguguaaccugaccaguacaugggugaccuaugggacuugcaaucaggcuggagagcaccgccgagacaagcguagcgucgcccuugcaccccaugugggcaugggucuggauacaagaacccagacguggauguccgccgagggggcuuggaggcaggucgaaaagguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucagcuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaagggauuaccgcagaaaucacuccucaggcuuccacgacagaggccauccucccagaauauggaacccuuggccuggagugcucuccgcgaacugguuuggacuucaaugagaugauucuacugaccaugaaaaacaaggcguggaugguccauagacagugguuuuucgaucucccccugccuuggacaagcggggccaccacugaaacaccaacguggaauaggaaagagcuucuggugaccuuuaagaacgcacacgcuaaaaagcaagaaguaguuguguugggcucccaggagggagccaugcacacugcucucacaggcgccaccgaaauacaaaauucagggggaacaaguaucuucgcaggucaucugaagugucgguuaaaaauggacaagcuggagcuaaaaggcaugagcuacgccaugugcacuaacaccuuuguccucaagaaagaggugucugaaacgcagcacgggaccauucugaucaaggucgaguacaagggagaagaugcucccuguaaaauaccuuucuccacagaggacggccaagguaaggcgcauaacgggcgucuuauuacugcaaauccagugguuaccaaaaaggaggaacccgugaacaucgaggccgaaccgccuuucggcgagucaaauaucguaauuggaaucggcgauaacgcuuugaaaauuaauugguauaagaaggggagcaguauaggaaaaauguuugaagccacagcacgcggugccagaaggauggcuauccugggcgacacugccugggauuucgggucugucggaggcgugcucaacucccuggguaagaugguucaccagauuuuugggagcgcauacaccgcgcuuuucucgggcgugucuugggucaugaaaaucggaaucggcgugcuguugacguggauugggcucaauuccaagaacacaucaaugaguuuuagcugcauagcuaucggaauuaucacccuguauuuaggcgccguagugcaggcagacauggguuguguuauuaauuggaaagggaaggagcugaagugcggauccggcaucuucgucacuaacgaggugcauacauggaccgaacaguacaaauuucaagccgauucucccaagcggcuagcuacugccauagugggugcaugggagaauggcgucugugggauccgaagcaccacacgcauggaaaaccuccuguggaaacagauugcuaaugagcuuaacuauaucuugugggaaaauaacauuaagcugacgguuguggugggagacaccaucggcguacucgagcaggggaaaagaacucugacaccacagccuauggaguuaaaguacucauggaaaaccuggggaaaggccaagauagucacagcggaaacucaaaacaguuccuucauuaucgauggccccaauaccccagagugccccagcgccucuagggcuuggaacgugugggaaguugaggacuaugguuuugggguguucacgacaaauauuuggcugaaacuucgggaagucuacacccagaugugugaccaccgcuugaugucagcagccgugaaggaugagagagcuguucacgccgacaugggauacuggaucgagagucagaaaaacggcagcuggaagcucgaaaaagcaucccugauagaggugaagacuugcaccuggccuaagucucauacacuauggucgaaugguguacuggaaagcgauaugaucauuccaaaaucccucgcgggcccgaucucacagcacaacuauaggcccggguaccauacucaaaccgccggaccuuggcaccugggcaaacuugaguuggacuuuaauuauugcgaggggacaacggucgugauuaccgaaaacuguggaacucguggcccaagucugcggacaaccacugugucugguaaauuaauccacgaguggugcugucgaagcugcacacuacccccucugagauacaugggggaagauggauguugguauggcauggagauaaggccaauuuccgaaaaggaggagaauauggucaaaucacuuguuagcgcugguucuggcaagguggacaacuucaccauggggguacugugcuuggccauccucuuugaagaggugaugcgcggaaaguucggcaaaaagcauaugaucgcaggggucuucuuuacguucgugcugcuacuguccggacagauuacuuggcgggauauggcucacacccucaucaugauuggcaguaaugccagcgacagaauggguauggggguuacauaccuggcacuuauagccaccuuuaaaauccagcccuucuuggcucugggauuuuucuuaaggaagcucacuucucgcgaaaaccugcuucugggcgugggccuagcgauggccacaacccuccaacugccggaggauauugaacagauggcaaaugggaucgcuuugggacugauggccuuaaaacucauuacacaguuugagacuuaucagcuguggaccgcccuuaucucccugacguguucaaacacaauauucaccuugacugucgcuuggcgaaccgcaacacucauccuggccggugugagucuacugccuguuugccaaagcucguccaugcggaagacugacuggcuuccaaugaccguggcggcuaugggcguacccccucucccccuguuuauuuucucuuugaaggauacgcugaaacguagaagcuggccauuaaaugaggggguaauggccgugggacucguuucaaugcuggcaaguucccuucugaggaacgacgugccuauggccggccccuuggucgcuggugggcuccugaucgcauguuacgugauuacaggaaccucugccgaucuaacuguagaaaaggcggcugacgugacaugggaggaagaggccgaacagaccggcgucagccauaaccugaugaucacuguugacgaugacggcacaaugcgcauaaaagaugacgagaccgagaauauucuuacggugcuccugaagacugcauuguuaaucguguccgggaucuuuccauacucaauuccggccacccugcucgucuggcacacauggcagaaacagacccaacggagcggagugcugugggauguuccuagucccccagaaacacagaaggcugagcuugaagaggguguauauagaauaaaacagcagggcauccuggggaagacucaagugggagucggcgugcagaaggacgguguuuuccauaccauguggcacgugacgagaggggccgucuugacacacaacggaaaacgacuagagcccaauugggcaucugugaagaaagaucugauuuccuacggcggcggguggcgccucagcgcucaguggcaaaagggagaagagguacaggucaucgccguggaaccugguaaaaacccaaagaauuuucagacuaugcccggcaccuuccagacaaccacuggggagauuggagcgaucgcccuggacuucaagccuggcaccucggguucaccgauaaucaaccgggaagggaaaguugugggacuuuauggcaauggcgucgugacaaagaacgggggauacguuucugguauugcacaaacgaaugcugagccagauggccccacuccugaguuagaagaggaaauguuuaaaaagagaaaccugaccaucauggaccuccauccagggaguggaaaaacaaggaaguauuugcccgccauugugcgugaggcuaucaagcgccggcugagaacccucauacuggcaccuacuagggucguggccgccgaaauggaggaggcucuuaaaggccugccgauucgauaccagacaaccgcgacgaaguccgaacacacuggucgggagaucguagauuugaugugccaugcaacauucaccaugcgccuacugagccccgugagaguuccaaauuauaaccucaucauuauggacgaagcccacuuuaccgauccugcuucuaucgccgcaaggggguacauaagcacucgggucggaaugggcgaggccgcugcgauuuucaugacagccacacccccaggcacagcagacgcuuuuccucaguccaaugcccccauccaggacgaggaacgagauauuccagagagaucauggaacagugggaaugaauggaucacugacuucgcaggaaaaacggugugguuugugccgagcauaaaggccgguaacgauauugcuaacuguuuacgcaaaaauggcaagaaggucauccaacugucuaggaaaaccuucgacacagaguaccagaagacuaaacuuaacgauugggacuuuguagugaccacagauaucuccgaaaugggggccaauuucaaggcggaccguguuauugauccucggagaugccugaaacccgugauccucaccgacggaccagagagggucauuuuggcaggccccaugccugugacugccgcuucagccgcucagcgccgagguagaguugggcggaacccacagaaggagaaugaucaauauauauuuacgggccagccccugaacaaugacgaagaccaugcacacuggaccgaggccaagaugcuccuggauaacaucaauacaccugaaggaauuaucccggcucuuuucgagccagaaagggagaaaagugccgcaaucgacggcgaguaccgccuaaagggggaaagccguaaaacuuucguggagcugaugagacggggagauuugcccgucugguuagcgcacaagguggccuccgaagguauuaaauauaccgacaggaaguggugcuuugauggccagcgcaacaaucagauacuggaggaaaacauggacguagagaucuggacaaaagagggggaaaagaagaaacuccgaccuagauggcuggaugcucggaccuacucugacccccuugcccugaaggaguucaaagauuuugcagcuggaaggaagucgauugcccucgacuuggugacugaaaucggccgcguuccaagccaucuggcacacagaacaaggaaugcccuagauaaccuggucaugcuccauacgucagagcacggugggcgggcuuaucgucacgcgguggaggaacuuccugagaccauggaaacucuguuauugcugggccucaugauucugcuuacaggaggcgccaugcuguuccucaucuccgggaaaggaauagguaagaccaguaucggcuugauuugugugaucgcaucuagcgggaugcuguggauggcugagauucccuuacaauggaucgccuccgccauaguccuagaauuuuucaugaugguucugcucauuccagagccugagaagcagcgcaccccgcaggacaaucaacuugcauacgugguaaucggcauucugacaauggcugccaucauagcggcuaacgaaaugggcuugcuggagacuacgaaacgagaucucgguaugucaaaggaacccgggguggucucuccaaccagcuaucuggacguggaccuucauccugccagugcauggacacucuacgccguugcuacuaccgugaucacacccaugcugagacacaccauugaaaauuccacugcaaacgucagcuuggccgcgaucgcuaaccaggccguagugcugaugggcuuagauaaaggauggccaauuucuaagauggaccuaggcguuccucugcucgcacuugggugcuacucacaggugaauccccugacguugacagccgcuguccugcuccuggugacccauuaugccaucauaggaccgggccuucaggcaaaagcuacuagggaagcccaaaagcggaccgcggccgguauuaugaagaacccaacagucgaugggaucaucacuauugacuuagauccugugaucuacgacuccaaauuugagaagcagcugggacagguuaugcucuuggugcugugugcaguacagcuacugcucaugcgcaccaguugggcucuuugcgaggcccugacauuggcaacgggccccauaaccacucugugggaagguagcccaggcaaauucuggaauacaaccauugcugugucgauggccaacaucuuuagagggucuuaucucgccggagcgggccuggcuuucuccauuaugaaaagcgucgggacuggaaaaaggggcacagguucacaaggggagaccuuaggagaaaaguggaagaagaaacuuaaucagcugagucggaaagaguuugaucucuacaagaaaucuggcaucacggaaguugaccgaaccgaggcaaaagagggucuaaaaagaggcgaaacaacucaccaugccgugucccgcgggagcgcuaagcugcagugguucgucgagaggaacauggugauacccgaaggacggguaaucgauuugggcugugggcguggaggcuggucauauuacugcgccggucugaagaaagugaccgagguuagaggguauacaaagggaggcccuggccacgaggaaccggugcccaugaguacuuacggguggaauauugucaaacucaugagcggaaaggacguguuuuaccuuccaccugagaaaugugauacccuguugugcgacaucggugaauccucucccagcccuacagucgaggaauccaggaccauucgcgugcugaagaugguugagccauggcucaagaacaaucaguucuguaucaaaguauuaaaccccuauaugccugcagugauugagcaccuggaacggcuucaacgaaagcauggcgggaugcuggucagaaauccacuaucaaggaacucuacucacgagauguacuggaucaguaauggaacgggcaacauagugucgagcguuaauauggugucccgccuccuguugaaccgguucacaaugacccauagacgucccacuauugaaaaagaugucgaccugggugccgggaccaggcacgugaacgcugagccggaaacaccuaauauggacguaaucggagagcggaucaagcgcauuaaagaggaacacaacucuacguggcauuaugaugacgagaauccauacaagaccugggcguaucacggcucauacgaagugaaggccacuggcagcgcauccaguaugauaaacgggguugucaaacuccuuacaaagcccugggauguggugccuauggucacccagauggcuaugacugacacaaccccauuuggacagcaacgaguuuucaaagagaagguggauacaagaacucccaggccgaugccugguacccggaaaguaauggaaaucacggccgaguggcuguggcgcaccuuaggcagaaauaagaggccccgacugugcacacgggaggaauuuacuaagaaagugcguaccaacgcagccaugggggcugucuucacagaggaaaaucagugggacucugccaaggcggcaguggaggaugaagaguuuuggaaauugguugacagagagcgcgaacuccauaagcugggaaaauguggcagcugcguguauaacaugauggguaagagggagaaaaagcuaggggaguucggaaaggccaaaggcucacgggcuauuugguacauguggcuuggcgccagauaccuggaguuugaggcacucggguuccugaaugaagaucacugguuuucccgcgagaacaguuauagcggagucgaaggugagggcuugcauaagcugggguacauccucagggacauuucuaaaaucccaggaggcgcuauguaugccgaugacacugcugguugggacacccgaauaacggaagaugaccuucacaaugaggagaagaucacacagcagauggauccugaacaccggcuguuagccaacgcaauuuucaaacugaccuaccaaaauaaggugguaaagguucagagacccacuccaacagggaccgugauggacaucauuuccaggaaagaucagcgcggaucaggccaggucggcacuuauggguugaacaccuuuacaaauauggaggcgcaacucgugcgucagauggaaggagagggugugcugagcaagacggaccuagaaaacccccaucuuccugagaaaaagaucacccaguggcuggagacuaaaggcgucgaacggcucaagagaauggccauaucgggggaugacugcguugugaagccaauugaugacagguucgcuaacgcccuguuggcauuaaaugauaugggaaaaguacgcaaggacaucccgcaguggcaacccucuaaaggcuggcacgauuggcaacaggugccuuuuuguagucaucacuuccacgagcugaucaugaaggacggucgaaaacucgucgugccaugccggccccaggacgaacuuauugggagagcuaggauaucccaaggagccggcuggagccugcgcgagacagcaugucuaggcaaggccuacgcgcagauguggucacugauguauuuccauagacgggaucucagguuggcuuccaacgccaucugcucugcaauuccuguucacugggugccaaccagccguacuacauggaguauccaugcccaccaucaguggaugaccacggaagacaugcugacagucuggaaucgaguguggauugaggauaaccccuggauggaggacaagaccccuaucacuaccugggaaaauguaccguaccuugggaaacgcgaggaucaaugguguggaucccugauaggucucacaagcagagcuacuugggcccagaacaucccaaccgcaauucagcagguucggucuuuaaucggcaaugaagaguuucuggacuacaugcccucaaugaagagguuccgcaaagaggaagagagugaaggggcuauuugguga

SEQ ID NO: 15126 - RNA, 9873 nt, Artificial Sequence
  derived and/or modified CDS sequence (opt3) from DENV-3__KX380839__SS-prME
accagccugugccucaugaugaugcuucccgccacacuggcuuuccacuugacuuccagagacggcgagccuaggaugaucguggggaagaacgaacggggaaaaucuuuacuguuuaagacggcaucagguauuaauauguguacccuaauagccauggaucucggcgagaugugcgacgauacaaucacuuacaaauguccacugauuaccgaagucgagccggaagacaucgauugcugguguaaccuuacaaguaccuggguuacuuaugggacaugcaaucaggcgggagagcaucgccgagacaagcguagcguggcucuggccccccacguaggcauggguuuggauaccagagcacaaacguggauguccgccgagggggcuuggaggcagguggaaaaagucgagacuugggcauuccggcauccuggauuuaccauucucgcccuguuccuggcucacuacaucggcacaucucucacucagaaggugguuauauuuaucuuacugaugcuugugaccccaucgaugacaaugcgcugugucggcguggggaacagagacuucguagaaggauugucaggugccaccuggguugaugugguccuggagcauggcgggugcgugacgacuauggcgaagaauaaacccacacuagacauugagcuccagaagaccgaagcaacucaacuggccacacuuaggaaacuguguaucgagggaaagauuaccaacgugacgaccgauagccggugcccuacacagggcgaagcuacuuugccagaggaacaggaccagaauuaugucuguaaacacaccuacguugaucgcgguugggggaacggaugcggccucuuuggcaaggggagucuggugacaugcgccaaguuccaauguuuagagcugacugagggaaaaguagugcagcacgaaaaucucaaguauaccgucaucauaacagugcauaccggugaccagcaccagguuggcaacgagacucaaggggugacggcagaaauuacaccccaggcuuccaccgucgaggccaucuuucgaucuuacggaacucuuggccuggaaugcagcccuagaaccgguuuggacuucaaugagaugauucuacugacaaugaaaaacaaggcguggauggugcauaggcagugguuuuucgaucucccacugccguggaccuccggggccacuacagagacgcccaccuggaauaaaaaggaacuucugguaacuuuuaaaaacgcacacgcuaagaagcaagagguuguggucuugggcucacaggaaggagccaugcacacagcucucaccggcgccacagagauccagacuagugggggaaccagcaucuucgcaggucaucugaaaugucgguuaaagauggacaaacuggaacuaaagggcaugucuuaugccaugugcuccaaugcuuucgugcucaaaaaggaggucucagagacgcagcacgggaccauucugauaaagguggaauacaaaggagaggaugcgccuuguaagaucccauuuagcacagaagacggccaagguaaagcacauaacgggcgucuuauuacugccaaccccguugugaccaagaaagaggagccuguaaauaucgaagcugagccacccuucggcgaaaguaacauaauuaucggaaucggcgauaaggccuugaagauuaauugguacaaaaaggggucuuccaucggaaaaauguuugaggcaacagcccgcggugcuagaaggauggccauucugggcgacacugcaugggauuucgggagcgucggaggcgugcucaacucgcuggguaagaugguucaccagauauuugggucugcguauaccgcucuuuucuccggcgugucauggaucaugaaaauuggaaucggcguccuguugacguggaucgggcucaauaguaagaacacaagcauguccuuuucuugcauugugauaggaaucauuacccuguacuuaggcgccguagugcaggcagacauggguuguguuaucaauuggaaggggaaagaacugaagugcggaagcggcauuuucgucacuaacgaggugcauacauggaccgagcaguauaaauuucaagccgauucaccgaagcggcuagcuacugccaucgcaggugcuugggaaaauggcgugugugggauacgaaguaccacacgcauggagaaccuccuguggaaacagaucgccaaugaacuuaacuacauuuugugggagaauaacaucaagcugacggucguugugggagacauuaucggcauacucgaacaggggaaaagaacccugacuccucagcccauggaguuaaaguauuccuggaagacauggggaaaagcgaagauugugaccgccgagacacaaaauagcucuuucaucauugauggcccaaacacuccugaaugccccaacgcuucaagggcauggaauguaugggaggucgaagacuacgguuuugggguguucaccacgaacaucuggcugaaacuucgggagauguauacacaguugugugaccaccgccucaugagugccgcuguuaaggaugaaagagccgugcacgcagacaugggauacuggauagagagccagaaaaauggcuccuggaagcuggagaaggcgucucuaaucgaagucaaaaccugcacuuggccaaagucgcauacccuguggagcaacggugugcucgaguccgauaugauuauccccaaaucacuggccggcccuauuagucagcacaauuacaggccaggguaucauacacaaacugcuggaccguggcaccuuggcaaguuggaacuggacuuuaacuacugcgaggggaccacaguugugaucacggagaauuguggaacccguggccccucuuuacggacuacaaccguaagcgguaaacucauacacgaauggugcugucgauccugcacucugccuccacuuagauauaugggggaggauggauguugguacggcauggaaauuaggcccaucaacgagaaggaagagaauauggucaagucacuggugagcgccgguucuggcaaaguggacaacuucacaaugggggucuugugccucgcaauccuguucgaggaaguuaugcgcggaaaguuuggcaaaaagcauaugauugcuggggugcuauucaccuuuguacugcuccuguccggacagaucacguggcgggauauggccagaacucuuauuaugauaggcaguaaugcaagcgacaggauggguaugggggugaccuauuuggcccugaucgcuacauucaaaauucagccuuuuuuagcgcucggauucuuucugcgcaagcuuaccucucgagagaaccugcuacucggcgucggccuggccauggcaacuacauugcaacugccagaagauaucgagcagauggcuaaugggauugccuuaggacucauggcccugaagcuuaucacccaguucgaaacauaccagcugugggcugcauuggugucccucauguguucaaacacuauauuuacccugacgguugccuggcggacagcgacccuaauccuggcugguauuagucuucuccccaugugccaaagcucguccaugcguaaaacugacuggcugccgaugaccguggccgcaaugggcgucccuccauugccccuguucaucuuuucuuuaaaggauacacucaaaagaaggagcuggccucugaaugagggggugauggccguuggacuugugucaauucuggcuaguuccuugcuccgcaacgacguccccauggcaggcccacugguagccggugggcuacugaucgcguguuaugugauaacuggaaccucugcugaucuuacgguugagaaggccgcagacgugacaugggaagaggaagccgagcagaccggcgucagccacaaccucaugauuacuguggacgaugacggcacaaugcggaucaaagaugacgaaaccgagaauauccugacuguauuguuaaagacagcucugcucauuguguccgggauauucccuuacucaauccccgccacccugcuugucuggcauacguggcagaaacagacucaaagaagcggaguucugugggaugugccaaguccgccugagacccagaaggcagaauuggaggaagguguguacaggauuaagcagcagggcaucuuugggaaaacacaagucggagugggcguucagaaggaggguguauuccacaccauguggcaugugacacgaggggcuguccuaacucacaacggaaaacgccuggagcccaauugggccucugugaagaaagaccucauuuccuauggcggcggguggcggcugagcgcgcaguggcaaaagggagaagagguucaggugaucgccgucgaaccagguaagaaccccaaaaauuuccagaccaugccuggcauauuucagacgacaacuggggagaucggagcaauugcucuugauuucaagccaggcaccucggguucacccaucauuaacagagaagggaaagugguaggauuauacggcaauggcgucgugacaaagaacgggggauauguuucugguaucgcccaaaccaaugcugagccugacggcccgacuccagagcuggaagaggaaauguuuaaaaagaggaaccucaccauaauggauuugcaccccgggaguggaaagacacguaaauaccugccugcaauugugcgcgaggccaucaagcggagacucaggacgcugauccuugccccaacucgagucguggcugcggaaauggaggaggcacugaaaggcuugcccauucgguaucagaccacagccaccaaguccgaacauacugguaaagagaucguugaccuaaugugccacgcuacauucaccaugcgccugcucagcccugugagagucccgaauuacaacuuaauaauuauggaugaagcccauuuuacggaccccgcaucuaucgccgcuaggggguauauuagcacucgggugggaaugggcgaggcggccgcaaucuucaugacagcuaccccaccuggcaccgccgaagcauuuccccaguccaaugccccaauacaggaugaggagcgagacauuccugaaagaucauggaacagugggaaugacuggaucacugauuucgcuggaaagacaguaugguuugugcccagcaucaaggccgguaacgacauugcgaacugucugcgcaaaaauggcaagaaaguuauccaacuuucuaggaagaccuucgauacagaguaccagaaaacuaagcugaacgacugggauuuugucgugacgaccgacauuuccgaaaugggggcaaauuucaaggccgaucgugugauagacccacggagaugccucaaaccggucaucuugacagauggaccugagaggguaauucuggcuggccccaugccagugacuguugccucagcugcacagcgccgagguagaguggggcggaacccccagaaggagaaugaccaauacaucuucaccggccagccucucaacaaugaugaagaccacgcccauuggacagaggcuaaaaugcugcuugacaacaucaauaccccagaaggaauuauacccgcccuauuugagccugaaagggagaagagugcagcgaucgauggcgaguaucgccugaaaggggaaagccguaagacuuucgucgaguugaugagacggggagacuuaccgguguggcuggcccacaaaguugcuuccgaagguauuaaguacacggauaggaaguggugcuuugacggcgagcgcaacaaucagauccucgaagagaacauggauguggagauuuggaccaaagaaggggagaagaaaaagcugcgaccaagauggcuugacgcccggacauauucugauccccuggcacucaaagaauucaaggacuuugcugccggaaggaagucgaucgcauuggaucuggucacugagauaggccgcgugccuccccaccuagcccauagaaccaggaaugcucuggacaaccucguaaugcuucacacaagcgaauacggugggcgggcguaucgucaugccguggaggagcugccagaaaccauggagacuuuauugcugcucggccugaugauccuucugacaggaggcguuaugcucuucuugauuucagggaaaggagucgguaagacguccaucggccugauuugugugguggcaaguucugggauguuauggauggcugauaucccucuacaguggauagccagcgccauuguccuggaauuuuucaugaugguucuccuuauccccgagccagagaaacaacgcaccccucaggacaaucagcuggcauacgugguaauuggaaucuugacucuggcugccauaguggcggcuaacgaaaugggccuccuggagacaaccaagcgagaucuugguauguccaaagaaccgggggucgugucacccaccucuuaucucgacguugaccugcacccagccagcgcauggacauuguacgccguggcuacuacggucaucaccccuaugcugagacacacaauugagaauaguacugcaaacguauccuuagccgcgaucgcuaaccaagccgugguucuaaugggccuggauaagggauggcccauuagcaagauggaccucggcgugccacuucuggcauuggggugcuacucucaggucaauccucugacccucacagccgcugugcugcuuuuagucacccauuaugccaucauaggacccggccugcaggcaaaagcuacuagggaagcccagaagcggacggcggccgguauuaugaaaaacccgacaguggaugggaucaugaccaucgaccucgauccaguuauuuacgacucaaaguuugagaaacaauugggacaggugaugcugcuaguacugugugcagugcagcuccuucugaugcgcacuuccugggcuuucugcgaggccuugacccuggcaacaggcccuaucacuacccucugggaagguagucccggcaaguuuuggaauacaacgauagcugucagcauggccaacauuuucagagggucguaucuggccggagcgggcuuagcuuuuucuaucaugaaguccguugggaccggaaaaaggggcacugguagccagggggagacacuuggagaaaaguggaaaaagaaacugaaucaacucucacggaaggaguucgaucuauacaaaaagaguggcauuaccgaaguggaccgaacugaggcaaaggagggucugaaaagaggcgaaaucacacaccaugccgucucucgcggguccgcuaaguugcagugguucguggagaggaacaugguaauaccagaaggacgggugaucgaucugggcugugggcguggaggcuggagcuauuacugcgccggucucaaaaagguuaccgaggugagaggguauacgaaaggaggccccggccacgaagagccugucccgaugucaaccuacggguggaauauugugaagcuuaucaguggaaaggacgucuuuuaccugcccccagagaaaugugauacauugcugugcgacauuggugaaagcuccccuucucccacuguggaggaaagcaggaccauccgcguucucaagaugguagagccuugguuaaaaaacaaucaguucuguauuaaggugcugaacccauauaugcccgcagucaucgagcaucuugaacggcugcagcgaaaacacggcgggaugcuagugagaaauccucucuccaggaacucaacacacgagauguacuggauaucuaauggaacuggcaacauuguuaguucggugaauaugaucagccgccuguugcugaaccgguuuaccaugacauauagacguccaaccaucgaaaaggaugucgaccucggugccgggacuaggcaugugaacgcugagcccgaaacgccgaauauggacguaauuggagagcggauacgccgaaucaaggaggaacacuccucuacauggcauuacgaugacgagaacccuuauaaaaccugggcguaccacggcucauaugaagugaaggccacuggcagcgcauccaguaugauuaaugggguugucaaacuucugaccaagccaugggauguggugcccacagucacgcaaauggcuaugaccgacacuacaccuuucggacagcagagaguuuuuaaagagaagguggauaccaggacuccaaagcccaugccggguacacggaaaguaauggaaaucaccgccgagugguuauggcgcacacugggcagaaacaagaggccucgauugugcacucgggaggaauucaccaaaaaggugcguacgaaugcagccaugggggcugucuuuaccgaggaaaaccaaugggacucugccagagcggcaguggaggaugaagaguucuggaaacucguugaccgcgagagggaacugcacaagcuaggaaaauguggcagcugcguguacaauaugauggguaagcgggagaagaaacuuggggaauuuggaaaggccaaaggcucaagagcuauuugguacauguggcugggcgcccgcuaucucgaguucgaggcacugggguuuuugaacgaagaucauugguucuccagggagaauaguuacagcggagucgaaggugagggccugcacaagcucggguauauccuucgagacauaucuaaaauccccggaggcgcuauguacgccgaugacacagcugguugggacacucggauuaccgaagaugaccugcauaacgaggagaagaucacacagcagauggauccagaacacagacaguuagccaaugcaauuuuuaagcugacuuaucaaaacaaagugguaaagguucagaggccuacccccaaagggacggugauggacaucauaucccgcaaggaucagcguggaucaggccaggucggcacauacggguugaauaccuucacuaacauggaggcgcaacucauucggcagauggaaggagagggugugcugagcaaaacagaccuagaaaauccacaucuucuggagaagaagaucacccaguggcucgagacuaaaggcguggaaagacugaagaggauggccaucucgggggaugacugcgucguuaaacccauugaugaccgcuucgcuaacgccuuguuagcacugaacgauaugggaaaggugcgaaaagacauaccucaguggcaaccaucuaagggcuggcacgauuggcagcagguaccguuuuguagucaccauuuccacgagcucaucaugaaggacggucggaaacuugugguccccugcagaccucaggacgaacugauugggagggcucgcaucucccaaggagccggcuggagccuaaaggagaccgcaugucugggcaaagccuaugcgcagaugugggcucucauguacuuucauagacgggauuugaggcuggccucaaaugcaauuugcuccgccgugccaguucacugggugcccacaucucguacgaccuggagcauccacgcucaucaccaguggaugacuacagaagacaugcuuaccgucuggaaccgaguguggauagaggauaauccuuggauggaggacaagacuccaguaacaaccugggaagauguucccuaccuggggaaacgcgaggaccaaugguguggaagucucaucgguuuaacguccagagccacaugggcacagaacauucugaccgcuauccagcaggugcggagcuugauuggcaaugaagaguuccuggauuauaugccuucuaugaagagguuucgcaaggaggaagagucagaaggggccaucugguga

SEQ ID NO: 15127 - RNA, 9873 nt, Artificial Sequence
  derived and/or modified CDS sequence (opt3) from DENV-3__KX380840__SS-prME
accagccugugccucaugaugaugcuucccgccacucuggcuuuccacuugacuuccagggacggagagccuaggaugaucguggggaagaacgaacggggaaagucuuuacuguuuaagacggcaucagguauuaauauguguacccuaauagccauggaucucggcgagaugugcgacgauacaaucacuuacaaguguccacugauuaccgaagucgagccggaagacaucgauugcugguguaaccuuacaaguaccuggguuacuuaugggacaugcaaucaggcgggagagcaucgccgagacaagcguagcguggcucuggcaccacacguaggcauggguuuggauaccagagcacagacguggauguccgccgagggggcuuggagacagguggaaaaggucgagacuugggcauuccggcauccuggauuuaccauucucgcccuguuccuggcucacuacaucggcacaucucucacucagaaggugguuauauuuaucuuacugaugcuugugaccccaucgaugacaaugcgcugugucggcguggggaacagagacuucguagaaggauugucaggugccaccuggguugaugugguccuggagcauggcgggugcgugacgacuauggcgaagaauaaacccacacuagacauugagcuccagaagaccgaagcaacucaacuggccacacuuaggaaacuguguaucgagggaaagauuaccaacgugacgaccgauagccggugcccuacacagggcgaagcuacuuugccagaggaacaggaccagaauuaugucuguaaacacaccuacguugaucgcgguugggggaacggaugcggccucuuuggcaaggggagucuggugacaugcgccaaguuccaauguuuagagcugacugagggaaaaguagugcagcacgaaaaucucaaguauaccgucaucauaacagugcauaccggugaccagcaccagguuggcaacgagacucaaggggugacggcagaaauuacaccccaggcuuccaccgucgaggccaucuuucgaucuuacggaacucuuggccuggaaugcagcccuagaaccgguuuggacuucaaugagaugauucuacugacaaugaaaaacaaggcguggauggugcauaggcagugguuuuucgaucucccacugccguggaccuccggggccacuacagagacgcccaccuggaauaaaaaggaacuucugguaacuuuuaaaaacgcacacgcuaagaagcaagagguuguggucuugggcucacaggaaggagccaugcacacagcucucaccggcgccacagagauccagacaagugggggaaccagcaucuucgcaggucaucugaaaugucgguuaaagauggacaaacuggaacuaaagggcaugucuuaugccaugugcuccaaugcuuucgugcucaaaaaggaggucucagagacgcagcacgggaccauucugauaaagguggaauacaaaggagaggaugcgccuuguaagaucccauuuagcacagaagacggccaagguaaagcacauaacgggcgucuuauuacugccaaccccguugugaccaagaaagaggagccuguaaauaucgaagcugagccacccuucggcgaaaguaacauaauuaucggaaucggcgauaaggccuugaagauuaauugguacaaaaaggggucuuccaucggaaaaauguuugaggcaacagcccgcggugcuagaaggauggccauucugggcgacacugcaugggauuucgggagcgucggaggcgugcucaacucgcuggguaagaugguucaccagauauuugggucugcguauaccgcucuuuucuccggcgugucauggaucaugaaaauuggaaucggcguccuguugacguggaucgggcucaauaguaagaacacaagcauguccuuuucuugcauugugauaggaaucauuacccuguacuuaggcgccguagugcaggcagacauggguuguguuaucaauuggaaggggaaagaacugaagugcggaagcggcauuuucgucacuaacgaggugcauacauggaccgagcaguauaaauuucaagccgauucaccgaagcggcuagcuacugccaucgccggugcuugggaaaauggcgugugugggauacgaaguaccacacgcauggagaaccuccuguggaaacagaucgccaaugaacuuaacuacauuuugugggagaauaacaucaagcugacggucguugugggagacauuaucggcauacucgaacaggggaaaagaacccugacuccucagcccauggaguuaaaguauuccuggaagacauggggaaaagcgaagauugugaccgccgagacacaaaauagcucuuucaucauugauggcccaaacacuccugaaugccccaacgcucugagggcauggaauguaugggaggucgaagacuacgguuuugggguguucaccacgaacaucuggcuuaaauugcgggagauguauacacagcucugugaccaccgccugaugucagccgcuguuaaggaugaaagagccgugcacgcagacaugggauacuggauagagagucagaaaaauggcagcuggaagcuagagaaggcgucccugaucgaagucaaaaccugcacuuggccaaagucucauacccucuggucgaacggugugcuggagagcgauaugauuauccccaaaucccuugccggcccuauuucacagcacaauuacaggccaggguaucauacacaaacugcuggaccguggcacuugggcaagcuggaauuagacuuuaacuacugcgaggggaccacaguugugaucacggagaauuguggaacccguggccccagucuccggacuacaaccguaucugguaaacugauacacgaauggugcugucgaagcugcacucuuccuccacugagauauaugggggaggauggauguugguacggcauggaaauuaggcccaucaacgagaaggaagagaauauggucaaguccuuggugucagccgguagcggcaaaguggacaacuucacaauggggguccucugccuggcaauccuauucgaggaaguuaugcgcggaaaguuuggcaaaaagcauaugauugcuggggugcuguucaccuuuguacuccugcuuucuggacagaucacguggcgggauauggccagaacuuugauuaugauaggcuccaaugcaagugacaggauggguaugggggugaccuaucuggccuuaaucgcuacauucaaaauucagccuuuucucgcgcugggauucuuucuucgcaagcugaccagccgagagaaccuacuccugggcgucggcuuggccauggcaacuacacugcaauuaccagaagauaucgagcagauggcuaaugggauugcccucggacugauggcccuuaagcugaucacccaguucgaaacauaccaguugugggcugcacucgugucucugauguguuccaacacuauauuuacccuaacgguugccuggcggacagcgacccugauccuugcugguauuucacuccugcccaugugccaaaguagcucgaugcguaaaacugacugguugccgaugaccguggccgcaaugggcgucccuccacugcccuuauucaucuuuucccucaaggauacacugaaaagaaggucuuggccucuuaaugagggggugauggccguuggacuggugagcauuuuggcuucaagucuccugcgcaacgacguccccauggcaggcccccuaguagccggugggcugcuuaucgcguguuaugugauaacuggaaccuccgcugaucucacgguugagaaggccgcagacgugacaugggaagaggaagccgagcagaccggcgucucucacaaccugaugauuacuguggacgaugacggcacaaugcggaucaaagaugacgaaaccgagaauaucuugacuguauuacugaagacagcucuccugauugugagcgggauauucccuuacuccauccccgccacccuucuggucuggcauacguggcagaaacagacucaaagaucaggaguuuugugggaugugccaagcccgccugagacccagaaggcagaacuagaggaagguguguacaggauuaagcagcagggcaucuuugggaaaacacaagucggagugggcguucagaaggaggguguauuccacaccauguggcaugugacacgaggggcuguccugacucacaacggaaaacgccucgagcccaauugggccagugugaagaaagaccugauuucuuauggcggcggguggcggcuuuccgcgcaguggcaaaagggagaagagguucaggugaucgccgucgaaccagguaagaaccccaaaaauuuccagaccaugccuggcauauuucagacgacaacuggggagaucggagcaauugcuuuagauuucaagccaggcaccagcgguucgcccaucauuaacagagaagggaaagugguaggacuguacggcaauggcgucgugacaaagaacgggggauauguuucagguaucgcccaaaccaaugcugagccugacggcccgacuccagagcucgaagaggaaauguuuaaaaagaggaacuugaccauaauggaucugcaccccgggucuggaaagacacguaaauaccucccugcaauugugcgcgaggccaucaagcggagacugaggacgcuuauccuggccccaacucgagucguggcugcggaaauggaggaggcauugaaaggccuacccauucgguaucagaccacagccaccaagagugaacauacugguaaagagaucguugaccugaugugccacgcuacauucaccaugcgccucuuauccccugugagagucccgaauuacaaccugauaauuauggaugaagcccauuuuacggaccccgcaagcaucgccgcuaggggguauauuucuacucgggugggaaugggcgaggcggccgcaaucuucaugacagcuaccccaccuggcaccgccgaagcauuuccccagagcaaugccccaauacaggaugaggagcgagacauuccugaaagauccuggaacucagggaaugacuggaucacugauuucgcuggaaagacaguaugguuugugcccaguaucaaggccgguaacgacauugcgaacugucuucgcaaaaauggcaagaaaguuauccaacugagcaggaagaccuucgauacagaguaccagaaaacuaagcucaacgacugggauuuugucgugacgaccgacauuucugaaaugggggcaaauuucaaggccgaucgugugauagacccacggagaugcuugaaaccggucauccugacagauggaccugagaggguaauucucgcuggccccaugccagugacuguugccuccgcugcacagcgccgagguagaguggggcggaacccccagaaggagaaugaccaauacaucuucaccggccagccucugaacaaugaugaagaccacgcccauuggacagaggcuaaaaugcuucuagacaacaucaauaccccagaaggaauuauacccgcccuguuugagccugaaagggagaagucagcagcgaucgauggcgaguaucgcuugaaaggggaaagucguaagacuuucgucgaguuaaugagacggggagaccugccgguguggcucgcccacaaaguugcuagcgaagguauuaaguacacggauaggaaguggugcuuugacggcgagcgcaacaaucagauccuggaagagaacauggauguggagauuuggaccaaagaaggggagaagaagaaacuucgaccaagauggcuggacgcccggacauauuccgauccccucgcauugaaagaguucaaagacuuugcugccggaaggaagucuaucgcacuggaucuagucacugagauaggccgcgugccuccccaccuggcccauagaaccaggaaugcucucgacaaccuuguaaugcugcacacaucggaauacggugggcgggcguaucgucaugccguggaggaguuaccagaaaccauggagacuuugcugcuccugggccuuaugauccugcucacaggaggcguuauguuguuccugauuagcgggaaaggagucgguaagacgucaaucggcuuaauuugugugguggcauccagugggaugcuauggauggcugauaucccucugcaguggauagccucugccauuguccucgaauuuuucaugaugguucuucugauccccgagccagagaaacaacgcaccccucaggacaaucaguuggcauacgugguaauuggaauccugacucucgcugccauaguggcggcuaacgaaaugggccugcuugagacaaccaagcgagaucucgguaugagcaaagaaccgggggucgugucccccaccucauaucuggacguugacuugcacccagccucugcauggacacuguacgccguggcuacuacggucaucaccccuauguuaagacacacaauugagaauagcacugcaaacguaagucuagccgcgaucgcuaaccaagccgugguucugaugggccucgauaagggauggcccauuuccaagauggaccuuggcgugccacuguuggcacuggggugcuacagccaggucaauccucucacccugacagccgcugugcuuuuacuggucacccauuaugccaucauaggacccggccuccaggcaaaagcuacuagggaagcccagaagcggacggcggccgguauuaugaaaaacccgacaguggaugggaucaugaccaucgacuuggauccaguuauuuacgacucuaaguuugagaaacaacugggacaggugaugcuacugguacucugugcagugcagcuucuguugaugcgcacuucaugggcuuucugcgaggcccugacccucgcaacaggcccuaucacuacccugugggaagguucccccggcaaguuuuggaauacaacgauagcugucaguauggccaacauuuucagagggagcuauuuagccggagcgggccuugcuuuuucgaucaugaagucuguugggaccggaaaaaggggcacugguucccagggggagacacugggagaaaaguggaaaaagaaacucaaucaacuaagccggaaggaguucgaucuguacaaaaagucaggcauuaccgaaguggaccgaacugaggcaaaggaggguuugaaaagaggcgaaaucacacaccaugccgucagucgcgggucugcuaagcugcagugguucguggagaggaacaugguaauaccagaaggacgggugaucgaucucggcugugggcguggaggcugguccuauuacugcgccggucuuaaaaagguuaccgaggugagaggguauacgaaaggaggccccggccacgaagaaccugucccgaugagcaccuacggguggaauauugugaagcugaucucaggaaaggacgucuuuuacuugcccccagagaaaugugauacacugcucugcgacauuggugaaaguagcccuucccccacuguggaggaaucuaggaccauccgcguuuuaaagaugguagagccuuggcugaaaaacaaucaguucuguauuaaggugcuuaacccauauaugcccgcagucaucgagcaucuggaacggcuacagcgaaaacacggcgggaugcucgugagaaauccucugagcaggaacuccacacacgagauguacuggauaucaaauggaacuggcaacauuguuucuagugugaauaugaucucgcgcuugcugcucaaccgguuuaccaugacauauagacguccaaccaucgaaaaggaugucgaccuuggugccgggacuaggcaugugaacgcugagcccgaaacgccgaauauggacguaauuggagagcggauacgccgaaucaaggaggaacacagcuccacauggcauuacgaugacgagaacccuuauaaaaccugggcguaccacggcucuuaugaagugaaggccacuggcucagcaagcuccaugauuaaugggguugucaaacuguuaaccaagccaugggauguggugcccacagucacgcaaauggcuaugaccgacacuacaccuuucggacagcagagaguuuuuaaagagaagguggauaccaggacuccaaagcccaugccggguacacggaaaguaauggaaaucaccgccgaguggcuguggcgcacauugggcagaaacaagaggccucgacucugcacucgggaggaguucaccaaaaaggugcguacgaaugcagccaugggggcugucuuuaccgaggaaaaccaaugggacagugccagagcggcaguggaggaugaagaguucuggaaacugguugaccgcgagagggaacuacacaaacuuggaaaauguggcucuugcguguacaauaugauggguaagcgggagaagaaacugggggaauuuggaaaggccaaaggcagcagagcuauuugguacauguggcucggcgcccgcuaucuggaguucgaggcauugggguuucugaacgaagaucauugguucucaagggaaaauuccuacaguggagucgaaggugagggccuccacaaacuuggguauauccugcgagacauaagcaaaauccccggaggcgcuauguacgccgaugacacagcugguugggacacucggauuaccgaagaugacuuacauaacgaggagaagaucacacagcagauggauccagaacacagacagcuggccaaugcaauuuuuaaguugacuuaucaaaacaaagugguaaagguucagaggccuacccccaaagggacggugauggacaucauaucucgcaaggaucagcguggauccggccaggucggcacauacgggcucaauaccuucacuaacauggaggcgcaacugauucggcagauggaaggagagggugugcuaucaaaaacagaccuugaaaauccacaucugcucgagaagaagaucacccaguggcuggagacuaaaggcguggaaagauugaagaggauggccaucagcggggaugacugcgucguuaaacccauugaugaccgcuucgcuaacgccuuacuggcacucaacgauaugggaaaggugcgaaaagacauaccucaguggcaaccaucgaagggcuggcacgauuggcagcagguaccguuuuguucucaccauuuccacgagcuuaucaugaaggacggucggaaacuggugguccccugcagaccucaggacgaacuaauugggagggcucgcaucagucaaggagccggcuggucccugaaggagaccgcaugucucggcaaagccuaugcgcagaugugggcuuugauguacuuucauagacgggaucugaggcuugccagcaaugcaauuugcucagccgugccaguucacugggugcccacaucccguacgaccuggucuauccacgcucaucaccaguggaugacuacagaagacaugcugaccgucuggaaccgaguguggauagaggauaauccuuggauggaggacaagacuccaguaacaaccugggaagauguucccuaccucgggaaacgcgaggaccaaugguguggcagcuuaaucggucugacgaguagagccacaugggcacagaacauuuugaccgcuauccaacaggugcggucccugauuggcaaugaagaguuccucgauuauaugccuagcaugaagagguuucgcaaggaggaagagucugaaggggccaucugguga

SEQ ID NO: 15128 - RNA, 9873 nt, Artificial Sequence
  derived and/or modified CDS sequence (opt3) from DENV-3__JF808121__SS-prME
accagccugugccucaugaugauccuucccgccgcucuggcauuccacuugacauccagagacggcgagccuaggaugauuguggggaagaacgaacggggaaaaucuuuacuguuuaagacugccucagguacgaauauguguacccuaauagcgauggaucucggcgagaugugcgacgauacagucacuuacaaauguccacauaucaccgaaguugagccggaagacauugauugcugguguaaccugacaaguaccugggugacuuaugggacaugcaaucaggcuggagagcgccgacgugacaagagaagcguagcccuugcaccccacgugggcaugggucuggauaccaggacgcaaacuuggauguccgccgagggggcuuggcggcaggucgaaaaaguggagaccugggcauugcgccauccuggauucacaauccucgcccuguuucuggcucacuacauuggcacuucucucacccagaagguugugaucuucauauuacugaugcuugucacaccaucgaugaccaugagaugugugggcguagggaacagggacuuuguugaaggauugucaggugccacguggguggaugucgugcuggagcauggcgggugcgugacuacaauggcgaagaauaaacccacccuagacaucgagcuccagaagacugaagcaacacaacuggccacccuucggaaacuguguauugagggaaagaucacgaacauuaccacagauagccgcugcccuacucagggcgaagcugucuugccagaggaacaggaccagaauuauguuuguaaacacaccuacguggaucgagguugggggaacggaugcggccucuucggcaaggggagucugguaacaugcgccaaguuucaauguuuagagcugaucgagggaaaagugguccaguaugaaaaucucaaguacacugugauaauuaccguucacacaggugaccagcaucaggugggcaacgagacccaaggggucacugcagaaaucacgccccaggcuuccacaaccgaggccauucuuccugaauauggaacucugggcuuggagugcucuccaagaaccggucuagacuucaaugagaugauccugcucacaaugaaaaacaaggcguggauggugcacaggcagugguuuuucgaucugccgcuucccuggaccagcggggccacuacagaaacgccuaccuggaaucggaaagagcuguugguaacuuuuaagaacgcacaugcuaaaaagcaagaaguugugguccucggcucccaggagggagccaugcacacagcucugaccggcgccacagaaauccagaauucagggggaacuaguauuuucagcggucacuuaaagugucgucugaaaauggacaagcuagagcucaaaggcaugucuuacgcaaugugcaccaacacguuugugcugaagaaagaggucuccgaaacccagcaugggacaauacuuaucaagguggaguacaagggagaagaugccccauguaaaauucccuucucaacugaggacggccaagguaaggcucacaacgggcgcuugaucaccgcgaauccuguugugacaaaaaaggaggaaccaguaaacauagaggcagaacccccguucggcgagagcaauauugucaucggaacuggcgauaacgcccugaaaaucaauugguauaagaaggggaguucuauuggaaaaauguuugaagcuaccgccagaggugcaaggcggauggccauccucggcgacacggcuugggauuucggguccgugggaggcguucugaacagccuugguaagauggugcaucagauuuuugggucggccuacacagcacuguucucuggcgucuccugggugaugaaaauaggaaucggcguauugcucaccuggauugggcugaauucaaagaacacuaguaugagcuuuuccugcaucgcgaucggaauuauaacauuauaucugggcgcugugguucaggccgacauggguugugucaucaauuggaaagggaaggagcuaaagugcggaucuggcauuuucgugaccaacgaggugcacacuuggaccgaacaguacaaauuucaagcagauagcccuaagcgacucgccacagcuaucgccggugcaugggagaauggcgucugugggauucgcucaacgaccagaauggaaaaccugcuuuggaaacagaucgcuaaugaguugaacuauauacugugggaaaauaacaucaagcucacuguuguggugggagacauuaucggcguacuggagcaggggaaaaggacauuaaccccccagccaauggagcugaaguacaguuggaaaacauggggaaaggccaagauugucacugcggaaacccaaaacuccagcuucaucauagauggcccuaauacgcccgagugcccaucugccucacgggcuuggaacgugugggaaguugaggacuaugguuuugggguguucacaaccaauauuuggcuuaaauugcgcgaagucuacacucagcucugugaccauagacugaugagugcagccgugaaggaugagagggcuguucacgccgacaugggauacuggaucgagagccagaaaaacggcuccuggaagcuagaaaaagcaucucugauugaggugaagaccugcacauggcccaagucgcacacucucuggagcaaugguguacuggaauccgauaugaucauaccuaaaucacuugcgggcccaaucagucagcauaaccaccguccgggguaucauacccaaacagccggacccuggcacuugggcaagcuggaguuagacuuuaauuacugcgaggggacgaccgucgugauuacugaaaacuguggaacacggggcccuucucuccgaaccacuacagugagcgguaaacugauccacgaguggugcuguagauccugcacccuuccaccccugagguauaugggggaagauggauguugguacggcauggagauucgcccuaucucagaaaaggaggagaauauggucaaaagcuugguuucugcugguuccggcaagguggacaacuucacgauggggguacucugccuggccauacuauuugaagaggugaugcggggaaaguucggcaaaaagcauaugauugcaggggucuucuuuacuuucgugcugcuccugaguggacagaucaccuggagagauauggcucacacacuuaccaugaucggcagcaaugccucugacaggauggguauggggguuacuuauuuggcacugauugccacauuuaaaauccagccauucuuagcucucggauuuuuccugcgcaagcuuaccucccgagaaaaccugcuacucggcgugggccuggcgauggccacaacuuugcaacugcccgaggauauugaacagauggcaaaugggauagcuuuaggacucauggcccugaaacuuaucacccaguuugagacguaccagcuguggauugccuugaucucacucacauguaguaacaccauguucacucugaccgucgcuuggcggacagcaacucuaauucuggccggugugagccuucucccgguuugccaaucguccucuaugcguaagaccgacuggcugccuauggcgguggcugccaugggcgucccacccuugccucuguuuaucuucagcuuaaaggauacgcucaaaagaaggucauggccccugaaugaggggguaauggcagugggacuuguuaguauacuggccuccucuuugcuccgcaacgacgugccaauggcuggcccucuggucgcaggugggcuacugaucgccuguuaugugauuacaggaaccagcgcggaucuuacuguagaaaaggcugccgacaucacaugggaggaagaggcagaacagaccggcgugucccauaaccucaugauuacugucgacgaugacggcacaaugcggaucaaagaugacgagaccgagaauauacugacgguuuuguuaaagacugcccugcucauugugucagggguguuucccuacagcaucccagcuacccugcuugucuggcacacauggcagaaacagacccaaagaaguggagugcugugggauguuccgucuccucccgaaacacagaaggccgaguuggaagaggguguauacaggaucaaacagcagggcauuuucgggaagacucaagugggagucggcgugcagaaggaggguguuuuucauaccauguggcacgugacgcgaggggcaguccuaacauauaacggaaaacgccuggaaccaaauugggcuuccgugaagaaagaccucauaagcuacggcggcggguggcggcugucggcccaguggcaaaagggagaggaaguacaggucaucgcgguggagcccgguaaaaacccuaagaauuuccagacuaugccaggcaccuuccagacaaccacuggggaaauuggagccaucgcacuugauuuuaagcccggcaccucagguucuccuauuaucaacagagaggggaaaguugugggauuauauggcaauggcgucgugacaaagaacgggggauacguuagugguauagcucaaacgaaugccgagccggacggcccaacucccgaacuggaggaagagauguucaaaaagaggaaccucaccaucauggauuugcacccuggguccggaaaaacacguaaguaucugccagcuauugugcgcgaagcaaucaagcggagacucaggacccugauucuugcccccacucgagucguggccgcugagauggaggaagcgcugaaaggcuugccuauccgguaccagacaaccgcaacgaagagcgagcauacuggucgcgaaauaguagaccuaaugugccacgccacauuuaccaugagacugcucucuccggugaggguucccaauuauaacuuaauuaucauggaugaggcucauuucaccgacccagccagcaucgcagcccggggguacauuuccacucgagucggaaugggcgaagcugcggccaucuuuaugacagcaaccccucccggcacagcugaugccuucccacagucaaaugcaccuauacaggacgaggagagagacauucccgaacgcaguuggaacagcgggaaugaguggaucacugauuuugccggaaaaacggugugguucgugccaucuauuaaggcugguaacgacaucgccaacugucugaggaaaaauggcaagaaggucauacaacuuucccguaaaaccuuugauacagaauaccagaagacuaaacugaacgacugggauuucguagugaccacagacauuucagagaugggggcgaauuuuaaggcagaucggguuaucgacccgagaaggugccucaaaccugugaucuugaccgauggacccgagcgcgucauucuggccggcccaaugcccgugacugcugccagugcugcacagcgaagaggucggguugggaggaacccucagaaggaaaaugaccaauauaucuucacgggccagccacucaacaaugaugaggaccacgcccauuggaccgaagcuaagaugcugcuugacaacauuaauacacccgagggaauaaucccugcccuauucgaaccggagcgcgagaaaagcgcagcgauugauggcgaauaccgucugaagggggaguccagaaaaacuuuuguggaauugaugcggaggggagacuuaccagucuggcuggcccacaagguggcuucugaggguaucaaauauaccgaucgcaaguggugcuucgacggccagcgaaacaaucagauccucgaagagaacauggauguagagauuuggacaaaagaaggggagaagaagaaacugagaccccgguggcuugacgccaggaccuacucggauccucuggcacucaaggaauuuaaagacuucgcugccggacgcaagagcauagcauuggaucuggugacugagaucggcagaguucccucacaccuagcccauaggacacggaaugcucuggacaaccucgucaugcuucacacguccgaacauggugggcgugcguaucgccacgccguggaggagcugccagaaaccauggagacuuuauugcugcucggccugaugauucuucugacaggaggcgcaaugcucuuuuugaucagugggaaaggaauugguaagaccucuaucggccugauaugugugaucgcuagcuccgggauguuauggauggccgaaauuccucuacaauggaucgccucagcaauuguccuggaguucuuuaugaugguucuccuuauccccgagccagaaaagcagcgaaccccucaggauaaucaacuggcuuacgugguaauaggaauuuugacacuggccgcgaucauugcugccaacgagaugggccuccuggaaacuacgaaaagagaccuugguaugucuaaggagccggggguggucagccccaccaguuaucucgauguggaccugcacccagcauccgccuggacauuguacgcuguugcaacuaccgugaucacaccuaugcugaggcauaccauagaaaauagcacugccaacgucucuuuagcggcuaucgccaaccaggcaguagugcuaaugggccuggacaaaggauggcccauuucaaagauggaucucggcguuccacuucuggccuuggggugcuacucccaggugaauccucugacgcucacagcugccguccugcuuuuaaucacccacuaugcaauuaucggacccggccugcaggcuaaagccacucgggaggcgcaaaagcgcaccgccgcagguauaaugaagaacccgacaguggacgggauuaugacuaucgaucucgacccagucaucuacgauaguaaauucgagaagcaguugggacaggugaugcugcuaguucugugugcugugcagcuccuucugaugagaaccagcugggccuugugcgaagcacugacacucgcuacgggcccuauuaccacucugugggaggguucgcccggcaaauuuuggaauacaaccaucgccguaucuauggccaacauauucaggggguccuauuuagcgggagcuggccuugcauuuagcauuaugaagucaguggggacuggaaaacggggcacagguagucaaggggaaacccugggagagaaguggaagaaaaagcucaaucagcuaucucgaaaagaauucgaccuguacaagaaauccggcaucacggaggucgauagaaccgaggccaaggaagguuugaaacgcggcgagauuacacaucacgcuguuagcagggggucagccaagcugcagugguuuguggaacggaacauggucaucccagagggacgugugauagaccucggcugugggagaggaggcuggaguuauuacugcgcaggucuuaagaaaguaacugaagugaggggguauaccaagggaggccccggccaugaggagccuguuccgaugagcacauacggguggaauaucgugaaacugauguccggaaaggaugucuucuacuugcccccagaaaaaugugacacucugcucugcgauauuggugagucuagcccuucccccaccguggaagagucacgcacaauccgggucuuaaagaugguggagccuuggcugaagaacaaucaguucuguauuaaaguucuuaacccauauaugcccaccguaaucgaacaccuggagcgacuacaaagaaagcacggcgggaugcucgugaggaauccucugucucgcaacaguacucaugaaauguacuggauuucgaauggaacgggcaacaucgucgccagcgugaauaugguuucccgguugcugcucaacagauuuacaaugaaacaccguaggccaaccauagagaaggacguggaucuuggugcugggacucggcaugucaacgcggaacccgagaccccgaauauggacgugauuggagagcgcaucaaacgaaucaaggaagagcacaacucuacauggcacuaugacgaugaaaauccuuacaagacgugggccuaucauggcucauacgagguaaaagcaaccggcagcgcuuccaguaugauuaacggggugguuaagcuguuaacuaaaccaugggacgucgugcccauggugacacagauggccaugaccgauacuacaccuuucggacagcaaagagucuuuaaggaaaaaguugacaccaggacaccacggucuaugcccgguacucgcagagugaugggcauaaccgcagaguggcuguggaagacguuggggaggaauaagaaaccgcgacucugcccucgggaggaauucaccaagaaaguacguacaaacgccgcuaugggagccguguuuacugaggaaaaucagugggauagcgcgaaggcagccgucgaggacgaagauuucuggaaacugguggacagagagcgcgagcuacacaagcuuggcaaaugugguucaugcguuuauaacaugauggggaagagggaaaagaaacugggagaguuuggcaaggcuaaaggcucccgggccaucugguacauguggcucggggcaagauaccuggaauucgaggcuuugggauuucugaaugaggaucauugguucagucgcgaaaacagcuauucugguguggagggcgaagggcuccacaagcuuggauacauucugagggacaucuccaaaauucccggcggugccauguaugcugaugacaccgccgggugggacacacgaaucacugaggaugacuuacauaaugaagagaagauaacccagcagauggauccagagcaccggcaacuggcaaacgcgaucuuuaaguugacguaccagaauaaagucgugaagguacagagaccuacacccaccggaacuguuauggacauuaucucaaggaaagaucagcgcggcagcggccaaguggggacauauggacucaacaccuucacuaauauggaagcccagcugauucgucagauggagggugaaggcguccuaucgaaggcugaccuugagaacccacaccugcccgaaaaaaagaucacccaguggcucgagacaaaggggguggagcggcugaaaagaauggccauaucuggagaugacugcguggucaagccuauugaugacagguuugcaaacgcuuuguuagcccugaaugauaugggcaaaguucgcaaggacaucccacaauggcagccgaguaaagguuggcaugauuggcagcaggugcccuucuguucccaccauuuccacgaacucaucaugaaggacgggcgaaagcuuguagugccuugccggccacaagacgagcugauuggaagagcaaggauaagccagggcucaggcuggucccuacgcgaaacggccugucuggggaaagcguacgcucagauguggucucucauguauuuucacagacgggauuugaggcuggccagcaacgcaaucugcagugccguccccgugcauuggguuccuaccucccguaugacuuggagcauucacgcucaucaccaauggaugacaaccgaggacaugcuuacuguguggaaucgagucuggaucgaagauaacccauggauggaggacaagacacccgugaccacgugggagaauguaccuuaccugggaaaacgcgaagaucaguggugugguucucucauuggcuuaacaucaagagccaccugggcacagaacaucccgacugcuauacagcaaguucggagucugaucgggaaugaggaauucuuggacuacaugccauccaugaagagguuucgcaaagaggaggaaagcgagggagccauuugguga

SEQ ID NO: 15129 - RNA, 9873 nt, Artificial Sequence
  derived and/or modified CDS sequence (opt3) from DENV-3__JF808120__SS-prME
accagccugugccucaugaugauccuucccgcagcucuggcauuccacuugacauccagagacggagagccuaggaugauuguggggaagaaugaacggggaaagucuuuacuguuuaagacugccucagguauaaauauguguacgcugaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcgccgacgugacaagagaagcguagcccuugcaccccacgugggcaugggucuggauacaaggacccagacguggauguccgccgagggggcuuggcggcaggucgaaaaaguggagacuugggcauugcgccauccuggauucaccauucucgcccuguuucuggcucacuacaucggcacaucucucacucagaagguugugauauucaucuuacugaugcuugucaccccaucgaugacaaugagaugugugggcguagggaacagggacuuuguugaaggauugucaggugccaccuggguggaugucgugcuggagcauggcgggugcgugacgacuauggcgaagaauaaacccacacuagacauugagcuccagaagaccgaagcaacucaacuggccacacuucggaaacuguguaucgagggaaagauuaccaacaucacgaccgauagccgcugcccuacacagggcgaagcugucuugccagaggaacaggaccagaauuauguuuguaaacacacuuacguggaucgagguugggggaacggaugcggccucuucggcaaggggagucugguaaccugcgccaaguuucaauguuuagagcugauagagggaaaagugguccaguaugaaaaucucaaguacacagugauuaucacuguucacaccggugaccagcaucaggugggcaacgagacacaaggggucaccgcagaaauuacuccccaggcuuccacgacagaggccauccuuccugaauauggaacccugggcuuggagugcucuccaagaacuggucuagacuucaaugagaugauccugcucaccaugaaaaacaaggcguggauggugcacaggcagugguuuuucgaucugccgcuucccuggacaagcggggccaccacugaaacaccuacguggaaucggaaagagcuguugguaaccuuuaagaacgcacaugcuaaaaagcaagaaguugugguccucggcucccaggagggagccaugcacacugcucugacaggcgccaccgaaauucaaaauucagggggaacaaguauauucgcaggucacuuaaagugucgucugaaaauggacaagcuagagcucaaaggcaugagcuacgccaugugcacuaacaccuuugugcugaagaaagaggucucugaaacgcagcaugggaccauccuuauuaagguggaguacaagggagaagaugcuccauguaaaauccccuucuccacagaggacggccaagguaaggcgcacaacgggcgcuugauaacugcaaauccuguugugaccaaaaaggaggaaccaguaaacauugaggccgaacccccguucggcgagucaaauaucgucaucggaacaggcgauaacgcucugaaaauuaauugguauaagaaggggagcaguaucggaaaaauguuugaagccacugcaagaggugccaggcggauggcuauucucggcgacaccgccugggauuucgggucugugggaggcguucugaacucccuugguaagauggugcaucagauauuugggagcgcauacacggcgcuguucucgggcgucucuugggugaugaaaaucggaauuggcguauugcucacauggaucgggcuaaauuccaagaacaccucaaugaguuuuagcugcaucgcuauuggaauaaucacuuuauaucugggcgccgugguucaggcagacauggguugugucauuaauuggaaagggaaggagcuaaagugcggauccggcaucuucgugacaaacgaggugcacaccuggacugaacaguacaaauuucaagccgauucuccuaagcgacucgcuaccgccauugccggugcuugggagaauggcgucugugggauccgcagcacaacgagaauggaaaaccugcuuuggaaacagauagccaaugaguugaacuauauccugugggaaaauaacauuaagcucaccguuguggugggagacaucauuggcguacugaaacaggggaagaggacuuuaacaccccagccaauggagcugaaauacucauggaagaccuggggaaaggcgaaaaucgucacagccgagacucaaaacaguuccuucauaauugauggcccuaauacccccgaaugcccaagcgcuucucgggcauggaacgugugggagguugaagacuaugguuuugggguguucacgacaaauaucuggcuuaaguugcgcgaggucuacacccagcucugugaccauagacugaugucagccgcugugaaagaugaaagggccguucacgcagacaugggauacuggauugagagucagaagaacggcagcuggaaacuagagaaggcgucccugaucgaagugaagacuugcaccuggcccaaaucucacacacucuggucgaaugguguacuggagagcgauaugauaaucccuaagucccuugccggcccaauuucacagcauaaccaccguccgggguaucauacucaaaccgcuggacccuggcacuugggcaaacuggaauuagacuuuaauuacugcgaggggacaacggucgugaucaccgagaacuguggaacucggggcccuagucuccgaacaaccacugugucugguaagcugauucacgaauggugcuguagaagcugcacacuuccaccccugagguauaugggggaggauggauguugguacggcauggaaauccgcccuauauccgagaaagaagagaauauggucaagucauugguuagcgccgguucuggcaagguggacaacuucaccauggggguacucugccuggcaauucuauuugaggaagugaugcggggaaaauucggcaagaaacauaugaucgcuggggucuucuuuacguucgugcugcuccuguccggacagaucacuuggagagauauggcccacacccuuauuaugaucggcaguaaugcaagcgacaggauggguauggggguuacauauuuggcccugauugcuaccuuuaagauacagccauucuuagcgcucggauuuuuccugcgcaaacuuacuucucgagagaaccugcuacucggcgugggccuggccauggcaacaaccuugcaacugcccgaagauaucgagcagauggcuaaugggauugccuuaggacucauggcccugaaacuuaucacacaguuugaaacuuaccagcuguggaccgcuuugauuucccucacguguucaaacacaauguucacccugacugucgcauggcggaccgccacacuaauccuggcgggugugagucuucucccgguuugccaaagcucguccaugcguaagacugacuggcugccuauggcuguggccgcaaugggcgucccacccuugccucuguuuauauucaauuuaaaagauacccucaagagaaggucuuggccccugaacgaggggguaauggccgugggacuuguuagcauccuggcuucaaguuugcuccgcaacgacgugccaauggcaggcccucuggucgccggugggcuacugauugcguguuaugugaucacgggaacauccgcugaucuuaccguagagaaagccgcagacauuacuugggaagaggaagccgagcagacaggcgugucucauaaucucaugaucaccgucgacgaugacggcacuaugcggauaaaggaugacgaaacagagaacauucugaccguuuuguuaaaaacggcucugcucaucgugagcgggguguuucccuacuccaucccagccacucugcuugucuggcacaccuggcagaagcagacacaaagaucaggagugcugugggauguuccgagcccucccgagacccagaaagcagaauuggaggaagguguauacaggauuaagcagcagggcauacuagggaagacacaagugggagucggcgugcagaaagaggguguuuuccauacuauguggcacgugacccgaggggcuguccugacguauaauggaaagcgccucgagccaaacugggccagugugaaaaaggaccugaucucuuacggcggcggguggcggcuuuccgcgcaguggcaaaaaggagaagagguacaggucauugccguggaacccgguaagaauccuaagaacuuucagacaaugccaggcacuuuccagaccacaaccggggagaucggagcaauugcuuuagauuucaaacccggcacuagcgguucgccuaucauaaauagagaagggaagguugugggacuguauggcaacggcgucgugaccaaaaaugggggauacguuucagguaucgcccaaacaaacgcugagccggacggcccaacgcccgagcucgaagaggaaauguuuaagaaaaggaauuugacuauuauggaucugcacccugggucuggaaagacccguaaguaucucccagcaaucgugcgcgaggccauuaaacggagacugaggacacuuauccuggcccccacccgagucguggcugcggaaauggaggaggcauugaagggccuaccuauacgguaccagacuacagccaccaaaagugaacauacgggucgcgagauuaucgaccugaugugccacgcuacuuucacaaugagacucuuauccccgguaagggugcccaacuauaaucugaucauuauggaugaagcccauuuuaccgacccagcaagcaucgccgcucggggguacauaucuacccgaguuggaaugggcgaggcggccgcaauuuucaugacugcuacaccucccggcaccgccgaugcauuuccacagagcaacgccccuauccaggacgaagagagagacauucccgagcgcuccuggaacucagggaacgaauggaucacagauuucgcuggaaagacugucugguuugugccaaguauaaaagccgguaacgacauugcgaauugucuuaggaagaacggcaagaaagugauccaacugagccguaagacguucgauaccgaguaccagaaaacaaagcucaaugacugggauuuugucguaacuaccgacaucucugaaaugggggcaaacuucaaagccgaucgggugauugacccgagaaggugcuugaagccuguuauccugacagauggacccgagcgcgugauucucgcuggcccaaugcccgucaccgccgcuuccgcagcccagcgaagaggucggguggggaggaauccucagaaggagaacgaccaauauauauuuacuggccagccacugaauaacgaugaagaccacgcucauuggacggaggccaaaaugcuucuagacaauaucaacacccccgaaggaauuaucccugcacuguucgagccggaacgcgagaagucagcggccaucgauggcgaguaccguuugaaaggggaaaguagaaagacauucguugaguuaaugcggaggggagaccugccaguguggcucgcucacaaagucgccagcgaagguauuaaguauacugaucgcaaauggugcuuugacggccagcgaaauaaccagauacuggaggaaaauauggauguggagaucuggaccaaggagggggaaaagaagaaacuuagaccccgguggcuggacgcaaggacauacuccgauccucucgcuuugaaagaguucaaagacuuugccgcaggacgcaaaucuauugcccuggaucuaguaaccgaaaucggcagagugcccucgcaccuggcucauaggacucggaacgcgcucgacaaucuuguuaugcugcacacaagcgagcauggugggcgugccuaucgccacgcagucgaagaguuaccagagacgauggaaaccuugcugcuccugggccuuaugauucugcucacuggaggcgcuauguuguuccugaucucagggaagggaauagguaagacauccaucggcuuaauuugugugaucgccaguucugggaugcuauggauggccgagauuccucugcaauggaucgcaagcgcuauagugcucgaauuuuucaugaugguccuucugauucccgagccagagaaacagcgaaccccucaggauaaccaauuggccuacguugugaucggcauucugacccucgcggcuaucauagccgcaaaugaaaugggccugcuugagacaacuaagagagaccucgguauguccaaagaaccggggguagugucacccacgucuuaucuggaugucgacuugcacccagccagcgcuuggacccuguacgcaguggccacaacuguuaucaccccuauguuaaggcauacaauugagaacaguaccgcgaacgugucccuagcugccaucgcaaaucaggccgucguacugaugggccucgacaagggauggcccauuagcaaaauggaucuuggcgugccacuguuggcucuggggugcuacucucagguuaacccucucacucugacggccgcagugcuuuuacugaucacacacuaugcuauaauuggacccggccuccaggccaaggcgacccgggaagcccaaaagcgcacugcagcugguaucaugaaaaauccgaccgucgacgggaucaugacaauugauuuggacccagugaucuacgauucaaaguuugagaaacagcugggacaggucaugcuacuggugcucugugccguucagcuucuguugaugagaacuuccugggcacugugcgaggcucucacccuggccacaggcccuauaacgaccuuaugggaagguagucccggcaaguucuggaacacuacaauugccgugagcauggcgaauaucuuuagggggucguaucuugcuggagcaggccuggccuucucuauuaugaaauccguagggaccggaaagcggggcacugguagccaaggggagacacucggagaaaaguggaaaaagaaacuaaaccagcugucacgaaaggaguuugacuuguacaaaaagaguggcaucaccgaaguggauagaacggaggcuaaagagggucugaagcgcggcgaaauaacccaucacgccgucucuaggggguccgcaaagcuccagugguucguugagcggaauauggugaucccagaaggacgugucauugaccuuggcugugggagaggaggcuggagcuauuacugcgccggucugaaaaaggugacagagguaaggggguauacuaaaggaggccccggccaugaagaaccugugccgaugaccacauacggguggaacaucguuaaguugaugucaggaaaagauguguuuuaccugcccccagagaagugugacacucucuuaugcgauauuggugaaaguagcccuucccccaccgucgaggaaucucgcacaauccgggugcugaagauggucgagccuuggcuuaaaaauaaccaguucuguauuaaggugcugaauccauauaugcccaccguuaucgagcaccuagaacgacuccaaagaaaacacggcgggaugcugguaaggaacccuuugagccgcaauuccacucaugagauguacuggauaucaaacggaacgggcaauauuguggcuucugucaacauggugagucggcugcuccuuaacagauucacaaugacccaccguaggccaacuaucgaaaaggacguugaucugggugcggggacccggcaugugaaugccgagcccgaaacaccgaacauggacgucaucggagagcgcauuaaacgaauaaaggaggaacacaauucgacguggcacuaugacgaugagaacccuuacaagaccugggcauaucauggcagcuacgaagugaaagcuacuggcuccgccucuucaaugaucaaugggguagugaaguuacugacaaaaccaugggacguuguccccauggugacccagauggcaaugacugauacaaccccuuuuggacagcaaagaguguucaaggagaaagucgacacaaggacuccacggagcaugcccgguacccgcagaguuaugggcauuacggccgaaugguuguggaggacccucgggcgaaacaagaagccgcggcugugcacacgugaggaguuuacuaaaaaggugagaaccaaugcugccaugggagcgguauucacagaagagaaccagugggauuccgcaaaagccgcuguggaagacgaggauuuuuggaagcuagucgaccgcgaaagggagcuucacaaacugggcaagugugguaguugcguguauaauaugauggggaaacgggagaagaagcucggagaguucggcaaagccaagggcucuagagcaaucugguacauguggcugggggcucgcuacuuggaguuugaagcccugggauuccucaacgaggaucauugguuuagcagggaaaauucauauuccgguguugaaggcgaggggcuucacaaacugggauacauuuuacgagacaucaguaagauaccuggcggugcuauguaugccgaugacacugcagggugggacacccggaucacggaagaugaccugcauaacgaggagaagauuacacagcagauggaucccgagcacagacaauuggcgaaugccaucuucaagcucaccuaccagaacaagguggucaaagugcagaggccaacuccuacaggaaccguaauggacauuaucagccgcaaggaucagcguggcucuggccaaguugggacuuauggacugaauaccuuuacaaacauggaggcucagcuaauacggcagauggaaggugagggcgugcuuuccaaagccgaccuggaaaacccccaccucccagagaagaaaauuacgcaguggcuggaaaccaagggggucgagagauugaagaggauggcaaucucaggagaugacugcguggugaaacccaucgaugaccgcuucgcuaaugccuuacuggcacucaacgauaugggcaagguccgaaaagacauuccucaauggcagccaagcaaggguuggcaugauuggcagcagguuccguuuuguucgcaccauuuccacgagcuuauaaugaaagacgggcggaagcuggugguacccugcagaccucaagacgaacuaaucggaagggcccgcauuucucagggcaguggcuggucccugagagagacugcgugucucgggaaggcuuacgcccagauguggagcuugauguauuuccaccggagggaucugcgucuugcaucaaaugccaucugcuccgcugugccaguccauugggugcccacaucucgaaccacuuggagcauucacgcccaucaccaauggaugacaaccgaagacaugcugacgguuuggaaccgcguguggaucgaggauaauccuuggauggaagacaaaacaccagucaccacuugggagaacgugcccuaccucggaaagagagaggaucaguggugugguaguuuaauaggccugaccucccgggcaacaugggcucagaauaucccuacugccauucagcaaguaaggagcuugaucgggaacgaagaguuucuggacuacaugccgucuaugaaacgcuucagaaaggaagaggagucagaaggagcgauuugguga

SEQ ID NO: 15130 - RNA, 9873 nt, Artificial Sequence
  derived and/or modified CDS sequence (opt3) from DENV-3__JF808119__SS-prME
accagccugugccucaugaugauccuucccacugcccuggcuuuccacuugacuuccagagacggcgagccuaggaugauuguggggaagaacgaacggggaaaaucuuuacuguuuaagacggcaucagguauaaauauguguacccuaaucgccauggaucucggcgagaugugcgacgauacagucacuuacaaauguccacauauuaccgaaguugagccggaagacaucgauugcugguguaaccugacaaguaccugggugacuuaugggacaugcaaucaggcgggagagcaccgccgagacaagcguagcguagcucuugcaccccaugugggcaugggucuggauaccagaacgcagacuuggauguccgcagagggggccuggaggcaggucgaaaaaguggagaccugggcuuugcggcacccuggauucacaauucucgcacuguuucuggcccauuacaucggcacuucucucacccagaagguugugauauucaucuuacugaugcuugucacaccaucgaugaccaugcgcugugugggcguagggaacagagacuuuguugaaggauugucaggugcuacguggguggaugucgugcuggagcacggcgggugcgugacuacaauggccaagaauaaacccacccuagacauugagcuccagaagacugaagcgacacaacuggcaacccuuaggaaacuguguaucgagggaaagauuacgaacaucaccacagauagccggugcccuacucagggcgaagccgucuugccagaggaacaggaccagaauuauguuuguaaacacaccuacguggaucgcgguugggggaacggaugcggccucuucggcaaggggagucugguaacaugcgcuaaguuucaauguuuagagcccauagagggaaaagugguccaguaugaaaaucugaaguacacugugauuaucaccguucauacaggugaccagcaccaggugggcaacgagacccaaggggucacugccgaaauuacgccucaggcauccacaaccgaggcuauccucccagaauauggaacucuuggccuggagugcucuccgcgaaccgguuuggacuucaaugagaugauccuacugacaaugaaaaacaaggccuggauggugcauagacagugguuuuucgaucucccccugccuuggaccagcggggcgacuacagaaacgccaaccuggaauaggaaagagcuucugguaacuuuuaagaacgcccacgccaagaagcaagaaguuguggucuugggcucccaggagggagcuaugcacacagcccucaccggcgcuacagaaauucaaaauucagggggaacaaguauauucgccggucaucugaagugucgguuaaaaauggacaagcuggagcuaaaaggcaugagcuacgcaaugugcaccaacacguuugugcucaagaaagaggucucugaaacccagcacgggacaauccugauuaagguggaguacaagggagaagaugcccccuguaaaaucccuuucuccacugaggacggccaagguaaggcucauaacgggcgucuuauaaccgcgaauccaguugugacuaagaaggaugagcccguaaacauugaagcagagccgccuuucggcgaaucaaauaucgucaucggaauuggcgacaacgccuugaaaaucaauugguauaagaaggggagcaguauuggaaaaauguuugaggcuacugcccgcggugcaagaaggauggccauacugggcgauaccgcuugggacuucgggucugugggaggcguucucaacucccuggguaagauggugcaccagaucuuugggagcgccuacacggcacuuuucucgggcgucucuugggugaugaaaauuggaaucggcguacuguugacauggaucgggcucaauuccaagaacaccucaaugaguuuuagcugcauugcgauaggaaucauuacucuguauuuaggcgcugugguucaggccgauauggguugugucaucaauuggaaagggaaggaacugaagugcggauccggcauuuucgugacaaacgaggugcauaccuggacugagcaguacaaauuucaagcagacucucccaagcggcuagccaccgcuaucgccggugcaugggaaaauggcgucugugggauacgaagcacaacgcgcauggagaaccuccuguggaaacagguugcuaaugaacuuaacuauaucuugugggagaauaacauuaagcugaccguggugguaggagauaucauuggcguccucgaacaggggaaaagaacucugacaccacagccuauggaguuaaaguacucauggaaaaccuggggaaaggccaagaucgugacagcggagacucaaaacaguuccuucauaauugacggccccaauaccccagaaugccccagcgccucuagggcuuggaacguuugggagguggaagacuaugguuuuggggucuucacgacaaauaucuggcugaaacuucgggagguguacacccaguugugugaucaccgccucaugucagcagccguuaaggacgaaagagcugugcacgccgauaugggauacuggauugagagucagaaaaacggcagcuggaagcuggagaaagcaucccuaaucgaaguaaagacuugcaccuggccuaagucucauacacuguggucgaaugguguccucgagagcgacaugauaaucccaaaaucccuggcgggcccgauuucacagcacaaccauaggcccggguaucacacucaaaccgccggaccuuggcaccuuggcaaguuggaacuggauuuuaauuacugcgaggggacaacgguggugaucaccgagaacuguggaacucguggcccaaguuuacggacaaccacugucucugguaaacucauucaugaauggugcugucgaagcugcacacugcccccucuuagauauaugggggaggacggauguugguacggcauggaaaucaggccaauauccgagaaggaagagaauaugguuaaaucacuggugagcgcugguucuggcaagguagauaacuucaccauggggguguugugccucgccauucuguuugaggaagucaugcgcggaaaguucggcaaaaagcacaugaucgcagggguguucuuuauguucguucuacugcucuccggacagaucacguggcgggacauggcucauacucugauuaugaucggcaguaaugccagcgauagaauggguaugggggugaccuaucuugcauugauugccacauuuaaaauacagcccuuccuggcuuuaggauuuuuccucaggaagcugaccucucgcgagaaccuucugcuaggcgucggccucgcgauggccacuacacugcaauugccggaagacaucgagcagauggcaaaugggauugcucugggauuaauggcccucaaacugaucacccaguuugaaacauaccagcuuuggacugcccugauuuccuugaccuguucaaacacgauguucacacucaccguggcuuggcgaacugcaacccugauccuagccgguguuagucugcuuccugugugccaaagcucguccaugcggaagacagauuggcucccaauggcggucgcugccaugggcguacccccucugcccuuguuuauauucucucugaaggacacuuuaaaacguagaagcuggccacucaaugagggggugauggcaguuggacuggugucaauccuugccaguucccuguugaggaacgaugucccuauggcuggcccccucguggcuggugggcugcuaauugccuguuauguaaucaccggaacgucugcggaccugacaguggagaaggcugccgacauuaccugggaagaggaagcagagcagacuggcgucagccacaaccuuaugaucacaguugaugacgauggcaccaugcgcauaaaagacgaugaaacugagaauauucucacagugcuguugaagaccgccuuacugaucguguccggggucuuuccauacucaaucccggcuacgcuccugguguggcauacuuggcagaaacagacccaacggagcggaguucuuugggacguaccuagucccccagagacacagaaggccgaacuggaggaagguguguacagaauuaaacagcagggcauauucgggaagacccaagucggagugggcguucagaaggaggguguguuucacacaauguggcacgucacuagaggggcaguguugaccuauaacggaaaacgacuagagcccaauugggcuucuguaaagaaagaucugaucuccuacggcggcggguggcgccucagcgcccaguggcaaaagggagaagagguccaggugauugcgguugaaccugguaaaaacccaaagaauuuccagacgaugcccggcacauuccagacuaccacaggggagaucggagccauugcacuggacuuuaagccuggcaccucggguucaccgaucauaaaccgggaagggaaaguggucggacuuuauggcaauggcgugguuacuaagaacgggggauacgugucugguaucgcucaaaccaaugccgagccagauggccccacaccugaguuagaagaggaaauguucaaaaagagaaaccugacgauuauggaccuccauccagggaguggaaaaacuaggaaguauuugcccgcuaucguccgugaggcaauuaagcgccggcugagaacccucauccuggccccuacaagggugguagccgcugaaauggaggaggcgcuuaaaggccugccgauacgauaccagaccacugcaacaaaguccgaacacaccggucgggagauuguggauuugaugugccaugccacguuuacuaugcgccuacugagccccguuagagucccaaauuauaaccucaucaucauggacgaagcucacuucacagauccugccucuauugcagccaggggguacaucagcacccgggugggaaugggcgaggcugcggccauauuuaugaccgcaacucccccaggcacagcugacgccuucccucaguccaaugcacccauucaggacgaggaacgagauaucccagagagaucauggaacagugggaaugaauggauuaccgacuuugccggaaaaacagugugguucgucccgagcaucaaggcugguaacgauauagccaacuguuuacgcaaaaauggcaagaagguaauucaacugucuaggaaaacuuuugacacggaguaccagaagaccaaacuuaacgauugggacuucgugguuacaacugauaucuccgaaaugggggcgaauuuuaaggcagaccgugugaucgauccucggagaugccugaaacccgucauucucaccgacggaccagagagggugaucuuggccggccccaugccuguuacagcugccucagcugcacagcgccgagguagaguggggcggaacccacagaaggagaaugaucaauauauuuucaccggccagccccugaacaaugacgaagaccaugcccacuggacugaggcuaagaugcuccuggauaacauaaauacgccugaaggaaucauuccggcccuuuucgagccagaaagggagaaaagugcagcgaucgacggcgaguaccgccuaaagggggaaagccguaaaaccuuugucgagcugaugagacggggagauuugcccgugugguuagcccacaagguagcuuccgaagguaucaaauauacagacaggaaguggugcuucgauggccagcgcaacaaucagauucuggaggaaaacauggacguggagauauggacuaaagagggggaaaagaagaaacuccgaccuagauggcuggaugcccggaccuacucugacccccuugcacugaaggaguuuaaagauuucgcugccggaaggaagucgaucgcacucgacuugguuacagaaauuggccgcgucccaagccaucuggcccacagaaccaggaaugcucuagauaaccuggugaugcuccauacuucagagcacggugggcgggcguaucgucacgccguggaagaacuuccugagacaauggaaacgcuguuauugcugggccucaugauccugcuuaccggaggcgcaaugcuguuucucauuuccgggaaaggaaucgguaagacaaguauaggcuugaucugugucauugcuucuagcgggaugcuguggauggccgagauccccuuacaauggauugccuccgcaaucguucuagaguucuuuaugauggugcugcucauaccagagccugagaagcagcgcacaccgcaggacaaucaacuugcuuacguagugauuggaauccugaccuuggccgcgauuaucgcugccaacgaaaugggccugcucgagaccacaaaacgagaucuggguaugucaaaggaacccggggucgugucuccaacuagcuaucuugacguugaccuccauccugcaagugccuggacgcuguacgcuguggcaaccacagucauaacucccauguugagacacaccaucgaaaauuccacagccaacguaagccuggcggcuauugccaaccaggcagugguuuuaaugggccuagauaaaggauggccaaucucuaagauggaccugggcgugccucuccuugcccuggggugcuacucacaggucaaucccuugacccugacugcugccgugcuccugcuuauuacgcauuaugcaaucauaggaccgggcuuacaggcuaaagccacaagggaagcgcaaaagcggaccgccgcagguauuaugaagaacccaacugucgaugggaucaugaccaucgaccuggauccugugauuuacgacuccaaauucgagaagcagcucggacagguuauguugcuggugcuaugugcuguacagcugcuccuuaugcgcacaaguugggcccugugcgaggcauugacucuggcuaccggccccaucacaacgcucugggaagguagcccaggcaaauuuuggaauaccacuauagccgugucgauggccaacauuuucagagggucuuaucuggcgggagcuggcuuagcauuuuccaucaugaaaagcgucgggacaggaaaaaggggcaccgguucacaaggggagacucuuggagaaaaguggaagaaaaagcugaaucagcucagucggaaagaguucgaucuauacaagaaaucuggcauuacagaaguugaccgaaccgaggccaaggagggucugaaaagaggcgaaacgacccaccaugcugugucccgcgggagcgccaaguugcagugguuugucgagaggaacauggugauccccgaaggacggguaauagaucugggcugugggcguggaggcuggucauauuacugcgcaggucucaagaaagugacagagguuagaggguauacuaagggaggcccuggccacgaggaaccggugcccaugaguaccuacggguggaauaucauuaaacuuaugagcggaaaggacgucuucuaccugccaccugagaaaugugauacauugcugugcgacaucggugaauccucucccagcccuacuguggaggaauccaggaccauucgcguccucaagaugguggagccaugguuaaagaacaaucaguucuguaucaaaauucugaaccccuauaugccuacaguuaucgagcaccuugaacggcugcaacgaaagcauggcgggaugcuaguaagaaauccacucucaaggaacucuacccacgagauguacuggauaaguaauggaacuggcaacauuguggccucggucaauauggugagccgccuguugcugaaccgguuuacgaugacacauagacgucccaccaucgaaaaagauguugaccucggugcugggacuaggcacgugaacgcggagccggaaaccccuaauauggacgucaucggagagcggauuaagcgcauaaaagaggaacacaacuccacauggcauuaugaugacgagaauccauacaagacgugggccuaucacggcucuuacgaagugaaggcaaccggcucagcuagcuccaugaucaacgggguagugaaacuucugacuaagcccugggauguugucccuauggugacacagauggccaugaccgacacuacaccauucggacagcaacgaguguuuaaagagaaggucgauaccagaacacccaggaguaugccggguacucggcgcguuaugggcauuaccgcagaaugguuauggagaacgcuggggaggaauaaaaagccucgauugugcacccgggaggaguucacaaagaaagugcguacuaacgccgcuaugggagccguauuuaccgaagagaaucagugggacucugcgaaggcagccguggaagaugaggacuucuggaaacucgucgauagagaacgcgagcugcauaagcuaggcaaaugugguagcugcguguauaacaugauggggaagagggagaagaaacuuggagaauuuggcaaagcuaaaggcucacgggccaucugguacauguggcugggggcaagauaccucgaguucgaagcucugggauuuuugaaugaggaccacugguucucccgcgagaacaguuauagcgguguugaaggcgaggggcugcauaagcucggauacauucuuagggauaucucuaaaauacccggcggugccauguaugcugacgacacagccgggugggauacucgaaucaccgaagacgaucugcacaaugaggaaaagauuacgcagcagauggacccagagcaccggcaauuagcaaacgcgaucuuuaaacugacauaccagaauaagguggucaaggugcagagaccuacccccacuggaacaguaauggauauuaucuccaggaaagaccagcgcggcucaggccaaguugggaccuauggauugaacacuuucaccaauauggaggcccagcucauacgucagauggaaggugagggcgugcugagcaaggcugaucuagaaaacccacaucuucccgagaaaaagauuacacaguggcuggaaacgaaaggggucgagcggcucaagagaauggccaucucgggagaggacugcgugcugaagccuaucgaugacagguuugauaacgcauuguuagcucugaaugacaugggcaaagugcgcaaggauauuccacaauggcagccgucuaaagguuggcacgacuggcagcagguccccuucuguagucaucacuuccacgaacucauaaugaaggacgggcgaaaacuuguugugccuugccggccacaagaugagcugaucggaagggccaggauuucccagggcgcaggcuggagccuacgcgaaaccgccugucuggggaaggcguacgcucagauguggucacucauguauuuucauagacgggacuugaggcuggccuccaacgcaaucugcucugccguacccgugcacugggucccuacuagccguacaaccuggaguauucaugcacuucaccaauggaugacuacagaggauaugaucaccguguggaaucgaguuuggauagaagacaacccauggauggaggauaagacgcccgugacaaccugggaggacgucccuuaccugggaaaacgcgaagaucaguggugugguucccucaucggcuuaacuagcagagccaccugggcacagaauauuccgacagcuauccagcaagugcggucucugauugggaacgaggaguucuuggacuacaugccaucaaugaagagguuucgcaaagaggaggaaagugagggagccaucugguga

SEQ ID NO: 15131 - RNA, 9873 nt, Artificial Sequence
  derived and/or modified CDS sequence (opt3) from DENV-3__JF808118__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcgccgacgugacaagagaagcguagcccuugcaccccacgugggcaugggucuggauacaaggacccaaacguggauguccgccgagggggcuuggcggcaggucgaaaaaguggagacuugggcauugcgccauccuggauucaccauucucgcccuguuucuggcucacuacaucggcacaucucucacucagaagguugugauauucaucuuacugaugcuugucaccccaucgaugacaaugagaugugugggcguagggaacagggacuuuguugaaggauugucaggugccaccuggguggaugucgugcuggagcauggcgggugcgugacgacuauggcgaagaauaaacccacacuagacauugagcuccagaagaccgaagcaacucaacuggccauccuucggaaacuguguauugagggaaagaucacaaacauaaccacggauagccgcugcccuacccagggcgaagcugucuugccagaggaacaggaccagaauuauguuuguaaacacacauacguggaucgagguugggggaacggaugcggccucuucggcaaggggagucugguaacuugcgccaaguuucaauguuuagagcccauugagggaaaagugguccaguaugaaaaucugaaguacaccgugaucauuacaguucacacuggugaccagcaucaggugggcaacgagacccaaggggucacagcagaaaucaccccucaggcuuccacuacggaggccauccucccagaauauggaacacuuggccuggagugcucuccgagaaccgguuuggacuucaaugagaugauucuacugacuaugaaaaacaaggcguggauggugcacaggcagugguuuuucgaucucccccugccuuggaccagcggggccacaaccgaaacuccaacauggaaucggaaagagcuucugguaacguuuaagaacgcacaugcuaaaaagcaagaaguuguggucuugggcucccaggagggagccaugcacaccgcucucacuggcgccacagaaauacagaauucagggggaaccaguaucuucgcaggucaccugaagugucguuuaaaaauggacaagcuggagcuaaaaggcaugagcuacgccaugugcacaaacacuuuugugcucaagaaagaggucucugaaacccagcaugggacgauucugaucaagguggaguacaagggagaagaugcucccuguaaaauaccuuucuccaccgaggacggccaagguaaggcgcacaacgggcgccuuauuacagcaaauccaguugugacuaaaaaggaggaacccguaaacaucgaggccgaaccgccuuucggcgagucaaauaucgucauuggaaucggcgauaacgcuuugaaaauuaauugguauaagaaggggagcaguauaggaaaaauguuugaagccaccgcaagaggugccaggcggauggcuauccugggcgacacagccugggauuucgggucugugggaggcguucucaacucccuggguaagauggugcaucagauuuuugggagcgcauacacugcgcuuuucucgggcgucucuugggugaugaaaaucggaaucggcguacuguugaccuggauugggcucaauuccaagaacacgucaaugaguuuuagcugcauagcuaucggaauuaucacacuguauuuaggcgccgugguucaggcagacauggguugugucauuaauuggaaagggaaggagcugaagugcggauccggcaucuucgugaccaacgaggugcacacuuggacagaacaguacaaauuucaagccgauucucccaagcgacuagcuaccgccauagcaggugcuugggagaauggcgucugugggauccgcagcacuaccagaauggaaaaccuccuguggaaacagauugccaaugagcuuaacuauaucuugugggaaaauaacauuaagcugacaguuguggugggagacaucauaggcguacucgagcaggggaaaaggacgcugaccccacagccuauggaguuaaaguacucauggaaaacuuggggaaaggcgaagauugucacagccgaaacccaaaacaguuccuucaucauugauggccccaauacaccagagugccccagcgcuucucgggcauggaacgugugggaaguugaggacuaugguuuugggguguucacuaccaauaucuggcugaaacuucgcgaagucuacacgcaguugugugaccauagacucaugucagccgcugugaaggaugagagggccguucacgcagacaugggauacuggauagagagucagaaaaacggcagcuggaagcuggaaaaagcgucccuaaucgaggugaagacaugcaccuggccuaagucucacacucuguggucgaaugguguacucgaaagcgauaugauuaucccaaaaucccuggccggcccgauuucacagcauaaccaccgucccggguaucauacccaaacagcuggaccuuggcaccuuggcaaguuggagcuggacuuuaauuacugcgaggggacuaccgucgugaucacagaaaacuguggaacgcggggcccaaguuuacgaaccacuacagugucugguaaacucauacacgaguggugcuguagaagcugcacccugcccccucuuagguauaugggggaagauggauguugguacggcauggagauucgcccaaucuccgaaaaggaggagaauauggucaaaucacugguuagcgccgguucuggcaagguggacaacuucacuauggggguauugugccucgcaauccuguuugaagaggugaugcggggaaaguucggcaaaaagcauaugauugcuggggucuucuuuacauucgugcuacugcucuccggacagaucaccuggagagauauggcccacacgcugauuaugauaggcaguaaugcaagcgacaggauggguauggggguuacuuaucuugccuugaucgcuaccuuuaaaauucagcccuuccuggcguuaggauuuuuccuccgcaagcugacaucucgagaaaaccuucugcuaggcgugggccucgccauggcaaccacucugcaauugccggaggauaucgaacagauggcuaaugggauugcccugggauuaauggcccucaaacugaucacacaguuugagaccuaccagcuuuggacagcucugauauccuugacuuguucaaacaccauguucacgcucacagucgcauggcggaccgccacucugauccuagcgggugugagucugcuuccuguuugccaaagcucguccaugcguaagaccgacuggcucccaauggcuguggccgcaaugggcguccccccucugcccuuguuuauuuucucucugaaggauacauuaaaaagaaggagcuggccacucaaugaggggguaauggccgugggacugguuucaauccuugcuaguucccuguugcgcaacgacgugccuauggcaggcccccucgucgccggugggcugcuaauugcguguuaugugaucacuggaaccucugcugaucugacgguagaaaaggccgcagacauaacaugggaggaagaggccgaacagaccggcgugagccauaaccuuaugauuacugucgacgaugacggcacaaugcggaucaaagaugacgagaccgagaauauccucacuguucuguugaagacagcuuuacugauuguguccgggguguuuccauacucaauaccggccacccuccuggucuggcacacguggcagaaacagacucaaagaagcggagugcuuugggauguuccuagucccccagaaacccagaaggcagagcuggaagaggguguauacaggaucaaacagcagggcauuuucgggaagacacaagugggagucggcgugcagaaggaggguguuuuucauaccauguggcacgugacacgaggggcugucuugacuuauaacggaaaacgccuagaacccaauugggccucugugaagaaagaccugaucuccuacggcggcggguggcggcucagcgcgcaguggcaaaagggagaggaaguacaggucauugccguggagccugguaaaaacccaaagaauuuccagaccaugcccggcacguuccagacaacuaccggggaaaucggagcaauagcucuggauuuuaagccuggcacaucggguucaccgaucauuaacagagaggggaaaguugugggacuuuauggcaauggcgucgugaccaagaacgggggauacguuucugguaucgcccaaacuaaugcugagccagacggccccaccccugaauuagaggaagagauguucaaaaagaggaaccugacaauuauggaucuccacccagggaguggaaaaacgcguaaguauuugcccgcaaucgugcgcgaagccauaaagcggagacugaggacucucauucuggccccuacccgagucguggcugcggagauggaggaagcacuuaaaggccugccgauccgguaccagacaaccgccacuaaguccgagcauacaggucgcgaaaucguagacuugaugugccacgcuaccuuuacgaugagacuacugagccccgugaggguuccaaauuauaaccucauuaucauggaugaggcccauuucacugacccugcaucuauagccgcucggggguacauuagcacacgagucggaaugggcgaagcggccgcaaucuuuaugaccgcuacccccccaggcacugccgaugcauucccucaguccaaugcccccauucaggacgaggagagagacaucccagaacgcucauggaacagugggaaugaguggauaacagauuuugcuggaaaaaccgugugguucgugccgagcauuaaggccgguaacgacaucgcgaacuguuuaaggaaaaauggcaagaaggucauccaacugucucguaaaacauuugauacugaauaccagaagacgaaacuuaacgacugggauuucguagugaccacagacauuuccgagaugggggcaaauuuuaaggccgaucggguuaucgacccuagaaggugccugaaacccgugauucucacugauggaccagagcgcgucauauuggcuggccccaugccugugaccgccgcuucagcagcccagcgaagaggucggguugggaggaacccacagaaggaaaaugaccaauauaucuucacaggccagccccugaacaaugaugaggaccacgcucauuggaccgaagccaagaugcuccuggacaacauuaauacuccugagggaaucaucccggcacuuuucgaaccagagcgcgagaaaagugcggccauugauggcgaauaccgucuaaagggggagagcagaaaaacguuuguggaacugaugcggaggggagacuugcccgucugguuagcucacaagguggccuccgaggguauaaaauauaccgaucgcaaguggugcuucgacggccagcgaaacaaucagauccuggaagagaacauggauguagagauuuggacaaaagaaggggagaagaagaaacucagaccucgguggcuggacgcaaggacuuacucugauccccuugcucugaaggaauuuaaagacuucgccgcaggacgcaagucgaucgcccucgauuuggugaccgagauuggcagaguuccaagccaccuggcucauaggacacggaaugcgcuagacaaccuggucaugcuccacaccucagaacauggugggcgugccuaucgccacgcaguggaggagcuuccugaaacuauggagacacuguuauugcugggccucaugauccugcuuacgggaggcgcuaugcuguuucucauauccgggaaaggaaucgguaagaccaguauuggcuugaucugugugauugccucuagcgggaugcuguggauggccgaaauccccuuacaauggauagcauccgcuauuguccuagaguucuuuaugaugguucugcucaucccagagccugaaaagcagcgaacuccgcaggauaaucaacuugccuacgugguaauuggaauccugacauuggcggcuauaaucgccgcaaacgagaugggccugcucgaaaccaccaaaagagaccuggguaugucaaaggagcccgggguggucucuccaacaagcuaucuugauguggaccuccacccugccagugcuuggacucuguacgcaguugccacgaccgugauuacacccauguugaggcauacuaucgaaaauuccaccgcgaacgucagccuggcugccauugcaaaccaggccguaguguuaaugggccuagacaaaggauggccaaucucuaagauggaucugggcguuccucuccuugcucuggggugcuacucacaggugaaucccuugacacugaccgccgcaguccuccugcuuauaacucacuaugcuauuaucggaccgggcuuacaggccaaagcgacgcgggaggcccaaaagcgcacagcagcugguaucaugaagaacccaaccguggacgggauuaugacuaucgaucuggacccugucauauacgauuccaaauucgagaagcagcucggacaggugauguugcugguucuaugugccgugcagcugcuccuuaugagaaccaguugggcacugugcgaagcuuugacacuggccacuggccccauuaccacacucugggaggguagcccaggcaaauuuuggaauacgaccaucgccguaucgauggcgaacauuuucagggggucuuaucuggcuggagcaggcuuagccuuuuccaucaugaagagcguggggacuggaaaacggggcacagguucacaaggggaaacccuuggagagaaguggaagaaaaagcugaaucagcucagucgaaaagaauucgaccuauacaagaaaucuggcauaacugaggucgauagaacagaggcuaaggaaggucugaaacgcggcgagaccacgcaucacgccguuuccagggggagcgcaaaguugcagugguuuguggaacggaacauggucauccccgagggacgugugauugaccugggcugugggagaggaggcuggucauauuacugcgccggucucaagaaaguaaccgaagugaggggguauacaaagggaggcccuggccaugaggagccgguucccaugaguacuuacggguggaauaucgugaaacuuaugagcggaaaggaugucuucuaccugccaccugaaaaaugugacaccuugcugugcgauauuggugaguccucucccagcccuacaguggaagagucccgcacuauccggguccucaagaugguggagccaugguuaaagaacaaucaguucuguauuaaaguucugaaccccuauaugccuaccguaaucgaacaccuugagcgacugcaaagaaagcacggcgggaugcuagugaggaauccacucucacgcaacucuacacaugaaauguacuggauaaguaauggaaccggcaacauugucgcuucggugaauaugguuagccggcuguugcugaacagauuuacuaugacgcaccguaggcccacaaucgagaaagacguggaucucggugcggggacccggcaugucaacgccgaaccggagacuccuaauauggacgugaucggagagcgcauuaagcgaauaaaagaagagcacaacuccaccuggcacuaugacgaugaaaauccauacaagacaugggcauaucauggcucuuacgagguaaaggcuacgggcucagccagcuccaugaucaacggggugguuaaacuucugaccaagcccugggacgucgugccuauggugacucagauggcaaugacagauaccacuccauucggacagcaaagagucuuuaaagaaaagguugacacaaggaccccccggaguaugccggguacacgcagagugaugggcauuacugccgagugguuauggaggacccuggggcgaaauaaaaagccucgguugugcacgcgugaggaauucaccaagaaaguaagaacaaacgcugccaugggagcgguguuuacugaggaaaaucagugggauucugcaaaggccgcugucgaggacgaagauuucuggaaacucguggaccgcgagagggagcugcacaagcuaggcaaaugugguagcugcguuuauaacaugauggggaagcgggaaaaaaagcuuggagaguuuggcaaggccaaaggcucaagagcaaucugguacauguggcugggggcucgcuaccucgaauucgaggcccugggauuuuugaaugaggaucauugguucuccagggaaaacaguuauagcgguguggagggcgaagggcugcacaagcucggauacauucuucgagacaucucuaaaauacccggcggugcuauguaugccgaugacaccgcagggugggacacacggaucacugaggaugaccugcauaaugaagagaagauuacccagcagauggauccagagcacagacaauuagcgaacgccaucuuuaaacugacguaccagaauaaggucgugaagguacagaggccuacacccaccggaacuguuauggacauuaucucccgcaaagaucagcguggcucaggccaaguggggacauauggauugaacaccuucacuaauauggaagcucagcucauacggcagauggagggugaaggcguccugagcaaggccgaccuagagaacccacaccuucccgaaaaaaagauuacccaguggcuggagacaaaagggguggagagacucaagaggauggcaaucucgggagaugacugcguggucaagccuaucgaugaccgcuuugcuaacgcccuguuggcauuaaaugauaugggcaaaguucgaaaggacauuccacaauggcagccgucuaaagguuggcaugauuggcagcaggugcccuucuguagucaccauuuccacgaacugauaaugaaggacgggcggaaacucguagugccuugcagaccacaagacgagcuuaucggaagggcccgcauuucccagggcgcgggcuggagccugagagaaacggcuugucuagggaaggccuacgcacagauguggucacugauguauuuucaccggagggaucuccguuuggccuccaacgcuaucugcucugccguccccgugcauuggguuccuaccagccgaacuacauggaguauucacgcacaucaccaauggaugaccacugaggacaugcugacaguguggaaucgcgucuggaucgaagauaacccauggauggaggacaagacccccgugacgacaugggagaauguaccuuaccuuggaaaaagagaagaucaguggugugguucccugauaggccucaccagccgggcuacuugggcccagaacaucccgaccgcgauucagcaaguuaggucuuuaaucgggaaugaggaauuccuggacuacaugccaucaaugaagcgcuuuagaaaagaggaggaaagugagggagcuauuugguga

SEQ ID NO: 15132 - RNA, 9873 nt, Artificial Sequence
  derived and/or modified CDS sequence (opt3) from DENV-3__JF808127__SS-prME
accagccugugccucaugaugauccuucccgcagcucuggcauuccacuugacuuccagggacggcgagccuaggaugauuguggggaagaacgaacggggaaagucuuuacuguuuaagacugccucagguauaaauauguguacgcugaucgcgauggaucucggcgagaugugcgacgauaccgucacauacaaguguccacacauuacugaaguugagccggaagacaucgauugcugguguaaccugaccaguacaugggugaccuaugggacuugcaaucaggcuggagagcgccgacgugacaagagaagcgucgcccuugcaccccacgugggcaugggucuggauacaaggacccagacguggauguccgccgagggggcuuggcggcaggucgaaaagguggagacuugggcauugcgccauccuggauucaccauucucgcccuguuucuggcucacuacaucggcacaucucucacucagaagguugugauauucaucuuacugaugcuugucaccccaucguugacaaugagaugugugggcguagggaacagggacuuuguugaaggacugucaggugccaccuggguggaugucgugcuagagcauggcgggugcgugacgacuauggcgaagaauaagcccacacucgacauugagcugcagaagaccgaagcaacucagcuugccacacugcggaaguuguguaucgagggaaagauuaccaacaucacgaccgauagccgcugcccuacacagggcgaagcuguccucccagaggaacaggaccagaauuauguuuguaaacacacuuacguggaucgagguugggggaacggaugcggccuguucggcaaggggaguuuaguaaccugcgccaaguuucaaugucuggagcccauagagggaaaagugguccaguaugaaaaucucaaguacacagugauuaucacuguucacaccggugaccagcaucaggugggcaacgagacacaaggggucaccgcagaaauuacuccucaggcuuccacgacagaggccauccuuccagaauauggaacccugggcuuggagugcucuccgagaacuggucuagacuucaaugagaugauccugcucaccaugaaaaacaaggcguggauggugcacaggcagugguuuuucgaucugccccuuccuuggacaagcggggccaccacugaaacaccaacguggaaucggaaagagcuguugguaaccuuuaagaacgcacaugcuaaaaagcaagaaguugugguccucggcucccaggagggagccaugcacacugcucugacaggcgccaccgaaauucaaaauucagggggaacaaguauauucgcaggucacuuaaagugucgucugaaaauggacaagcuagagcucaaaggcaugagcuacgccaugugcacuaacaccuuugugcugaagaaagaggucucugaaacgcagcaugggaccauccuuauuaagguggaguacaagggagaagaugcucccuguaaaaucccuuucuccacagaggacggccaagguaaggcgcacaacgggcgcuugauaacugcaaauccaguugugaccaaaaaggaggaacccguaaacauugaggccgaaccgccuuucggcgagucaaauaucgucaucggaacaggcgauaacgcucugaaaauuaauugguauaagaaggggagcaguaucggaaaaauguuugaagccacugcaagaggugccaggcggauggcuauucucggcgacaccgccugggauuucgggucugugggaggcguucugaacucccuugguaagauggugcaucagauauuugggagcgcauacacggcgcuguucucgggcgucucuugggugaugaaaaucggaauuggcguauugcucacauggaucgggcuaaauuccaagaacaccucaaugaguuuuagcugcaucgcuauuggaauaaucacuuuauaucugggcgccgugguucaggcagacauggguugugucauuaauuggaaagggaaggagcuaaagugcggauccggcaucuucgugacaaacgaggugcacaccuggacugaacaguacaaauuucaagccgauucucccaagcgacucgcuaccgccauugccggugcuugggagaauggcgucugugggauccgcagcacaacgagaauggaaaaccugcuuuggaaacagauagccaaugaguugaacuauauccugugggaaaauaacauuaagcucaccguuguggugggagacaucauuggcguacuggagcaggggaaaaggacuuuaacaccacagccuauggagcugaaguacucauggaaaaccuggggaaaggcgaagaucgucacagccgaaacucaaaacaguuccuucauaauugauggccccaauaccccagagugccccagcgcuucucgggcauggaacgugugggaaguugaggacuaugguuuugggguguucacgacaaauaucuggcuuaaauugcgcgaagucuacacccagcucugugaccauagacugaugucagccgcugugaaggaugagagggccguucacgcagacaugggauacuggauugagagucagaaaaacggcagcuggaagcuagaaaaagcgucccugaucgaggugaagacuugcaccuggccuaagucucacacacucuggucgaaugguguacuggaaagcgauaugauaaucccaaaaucccuugccggcccgauuucacagcauaaccaccgucccggguaucauacucaaaccgcuggaccuuggcacuugggcaagcuggaguuagacuuuaauuacugcgaggggacaacggucgugaucaccgaaaacuguggaacucggggcccaagucuccgaacaaccacugugucugguaaacugauucacgaguggugcuguagaagcugcacacuucccccucugagguauaugggggaagauggauguugguacggcauggagauccgcccaauauccgaaaaggaggagaauauggucaaaucauugguuagcgccgguucuggcaagguggacaacuucaccauggggguacucugccuggcaauucuauuugaagaggugaugcggggaaaguucggcaaaaagcauaugaucgcuggggucuucuuuacguucgugcugcuccuguccggacagaucacuuggagagauauggcccacacccuuauuaugaucggcaguaaugcaagcgacaggauggguauggggguuacauauuuggcccugauugcuaccuuuaaaauacagcccuucuuagcgcucggauuuuuccugcgcaaacuuacuucucgagaaaaccugcuacucggcgugggccuggccauggcaacaaccuugcaacugccggaggauaucgaacagauggcuaaugggauugccuuaggacucauggcccugaaacuuaucacacaguuugagacuuaccagcuguggaccgcuuugauuucccucacguguucaaacacaauguucacccugacugucgcauggcggaccgccacacuaauccuggcgggugugagucuucucccuguuugccaaagcucguccaugcguaagacugacuggcugccaauggcuguggccgcaaugggcguacccccuuugccccuguuuauauucucuuuaaaggauacccucaaaagaaggagcuggccacugaaugaggggguaauggccgugggacuuguuucaauccuggcuaguuccuugcuccgcaacgacgugccuauggcaggcccccuggucgccggugggcuacugauugcguguuaugugaucacgggaacaucugcugaucuuaccguagaaaaggccgcagacauuacuugggaggaagaggccgaacagacaggcgugagccauaaccucaugaucaccgucgacgaugacggcacuaugcggauaaaagaugacgagacagagaauauucugaccguuuuguuaaagacggcucugcucaucguguccgggguguuuccauacucaaucccggccacucugcuugucuggcacaccuggcagaaacagacacaaagaagcggagugcugugggauguuccuagucccccagaaacccagaaggcagaguuggaagaggguguauacaggauuaaacagcagggcauauucgggaagacacaagugggagucggcgugcagaaggaggguguuuuucauacuauguggcacgugacccgaggggcuguccuaacguauaacggaaaacgccuggaacccaauugggccucugugaagaaagaccucaucuccuacggcggcggguggcggcugagcgcgcaguggcaaaagggagaggaaguacaggucauugccguggagccugguaaaaacccaaagaauuuccagacaaugcccggcacuuuccagaccacaaccggggaaaucggagcaauugcucuugauuuuaagccuggcacuucggguucaccgaucauaaacagagaggggaaaguugugggauuauauggcaauggcgucgugaccaagaacgggggauacguuucugguaucgcccaaacaaaugcugagccagacggccccacgccugaacuggaggaagagauguucaaaaagaggaaccucacuauuauggauuugcacccagggaguggaaaaacccguaaguaucugcccgcaaucgugcgcgaagccauuaagcggagacucaggacacugauccuugccccuacccgagucguggcugcggagauggaggaagcacugaaaggcuugccgauacgguaccagacuacagccaccaaguccgagcauacgggucgcgaaauuguagaccuaaugugccacgcuacuuuuacaaugagacugcucagccccgugaggguuccaaauuauaacuuaaucaucauggaugaggcccauuucaccgacccugcaucuauugccgcucggggguacaucagcacccgagucggaaugggcgaagcggccgcaauauuuaugacugcuacacccccaggcaccgccgaugcauucccucaguccaaugcccccauucaggacgaggagagagacaucccagaacgcucauggaacagugggaaugaguggauuacagauuuugcuggaaaaacugugugguucgugccgagcaucaaggccgguaacgacauagcgaacugucugaggaaaaauggcaagaaggucauucaacuuucucguaaaacguuugauaccgaauaccagaagacaaaacugaacgacugggauuucguagugacuaccgacaucuccgagaugggggcaaauuuuaaggccgaucggguuaucgacccuagaaggugccucaaacccgugauuuugacagauggaccagagcgcgucauccuggcugaacccaugccugugaccgccgcuucagcagcccagcgaagaggccggguugguaggaacccacagaaggagaaugaccaauauauuuucacugggcagccccucaacaaugaugaagaccacgcucauuggacggaggccaagaugcugcuugacaacauaaauaccccugaaggcaucauuccggcacuauucgagccagagcgcgagaagagugcggccaucgauggagaguaccgucugaagggcgaaagcagaaaaacauuuguggaguugaugcggagaggggacuuacccgucuggcuggcucacaagguggccuccgaaggaaucaaauauacugaucgcaaguggugcuucgacggucagcgaaacaaucagauucucgaggagaacauggauguagaaauauggaccaaagagggcgaaaagaagaaacugagaccucgguggcuugacgcaaggacauacucugauccccuggcucucaaggaguuuaaagacuucgccgcagggcgcaagucgaucgccuuggaucuggugaccgaaauuggaagaguuccaagccaccuagcucauaggacucggaaugcgcuggacaaccucgucaugcuucacacaucagagcauggcggucgugccuaucgccacgcaguggaggaacugccugagacgauggaaaccuuauugcugcucgggcugaugauccuucugacuggcggagcuaugcucuuuuugauuuccggcaaagggaucggaaagacaaguauaggucugaucugugugauugccucuagcggcauguuauggauggccgagaucccccuacaauggauugcauccgcuaucguccuggaguucuuuaugaugguucuccuuauaccagaaccugagaagcagcgaaccccgcaggauaaucaacuggccuacgugguaauugggaucuugacccuggcggcuauuaucgccgcaaacgaaaugggacuccuggagacaacuaaaagagaccuuggcaugucaaaggaacccgguguggucucuccaacgagcuaucucgauguggaccugcacccugccagugcuuggaccuuguacgcaguugccacaacugugauaacccccaugcugaggcauacaaucgaaaauuccaccgcgaacgucagcuuagcugccauugcaaaccaggccguagugcuaauggggcuggacaaaggcuggccaaucucuaagauggaucucggaguuccucuucuggcuuugggcugcuacucacaggugaauccccugacucucacggccgcaguccugcuuuuaauuacacacuaugcuaucauagggccgggacugcaggccaaagcgacccgggaggcccaaaagcgcacugcagcuggcauuaugaagaacccaaccguggacgguaucaugacaaucgaucucgacccugucauuuacgauuccaaauucgaaaagcaguugggacaggugaugcugcuaguucugugugccgugcagcuccuucugaugagaacaaguugggcauugugcgaggcucugacccucgccacaggacccaucacgacccugugggaaggcagcccagguaaauuuuggaauacuacaauagccguaucgauggcgaacauuuucaggggcucuuauuuagcuggggcaggacuugccuuuuccaucaugaaaagcgugggcaccgggaaacggggaacuggcucacaaggugagacacugggggaaaaguggaagaaaaagcucaaucagcuaagucgaaaagaguucgaccugaacaagaaaucuggaauuaccgaggucgauagaacggaagcuaaggagggcuugaaacgcggugaaaucacccaucacgccguuuccaggggcagcgcaaagcugcagugguuuguggagcggaauauggucauacccgaagggcgugugaucgaccucggauguggcagagggggauggucauacuauugcgccggccuuaagaaaguaacagaggugagggguuacacuaaaggcgggccugggcaugaggaaccgguucccaugaguaccuauggcuggaacauugugaaacugaugagcgggaaggaugucuucuacuugccaccugagaaaugugacacacugcucugcgauaucggagaauccucucccagcccuacuguggaggagucccgcaccauucgggucuuaaagaugguggaaccauggcugaagaauaaccaguucuguaucaaaguucuuaaucccuacaugccuacaguaauugagcaccuggaacgacuacaaagaaagcacgguggcaugcucgugaggaacccacugucacgcaauucuacccaugagauguauuggaucaguaacgggacuggaaauauagucgcuucggugaaaaugguuagccgguugcugcucaacagauuuacgaugacacaccguaggcccaccauugaaaaggacguggaucuuggcgcggguacucggcaugucaacgccgagccggagaccccuaauauggacgugaucggggaacgcaucaaacgaauuaaggaggaacacaacuccacauggcacuacgacgaugagaauccauauaagacgugggcauaccauggaucuuaugaaguaaaagcuaccggcucagccagcuccaugauaaacggcgugguuaagcuguuaacuaaacccugggacgucgugccuauggugacacagauggcaaugaccgauacuacaccauucgggcagcaaagagucuuuaaggagaaaguugacaccaggacaccccggaguaugccgggaacucgcagagugauggguaucaccgccgaguggcuguggaggacguugggccgaaauaagaagccuaaacucugcacccgggaagaguucacaaagaaaguacguacuaacgcugccaugggggcgguguuuaccgaagagaaucagugggauucugcaaaggccgcugucgaagacgaggauuucuggaaacugguggacagagagcgcgaacuacacaaacuuggaaaauguggcagcugcguuuacaacaugauggguaagagggagaagaaacugggggaauuuggaaaggccaaaggcucacgggcaauuugguauauguggcucggcgcuagauaccuggaguucgaggccuugggguuucugaaugaagaucauugguucucccgcgagaacaguuacagcggaguggaaggugagggccuccacaaacuuggguauauccugagggacauuucuaaaauccccggaggcgcuauguacgccgaugacacagcagguugggacacucgaauaaccgaagaugacuuacauaaugaggagaagaucacgcagcagauggauccagaacaccggcaacuggcgaacgccauuuuuaaguugacauaucagaauaaagucgugaagguacagagaccuacccccacugggacaguuauggacaucauuuccaggaaagaucagcgcggaucaggccaagugggcaccuacgggcucaacacuuucaccaauauggaggcucagcugauccgucagauggaaggagaggguguccuaagcaaggccgaccuugaaaacccacaucugcccgagaaaaagauaacacaguggcucgagacgaagggcguggaacggcugaaaagaauggcaauuucgggggaugacugcguggucaagccuaucgaugacagguuugcuaacgccuuguuagcacugaaugauaugggaaaaguucgcaaggacaucccacaauggcagccgucuaaaggcuggcaugauuggcaacaggugcccuucuguagucaccauuuccacgagcucauuaugaaggacggucgaaaacuuguagugccuugccggccacaagacgaacugauagggagagccaggaucucccagggagcgggcuggagccuacgcgagaccgcuugucugggcaaagccuaugcacagauguggucacucauguacuuucacagacgggauuugaggcuggccuccaacgcuauuugcucugccguccccgugcauuggguuccuacuagccguacaaccuggaguauccacgcacaucaccaauggaugacuacagaagacaugcuuaccguguggaaucgagucuggauugaggauaacccauggauggaggacaagacgcccgugacaaccugggaaaauguaccuuaucuggggaaacgcgaggaucagugguguggaucccucaucgguuuaacuagcagagcuaccugggcccagaacauaccgacagcgauccagcaaguucggucucugauuggcaaugaagaguucuuggacuacaugccaucaaugaagagguuucgcaaagaggaagagagugaaggggcuaucugguga

SEQ ID NO: 15133 - RNA, 9873 nt, Artificial Sequence
  derived and/or modified CDS sequence (opt3) from DENV-3__JF808124__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcgccgacgugacaagagaagcguagcccuugcaccccacgugggcaugggucuggauacaaggacccaaacguggauguccgccgagggggcuuggcggcaggucgaaaaaguggagacuugggcauugcgccauccuggauucaccauucucgcccuguuucuggcucacuacaucggcacaucucucacucagaagguugugauauucaucuuacugaugcuugucaccccaucgaugacaaugagaugugugggcguagggaacagggacuuuguugaaggauugucaggugccaccuggguggaugucgugcuggagcauggcgggugcgugacgacuauggcgaagaauaaacccacacuagacauugagcuccagaagaccgaagcaacucaacuggccacacuucggaaacuguguaucgagggaaagauuaccaacaucacgaccgauagccgcugcccuacacagggcgaagcugucuugccagaggaacaggaccagaauuauguuuguaaacacacuuacguggaucgagguugggggaacggaugcggccucuucggcaaggggagucugguaaccugcgccaaguuucaauguuuagagcccauagagggaaaagugguccaguaugaaaaucugaaguacacagugauuaucacuguucacaccggugaccagcaucaggugggcaacgagacacaaggggucaccgcagaaauuacuccucaggcuuccacgacagaggccauccucccagaauauggaaccuucggccuugagugcucuccgagaacuggucuggacuuuaaugagaugaucuugcuaaccaugaaaaacaaggcguggauggugcacaggcagugguucuuugaucugccccucccuuggacaagcggggccaccacugaaacaccaacguggaaucggaaagagcugcuuguaaccuucaagaacgcacaugcuaaaaagcaagaaguugugguccugggcucccaggagggagccaugcacacugcuuugacaggcgccaccgaaauucagaauucagggggaacaaguauauuugcaggucaccucaagugucgucugaaaauggacaaguuagagcugaaaggcaugagcuacgccaugugcacuaacaccuucgugcuaaagaaagaggucucugaaacgcagcaugggaccauccucauuaagguggaguacaagggagaagaugcucccuguaaaaucccuuucuccacagaggacggccaagguaaggcgcacaacgggcgccugauaacugcaaauccaguugugaccaaaaaggaggaacuuguaaacauugaggccgaacccccguuuggcgagucaaauaucgucaucggaauuggcgauaacgcuuugaaaaucaauugguauaagaaggggagcaguauuggaaaaauguucgaagccacagcaagaggugccaggcggauggcuauacugggcgacacugccugggauuuugggucugugggaggcguucucaacucccuggguaagauggugcaucagaucuucgggagcgcauacaccgcgcuuuuuucgggcgucucuugggugaugaaaauuggaaucggcguacuguugacguggaucgggcucaauuccaagaacacaucaaugaguuucagcugcauugcuauaggaaucauuacccuguauuuaggcgccgugguucaggcagacauggguugugucaucaauuggaaagggaaggagcugaagugcggauccggcauuuuugugacuaacgaggugcacacauggaccgaacaguacaaauuccaagccgauucuccuaagcgacuagcuacugccaucgcaggugcuugggagaauggcgucugugggauacgcagcaccacaagaauggaaaaccuccuguggaaacagguugccaaugagcuuaacuauaucuugugggaaaauaacauuaagcugacgguggugguaggagacaucauuggcguccucgagcaggggaaaaggacccugacuccccagccaauggaguuaaaguacucauggaaaacauggggaaaggcgaagaucgugaccgccgaaacacaaaacaguuccuuuauaauugauggcccuaauacucccgagugcccaagcgcuucucgggcauggaacguuugggaaguggaggacuaugguuucggggucuuuaccacgaauaucuggcugaaacuucgcgaaguguacacacaguugugugaccauagacucaugucagccgcuguuaaggaugagagggccgugcacgcagacaugggauacuggauugagagucagaaaaacggcagcuggaagcuggaaaaagcgucccuaaucgagguaaagaccugcacuuggcccaagucucacacccuguggucgaaugguguccucgaaagcgauaugauaaucccuaaaucccuggccggcccaauuucacagcauaaccaccguccgggguaucauacacaaacugcuggacccuggcaccuuggcaaguuggagcuggacuucaauuacugcgaggggaccacaguggugaucacggaaaacuguggaacccggggcccuaguuuacgaacuacaaccgucucugguaaacucauucacgaguggugcuguagaagcugcacucugccaccccuuagguauaugggggaagauggauguugguacggcauggagauccgcccuauauccgaaaaggaggagaauaugguuaaaucacuggugagcgccgguucuggcaagguagacaacuuuacaauggggguguugugccucgcaauucuguucgaagaggucaugcggggaaaguucggcaaaaagcauaugaucgcuggggugcuauuuaccuguguucugcuccuguccggacagaucacguggagagauauggcccacacucuuauuaugaucggcaguaaugcaagcgacaggauggguaugggggugaccuauuuggcccugauugcuacauucaaaauacagccauuuuuagcgcucggauucuuucugcgcaagcuuaccucucgagaaaaccugcuacucggcgucggccuggccauggcaacuacauugcaacugcccgaggauaucgaacagauggggaauggaauugcuuuaggucucauggcccugaaacuuaucacccaguucgagacauaccagcuguggacugccuugauuucccucaccugcucaaacacgauguuuacacugaccguggcuuggcggacugcaacccuaauccuggccggcguuagucuucucccggugugucaaagcucguccaugcguaagacagacuggcugccuauggcggucgcugccauggggguaccacccuugccucuguucauauuuucuuuaaaggauacucucaaaagaaggagcuggccccugaaugagggagugauggcaguuggccuugugucaauccuggccaguuccuugcuccgcaacgacgucccaauggcugguccucugguggcagggggacuacugauugccugcuauguaaucaccggcacgucugcggaucuuacaguggaaaaggcugccgacauuaccugggaggaagaggcagaacagacuggcgucagccauaaccucaugaucacaguugacgaugacgggaccaugcggauaaaagaugacgagacugagaauauucugacaguguuguuaaagaccgcccugcucauccuguccggaguguuccccuacucaaucccagcuacgcuucuggucuggcacacuuggcagaaacagacccaaagaagcgguguguugugggauguuccgaguccucccgaaacacagaaggccgagcuagaagagggcguauacaggauuaaacagcaggggauauuuggaaagacccaagugggcgucggugugcagaaggaggggguuuuccauacaauguggcacgugacucgaggagcaguccugaccuauaacggcaaacgccucgaaccaaauugggcuucugugaagaaagaccugaucuccuacggcgggggauggcggcuuagcgcccaguggcaaaagggugaggaaguacaggucauugcgguggagcccggcaaaaacccuaagaauuuucagacgaugccagggacauuccagacuaccacaggagaaaucggcgccauugcauuagauuucaagcccgguaccucggggucaccuaucauaaacagagagggaaaaguugugggccuguauggcaauggggucgugacuaagaacggagguuacguuucuggcaucgcucaaaccaaugccgagccggacgggccaacacccgaacucgaggaagagauguuuaaaaagaggaacuugacgauuauggaucugcacccuggaaguggcaaaacucguaaguaucucccagcuaucgugcgcgaagcaauuaagcggagacugaggacccuuauccuggcccccacacgagucguggccgcugagauggaggaagcguugaaaggucuaccuauacgguaccagaccacugcaacaaaguccgagcauaccgggcgcgaaauuguagaccugaugugucacgccacguucacuaugagacucuuaagcccggugaggguucccaauuauaaccugaucaucauggaugaggcucauuuuacagacccagccucuauuggagcacggggcuacaucagcacccgagucggcaugggggaagccgcugcgauauucaugaccgccacuccucccggaacagcagaugcuuuuccacaguccaaugccccuauucaggacgaggagagagacauccccgaacgcucauggaacagugguaaugaguggauuaccgauuucgcaggcaaaacagugugguuugugccaagcaucaaggccgggaacgacauagcuaacugccuuaggaaaaauggaaagaaggucauucaacugucucguaaaacuuucgauacggaauaccagaagaccaaacucaacgacugggauuuuguagugacaacugacaucuccgagaugggcgccaauuucaaggcggaucggguuaucgacccgagaaggugcuugaaaccugugauucugaccgauggucccgagcgcgucauccucgcagggccaaugcccgugacagccgcuucagccgcucagcgaagaggccggguuggaaggaacccucagaaggaaaaugaccaauauauuuuuaccggccagccacugaacaaugaugaggaccacgcacauuggacugaagccaagaugcuucuagacaacauaaauacgcccgaggggaucauuccugcucuguucgaaccggagcgcgagaaaagugccgcaaucgauggagaauaccguuugaagggugagagcagaaaaaccuucguggaauuaaugcggaggggcgaccugccagucuggcucgcgcacaagguggccuccgaggggaucauuuauacagaucgcaaaugguguuuugacggacagcgaaacaaucagauacuggaagagaacauggauguagagaucuggacuaaggaaggcgagaaaaagaagcuuagaccccgguggcuggacgcuaggaccuacucugauccucucgccuugaaagaauucaaggacuuugcagcuggucgcaaaucgauugcccuggaucuagugacagagaucgggagaguucccagccaccuggcacauaggacccggaaugcccucgacaaccuugucaugcugcacacuucagaacauggcggacgugcuuaucgccacgcgguggaggaguuaccagaaacaauggagacguugcugcuccugggccuuaugauucugcucaccgggggagccauguuguuccugaucuccgguaagggcauagggaaaacuaguaucggauuaauuugcgugaucgcaucuagcggcauguccuggauggcugaaauuccucuacaauggaucgccucagccauaguccuggaguuuuucaugaugguucuccuuauucccgagccagaaaagcagcgaacaccucaggauaaucaacuggcauacgugguaaucgguauuuugacccuggcugccaucauagcggcuaacgagauggggcuccuggaaaccacaaagagagaccuuggcaugucuaaagagccgggaguggucagccccacuaguuaucucgauguggaccugcacccagccuccgcauggacguuguacgccguugcuaccacagugaucacuccuaugcugaggcauaccauugaaaauagcacagcaaacgucucuuuagccgcgaucgcuaaccaggccguagugcuaaugggccuggacaagggguggcccauuucaaaaauggaucucggaguuccacuucuggcauugggcuguuacucccaggugaauccucugacccucacugccgcuguccugcuuuuaaucacgcacuaugccauaauuggucccgggcugcaggcaaaggcuacacgggaggcccaaaaacgcaccgcggccggaaucaugaagaacccgacuguggacggcaucaugaccauugaucucgacccagucaucuacgauaguaaguuugagaaacaguugggucaggugaugcugcuaguucugugcgcagugcagcuccuucugaugagaacaagcugggcuuugugugaagcccugacucucgcaaccggcccuauaacaacgcugugggaggggucgcccggaaaguucuggaauaccacuauugcuguaucuauggccaacaucuuuaggggcuccuauuuagccggggcgggacuugcuuucagcauuaugaaaucagugggcacagguaagcgggggaccggaagucaaggcgaaacucugggugagaaauggaagaagaaacucaaucagcuaucucgaaaggaauuugaccuguacaaaaaguccggcaucacagaggucgauagaaccgaggcaaaagaaggguugaagcgcggagagauaacgcaucacgccguuagcaggggcucagcuaaacugcagugguucguggaacggaacauggucaucccagaggggcgugugauugaccucggaugcggcagagguggguggaguuauuacugugccggacuuaagaagguaaccgaagugaggggcuauacaaaaggcgggcccggacaugaggagccuguuccgaugagcacuuacgguuggaauaucgugaagcugauguccggcaaagaugucuuuuacuugcccccagaaaagugcgacacccugcucugugauauuggggagucuagcccuucccccacaguggaagagucacgcacuauccgggucuuaaaaaugguggagccuuggcugaagaacaaucaguucugcauuaagguucuuaacccauauaugcccaccguaaucgaacaccuggagcgacuacaaagaaaacacggaggcaugcucgugaggaauccucugucucgcaacaguacacaugaaauguacuggauaucgaaugguaccgggaacauugucgcaagcgugaauaugguuucccgguugcugcucaacagauucacuaugacgcaccguaggccaacaaucgagaaggacguggaucuuggagccggcacccggcaugucaacgcugaacccgagacuccgaauauggacgugaucggcgagcgcauuaaacgaauaaaggaagagcacaacucuaccuggcacuaugacgaugaaaauccuuacaaaacaugggcguaucaugggucauacgagguaaaggccacgggaagcgcauccaguaugaucaacggugugguuaagcuguuaaccaaaccaugggacgucgugcccauggugacucagauggcuaugacagauaccacuccuuuuggccagcaaagagucuucaaggaaaaaguugacacaaggaccccacggucuaugcccgggacacgcagagugaugggaauuacugccgaguggcuguggaggaccuugggccgaaauaagaaaccgcggcucuguacgcgugaggaauuuaccaagaagguaagaacaaacgcagccaugggugcuguguucacugaggaaaaucagugggauagcgccaaagcggcagucgaggacgaagauuuuuggaagcugguggaccgcgagagggagcuacacaaacuugggaagugcggaucaugcguuuauaacaugaugggcaaacgggaaaagaaacugggcgaguucgggaaggccaagggauccagagcuaucugguacauguggcucggugcccgcuaccuggaauuugaggcauugggcuuccugaaugaggaucauugguuuaguagggaaaacagcuauucugggguggagggagaaggccuccacaaacuugguuacauucugcgagacaucuccaagauaccugggggagcuauguaugccgaugacaccgcuggcugggacacacggaucacugaggaugacuuacauaaugaagagaaaauuacccagcagauggaucccgagcacagacaacuggccaacgcaaucuucaaguugacguaccagaauaaagucgugaagguacagaggccaacaccuaccggcacuguuauggacauuaucucacgcaaggaucagcgugggagcggacaaguggguacauauggccucaacaccuuuacuaauauggaagcgcagcugauacggcagauggagggggaaggaguccuaucgaaagccgaccuugagaacccccaccugccagaaaagaaaauuacccaguggcucgagacaaagggcguggagagacugaaaaggauggcuaucucuggugaugacuguguggucaagcccaucgaugaccgcuucgccaacgcauuguuagcucugaaugauauggggaagguucgaaaagacauuccucaauggcagccaaguaagggauggcaugauuggcagcaggugccguuuugcucccaccauuuccacgaacucauaaugaaagacggccggaagcuuguagugcccuguagaccucaagacgagcugaucggcagggcccgcauuagccagggggcaggauggucacuaagagaaacggccugccuggguaaagcguacgcucagauguggucccucauguauuuccaccggagggauuugcgucuggccucuaacgcaaucuguagcgccgucccagugcauuggguucccaccagucgaacuacaugguccauucacgcucaucaccaauggaugaccacugaggacaugcuuacaguguggaaucgcgucuggaucgaagauaacccuuggauggaggacaagaccccagugacgacaugggagaauguacccuaccugggcaagagagaagaucaguggugcgggagccucauaggauuaaccucucgggccacuugggcacagaacaucccuaccgcuauucagcaaguuaggucacugaucggcaaugaggaauuuuuggacuacaugccgaguaugaaacgcuucagaaaggaggaggaauccgagggugccauuugguga

SEQ ID NO: 15134 - RNA, 9873 nt, Artificial Sequence
  derived and/or modified CDS sequence (opt3) from DENV-3__JF808126__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaccuuacugaugcuugucacaccaucgaugaccaugcgcugugugggcguagggaacagagacuuuguugaaggauugucaggugccacguggguggaugucgugcuggagcacggcgggugcgugacuacaauggcgaagaauaaacccacccuagacaucgagcuccagaagacugaagcaacacaacuggccacccuuaggaaacuguguauugagggaaagaucacgaacauuaccacagauagccggugcccuacucagggcgaagcugucuugccagaggaacaggaccagaauuauguuuguaaacacaccuacguggaucgcgguugggggaacggaugcggccucuucggcaaggggagucugguaacaugcgccaaguuucaauguuuagagcccaucgagggaaaagugguccaguaugaaaaucugaaguacacugugauaauuaccguucauacaggugaccagcaccaggugggcaacgagacccaaggggucacugcagaaaucacgccucaggcuuccacaaccgaggccauucucccagaauauggaacucuuggccuggagugcucuccgcgaaccgguuuggacuucaaugagaugauccuacugacaaugaaaaacaaggcguggauggugcauagacagugguuucucgaucugccccuuccuuggaccagcggggccacuacagaaacgccaaccuggaauaggaaagagcuguugguaacuuucaagaacgcacacgcuaaaaagcaagaaguugugguccucggcucccaggagggagccaugcacacagcucugaccggcgccacagaaauccagaauucagggggaacuaguauuuuugcaggucauuuaaagugucggcugaaaauggacaagcuagagcucaaaggcaugagcuacgccaugugcaccaacacguucgugcugaagaaagaggucucugaaacccagcacgggacaauacuuaucaagguggaguacaagggagaagaugcucccuguaaaauuccuuuuuccacugaggacggccaagguaaggcgcauaacgggcguuugaucaccgcaaauccaguugugacaaaaaaggaggaacccguaaacauagaggccgaaccgccuuucggcgagucaaauauugucaucggaaucggcgauaacgcucugaaaauuaauugguauaagaaggggagcaguaucggaaaaauguucgaagccacugcacgcggugccagaaggauggcuauucucggcgacaccgccugggauuuugggucugugggaggcguucugaacucccuugguaagauggugcaccagauauucgggagcgcauacacggcgcuguuuucgggcgucucuugggugaugaaaaucggaauuggcguauugcucacauggaucgggcugaauuccaagaacaccucaaugaguuucagcugcaucgcuauuggaauaaucacuuuauaucugggcgccgugguucaggcagacauggguugugucauuaauuggaaagggaaggagcuaaagugcggauccggcaucuuugugacaaacgaggugcauaccuggacugaacaguacaaauuccaagccgauucucccaagcggcucgcuaccgccauugcaggugcuugggagaauggcgucugugggauccgaagcacaacgcgcauggaaaaccugcuuuggaaacagauagccaaugaguugaacuauauccugugggaaaauaacauuaagcucaccguuguggugggagacaucauuggcguacuggagcaggggaaaagaacuuuaacaccacagccuauggagcugaaguacucauggaaaaccuggggaaagaguaagaucgucacagcggaaacucaaaacuccagcuuuauaauugauggccccaauaccccagagugccccucugccucaagggcuuggaacgugugggaaguugaggacuaugguuucgggguguuuacgacaaauaucuggcuuaaauugcgggaagucuacacccagcucugugaccaccgccugaugagugcagccgugaaggaugagagagcuguucacgccgacaugggauacuggauugagagccagaaaaacggcuccuggaagcuagaaaaagcaucucugaucgaggugaagacuugcaccuggccuaagucgcauacacucuggagcaaugguguacuggaauccgauaugauaaucccaaaaucacuugcgggcccgauuagucagcacaaccauaggcccggguaucacacucaaaccgccggaccuuggcacuugggcaagcuggaguuagacuucaauuacugcgaggggacaacggucgugaucaccgaaaacuguggaacucguggcccagcucuccggacaaccacugugucugguaaacugauucaugaguggugcugucgaagcugcacacuucccccucugagauauaugggggaagauggauguugguacggcauggagaucaggccaauauccgaaaaggaggagaauauggucaaaucauugguuagcgccgguucuggcaagguggacaacuuuaccauggggguacucugccuggcaauucuauucgaagaggugaugcgcggaaaguuuggcaaaaagcacaugaucgcuggggucuucuucacguuugugcugcuccuguccggacagaucacuuggcgggauauggcccauacccuuauuaugaucggcaguaaugcaagcgacagaauggguauggggguuacauauuuggcccugauugcuaccuucaaaauacagcccuuuuuagcgcucggauucuuucugaggaagcuuacuucucgcgaaaaccugcuacucggcgugggccuggccauggcaacaaccuugcaacugccggaggauaucgaacagauggcuaaugggauugccuuaggacucauggcccugaaacuuaucacacaguucgagacuuaccagcuguggaccgcuuugauuucccucacguguucaaacacaauguuuacccugacugucgcauggcgaaccgccacacuaauccuggcgggugugagucuucucccuguuugccaaagcucguccaugcggaagacugacuggcugccaauggcuguggccgcaaugggcguccccccuuugccccuguucauauuuucuuuaaaggauacccucaaacguagaagcuguccacugaaugaggggguaauggccgugggacuuguuucaauccuggcuaguuccuugcucaggaacgacgugccuauggcaggcccccuggucgccggugggcuacugauugcgugcuaugugaucacgggaacaucugcugaucuuaccguagaaaaggccgcagacauuacuugggaggaagaggccgaacagacaggcgugagccacaaccucaugaucaccgucgacgaugacggcacuaugcgcauaaaagaugacgagacagagaauauucugaccguuuuguuaaagacggcucugcucaucguguccgggguguucccauacucaaucccggccacucugcuugucuggcauaccuggcagaaacagacacaacggagcggagugcugugggauguuccuagucccccagaaacccagaaggcagaguuggaagaggguguauacagaauuaaacagcagggcauauuugggaagacacaagugggagucggcgugcagaaggaggguguuuuccacacuauguggcacgugaccaggggggcuguccuaacguauaacggaaaacgacuggaacccaauugggccucugugaagaaagaccucguauccuacggcggcggguggcgccugagcgcgcaguggcaaaagggagaggaaguccaggugaucgccguugagccugguaaaaacccaaagaauuuucagacaaugcccggcacuuuccagaccacaaccggggaaauuggagcaaucgcucuugauuucaagccuggcacuucggguucaccgauuaucaaccgggaggggaaaguggucggauuauauggcaauggcgugguuaccaagaacgggggauacgugucugguauagcccaaacaaaugcugagccagacggccccacgccugaacuggaggaagagauguuuaaaaagagaaaccucacuaucauggauuugcauccagggaguggaaaaaccaggaaguaucugcccgcaauuguccgugaagccaucaagcgccggcucagaacacugauucuugccccuaccagggugguagcugcggagauggaggaagcacugaaaggcuugccgauccgauaccagacuacagccaccaaguccgagcacacgggucgggaaauaguggaccuaaugugucaugcuacuuucacaaugcgccugcucagccccguuagaguccagaauuauaacuuaauuaucauggaugaggcccacuuuaccgacccagcaucuaucgccgcuaggggguacauuagcacccgggugggaaugggcgaagcggccgcaaucuucaugacugcuacaccucccggcaccgccgaugcauuuccacaguccaaugccccuauacaagacgaggagcgagacauucccgaaagaucauggaacagugggaaugaguggaucacagauuucgcuggaaaaacugugugguuugucccaagcauuaaggccgguaacgacaucgcgaacugccugcgcaaaaauggcaagaagguaauacagcuuucuaggaaaacguucgauaccgaauaccagaagacaaaacugaacgacugggauuuugugguuacuaccgacauuuccgagaugggggcaaauuucaaggccgaucgugugaucgacccgcggagaugccucaaaccugucaucuugacagauggacccgagagggugauucuggcuggcccaaugcccguuaccgccgcuucagcagcccagcgccgagguagaguggggcggaacccucaaaaggaaaaugaccaguauaucuuuacuggccagccacucaacaaugaugaggaccaugcucacuggacggaagccaagaugcugcuugacaacauuaauacccccgagggaauaaucccugcacuauucgaaccggagagggagaaaagugcggccauugauggcgaauaccgccugaagggggagagccguaaaacauucgucgaauugaugagacggggagacuuaccaguguggcuggcucacaagguagccuccgaggguaucaaauauacugauaggcgcugguguuuugacggccagcgaaacaaucaaauccucgaagagaacauggauguggagauuuggaccaaggaaggggagaaaaagaagcugagaccccgguggcuugacgcaaggacauacucugauccucuggcucucaaagaauucaaggacuuugccgcaggacgcaaaucgauagccuuggaucugguuaccgagaucggcagaguccccagccaucuagcucacaggacucggaaugcgcuggacaaccucgugaugcuucauacaucagaacacggugggcgugccuaucgccacgcaguggaggagcugccagaaacgauggagaccuuauugcugcucggccugaugauucuucugacuggaggcgcuaugcucuucuugaucuccgggaagggaauugguaaaacaaguaucggccugauaugcgucaucgccucuagcgggauguuauggauggccgaaauuccucuacccuggaucgcauccgcuauuguucuggaguuuuucaugauggugcuccuuaucccagagccugaaaagcagcgaaccccgcaggauaaucaacuggccuacguagugauaggaauuuugacccuggcggcuaucauugccgcaaacgagaugggccuccuggaaacaacuaagagagaccuugguaugucaaaagagcccggggucgugucuccaacgagcuaucucgauguugaccugcauccugccagugcuuggaccuuguacgcaguggccacaacugucaucacccccaugcugaggcacacaauagaaaauuccaccgcgaacguaagcuuagcugccaucgcaaaccaggccgugguucuaaugggccuggacaagggauggccaauuucuaaaauggaucucggcgugccucuucuggcuuugggguguuacucacaggucaauccccugacucucacggccgcagugcugcuuuuaaucacacauuaugcuauuaucggaccgggccugcaggccaaggcgacccgggaggcccaaaaacgcacugcagcugguauaaugaagaacccaaccgucgacgggauuaugacaaucgaucucgacccugugaucuacgauuccaaguuugagaaacaguugggacagguuaugcugcuagugcugugcgccguacagcuccuucugaugagaacuaguugggcauugugugaagcucugacccucgccacaggccccauuacgacccugugggaggguagcccaggcaaguucuggaauacuacaaucgccgugucgauggcgaacauauuuagggggucuuauuuagcuggagcaggccuugccuucuccauuaugaaaagcgucgggaccggaaagcggggcacugguucacaaggggaaacacugggagagaaauggaagaagaaacucaaucagcuaagucgaaaggaauuugaccuguacaaaaagucuggcaucaccgagguugauagaacggaggcuaaagaagguuugaagcgcggcgagauuacccaccaugccguguccagggggagcgcaaaacugcagugguucgucgaacggaacauggugauccccgagggacguguaauagaccucggcugcgggagaggaggcuggucauauuacugugccggucuuaagaaggugacagaaguuaggggguauacuaaaggaggcccuggccacgaggagccggugcccaugaguaccuacggguggaauaucgucaagcugaugagcggaaaagauguguuuuacuugccaccugaaaagugcgacacacugcucugugauauuggugaguccucucccagcccuacugucgaagagucccgcaccauccggguguuaaaaaugguugagccauggcugaagaacaaucaguucugcauuaagguacuuaaccccuauaugccuacagugaucgaacaccuggagcgacuacaaagaaaacauggcgggaugcucgucaggaauccacugucacgcaacucuacccacgaaauguacuggauuaguaauggaacuggcaacaucguggcuucgguuaauauggugagccgguugcugcucaacagauucacgaugacacaucguaggcccaccauagagaaggacgucgaucuuggugcggggacucggcacgugaacgccgaaccggagaccccuaauauggacguaauuggagagcgcaucaaacgaaucaaggaagagcacaacuccacauggcauuaugacgaugaaaauccauacaaaacgugggcauaucacggcucuuacgaggugaaggcuaccggcucagccagcuccaugauuaacgggguugucaagcuguuaacuaaacccugggacguggugccuauggucacacagauggcaaugaccgauacuacaccauuuggacagcaaagaguuuucaaggaaaaaguggacaccaggacaccccggaguaugccggguacucgcagaguaaugggcauaaccgccgaguggcuguggaggacguuggggcgaaauaagaaaccucggcucuguacccgugaggaauuuacaaagaaggugagaacuaacgcugccaugggagcggucuucaccgaggaaaaucagugggauucugcaaaagccgcuguggaggacgaagauuuuuggaagcugguugaccgcgagagggagcuacauaaacuuggcaagugcgguagcugcguguauaacaugauggggaaacgggaaaagaaacugggagaguucggcaaggccaagggcucaagagcaaucugguacauguggcucggggcucgcuaccuggaauuugaggccuugggauuccugaaugaggaucacugguuuuccagggaaaacaguuauagcggugucgagggcgaagggcuccauaaacuuggauacauucugcgagacaucucuaagauucccggcggugcuauguaugccgaugacacagcagggugggacacucggaucaccgaggaugacuuacacaaugaagagaaaauaacgcagcagauggauccagagcacagacaacuggcgaacgccaucuucaaguugacauaccagaauaaagugguaaagguucagaggccuacccccacuggaacagugauggacauuaucucccgcaaggaucagcguggcucaggccaagucgggaccuauggacucaacacuuuuaccaauauggaagcucagcugauucggcagauggagggugaaggcgugcuaagcaaagccgaccuugagaacccacaucugcccgaaaagaaaaucacacaguggcucgagacgaaggggguggagagacugaaaaggauggcaauaucgggagaugacugugucguuaagccuauugaugaccgcuucgcuaacgccuuguuagcacugaaugauaugggcaaggugcgaaaagacaucccacaauggcagccgucuaaggguuggcacgauuggcagcagguacccuuuugcagucaucacuuccacgaacucaucaugaaagacgggcggaagcuuguggucccuuguagaccacaagacgagcugauuggaagggcccgcauaucccagggcgcgggcuggagccuaagagaaaccgcuugccuggggaaagccuacgcacagauguggucacucauguauuuccaucggagggauuugcgucuggccuccaacgcuaucuguucugccgugcccguucacugggugccuacuagccgaacaaccuggaguauucaugcacaccaucaauggaugacuacagaggacaugcuuaccgucuggaaucgcguguggaucgaagauaacccauggauggaggacaagacgcccguaacaaccugggagaauguuccuuaccugggaaagagagaagaucaguggugcgguucccucauuggcuuaacuagccgggcuaccugggcccagaacaucccgacagcgauacagcaagugaggucucugaucgggaaugaggaauuuuuggacuacaugccaucaaugaaacgcuucagaaaggaggaggaaagugagggagcuauuugguga

SEQ ID NO: 15135 - RNA, 9873 nt, Artificial Sequence
  derived and/or modified CDS sequence (opt3) from DENV-3__JF808125__SS-prME
accagccugugccucaugaugauccuucccgccgcucuggcauuccacuugaccucccgggacggcgagccuaggaugauugugggggaaaacgagcggggaaagucuuuacuguuuaagacugccucagguauaaaucgccgaacgcuaaucgcgauggaucucggcgaaaugugugaggaaaccgagacauacaagugcccacauauuacugaggucgaaccggaggacaucgauuguuggugcaaccugaccaguacauggguuaccuaugggacuuguaaucaggcuggagaacguagaagggacaagcggagcguggcccuugcaccccacguaggcaugggucuggauacacgcacccagacguggauguccgccgagggggcuuggcggcaaguggagaaggucgaaacuugggcauugaggcauccuggauucaccauucucgcccuguuucuggcucacuacaucggcacaucucucacucagaaagugguuauauucaucuuacugaugcuugugaccccaucgaugacaaugcggugcgucggcguggggaaccgcgacuuuguagagggauugucaggugccaccuggguugaugugguccuggaacauggcgggugugugacgacuauggcgaagaauaagcccacacuagacauugagcuccagaaaaccgaagcaacucagcuggccacacuucgaaagcugugcaucgagggaaaaauuaccaacaucacgaccgauagcagauguccuacacagggcgaggcuguguugccagaagaacaggaccagaauuaugucugcaagcacacuuacguugauagggguugggggaacggauguggccucuucggcaaagggagucuggugaccugcgccaaguuucaaugcuuagaacccauagagggaaagguagugcaguaugaaaaucugaaauacacagucauuaucacugugcacaccggugaccagcaucagguuggcaacgagacacaaggggugaccgcagagauuacuccucaggcuuccacgacagaagccauccucccagaguauggaacccuuggccuggaauguucuccgcggacugguuuggauuucaaugagaugauccuacugaccaugaagaacaaagcguggaugguccaccgucagugguuuuucgaccucccccugccuuggacaagcggggccaccgcagaaacuccaacauggaaucgcaaggagcuucuggugacguuuaaaaacgcucaugccaagaaacaagagguaguuguguugggcucccaggaaggagcuaugcacaccgcccucacuggcgcaacagagauucaaaauucagggggaaccaguauauucgccggucaccugaagugcagauuaaagauggacaaacuggaacuaaagggcaugagcuacgcuauguguacaaacacuuuuguccucaaaaaggaggugucugagacccagcaugggacgauccugauuaaagucgaauacaagggagaggaugcgcccugcaagaucccuuucuccaccgaagacggccaagguaaagcacacaacgggaggcuuauaacagccaauccagugguuacuaagaaagaggaacccgugaacauugaggcugagccgccuuucggcgaaucaaauaucguaaucggaauuggcgauaacgccuugaagaucaauugguauaaaaaggggagcaguauuggaaagauguuugaggcaaccgcccggggugcucgacgcauggccauacugggcgacacagcaugggauuucgggucugucggaggcgugcucaacucccuggguaaaaugguucaucagaucuuugggagcgcguacacugcucuuuucucgggcgugucuugggucaugaagauuggaaucggcgugcuguugaccuggaucgggcucaauuccaaaaacacgucaaugaguuuuagcuguauugccauaggaaucauuacacuguauuuaggcgcaguagugcaggccgacauggguugcguuaucaauuggaaggggaaagaacugaaguguggauccggcauuuucgucaccaacgaggugcacacuuggacagaacaguacaaguuucaagcugauucucccaaaagacuagccaccgcaaucgcuggugccugggagaauggcgugugcgggauaaggagcacuacccggauggagaaccuccuguggaagcagaucgcgaaugaacuuaacuauauuuugugggagaauaacaucaaacugacagucguugugggagacauuaucggcgugcucgaacaggggaagcgcacgcugaccccacagccuauggaguuaaaauacucauggaagacuuggggaaaagccaagauaguaacagcugaaacccaaaacaguuccuucauuaucgauggccccaauacaccagagugucccagcgcaucuagagccuggaacgucugggagguggaagacuaugguuuugggguuuucacuaccaauauuuggcugaaacuuagggagguguacacgcaguugugcgaucaucgucucaugucagcugccgucaaagacgaacgggcagugcacgcggacaugggauacuggaucgagagucagaagaacggcagcuggaaacuggagaaggccucccuaauagaaguuaaaacauguaccuggccuaagucucacacucuguggucgaauggugugcucgagagcgauaugaucauuccaaagucccuggcuggcccgaucucacagcauaaccaccgacccggguaucauacccaaacagccggaccuuggcaccuuggcaaauuggaacuggacuuuaauuacugcgaggggacuaccguagucauuacagaaaacugcggaacgagaggcccaaguuuaaggaccacuacagugucugguaagcucauccacgagugguguugccgcagcuguacccugcccccucuucgguauaugggggaggauggaugcugguacggcauggaaauaagaccaauuuccgagaaagaagagaauauggugaagucacuggucagcgcagguucuggcaaaguugacaacuucacuauggggguguugugucucgcuauccuguuugaagagguaaugaggggaaaguucggcaagaaacauaugaucgccgggguguucuuuacauucguccuacugcucuccggacagauuaccuggcgcgauauggcacacacgcugaucaugauuggcaguaaugccagcgaccgaauggguaugggggugacuuaucuugcuuugauagcgaccuuuaagauccagcccuuccuggccuuaggauuuuuccuccggaaacugacaucucgugagaaccuucugcuaggcguuggccucgcaauggcuaccacucugcaauugccggaagauauugagcagauggccaaugggaucgcccugggauuaauggcucucaagcugauuacacaguuugaaaccuaccagcuuuggacagcacugaucuccuugacuugcucaaacaccauguucacgcucacaguggccuggagaaccgcgacucugauacuagcuggugucagucugcuuccugugugucaaagcucguccaugaggaaaaccgacuggcucccaauggccguugcagccaugggcgugcccccucugcccuuguuuaucuucucucugaaggauacauuaaagcgccggagcuggccacucaaugagggggucauggcuguaggacuggugucaauucuugcaaguucccuguugagaaacgacguuccuauggccggcccccucguggcgggugggcugcuaaucgcuugcuaugucauuacuggaaccucugccgaucugacgguggaaaaagcagccgacaucacaugggaggaggaagcugagcagaccggcguaagccauaaccuuaugauaacuguggaugacgacggcacaaugaggauuaaggaugacgaaaccgagaauauccucacuguccuguugaaaacagccuuacugaucguuuccgggguguuuccauacucaauuccggcaacccuccugguguggcacacguggcagaagcagacucaacgaagcggaguccuuugggaugugccuagucccccagagacccagaaagcugaacuggaggaagguguuuaccgcauaaagcagcagggcaucuucgggaaaacacaaguaggagugggcguccagaaggaggguguguuucauaccauguggcacguuacaagaggggccguguugacuuauaacggaaagagacuagaacccaauugggcgucugucaaaaaggaccugauuuccagcggcggcggguggaggcucucggcccaguggcaaaaaggagaggaggugcagguaaucgcagucgaaccugguaagaaccccaagaauuuccagaccaugcccggcacguuccagacaacuaccggggagauuggagcuaucgcccuggauuuuaagccuggcacaucagguucuccgauaaucaaccgugaagggaaggugguuggacuuuacggcaauggcguggucaccaaaaacgggggauaugugagugguauugcucaaacuaaugcagagccagacggccccaccccugaauuagaggaggaaauguucaagaaacgcaaccugacaaucauggaucuccacccaggguccggaaagacgcggaaauacuugcccgccauuguuagagaggccaucaagaggcgacugcggacucucauacuggcuccuacccgcguggucgcggcagaaauggaggaagcccuuaagggccugccgauuagauaucagacaaccgcuacuaaaagcgagcauacagguagggagaucguggacuugaugugucacgccaccuuuacgaugcggcuacugucucccguacgagugccaaauuacaaccucaucauuauggaugaagcacauuucacugacccugccagcaucgcugcgagaggguauauauccacacgcguuggaaugggcgaggccgcagcuauuuuuaugaccgccacaccaccaggcacugcagaugccuucccucagucaaaugcucccauccaggacgaagagagggauauuccagagcguaguuggaacagcgggaaugaauggaucacagacuuugccggaaagaccgucugguucgugccgucuauaaaagcggguaacgacauugcaaacugcuuacggaagaauggcaaaaaggugauccaacuguccagaaagacauuugauacugaguaccagaaaacgaaacuuaacgacugggauuucgucguaaccacagacaucucagaaaugggggccaauuuuaaagcugauagggugauugacccucgccgaugucugaagcccguuauccucacugauggaccagagagagugauuuuggccggccccaugccugucaccgcugcaagugccgcucagcggaggggucgcguggggcguaacccacagaaagaaaaugaccaauacauauucacaggccagccccugaacaaugaugaggaccacgcccauuggaccgaggcaaagaugcuccuggauaacaucaauacuccugaaggaauuaucccggcgcuuuucgagccagaaagagaaaagagcgccgcuaucgacggcgaauaucggcuaaaaggggaguccaggaagacguuuguugagcugaugcgccgaggagacuugcccgugugguuagcccacaaagucgcaucugaagguauuaaguacaccgauagaaaauggugcuucgacggccagcggaacaaucagauacuggaggaaaacauggauguggagaucuggacaaaggaaggggagaaaaagaagcucaggccucgcuggcuggacgcuagaacuuauucggauccccuugcccugaaagaguuuaaggacuucgcagccggaaggaaaagcauugcucucgauuugguaaccgaaaucggccgggugccaucacaccuggcgcaucguacacgcaaugcccuagacaaccugguuaugcuccacaccuccgagcauggugggcgagcauacagacacgcugucgaagaacuuccugagacuauggaaacacuguuauugcugaggcucaugauucugcuuacgggcggagccaugcuguuucucaucaguggcaaggggauaggaaaaaccucuaucgguuugauuugcgugaucgccagcuccggcaugcuguggauggcagagauucccuuacaauggaucgcuucagccauagugcuagaguucuuuaugaugguccugcucauuccagagccugaaaagcagcggacuccgcaggauaaucaacuugcguauguugugaucgggauucugacauuggcugccaucauagcagccaacgagaugggacugcucgagaccaccaagcgcgaccugggcaugucuaaagaacccgguguagugagcccaacaaguuaccuugaugucgaccuccacccugcuuccgcauggacucuguaugccguggcgacgaccguuaucacacccauguugagacauacuauugagaauagcaccgcuaacgugucucuggccgcaaucgccaaccaggcugucguauuaauggggcuagauaagggcuggccaauuucaaaaauggaccugggagugccucuccuugcccugggcuguuacucccagguuaaucccuugacacugaccgcagcugugcuccugcuuaucacucacuacgccauaauugggccgggauuacaggcgaaggccacgagggaagcacaaaaacggacagcugccggcaucaugaagaacccaaccgucgacgguaucaugacuauugaucuggacccugugaucuaugauaguaaguucgagaaacagcucgggcaggucauguugcuggugcuaugcgcaguucagcugcuccuuaugcgaaccagcugggcucugugugaagccuugacacuggccacuggacccauaaccacacucugggagggcucgccagguaaguuuuggaauacgaccauugcggugucuauggcuaacaucuucagaggcuccuaccuggcaggggccggauuagcuuuuagcauuaugaaaucaguaggcacugggaagcgcggaacaggcagucaaggugagacccuuggggaaaaauggaagaagaaacugaaucagcucucuaggaaggaguucgaccuauauaaaaaguccggaaucacugaaguggaucggacagaggccaaagaaggccugaagcguggugagauaacccaucacgcagucagcagaggcucagccaaauugcagugguuuguugagaggaacauggugauccccgaagggcgcgucauugaccugggaugcggcagagggggauggaguuacuauugugcuggccucaagaaggugacggagguacgagguuacaccaaagggggaccuggccaugaggaaccggugcccaugagcacauauggcuggaauaucguuaaacuuauguccgggaaagauguguucuaccugccaccugagaagugcgacacuuugcugugugauauuggagaaucuagccccuccccuaccgucgaggaaucaagaacaaucagggugcucaaaauggucgagccaugguuaaagaacaaucaguucugcauuaaggugcugaaccccuacaugccuacuguuaucgaacaccuugagcgccugcaacggaaacacgguggcaugcuaguaagaaauccacucucucguaacaguacccaugagauguauuggauaucgaaugggacaggaaacauuguggcgagcgucaauaugguguccaggcuguugcugaaccgguuuaccaugacucaccgccgacccacgaucgaaaaggacguugaucucggcgccgguacaagacaugugaacgcagagccggaaaccccuaauauggacgucaucggggagaggauuaaacggauaaaggaggaacacaacucuacuuggcacuacgaugacgagaauccauauaaaaccugggcuuaccauggaucauaugaagugaaggccacaggcagcgcauccaguaugaucaacggcguagugaaacuucugacgaaacccugggacguugucccuauggugacccagauggccaugacugauacaaccccauucgggcagcaacgcguguuuaaggagaaagucgacacuagaacacccaggucuaugccgggaacccgacggguuauggguauuacagcugaaugguuauggcguacucugggcagaaauaagaaaccucgcuuguguaccagggaggaguucacgaagaaggugcggaccaacgccgcgaugggggcaguauuuacagaggagaaucagugggauagcgccaaagcugccguggaagacgaggauuucuggaagcucgucgacagagaacgcgagcugcacaaacuaggaaagugcggcucauguguguacaacaugauggguaaaagggagaagaaacuuggggaauuuggaaaggcaaagggcucccgagcuaucugguauauguggcugggcgcccgguaccucgaguucgaagcucugggguuuuugaaugaggaucauugguucaguagagaaaacagcuacucuggaguugagggugagggccugcacaaacucggguauauucuuagggacaucuccaagauacccggaggcgccauguacgcagaugacacugcggguugggauacccgcaucacagaagacgaccugcauaaugaggagaagauuacucagcagauggauccagagcaccgucaauuagccaacgcuaucuuuaagcugaccuaucagaauaaaguggucaaggugcagcggccuacgcccacagggaccguaauggacauuaucucaagaaaggaucagaggggaagcggccaaguuggcacuuacggguugaacacauucaccaauauggaagcccagcucauacgccagauggagggagagggugugcugucgaaagcagaccuagaaaacccacaccuucccgagaagaaaauuacucaguggcuggaaaccaagggcgucgagcgacucaaacggauggcuaucucuggggaugacugcguggugaagccuaucgaugacagauuugccaacgcacuguuggccuuaaaugauaugggaaaggucaggaaagacauuccacaauggcagccgaguaagggcuggcaugauuggcagcagguucccuucugcucccaccauuuccacgaacugauaaugaaagacggucgcaagcucgugguaccuuguagaccacaagaugagcuuaucgggcgggcgaggauuagccagggagcuggcuggucacugcgugagacagccugccuaggcaaagcauaugcccagauguggucccugauguacuuucaccgacgcgaccucagauuggcuucuaacgccaucuguagcgcagugcccguccauugggugccuacgagucggaccacuugguccauucacgcucaucaccaauggaugacaaccgaagacaugcugacuguuuggaauaggguguggaucgaggauaacccauggauggaagacaagacacccgucaccacgugggagaaugugccuuaucuugggaagcgcgaggaucaguggugcggaagccugauaggucucacaucuagagccaccugggcgcagaacaucccgacugcuauucagcaaguacggucauuaaucggcaaugaagaguuccuggacuacaugccaaguaugaaaagguuucgaaaggaagaggaauccgagggggccauuugguga

SEQ ID NO: 15136 - RNA, 9873 nt, Artificial Sequence
  derived and/or modified CDS sequence (opt3) from DENV-3__JF808129__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucagaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagaugcucccuguaaaaucccuuucuccacagaggacggccaagguaaggcgcauaacgggcgucuuauaacugcaaauccaguugugaccaaaaaggaggaacccguaaacauugaggccgaaccgccuuucggcgagucaaauaucgucaucggaauuggcgauaacgcuuugaaaaucaauugguauaagaaggggagcaguauuggaaaaauguuugaagccacagcacgcggugccagaaggauggcuauacugggcgacacugccugggauuucgggucugugggaggcguucucaacucccuggguaagauggugcaccagaucuuugggagcgcauacaccgcgcuuuucucgggcgucucuugggugaugaaaauuggaaucggcguacuguugacguggaucgggcucaauuccaagaacacaucaaugaguuuuagcugcauugcuauaggaaucauuacccuguauuuaggcgccgugguucaggcagacauggguugugucaucaauuggaaagggaaggagcugaagugcggauccggcauuuucgugacuaacgaggugcauacauggaccgaacaguacaaauuucaagccgauucucccaagcggcuagcuacugccaucgcaggugcuugggagaauggcgucugugggauacgaagcaccacacgcauggaaaaccuccuguggaaacagaucgccaaugagcuuaacuauauuuugugggaaaauaacaucaagcugacgguuguggugggagacauuaccggcguacucgagcaggggaaaagaacucugacaccacagccuauggaguuaaaguacucauggaaaaccuggggaaaggcgaagaucgucacagccgaaacucaaaacaguuccuucauaauugauggccccaauaccccagagugccccagcgcuucuagggcauggaacgugugggaaguugaggacuaugguuuugggguguucacgacaaauaucuggcugaaacuucgggaagucuacacccaguugugugaccaccgccucaugucagccgcugugaaggaugagagagccguucacgcagacaugggauacuggauugagagucagaaaaacggcagcuggaagcuggaaaaagcgucccuaaucgaggugaagacuugcaccuggccuaagucucauacacuguggucgaaugguguacucgaaagcgauaugauaaucccaaaaucccuggccggcccgauuucacagcacaaccauaggcccggguaucacacucaaaccgcuggaccuuggcaccuuggcaaguuggagcuggacuuuaauuacugcgaggggacaacggucgugaucaccgaaaacuguggaacucguggcccaaguuuacggacaaccacugugucugguaaacucauucaugaguggugcugucgaagcugcacacugcccccucuuagauauaugggggaagauggauguugguacggcauggagaucaggccaauauccgaaaaggaggagaauauggucaaaucacugguuagcgccgguucuggcaagguggacaacugcaccauggggguauugugucucgcaauucuguucgaagaugugaugcgcggaaaguuuggcaaaaagcacaugaucgcuggggucuucuucacguuugugcuacugcucuccggacagaucacuuggcgggacauggcccauacccugauuaugaucggcaguaaugcaagcgauagaauggguauggggguuacauaucuugccuugauugcuaccuucaaaauacagcccuuucuggcguuaggauucuuucucaggaagcugacuucucgcgagaaccuucugcuaggcgugggccucgccauggcaacaacccugcaauugccggaagacaucgagcagauggcuaaugggauugcccugggauuaauggcccucaaacugaucacacaguucgaaacuuaccagcuuuggaccgcucugauuuccuugacgugcucaaacacaauguuuacccucacugucgcauggcgaaccgccacacugauccuagcgggugugagucugcuuccuguuugucaaagcucguccaugcggaagacugauuggcucccaauggcuguggccgcaaugggcguccccccucugcccuuguucauauuuucucugaaggacaccuuaaaacguagaagcuggccacucaaugaggggguaauggccgugggacugguuucaauccuugcuaguucccuguugaggaacgaugugccuauggcaggcccccucgucgccggugggcugcuaauugcgugcuaugugaucacgggaacaucugcugaccugaccguagagaaggccgcagacauuacuugggaagaggaagccgagcagacaggcgugagccacaaccuuaugaccacugucgaugacgauggcacaaugcgcaucaaagacgaugaaaccgagaauauacucacgguucuguugaagacugcuuuaaccauuguguccgggguguucccauacucaaucccggccacacugcucgucuggcauaccuggcagaaacagacacaacggagcggagugcugugggacguuccuagucccccagagacucagaaggcagaacaggaggaagguguauacagaaucaaacagcaaggcauuuuugggaagacccaggugggagucggcgugcagaaggaggguguuuuccacacgauguggcacgugacaaggggggcuguccuuacuuauaacggaaaacgacuggagcccaauugggccucugugaagaaagauuugauauccuacggcggcggguggcgccuaagcgcgcaauggcagaagggagaagagguacaggucaucgccguggaaccugguaaaaacccaaagaauuuucagaccaugcccggcacauuccaaaccacuaccggggagauuggagcaaucgcucuggacuucaagccuggcacaucggguucaccgauuaucaaccgggaagggaaaguugugggacucuauggcaauggcgucgugacgaagaacgggggauacguuucugguauagcccagacuaaugcugagccagauggccccaccccugagcuggaagaggaaauguuuaaaaagagaaaccuuacaaucauggacuuacauccagggaguggaaaaaccaggaaguaucugcccgcaauugugcgugaggccaucaagcgccggcucagaacuuugauucuggccccuacaagggucguggcugcggaaauggaggaggcacucaaaggccugccgauccgauaccagaccacggccacuaaguccgaacacacaggucgggagauaguagaucuuaugugucaugcuaccuucaccaugcgccuguugagccccgugagaguuccaacuuauaaucuaauuaucauggacgaagcccacuuuacagauccugcaucuaucgccgcuaggggguacauuagcacccgggucggaaugggcgaggcggccgcaaucuucaugacagcuacucccccaggcacggccgacgcauuuccucaguccaacgcccccauacaagacgaagagcgagauauuccagagagaucauggaauagugggaacgaauggaucaccgacuucgcuggaaaaacagugugguuugugccgagcauuaaggccgguaaugauaucgcgaacugccugcgcaaaaacggcaagaaggucauacagcucucuaggaaaacuuucgacaccgaguaccagaagacaaaauuaaaugauugggacuuuguagugaccacugauauuuccgaaaugggggcaaacuucaaggccgaccguguuaucgauccucggagaugccugaaacccgugauccuuacggacggaccagagagggucauucuggcuggccccaugccugugaccgccgcuucagcagcccagcgccgagguagaguugggcggaauccacaaaaggagaacgaucaguauaucuuuacaggccagccccucaauaacgacgaagaccaugcucacuggacugaggccaagauguugcuggauaauauuaacaccccugaaggaauaaucccggcacucuucgagccagaaagggagaaaagugcggccauugacggcgaguaccgccugaagggggaaagccguaaaacauucguggagcuuaugagacggggagaucuacccgucuggcuggcucacaagguggccuccgaagguaucaaauauaccgacaggaagugguguuuugauggccagcgcaauaaccaaaucuuggaggaaaauauggacguagagauuuggacuaaagagggggaaaagaagaaauuacgaccuagauggcuggaugcacggacauacucugacccccucgcucugaaggaguucaaagauuuugccgcaggaaggaagucgauagcccuugaccuggugacggaaaucggccgcguuccaagccaucucgcucacagaaccaggaacgcguuggauaaucuggucaugcuacauacuucagagcacggugggcgggccuaucgucacgcaguggaagagcugccugagacaauggaaacccuccuucuguuaggcuugaugauucugcucaccggaggcgcuaugcuguuccuuaucuccgggaaaggaauugguaagacaaguaucggccugauaugcgugaucgccucuagcgggaugcucuggauggccgagauucccuugcaguggaucgcauccgcuauuguccuggaauuuuucaugaugguuuuacuaaucccagagccugagaagcagcgcacuccgcaagacaaccagcuggccuacgugguaauaggaauucucacgcuugcggcuaucauugccgcaaaugaaaugggccuguuggagaccacaaaacgagaucuggguaugucaaaggaacccgggguggucucuccaacuagcuaucucgacguggaccugcauccugccagugcuuggacccuuuacgcaguugccacaaccgugaucacucccaugcucagacacacgauagagaacuccacagcgaaugucagccuggcugccaucgcaaaccaggccguaguguugaugggccuggauaaaggauggccaauuucuaagauggacuuaggcguuccucuacuggcucucggguguuacucacaggugaacccccuuacccugacugccgcagucuugcugcucaucacccauuaugcuauuaucggaccgggccugcaagccaaagcgacaagggaagcccagaagcggacugcagcugguauaaugaagaauccaaccguggaugggauuaugacaaucgaccuugauccugucaucuacgacuccaaauuugagaagcaguuaggacaggugaugcugcucguuuugugcgccgugcaacugcuacugaugcgcacgaguugggcacucugugaggcucuuacccuggccacuggccccauuacaaccuugugggaagguagcccaggcaaauucuggaacacuacaaucgccguaucgauggcgaauauauuuagagggucuuaucuggcuggagcaggccucgccuucuccauuaugaagagcguggggaccggaaaaaggggcacggguucacagggggagacccugggagaaaaguggaagaaaaaguuaaaccagcuuagucggaaagaguuugaucuguacaagaaaucuggcaucacagaagucgaccgaacugaggcuaaggagggucucaaaagaggcgaaauuacccaccaugccguuucccgcgggagcgcaaagcuacagugguucguggagaggaauauggucauccccgaaggacgggugauagaucugggcugcgggcguggaggcuggucauauuacugugccgguuugaagaaaguaacagaggugagaggguauacuaagggaggcccuggccacgaagagccgguucccaugaguaccuacggguggaacaucgugaaacugaugagcggaaaggacgucuuuuaccucccaccugagaaaugcgauacacuucugugugacauuggugaauccucucccagcccuaccguggaggaauccaggacuauccgcgucuugaagaugguggagccauggcugaagaauaaccaauucugcauuaaaguucucaaucccuauaugccuacgguaaucgagcacuuagaacggcugcagcgaaagcauggcgggaugcuugugagaaacccacugucaaggaauucuacacacgagauguacuggauuaguaacggaaccggcaauaucgucgcuucggugaacaugguuagccgccuacuccugaaucgguucacuaugacccauagacgucccacaauagaaaaagauguggacuugggugcggggacgaggcacgucaacgccgagccggaaaccccuaacauggacgugauuggagagcggaucaagcgcacuaaagaggaacacaauuccacauggcauuaugaugacgagaacccauacaagaccugggcauaucacggcucuuacgaaguaaaggcuacuggcucagccagcuccaugaucaauggggugguuaaacugcucacaaagcccugggaugucgugccuauggugacccagauggcaaugacagacacuaccccauuuggacaacagcgagucuucaaagagaagguugauacgagaacccccaggaguaugccggguacacggcgcgugaugggcauuacugccgaauggcuuuggagaacccuggggaggaacaaaaagccucgauuauguacacgggaggaguuuacuaagaaaguacguaccaaugcugccaugggagcgguguucacggaagagaaccagugggacucugcaaaggccgcugucgaagaugaggacuuuuggaaacugguggauagagaacgcgaguugcauaagcucggcaaaugcgguagcugcguuuauaauaugauggggaagagggagaaaaagcugggagaauucggcaaggccaaaggcucacgggcaauaugguacauguggcuaggggcuagauaccuugaguuugaagcccugggauuccucaacgaggaccacugguuuucccgcgagaauaguuauagcgguguggaaggcgaggggcugcauaaguugggauacauccugagggauauuucuaaaauccccggcggugcuauguaugccgacgacacagcagggugggauacccgaauuacugaagacgaucuccacaacgaggaaaagaucacacagcaaauggacccagagcaccggcagcuugcgaaugccauauucaaacugaccuaccagaacaaggucgugaagguacagagaccuacucccaccggaacaguuauggauaucauuuccaggaaagaccaacgcggcucaggccagguggggacguauggauuaaauaccuuuacuaacauggaggcucagcugauccgucagauggaaggugagggcgucuugagcaaggccgaucucgaaaauccacaucugcccgagaaaaagauuacacaauggcuagaaaccaaagggguggagcggcuuaagagaauggcaaucucgggagacgauuguguggucaagccuauagacgauagguucgcuaacgcccugcucgcacugaacgacaugggcaaaguucgcaaggauauuccacaguggcagccgucuaaagguuggcacgacuggcagcaagugcccuuuugcagucaucacuuccacgaguugaucaugaaggacgggcgaaaauuaguagugccuugucggccacaggaugaacugaucggaagagccaggauuucccagggcgcgggcuggagccuccgcgagacugcuugccuugggaaggccuacgcacaaauguggucacugauguauuuccauagacgggaccuaaggcuggccuccaaugcuauauguucugccguccccgugcacuggguuccuacaagccguaccacguggaguauccaugcacaccaucaguggaugacaaccgaagauaugcucacuguguggaaccgagucuggauugaggacaauccauggauggaagauaagacccccgugacaacuugggagaacguaccuuacuugggaaaacgcgaggaccaguggugcgguucccugaucggccuuaccagcagagcuacaugggcccagaauauuccgacggcgauccaacagguucggucucugauagggaacgaagaguuucucgauuacaugccaucaaugaagagguuccgcaaagaagaggagagugaaggagcuaucugguga

SEQ ID NO: 15137 - RNA, 9873 nt, Artificial Sequence
  derived and/or modified CDS sequence (opt3) from DENV-3__JF808123__SS-prME
accagccugugccucaugaugauccuucccgccgcucuggcauuccacuugacuuccagagacggcgagccuaggaugauuguggggaagaacgaacgggguaagucuuuacuguuuaagacugccucagguauaaauauguguacgcuaaucgcgauggaucucggcgagaugugcgacgauaccgucacauacaaguguccacauauuacugaaguugagccggaagacaucgauugcugguguaaccugaccaguacaugggugaccuaugggacuugcaaucaggcuggggagcgccgacgugacaagagaagcgucgcccuugcaccccacgugggcaugggucuggauacaaggacccagacguggauguccgccgagggggcuuggcggcaggucgaaaaaguggagacuugggcauugcgccauccuggauucaccauucucgcccuguuucuggcucacuacaucggcacaucucucacucagaagguugugauauucaucuuacugaugcuugucaccccaucgaugacaaugagaugugugggcguagggaacagggacuuuguugaaggauugucaggugccaccuggguggaugucgugcuggagcauggcgggugcgugacgacuauggcgaagaauaaacccacacuagacauugagcuccagaagaccgaagcaacucaccuggccacacuucggaaacuguguaucgagggaaagauuaccaacaucacgaccgauagccgcugcccuacacaaggcgaagcugucuugccagaggaacaggaccagaauuauguuuguaaacacacuuacguggaucgagguugggggaacggaugcggccucuucggcaaggggagucugguaaccugcgccaaguuucaguguuuaggacccauagaggguaaagugguccaauaugagaaucugaaguacacagugauuaucacuguucauaccggcgaccagcaccagguggggaacgaaacacagggagucaccgcagagauuacuccucaggcuuccacgacagaagccauccucccagaguauggcacccuuggucuggaaugcucuccgagaacuggguuggacuucaaugagaugauccuacugaccaugaaaaacaaggcguggauggugcauaggcagugguuuuucgaucucccccugccuuggacaagcggcgccaccacugagacaccaacguggaaucggaaagaacuucugguaaccuuuaagaacgcacacgcuaaaaagcaggagguuguggucuugggaucccaagaaggcgccaugcacacugcucucacaggggccaccgagauucaaaauucaggagguacaaguauauucgcaggccaucugaagugucguuuaaaaauggacaagcuggaacuaaaagggaugagcuacgccaugugcacuaacaccuuugugcucaagaaagaggucucugagacgcagcacggaaccauccugauuaagguggaauacaagggcgaggaugcucccuguaaaaucccuuucuccacagaagacggucaggggaaggcgcauaacggccgccuuauaacugcaaauccaguugugaccaaaaaggaggagcccguaaacauugaagccgagccgccuuucggagaaucaaauaucgucaucggcacaggggauaacgcuuugaaaauuaauugguauaagaagggaagcaguaucgguaaaauguuugaggccacugcaagaggcgccaggcggauggcuauucugggggacaccgccugggauuucggaucugugggcgguguucucaacucccuggggaagauggugcaccaaauauuuggcagcgcauacacggcgcuuuucucgggagucucuugggugaugaaaaucggcauugggguacuguugacauggaucggacucaauuccaagaacaccucaaugaguuuuagcugcaucgcuauuggcauaaucacucuguauuuaggugccgugguucaggcagacauggggugugucauuaauuggaaaggaaaggaacugaagugcggcuccgguaucuucgugacaaacgaggugcauaccuggacugagcaguacaaauuucaggccgauucucccaagcgacuagcuaccgccauugcaggcgcuugggaaaauggggucuguggaauccgcagcacaacgagaauggagaaccuccuguggaaacaaauagccaaugaacuuaacuauaucuugugggagaauaacauuaagcugaccguuguggugggcgacaucauugggguacucgaacagggaaaaaggacucugacaccacagccuauggaguuaaaguacucauggaaaaccuggggcaaggcgaagaucgucacagccgagacucagaacaguuccuucauaauugauggucccaauaccccagaaugccccagcgcuucucgggcauggaacgugugggagguugaagacuauggguuuggaguguucacgacaaauaucuggcugaaacuucgcgaggucuacacccaauugugugaccacagacucaugucagccgcugugaaggaugaaagggccguucacgcagacaugggcuacuggauugagagucagaaaaacgguagcuggaagcuggagaaagcgucccuaaucgaagugaagacuugcaccuggccuaagucucauacacuguggucgaauggcguacucgagagcgauaugauaaucccaaaaucccuggccgggccgauuucacagcacaaccaucgucccggauaucacacucagaccgcuggcccuuggcaccuugggaaguuggaacuggacuuuaauuacugcgagggaacaacggucgugaucaccgagaacuguggcacucgggguccaaguuuacgaacaaccacugugucugggaaacucauucaugaauggugcuguagaagcugcacacugcccccucuuagguauaugggagaggauggcuguugguacgguauggaaauccgcccaauauccgagaaggaagagaauauggucaaaucacugguuagcgccggcucugggaagguggacaacuucaccaugggaguauugugccucgcaauucuguuugaggaagugaugcggggcaaguucgggaaaaagcacaugaucgcuggagucuucuuuacguucgugcuacugcucuccggccaaaucacuuggagagauauggcccauacccugauuaugaucgguaguaaugcaagcgacaggauggggaugggaguuacauaucuugccuugauugcuaccuuuaaaauacagcccuuccuggcguuaggcuuuuuccuccgcaagcugacuucucgagagaaccuucugcuaggcguggggcucgccauggcaacaacccugcaguugccggaagauaucgagcaaauggcuaauggaauugcccuggguuuaauggcccucaaacugaucacacaguuugaaacuuaccagcuuuggaccgcucugauuuccuugacguguucaaacacaauguucacccucacugucgcauggcggaccgccacacugauccuagcgggcgugagucugcuuccuguuugccagagcucguccaugcguaagacugacuggcucccaauggcuguggccgcaauggggguacccccucugcccuuguuuauauucucucugaaggauaccuuaaaaagaaggagcuggccacucaaugagggaguaauggccgugggccugguuucaauccuugcuaguucccuguugcgcaacgacgugccuauggcagguccccucgucgccgggggacugcuaauugcguguuaugugaucacgggcacaucugcugaucugaccguagagaaggccgcagacauuacuugggaagaggaagccgagcaaacaggcgugagccacaaccuuaugaucaccgucgacgaugacgggacuaugcggauaaaagaugacgaaacagagaauauucucaccguucuguugaagacggcuuuacugaucguguccggaguguuuccauacucaaucccggccacucuccuggucuggcauaccuggcagaaacagacacagagaagcggugugcuuugggauguuccuagucccccagagacccaaaaggcagaacuggaggaaggcguauacaggauuaaacagcaggggauauucggaaagacacaggugggcgucggugugcaaaaggaggggguuuuucacacuauguggcacgugacccgaggagcugucuugacguauaacggcaaacgccuagagcccaauugggccucugugaagaaagaccugaucuccuacggcgggggauggcggcucagcgcgcaguggcagaagggugaagagguacaagucauugccguggaaccuggcaaaaacccaaagaauuuccagacaaugcccgggacuuuccagaccacaaccggagagaucggcgcaauugcucuggauuuuaagccugguacuucggggucaccgaucauaaacagagaaggaaaaguugugggccuuuauggcaauggggucgugaccaagaacggagguuacguuucuggcaucgcccagacaaaugcugagccagacgggcccacgccugaguuagaagaggaaauguucaaaaagaggaaccugacuauuauggaucuccauccaggaaguggcaaaacccguaaguauuugcccgcaaucgugcgcgaggccauuaagcggagacugaggacacucauccuggccccuacccgagucguggcugcggaaauggaggaggcacuuaaaggucugccgauacgguaccaaacuacagccaccaaguccgaacacacggggcgcgagauuguagacuugaugugccaugcuacuuuuacaaugagacuacugagccccgugaggguuccaaauuauaaccucaucaucauggaugaagcccacuucaccgacccugcaucuauugccgcucggggauacaucagcacccgagucggcaugggcgaggcggccgcaauauuuaugacugcuacacccccagggaccgccgaugcauucccucaguccaaugcccccauucaggacgaagagagagacaucccagagcgcucauggaacaguggaaaugaauggauuacagauuuugcugguaaaacugugugguucgugccgagcaucaaggccggcaacgacauagcgaacuguuuaaggaaaaaugggaagaaggucauucagcugucucguaaaacguuugauaccgaguaccaaaagacaaaacuuaacgacugggauuucguagugacuaccgacaucuccgaaaugggagcaaauuuuaaggccgaucggguuaucgacccuagaaggugccugaaacccgugauucucacagauggcccagagcgcgucaucuuggcuggucccaugccugugaccgccgcuucagcagcccagcgaagagggcggguuggcaggaacccacagaaggagaaugaccaguauauuuucacuggacaaccccugaacaaugaugaagaccaugcucacuggacggaggccaagaugcuccuggacaacauaaauaccccugaaggcaucauuccggcacuuuucgagccagaacgcgagaaaagugcggccaucgauggggaguaccgucuaaagggagaaagcagaaaaacauuuguggagcugaugcggaggggugacuugcccgucugguuagcucacaagguggccuccgaaggcaucaaauauacugaucgcaaguggugcuucgacgggcagcgaaacaaucagauucuggaggaaaacauggauguagagauauggaccaaagagggagaaaagaagaaacucagaccucgguggcuggacgcaaggacauacucugauccccuugcucugaaggaguuuaaagacuucgccgcaggccgcaagucgaucgcccucgauuuggugaccgaaauugguagaguuccaagccaucuggcucacaggacucggaaugcgcuagacaaccuggucaugcuccauacaucagagcacgggggccgugccuaucgccacgcaguggaggaacuuccugagacgauggaaacccuguuauugcugggacucaugauccugcuuacuggcggggcuaugcuguuucucauuuccggaaaagguaucggcaagacaaguauaggguugaucugugugauugccucuagcggaaugcuguggauggccgagauccccuuacaguggauugcauccgcuaucguccuagaguucuuuaugaugguucugcucauaccagagccugagaagcaacgaaccccgcaggauaaucagcuugccuacgugguaauuggcauccugaccuuggcggcuauuaucgccgcaaacgaaaugggucugcucgagacaacuaaaagagaccuggggaugucaaaggaacccggcguggucucuccaacgagcuaucuugauguggaccuccauccugccagugcuuggacccuguacgcaguugccacaacugugauaacccccauguugaggcacacaaucgaaaauuccaccgcgaacgucagccuggcugccauugcaaaccaagccguaguguuaaugggacuagacaaaggcuggccaaucucuaagauggaucuggggguuccucuccuugcucugggaugcuacucacaggugaaucccuugacucugacggccgcaguccuccugcuuauuacacauuaugcuaucauaggcccggguuuacaggccaaagcgacccgggaagcccagaagcgcacugcagcugggauuaugaagaacccaaccguggacggaaucaugacaaucgaucuggacccugucauuuacgauuccaaauucgagaagcaacucggccaggugauguugcugguucuaugugccgugcagcugcuccuuaugagaacaaguugggcacugugcgaggcuuugacccuggccacaggucccaucacgacccucugggaaggcagcccagggaaauuuuggaauacuacaauagccguaucgauggcgaacauuuucaggggaucuuaucuggcuggcgcaggguuagccuuuuccaucaugaaaagcgugggaaccggcaaacgggguacugggucacagggagagacacuuggcgaaaaguggaagaaaaagcugaaucaacucagucgaaaagaguucgaccuauacaagaaaucugguauuaccgaagucgauagaacggaggcuaaggagggccugaaacgcggggaaaucacccaccaugccguuuccaggggaagcgcaaaguugcagugguuuguggagcggaacauggucauacccgaaggccgugugaucgaccugggguguggaagaggcgguuggucauauuacugcgccgggcucaagaaaguaacagaggugaggggauauacuaagggcggcccugggcacgaggaaccgguucccaugaguaccuacggauggaauauugugaaacuuaugagcgguaaggaugucuucuaccugccaccugagaaaugugacacauugcugugcgauaucggcgaauccucucccagcccuacuguggaggaaucccgcaccauucggguccucaagaugguggagccaugguuaaagaacaaucaguucuguaucaaaguucugaaccccuauaugccuacaguaauugagcaccuugaacgacugcagagaaagcaugggggaaugcuagugaggaauccacucucacgcaacucuacccacgagauguacuggaucaguaauggcacugguaacauagucgcuucggugaauaugguuagccggcuguugcugaacagauuuacgaugacacaucguaggcccaccauugaaaaagacguggaucucggggcgggaacucggcacgucaacgccgagccggaaaccccuaauauggacgugaucggcgagcgcaucaagcgaauuaaagaggaacacaacuccacauggcauuaugacgaugagaauccauacaagacgugggcauaucacggcucuuacgaaguaaaggcuaccgggucagccagcuccaugauaaacggagugguuaaacuucugacuaagcccugggacgucgugccuauggugacacaaauggcaaugaccgauacuacaccauucggucagcagagagucuuuaaagagaagguugacaccaggacaccccggaguaugccgggcacucgcagagugauggggaucaccgccgaaugguuauggaggacgcugggacgaaauaaaaagccucgguugugcacccgugaggaguucacaaagaaaguaagaacuaacgcugccaugggcgcgguguuuaccgaagagaaucaaugggauucugcaaaggccgcugucgaagacgaggauuucuggaaacucguggaccgcgaaagggagcugcauaagcuagguaaaugugggagcugcguuuauaacaugaugggaaagcgggagaagaaacuuggcgaauuuggcaaagccaaagggucaagagcaauuugguacauguggcugggagcucgcuaccucgaguucgaagcccugggauuuuugaaugaggaucacugguucuccagggagaacaguuauagcggcguggaaggggagggacugcauaagcucggcuacauccuucgagacauuucuaaaauccccgguggggcuauguaugccgaugacacagcaggaugggacacucggauaaccgaagaugaccugcacaaugaggaaaagaucacgcagcagauggauccagagcacagacaguuagcgaacgccauuuuuaaacugacauaccaaaauaaggucgugaagguacagaggccuacccccacuggcacaguuauggacaucauuucccgcaaagaucagcguggcucaggacaggugggaaccuaugguuugaacacuuucaccaauauggaggcucaacucauccggcagauggaaggcgaggggguccugagcaaggccgaccuagaaaacccacaucuucccgagaaaaagauaacacaguggcuggaaacgaaaggaguggagagacucaagaggauggcaauuucgggcgaugacugcguggucaagccuaucgaugaccgcuuugcuaacgcccuguuggcauuaaaugauauggguaaaguucgaaaggacaucccacaguggcaaccgucuaaaggguggcacgauuggcaacaggugcccuucuguagucaucacuuccacgagcugauuaugaaggacggacggaaacucguagugccuugcagaccacaggacgaacuuauaggcagggcccgcaucucccaaggcgcgggguggagccugagagagaccgcuugucuaggaaaggccuacgcacagauguggucacugauguauuuucaucggagggaucuccguuuggccuccaacgcuauuugcucugccguccccgugcacuggguuccuacuagccgaacaaccuggaguauccaugcacaccaucaguggaugacuacagaagacaugcugaccguguggaaucgcgucuggauugaggauaacccauggauggaagacaagacgcccgugacaaccugggagaauguaccuuaccuugguaaaagagaggaucaaugguguggcucccugaucgggcucacuagccgggcuaccugggcccagaacauaccgacagcgauccagcagguuaggucuuuaauuggaaaugaagaguuccuggacuacaugccaucaaugaagcgcuuuagaaaagaagaggagagugaaggcgcuaucugguga

SEQ ID NO: 15138 - RNA, 9873 nt, Artificial Sequence
  derived and/or modified CDS sequence (opt3) from DENV-3__JF808128__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaggaccgaagcaacucaacuggccacacuucggaagcuguguaucgagggaaaaauuaccaacaucacgaccgauagccgcugcccuacacagggcgaagcugucuugccagaggaacaggaccagaauuauguuuguaagcacacuuacguggaucgagguugggggaacggaugcggccucuucggcaaagggagucugguaaccugcgccaaguuucaauguuuagagcccauagagggaaaggugguccaguaugaaaaucugaaauacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgagaacugguuuggacuucaaugagaugauccuacugaccaugaagaacaaagcguggauggugcauaggcagugguuucucgaucugccccuuccuuggacaagcggggccaccacugaaacaccaacguggaaucggaaggagcuguugguaaccuucaaaaacgcacacgcuaagaaacaagaaguugugguccucggcucccaggagggagccaugcacacugcucugacaggcgccaccgaaauucagaauucagggggaacaaguauauuugcaggucauuuaaagugucgucugaagauggacaaacuagagcucaagggcaugagcuacgccaugugcacuaacaccuucgugcugaaaaaggaggucucugaaacgcagcacgggaccauccuuauuaaaguggaguacaagggagaagaugcucccuguaagaucccuuuuuccacagaggacggccaagguaaagcgcauaacgggcgcuugauaacugcaaauccaguugugaccaagaaagaggaacccguaaacauugaggccgaaccgccuuucggcgagucaaauaucgucaucggaauuggcgauaacgcucugaagaucaauugguauaaaaaggggagcaguauuggaaagauguucgaagccacagcaagaggugccaggcggauggcuauacucggcgacacugccugggauuuugggucugugggaggcguucugaacucccuugguaaaauggugcaccagaucuucgggagcgcauacaccgcgcuguuuucgggcgucucuugggugaugaagauuggaaucggcguauugcucacguggaucgggcugaauuccaaaaacacaucaaugaguuucagcugcauugcuauaggaaucauuaccuuauaucugggcgccgugguucaggcagacauggguugugucaucaauuggaaggggaaagagcuaaagugcggauccggcauuuuugugacuaacgaggugcauacauggaccgaacaguacaaguuccaagccgauucucccaaacgacucgcuacugccaucgcaggugcuugggagaauggcgucugugggauacgcagcaccacaagaauggaaaaccugcuuuggaagcagaucgccaaugaguugaacuauauucugugggaaaauaacaucaaacucacgguuguggugggagacauuaucggcguacuggagcaggggaagaggaccuuaacuccacagccuauggagcugaaauacucauggaagacauggggaaaaaguaagauagucaccgcggaaacacaaaacuccagcuuuauuaucgauggccccaauacuccagagugccccucugccucacgggcuuggaacgugugggaaguugaggacuaugguuucgggguguuuaccacgaauauuuggcuuaaguugcgcgaagucuacacacagcucugugaccacagacugaugagugcagccgugaaagaugagagggcuguucacgccgacaugggauacuggaucgagagccagaagaacggcuccuggaaacuagaaaaggcaucucugauagaggugaaaaccugcacuuggccuaagucgcauacccucuggagcaaugguguacuggaauccgauaugaucauuccaaagucacuugcgggcccgaucagucagcacaaccaucgucccggguaucacacacaaacugccggaccuuggcacuugggcaaacuggaguuagacuucaauuacugcgaggggaccacagucgugauuacggaaaacuguggaacccggggcccagcucuccgaacuacaaccgugucugguaagcugauccaugaguggugcuguagaagcugcacucuucccccucugagguauaugggggaagauggauguugguacggcauggagauacgcccaauuuccgaaaaagaggagaauauggucaagucauugguuagcgccgguucuggcaaaguggacaacuuuacaauggggguacucugccuggcaauccuauucgaagaggugaugcggggaaaguuuggcaagaaacacaugaucgcuggggucuucuucaccuuugugcugcuccuguccggacagauuacguggagagauauggcccauacucuuaucaugauuggcaguaaugcaagcgacaggauggguauggggguuaccuauuuggcccugauagcuacauucaagauccagcccuuuuuagcgcucggauucuuucugcgcaaacuuaccucucgagaaaaccugcuacucggcgugggccuggccauggcaacuacauugcaacugccggaggauauugaacagauggcuaaugggaucgccuuaggacucauggcccugaagcuuauuacccaguucgagacauaccagcuguggacugcuuugaucucccucaccuguucaaacacgauguuuacacugaccgucgcauggcggacugccacccuaauacuggcgggugugagucuucucccuguuugccaaagcucguccaugcguaaaacagacuggcugccaauggcuguggccgcaaugggcguccccccuuugccccuguucaucuuuucuuuaaaggauacucucaagagaaggagcuggccacugaaugaggggguaauggccgugggacuuguuucaauucuggcuaguuccuugcuccgcaacgacgugccuauggcaggcccccuggucgccggugggcuacugaucgcguguuaugugauuaccggaacgucugcugaucuuacaguagaaaaagccgcagacaucaccugggaggaagaggccgaacagacuggcgugagccacaaccucaugauaacagucgacgaugacggcaccaugcggauuaaggaugacgagacugagaauauccugacaguuuuguuaaaaaccgcucugcucaucguguccgggguguucccauacucaauuccggccacgcugcuugucuggcauacuuggcagaagcagacccaaagaagcggagugcugugggauguuccuagucccccagaaacacagaaagcagaguuggaagaggguguauacaggauaaagcagcagggcaucuuugggaaaacccaagugggagucggcgugcagaaggaggguguuuuccacacaauguggcacgugacucgaggggcuguccuaaccuauaacggaaagcgccuggaacccaauugggccucugugaaaaaggaccucguauccuacggcggcggguggcggcugagcgcgcaguggcaaaaaggagaggaaguccaggugauugccguugagccugguaagaacccaaaaaauuuucagacgaugcccggcacauuccagacuaccacaggggaaaucggagcaauugcucuugauuucaagccuggcaccucggguucaccgaucauaaacagagaggggaagguggucggauuauauggcaauggcgugguuacuaaaaacgggggauacgugucugguaucgcccaaaccaaugcugagccagacggccccacaccugaacuggaggaagagauguuuaagaaaaggaaccucacgauuauggauuugcauccagggaguggaaagacucguaaauaucugcccgcaaucguccgcgaagccauuaagcggagacucaggacccugauccuugccccuacacgagugguagcugcggagauggaggaagcacugaagggcuugccgauacgguaccagaccacugccacaaaauccgagcacaccggucgcgaaauuguggaccuaaugugccaugcuacguucacuaugagacugcucagccccguuagggucccaaauuauaacuuaaucaucauggaugaggcccacuuuacagacccugcaucuauugccgcucggggguacaucagcacccgagugggaaugggcgaagcggccgcaauauucaugaccgcuacucccccaggcacagccgaugcauuuccucaguccaaugcccccauucaggacgaggagagagacaucccagaacgcucauggaacagugggaaugaguggauuaccgauuucgcuggaaagacagugugguuugucccgagcaucaaagccgguaacgacauagcgaacugucugaggaagaauggcaaaaagguaauucaacuuucucguaagacuuucgauacggaauaccagaaaaccaagcugaacgacugggauuuugugguuacaacugacaucuccgagaugggggcaaauuucaaagccgaucgggugaucgacccuagaaggugccucaagcccgucauuuugaccgauggaccagagcgcgugauccuggcuggccccaugccuguuacagccgcuucagcagcccagcgaagaggucggguggggaggaacccacagaaagaaaaugaccaauauauuuuuaccggccagccccucaacaaugaugaggaccaugcucacuggacugaagccaagaugcugcuugacaacauaaauacgccugagggaaucauuccggcacuauucgaaccagagcgcgagaagagugcggccaucgauggcgaauaccgucugaaaggggagagcagaaagaccuucgucgaauugaugcggaggggagacuuacccguguggcuggcucacaaaguagccuccgaggguaucaaguauacagaucgccgauggugcuuugacggccagagaaacaaucagauucucgaagagaacauggauguggagauauggacuaaagaaggggagaagaaaaagcugcggccuagguggcuugacgcacgcaccuacucugauccccuggcucucaaggaauucaaagacuuugccgcaggaagaaagucgaucgccuuggaucugguuacagagauuggcagggucccaagccaucuagcucaccggacccguaaugcgcuggacaaccucgugaugcuucauacuucagaacacggugggcgcgccuaucgacacgcaguggaggagcugccugaaacaauggagacguuauugcugcucggccugaugauccuucugaccggaggcgcuaugcucuucuugauuuccgggaaaggaaucgguaagacuaguauaggccugaucugugucauugccucuagaagcauguccuggauggccgaaauccccuuacaauggauugcaucagcuaucguucuagaguuuuucaugauggugcugcucauaccagagccugaaaaacagaggacaccgcaggauaaucaacuugccuacguagugauugggauccugaccuuggcggcuauuaucgccgcaaacgagaugggacugcucgaaaccacaaagcgggaccugggcaugucuaaggagcccggugucgugagcccaacuaguuaucuugauguugaccuccauccugccuccgcuuggacgcuguacgcaguggccaccacagucauaacucccauguugcgccacaccaucgaaaauagcacagcgaacguaucucuggcugccauugcaaaccaggccgugguuuuaauggggcuagacaaaggcuggccaaucucaaagauggaucugggagugccucuccuugcucugggcugcuacucccaggucaaucccuugacccugacugccgcagugcuccugcuuauuacgcauuaugcuaucauagggccgggauuacaggccaaagcgacaagagaggcccaaaagaggaccgcagcuggcauuaugaaaaacccaacugucgacgguaucaugaccaucgaucuggacccugugauuuacgauaguaaguuugagaagcagcucgggcagguuauguugcuggugcuaugugccguacagcugcuccuuaugcggacaagcugggcacugugcgaagcuuugacucuggccaccggacccaucacaacgcucugggagggcucgccagguaaauucuggaauaccacuauagccgugucuauggcgaacauuuuucgaggcuccuaucuggcuggggcaggauuagccuucagcaucaugaagucagucggcacagggaaaagaggaaccggcagucaaggugaaacucuuggggagaaguggaaaaagaagcugaaucagcucucucgcaaagaauuugaccuauacaagaaauccggaauuacagagguugauaggaccgaggcuaaggaaggccugaaacggggugagaucacgcaccaugccgugagccguggcucagcaaaguugcagugguucgucgaaagaaacauggugauacccgaggggaggguaaucgaccugggauguggccgcgggggauggaguuauuacugcgccggccucaaaaaggugaccgaaguucgggguuauacaaaggggggaccuggccacgaggagccggugcccaugagcacuuacggcuggaauauugucaaacuuauguccgggaaggauguguuuuaccugccaccugaaaaaugugacaccuugcugugcgauaucggagagucuagccccuccccuacagucgaagagucacgaacuauuagagugcucaagaugguugagccaugguuaaaaaacaaucaguucuguaucaagguacugaaccccuauaugccuaccgugauugaacaccuugagaggcugcaacgcaagcaugguggcaugcuaguccggaauccacucucuagaaacaguacacacgaaauguacuggaucucgaaugggaccggaaacauaguggcuagcguuaauauggugucccgucuguugcugaacagguucacuaugacgcaucggcgccccacaauugagaaagacgucgaucucggcgcggguacccgacacgugaacgccgaaccggagacuccuaauauggacguaaucggggagagaaucaagaggauuaaagaagagcacaacucuaccuggcauuaugacgaugaaaauccauacaagacaugggcauaucacggaucauacgaggugaaagcuacgggcagcgccuccaguaugauaaacggcguugucaagcuucugaccaagcccugggacguggugccuauggucacucagauggcaaugacagauaccacuccauuugggcagcaacggguuuucaaagaaaagguggacacacgcacccccagaucuaugccgggaacaaggcgaguaauggguaucacugccgagugguuauggcggacccugggccguaauaaaaagccuagauugugcacgcgcgaggaauuuaccaaaaaggugaggacaaacgcugccaugggggcggucuucacugaggaaaaucagugggauagcgcaaaggccgcuguggaggacgaagauuuuuggaaacucguugaccgggagagagagcugcauaagcuaggaaaauguggcucaugcguguauaacaugauggguaagcgcgaaaaaaagcuuggggaguucggaaaagccaagggcuccagggcaauuugguacauguggcugggcgcucgauaccucgaauuugaggcccugggguucuugaaugaggaucacugguuuagucgggaaaacagcuauucuggagucgagggugaaggccugcauaagcucggguacauccuuagagacauuuccaaaauccccggaggcgcuauguaugccgaugacaccgcagguugggacacaaggauaacugaggaugaccugcacaaugaagagaagaucacccagcagauggauccagagcaccgccaauuagcgaacgccauuuucaaacugacguaccagaauaaggugguaaaaguucagcguccuacacccaccgggacugugauggacaucauuucacggaaggaucagagaggaagcggccaagucggcacauauggguugaacaccuuuacuaauauggaagcucagcucaucaggcagauggagggagaaggugugcugucgaaggccgaccuagagaacccacaucuucccgaaaaaaagauaacccaguggcuggagacaaaaggcguggagcgccucaagcgaauggcaauuucuggggaugacugcgucguuaaaccuaucgaugaccgguucgcuaacgcccuguuggcauuaaaugauaugggaaaggugagaaaggacaucccacaauggcagccgaguaaaggcuggcacgauuggcagcagguacccuuuuguucccaucacuuccacgaacugauuaugaaggacgguaggaaacucguggucccuugccgcccacaagacgagcuuauagggagagcccggaucagccagggagcgggcuggucacugagggaaacggcuugucuaggcaaggccuacgcacagauguggucccugauguauuuccaucgucgagaucuccgcuuggccucuaacgcuauuugcagcgccgugcccguucacugggugccuaccaguagaacuacaugguccauccaugcacaccaucaauggaugaccacugaggacaugcugacagucuggaaucggguguggauugaagauaacccauggauggaggacaaaacccccguaacgacaugggagaauguuccuuaccuugggaagagggaagaucagugguguggaagccugaucggucucaccucucgcgcuacuugggcccagaacauaccgaccgcgauccagcaagugagaucauuaauuggcaaugaggaauuucuggacuacaugccaaguaugaagcgguucaggaaagaggaggaauccgagggggcuaucugguga

SEQ ID NO: 15139 - RNA, 9873 nt, Artificial Sequence
  derived and/or modified CDS sequence (opt3) from DENV-3__JF808122__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaucaaauguacgcuaauugcgauggaucucggcgagaugugcgacgauaccgucacauacaaguguccacauaucacugaaguugagccggaagacauugauugcugguguaaucugaccaguacaugggugaccuaugggacuugcaaccaggcuggagagcgccgacgugacaaaagaagcguagcccuugcaccccacgugggcaugggucuggauacaaggacccaaacguggauguccgccgagggggcuuggcggcaggucgaaaagguggagacuugggcauugcgccauccuggauucaccauccucgcccuguuucuggcucacuacauaggcacaucucucacucagaagguugugaucuucauuuuacugaugcuugucaccccaucgaugacaaugagaugugugggcguagggaauagggacuuuguugaaggauugucaggugccaccuggguggaugucgugcuggagcauggcgggugcgugacgacuauggcgaaaaacaagcccacacuagacaucgagcuccagaaaaccgaagcaccucaccuggccacucuucggaagcuguguauugagggaaaaaucacaaauauaaccacggauagccgcugcccaacccaaggcgaagcugucuugcccgaggaacaggaccagaacuauguuuguaagcacacauacguggaucgagguugggggaauggaugcggccucuucggcaaggggagucugguaacuugcgccaaauuucaguguuuagagccuauugagggaaaggugguccaauaugaaaaccugaaauacaccgugaucauuacaguucauacuggugaccagcaccaggugggcaaugagacccagggggucacagcagaaaucaccccacaagcuuccacuacggaggccauccucccggaauauggaacacuuggccuggagugcucucccagaaccgguuuggacuucaacgagaugauucuacugacuaugaagaauaaagcguggauggugcauaggcagugguuuuucgaucucccucugccauggaccagcggggccacaaccgaaacucccacauggaaccggaaggagcuucugguaacguuuaaaaaugcacacgcuaagaagcaggaaguuguggucuugggcucccaagagggagccaugcacaccgcucucacuggcgccacagaaauacagaacucagggggaaccaguaucuucgcaggucaucugaaaugucguuuaaagauggacaaacuggagcuaaagggcaugagcuacgccaugugcacaaauacuuuugugcucaaaaaggaggucucugaaacccagcacgggacgauucugaucaagguggaguacaaaggagaagaugcuccuuguaagauaccauucuccaccgaggacggccaggguaaagcgcauaacgggcgccuuauuacagcaaaccccguugugacuaagaaagaggaaccgguaaauaucgaggccgaaccucccuucggcgagucaaacaucgucauuggaaccggcgauaaugcuuugaagaucaacugguauaagaaagggagcaguauuggaaagauguuugaagccacagcaagaggugccaggcggauggcuauacugggcgacacugccugggauuucgggucugugggaggcguucucaauucccuggguaaaauggugcaccaaaucuuugggagcgcauacaccgcgcuuuucucgggcgucucuugggugaugaagauuggaaucggcguacuguugacguggaucgggcucaacuccaaaaauacaucaaugaguuuuagcugcauugcuauaggaaucauuacccuguauuuaggcgccgugguucaggcagacauggguugugucaucaacuggaaggggaaggagcugaaaugcggauccggcauuuucgugacuaaugaggugcauacauggaccgaacaguacaaguuucaggccgauucuccaaaacgacuagcuacugccaucgcaggugcuugggagaacggcgucugugggauacgcagcaccacaagaauggaaaaucuccuguggaagcaaaucgccaacgagcuuaauuauauuuugugggaaaacaauaucaaacugacgguuguggugggagacauuaucggcguacucgagcaggggaagaggacccugacuccucagcccauggaguuaaaauacucauggaagacauggggaaaggcgaaaauagucaccgccgaaacacagaacaguuccuucauuaucgauggcccaaacacucccgagugcccuagcgcuucucgggcauggaaugugugggaaguugaggacuaugguuuugggguguucaccacgaacauuuggcugaagcuucgcgaagucuacacacaauugugugaccacagacucaugucagccgcugugaaagaugagagggccguucacgcagacaugggauacuggaucgagagucagaagaauggcagcuggaaacuggaaaaggcgucccuaauagaggugaagaccugcacuuggccaaaaucucauacccuguggucgaacgguguacucgaaagcgauaugaucauuccgaagucccuggccggccccaucucacagcacaaucaucguccuggguaucacacacagacugcuggaccauggcaccuuggcaaauuggagcuggacuuuaacuacugcgaggggaccacagucgugauuacggaaaauuguggaacccggggccccaguuuacgaacuacaaccgugucugguaagcucauccaugaguggugcuguagaagcugcacucugccuccacuuagguauaugggggaagauggauguugguacggcauggagauacgccccauuuccgaaaaagaggagaacauggucaagucacugguuagcgccgguucuggcaagguggacaauuucacaauggggguauugugccucgcaauccuguuugaagaggugaugcggggaaaauucggcaagaaacacaugaucgcuggggucuucuuuaccuucgugcuacugcucuccggacaaauuacguggagagauauggcccauacucugaucaugauuggcaguaacgcaagcgacaggauggguauggggguuaccuaucuugccuugauagcuacauuuaagauccagccguuccuggcguuaggauuuuuccuccgcaaacugaccucucgagaaaaucuucugcuaggcgugggccucgccauggcaacuacacugcaguugccugaggauauugaacaaauggcuaacgggaucgcccugggauuaauggcccucaagcugauuacccaguuugagacauaccagcuuuggacugcucugaucuccuugaccuguucaaauacgauguucacacucaccgucgcauggcggacugccacccugauacuagcgggugugagucugcuuccaguuugccagagcucguccaugcguaagacagacuggcuccccauggcuguggccgcaaugggcgucccuccccugccauuguuuaucuucucucugaaagauacuuuaaagagaaggagcuggccucucaacgaggggguaauggccgugggacugguuucaauucuugcuaguuccuuucugcgcaaugacgugcccauggcaggcccauuggucgccggugggcuccugaucgcguguuaugugauuaccggaacgucugcugaucuaacaguagaaaaagccgcagacaucaccugggaggaagaggccgaacaaacuggcgugagccacaaccugaugauaacagucgacgaugacggcaccaugcggauuaaggaugacgagacugagaacauccuuacaguucuccugaaaaccgcuuuguuaaucguguccgggguguucccguacucaauuccugccacgcugcucgucuggcauacuuggcagaagcagacccagagaagcggagugcugugggauguucccaguccacccgaaacacaaaaagcagagcuugaagaggguguauacaggauaaagcagcagggcaucuuugggaagacccaggugggagucggcgugcaaaaagaggguguuuuccacacaauguggcacgugacucgaggggcuguccugaccuauaauggaaagcgcuuggaaccuaacugggccucugugaaaaaggaccuaauuuccuacggcggcggguggcggcugagcgcgcaguggcagaaaggagaggaaguacaagucaucgccguggagccagguaagaaucccaagaacuuccagacgaugccuggcacauuucagacuaccacaggggaaauuggagcaaucgcucucgauuucaaaccgggcaccucggguucaccaauaaucaauagagaggggaagguugugggacuguauggcaacggcgucgugacuaaaaaugggggauacguuucugguauugcccagaccaacgcugagcccgacggcccuacaccagaacuugaggaagagauguuuaagaaaaggaauuuaacgaucauggaucugcaucccgggaguggaaagacucguaaguaucucccugcaauugugcgcgaagccaucaaacggagauugaggacccugauacucgccccgacacgagucguggcugcggagauggaggaagcacugaagggccuucccauucgguaccaaaccacugccacaaaauccgagcacaccggucgcgaaaucguagaccugaugugccaugcuacguucacuaugagauugcuaagcccagugaggguuccuaacuauaaucugaucauuauggaugaggcccacuuuacagaccccgcaucuaucgccgcucggggguacauaagcacccgagucggaaugggcgaagcggccgcaauuuucaugaccgcuacuccaccuggcacagccgaugcauuuccccaguccaacgccccaauccaggacgaggagagagacauuccggaacgcucauggaauagugggaacgaguggaucaccgauuucgcuggaaagacagugugguuugugccuagcauaaaagccgguaaugacauugcgaacugucucaggaagaacggcaagaaagucauccaguuaucucguaagacuuucgauacggaauaccaaaaaaccaagcugaaugacugggauuuuguagugacaacugacaucuccgagaugggggcaaacuucaaagccgaucggguuauugaccccagaaggugccuuaagccagugauccugaccgauggacccgagcgcgucauucucgcuggcccuaugccagugacagccgcuucagcagcccagcgaagaggucggguugggaggaauccccagaaggaaaacgaccaguauauauucaccggccaaccuuugaauaacgaugaggaccaugcucacuggacugaagccaaaaugcugcucgacaauaucaacacgccggagggaauuaucccagcacuguuugaacccgagcgcgagaagagugcggccaucgauggcgaauaccgucuuaaaggggagagcagaaagaccuucguggaacuaaugcggaggggagaccugccugucugguuggcucacaaaguggccuccgaggguauuaaguauacagaucgcaaauggugcuuugacggccagcgaaauaaccagauauuagaagagaauauggauguagagaucuggacuaaggaaggggagaagaaaaagcugagaccccgguggcucgacgcaaggaccuacucugauccacuggcucuuaaagaauucaaggacuuugccgcaggacgcaaaucgauugcccuggaucucgugacagagaucggcagaguuccuagccauuuggcucacaggacccggaacgcgcuggacaaucuagucaugcugcauacuucagaacacggugggcgugccuaucgccacgcaguggaggagcuccccgaaacaauggagacgcuucuguuauugggccugaugauucuccugaccggaggcgcuaugcuuuuccugaucuccgggaagggaauagguaagacuaguaucggccucauuugugugaucgccucuagcgggauguccuggauggccgaaauuccauugcaguggaucgcaucagcuauaguccuggaguuuuucaugaugguuuuacuaauuccugagccggaaaaacaacgaacaccccaggauaaccagcuggccuacgugguaaucggaauucucacccuugcggcuaucauagccgcaaaugagaugggccuguuggaaaccacaaagagagaccuggguaugucuaaagagccagggguggucagcccuacuaguuaucucgauguggaccugcaucccgccuccgcuuggacgcuuuacgcaguugccaccacagugaucacuccaaugcucaggcacaccauugaaaacagcacagcgaaugucucucuggcugccaucgcaaaccaagccguaguguugaugggccuggacaagggauggccuauuucaaaaauggauuuaggcguuccccuacuggcucucgggugcuacucccaggugaacccgcuuacccugacugccgcagucuugcugcucaucacgcauuaugcuauaauuggaccaggccugcaggccaaggcgacacgggaggcccagaagcgcaccgcagcugguaucaugaaaaauccuacuguggacgggaucaugaccauugaucuugaccccgucaucuacgauaguaaguuugagaaacaauuaggacaggugaugcugcucguuuugugugccgugcagcugcuacugaugagaacaagcugggcacucugcgaagcucuuacucuggccaccggcccaauaacaacguugugggaggguucgcccggcaaguucuggaacaccacuauugccguaucuauggcgaauaucuuuaggggguccuaucuggcuggagcaggccucgccuucagcauuaugaaaucaguggggacaggaaagcggggcaccgguagucagggggaaacucugggagagaaguggaaaaagaaauuaaaccaacuuucucgaaaggaauuugaccuguacaaaaaguccggcaucacagaggucgauagaaccgaggcuaaagaaggucucaagcgcggcgagauaacgcaccaugccguuagcagggggucagcaaagcuacagugguucguggaacggaauauggucaucccugagggacgugugauugaccugggcugugggagaggaggcuggaguuauuacugcgccgguuugaaaaagguaaccgaagugaggggguauacaaaaggaggcccgggccacgaggagcccguuccaaugagcacuuacggguggaacaucgugaagcugauguccggaaaagaugucuucuaccucccucccgaaaagugugacacccuucugugcgauauuggugagucuagcccuuccccaacaguggaagagucacgcacuauccgggucuugaagaugguggagcccuggcugaaaaauaaccaguuuuguauuaagguucucaauccuuauaugccaaccguaaucgaacacuuagagcgacugcagagaaaacauggcgggaugcuugugaggaacccccugucucgcaauaguacacacgaaauguacuggauaucgaacggaaccggcaauauugucgcuagcgugaacaugguuucccggcuacuccugaauagauucacuaugacgcaucguaggccgacaaucgagaaggacguggauuugggugcggggacccggcacgucaacgccgaaccugagacuccaaacauggacgugaucggagagcgcauuaaacgaauaaaggaagagcacaauucuaccuggcauuaugacgaugaaaaccccuacaagacaugggcauaucacggcucauacgagguaaaagcuacgggcagcgccuccaguaugaucaauggggugguuaagcugcucaccaaaccuugggacgucgugccaauggugacucaaauggcaaugacagauaccacucccuuuggacagcagagagucuucaaggaaaaaguugacacaaggaccccgcggucuaugccugguacacgcagagugaugggcauuacugccgaguggcuuuggaggacccuggggcgaaacaagaagccccgguuaugcacgcgugaggaauuuaccaaaaagguaagaacaaaugcugccaugggagcgguguucacugaggaaaaccaaugggauagcgcaaaagccgcugucgaggacgaagauuuuuggaagcugguggaccgcgagagggaguugcauaaacucggcaagugugguucaugcguuuauaauaugauggggaaacgggaaaagaagcugggagaguucggcaaagccaacggcuccagagcaaucugguacauguggcuaggggcucgcuaccuugaauuugaggcccugggauuccucaaggaguaucacugguuuaguagggaaaauagcuacucugguguggagggcgaagggcugcauaaauugggauauauucugcgagauaucuccaagauaccaggcggugcuauguacgccgacgauaccgcagggugggacacacggaucacugaggacgaucuccacaacgaagagaaaauuacccagcagauggacccugagcacagacagcuugcgaaugccaucuucaagcugacguaucaaaacaaggucgugaaaguacagaggcccacaccaaccggaacuguuauggauauuaucucacgcaaggaccagcguggcagcggccagguggggacauacggauuaaauaccuuuacuaacauggaagcucaacugauacggcagauggagggugaaggcgucuugucgaaagccgaucucgagaauccccaucugccugaaaagaaaauuacccaguggcuagagacaaaggggguggagagacuuaagaggauggcaaucucuggagacgauugcguggucaaaccaaucgacgaucgcuucgcuaacgcccugcucgcacugaacgacacgggcaagguucgaaaagauauuccgcaguggcaacccaguaaggguuggcacgacuggcagcaggugccuuucuguucccaucacuuucacgaauugauaaugaaagaugggcggaaguuaguagugccaugcagaccccaggacgagcugaucggaagggcccgcauuagccaaggcgcgggcuggucacucagagaaaccgcuugucuugggaaggccuaugcacagauguggucccugauguacuuccaucggagggaccuacgucuggccucuaaugcuaucugcagcgccgucccugugcacuggguuccaacuagucgaacaaccugguccauucaugcacaccaucaguggaugacuacagaggauaugcucaccguguggaaccgcgucuggaucgaagacaaucccuggauggaggauaaaacgccugugacaaccugggagaacguaccguacuugggaaagagagaagaccaauggugugguagccugauaggccuuacuucucgggcuaccugggcccagaauaucccaacagcgauucagcagguuaggucacugaucgggaacgaggaauuucucgauuauaugcccaguaugaaacgcuucagaaaggaggaggaauccgagggagcuauuugguga

SEQ ID NO: 15140 - RNA, 9873 nt, Artificial Sequence
  derived and/or modified CDS sequence (opt3) from DENV-3__GQ466079__SS-prME
accagccugugccucaugaugauccuucccgcagcucuggcauuccacuugacaucccgggacggcgaaccuaggaugauuguggggaagaacgaacggggaaaaucuuuacuguuuaagacugccucagguauuaauauguguacgcuaaucgcgauggaucucggcgagaugugcgacgauaccgucaccuacaaauguccacacauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccagacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucagcuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucaaaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagaugcucccuguaaaaucccuuucuccacagaggacggccaagguaaggcgcauaacgggcgucuuauaacugcaaauccaguugugaccaaaaaggaggaacccguaaacauugaggccgaaccgccuuucggcgagucaaauaucgucaucggaauuggcgauaacgcuuugaaaaucaauugguauaagaaggggagcaguauuggaaaaauguuugaagccacagcacgcggugccagaaggauggcuauacugggcgacacugccugggauuucgggucugugggaggcguucucaacucccuggguaagauggugcaccagaucuuugggagcgcauacaccgcgcuuuucucgggcgucucuugggugaugaaaauuggaaucggcguacuguugacguggaucgggcucaauuccaagaacacaucaaugaguuuuagcugcauugcuauaggaaucauuacccuguauuuaggcgccgugguucaggcagacauggguugugucaucaauuggaaagggaaggagcugaagugcggauccggcauuuucgugacuaacgaggugcauacauggaccgaacaguacaaauuucaagccgauucucccaagcggcuagcuacugccaucgccggugcuugggagaauggcgucugugggauacgaagcaccacacgcauggaaaaccuccuguggaaacagaucgccaaugagcuuaacuauauuuugugggaaaauaacaucaagcugacgguuguggugggagacaccauuggcguacucgagcaggggaaaagaacucugacaccacagccuauggaguuaaaguacucauggaaaaccuggggaaaggcgaagaucgucacagccgaaacucaaaacaguuucuuuauaauugauggccccaauaccccagagugccccuccgcuagcagggcauggaacgugugggaaguugaggacuaugguuucgggguguuuacgacaaauaucuggcugaaacuucgggaagucuacacccaguugugugaccaccgccucaugucugccgcugugaaggaugagagagccguucacgcagacaugggauacuggauugagucacagaaaaacggcaguuggaagcuggaaaaagcgagccuaaucgaggugaagacuugcaccuggccuaagucccauacacuguggucuaaugguguacucgaaucggauaugauaaucccaaaaagccuggccggcccgauuucccagcacaaccauaggcccggguaucacacucaaaccgcuggaccuuggcaccuugagaauuuggagcuggacuucacauacugcgaaggcacgaccgucgugaucacugagaacugugggacacguggaccaucauuacggaccacuacagugaguggcaagcucauucaugaauggugcugucgaucuugcacccugcccccucuuagauauaugggugaggauggguguugguacggaauggaaaucaggccaauaagcgagaaagaggaaaauauggucaagucccugguuucagccggcagcgguaaaguggacaacuuuacgaugggcauuuugugccucgcaauccuguucgaggaaguaaugcgcgggaaguucggaaagaaacacaugaucgcuggcguguuuuucacuuuuguccuacugcucucugggcagauuaccuggcgggauauggcccauacacugaucaugauuggauccaaugcaagugacagaaugggcaugggugugaccuaucuugccuugauagcuacuuucaagauccagcccuuucuggcguuaggguucuuucucaggaaacugacaagccgcgagaaccuucugcuaggaguuggccucgccauggcaaccacacugcaauugccggaagauauugagcagauggcuaauggcaucgcccugggguuaauggcccucaagcugauuacucaguucgagaccuaccagcuuuggacggcucugaucucuuugacauguuccaacaccauauuuacucucaccguggcauggcgaacagccacucugauccuagcgggagucucacugcuuccugugugccaaaguagcucgaugcggaaaaccgacuggcucccaaugacgguugcugccaugggugugcccccucugcccuuguucauauuuucccugaaggauacauuaaagcguagaucuuggccacucaaugaaggcgucauggcaguagggcuggugagcauccuugccucaagucuguugaggaacgacguuccuauggcuggaccccucguggcaggcggucugcuaauugccuguuaugucaucaccgggacuuccgcggaucugacaguggagaaagcugccgacguaaccugggaagaggaagcagagcagacuggagugucucacaaccuuaugauaacagucgacgaugacggcaccaugcgcauuaaggaugacgagacggaaaauauccucacuguucuguugaaaaccgccuuacugaucgugagcggcauuuucccauacuccauaccggcuacacuccugguguggcauaccuggcagaagcagacacaacggucagggguccuuugggaugugccuagcccaccagagacucagaaagccgaacuggaggagggaguuuacagaaucaagcagcaggguauuuugggcaaaacccaaguaggggugggaguccagaaggaaggcguguuucacacgauguggcacguuacaaggggugcagugcuaacucauaacgggaagcgacuggagcccaauugggcuagugucaaaaaggaccucaucucuuauggaggcggcuggcgccuguccgcccaguggcaaaaaggggaagaggugcagguaauugcggucgaaccuggaaagaaccccaaaaauuuccagaccaugcccgguacauuccagaccacuaccggcgagaucggggccauagcacuugauuuuaagccuggaacaagcggcucgccgaucauuaaccgggaggguaaggugguuggguuauacggaaauggcguggucacgaaaaacggcggguaugugucaggaaucgcucaaacuaaugccgaaccagacggucccaccccugagcuggaagaggaaauguucaagaaaagaaaccucacaauuauggauuugcacccaggcucugggaagaccaggaaauaccugcccgcuaucguucgugaggcaauaaagcgccggcucagaacucugauucuugccccuacaaggguggucgccgcugagauggaagaggcgcugaagggauugccgauccgauaucagaccacggcaacuaaaagugaacauacaggccgggagaucguggaccuaaugugccacgccaccuuuaccaugcgccugcucucccccguaagagugccaaauuacaacuuaauuaucauggaugaagcucauuucacugacccugccagcauagcagccagggguuauauuucuacacggguugggaugggagaggcugcggccaucuuuaugagcgcaacacccccaggcacagcugaugccuucccucaguccaaugcacccauucaggacgaggaacgagacaucccagagagaucauggaacaguggcaaugaauggauaacugauuuugccgggaagacggucugguucgugccgagcauuaaagcuggaaacgacaucgccaacugucugcgcaagaaugguaaaaaggugauccaacuuucuaggaagaccuuugauacagaguaccagaaaacuaagcugaacgacugggauuucgucguaaccacagacauuuccgagaugggcgcgaauuuuaaagcagaucgugugaucgacccucggagaugccucaagcccguuauuuugaccgaugggccagaaagggugauacuggccggacccaugccugucacugcugccucagcugcacagcgccgaggcagagugggucggaacccacagaaagagaaugaccaauacaucuucacggggcagccccucaacaaugaugaagaccacgcccacuggaccgaggcuaagaugcugcuugacaacauuaauacaccugaaggcaucaucccggcccuauucgagccagagagggaaaagagugcagcgauugauggagaguaucgccugaaaggcgaaagccguaagacuuuuguugaguugaugagaagaggggacuuacccguguggcuggcccauaaagucgcuuccgaaggaauaaaguacaccgauaggaaauggugcuucgacggucagcgcaacaaucagauccucgaggagaacauggauguggaaauuuggacaaaggagggcgagaaaaagaagcugcgaccuagauggcuugacgcccggaccuauucugauccccuggcacucaaagaguuuaaggacuucgcugccgggaggaaaucgaucgcauuggaucugguaacugaaauuggacgcgugccaagccaccuagcccauagaacaaggaaugcucuggacaaccucguuaugcuucacacgucagagcacggcggucgggcguaccgucaugccgucgaggaacugccugagaccauggaaacuuuauugcugcucgggcugaugauccuucugacaggcggagcaaugcucuuuuugauauccggcaaggggaucggaaaaaccaguauuggucugaucugugugauugcuucuagcggcauguuauggauggccgagaucccccuacaauggauagccuccgcaauugugcuggaguucuuuaugaugguccuccuuaucccagaaccugagaagcagcgcaccccgcaggauaaucaacuggcuuauguugugauugggaucuugacacuggccgcgauaaucgcugccaacgaaaugggacuccuggagacuacgaagcgagaccuuggcaugucaaaagaacccgguguagugucuccaaccagcuaccucgaugucgaccugcacccugcaagugccuggacauuguaugcuguggcaacuaccguuauuacacccaugcugagacauaccaucgaaaauuccacugccaacgugagcuuagcggcuauugccaaccaggcagucguacuaauggggcuggacaagggcuggccaaucucuaaaauggaucucggagugccucuucuggccuugggcugcuacucacagguuaauccccugacgcucacagcugccgugcugcuuuuaauaacccacuacgcaauuaucgggccgggacugcaggcuaaggccacuagggaggcgcaaaaacggaccgccgcaggcaucaugaagaacccaacagucgacgguauuaucacuauagaucucgacccugugauuuaugauuccaaguucgagaaacaguuggggcaggucaugcugcuagugcugugugcuguucagcuccuucugaugcgcaccaguugggccuugugcgaggcacugacacucgcuacgggacccaucaccacucugugggaaggcagcccagguaaguuuuggaauacaaccauugccgugucgauggccaacaucuucagaggcucuuacuuagcgggggcuggacuugcauuuuccauaaugaaaagcguaggcacugggaagaggggaacaggcucacaaggugagacccugggggaaaaauggaagaagaaacucaaucagcuaagucggaaggaguucgaccuguauaaaaagucuggaaucacggagguggaucgaaccgaagccaaagagggcuugaagagaggugaaacaacucaucacgcugucucccgcggcagcgccaaacugcaguggcucguugagaggaacauggugauucccgaagggcgggucaucgaccuuggauguggccgugggggauggucauacuauugcgcaggccugaagaaggugaccgagguaagagguuacacaaaagggggaccuggccacgaggaaccggugcccaugaguacuuauggcuggaauauuguuaaguugaugagcgggaaagauguguuuuaccugccaccugagaagugugacacccucuuaugcgauaucggagaauccucucccagcccuacagucgaggaguccaggaccauucgcgugcugaaaauggucgaaccauggcuuaagaacaaucaguucuguaucaaggugcugaaccccuacaugccugccguuauagagcaucuagaacggcuccaacgaaaacacgguggcaugcugguaagaaauccauugucaaggaacucuacucaugagauguauuggauuaguaaugggacgggaaacaucgugucgagcgucaauauggugucccgccugcuccuuaaccgguucacaaugacccacagacgucccacuaucgaaaaggacguugaucugggcgcugguaccaggcacgugaacgcggagccggagacaccuaauauggacgucauuggggaacggauaaaacgcaucaaggaggaacauaacucuacguggcacuacgacgaugagaauccauauaaaaccugggccuaccauggaucauaugaagugaaggcaacuggcagcgcuuccaguaugauuaacggcguagugaaguuacugacaaaacccugggacguugucccuauggugacccagauggccaugacugauacaaccccauuugggcagcaacgaguguucaaggagaaagucgacacaagaacucccaggccgaugccuggaacccggaagguuauggagaucacggcagaaugguuguggcgcacccucgguagaaauaaaaggccccgacugugcacacgggaggaauuuacuaagaaggugcguaccaacgccgcuaugggcgccguauucacagaggaaaaucagugggauucugcgaaagcagccguggaggacgaggaauuuuggaagcuagucgauagagagcgcgaacuucacaaacuggggaaguguggaagcugcguguacaacaugaugggcaaaagggagaagaaacucggugaguucgggaaggcuaagggaucacgggccauuugguauauguggcugggcuccagauacuuggaauuugaggcacugggcuuccucaaugaagaccauugguuuagucgcgagaacagcuacucugggguugaaggagagggucuucacaaacugggcuauaucuuaagggauauauccaagaucccagggggagcuauguacgccgacgauacugcuggcugggacacccgaauuacggaggacgaucugcacaaugaagagaaaaucacacagcagauggacccugaacaucgguugcucgccaacgcaauuuucaagcugaccuaucaaaauaaaguggucaaggugcagagacccacuccaacagguaccguaauggauaucauaucaaggaaggaccagcgcgggagcggacagguuggcacuuacggccuaaacaccuuuacaaauauggaggcgcaacuugugcgucagauggaaggggagggaguccugucgaaagccgaucucgagaacccccaucugccugaaaagaaaauuacgcagugguuggagaccaaggguguggaacgguuaaaaagaauggcuaucucuggcgacgauugcguggucaagccaaucgacgauagguucgccaacgcacugcucgcucuuaaugacauggggaagguucgcaaagauauuccgcaguggcaacccaguaagggauggcaugacuggcaacaggugccuuuuuguucccaccacuuccaugagcugauaaugaaagauggccgaaagcuaguagugccaugccggccccaggacgaacugaucgguagagccaggauuagccaaggggcaggauggucacuccgcgagacugccuguuugggcaaagcguaugcucagauguggucccugauguacuuccacagacgggaccuuaggcuggccucuaacgcaaucugcagcgccgucccugugcauuggguuccaacaagucguaccacuugguccauucacgcucaucaccaguggaugacaaccgaggauaugcucacgguguggaaucgagucuggaucgaagacaaccccuggauggaggauaagacaccugugaccacuugggaaaauguaccguauuuaggcaagcgcgaggaccaauggugugggagccugauaggauugaccucuagagccacaugggcacagaacaucccaacugcuauucagcagguucggucacugaucgguaaugaggaauuucucgauuacaugcccaguaugaaaagguuccgcaaggaggaagaguccgaaggcgccauuugguga

SEQ ID NO: 15141 - RNA, 9873 nt, Artificial Sequence
  derived and/or modified CDS sequence (opt3) from DENV-3__FJ898462__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucagaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagaugcucccuguaaaaucccuuucuccacagaggacggccaagguaaggcgcauaacgggcgucuuauaacugcaaauccaguugugaccaaaaaggaggaacccguaaacauugaggccgaaccgccuuucggcgagucaaauaucgucaucggaauuggcgauaacgcuuugaaaaucaauugguauaagaaggggagcaguauuggaaaaauguuugaagccacagcacgcggugccagaaggauggcuauacugggcgacacugccugggauuucgggucugugggaggcguucucaacucccuggguaagauggugcaccagaucuuugggagcgcauacaccgcgcuuuucucgggcgucucuugggugaugaaaauuggaaucggcguacuguugacguggaucgggcucaauuccaagaacacaucaaugaguuuuagcugcauugcuauaggaaucauuacccuguauuuaggcgccgugguucaggcagacauggguugugucaucaauuggaaagggaaggagcugaagugcggauccggcauuuucgugacuaacgaggugcauacauggaccgaacaguacaaauuucaagccgauucucccaagcggcuagcuacugccaucgcaggugcuugggagaauggcgucugugggauacgaagcaccacacgcauggaaaaccuccuguggaaacagaucgccaaugagcuuaacuauauuuugugggaaaauaacaucaagcugacgguuguggugggagacauuaucggcguacucgagcaggggaaaagaacccugacuccacagccuauggaguuaaaguacucauggaaaacauggggaaaggcgaagauagucaccgccgaaacacaaaacaguuccuucauuaucgauggccccaauacuccagagugccccagcgcuucuagggcauggaacgugugggaaguugaggacuaugguuuugggguguucaccacgaauauuuggcugaaacuucgggaagucuacacacaguugugugaccaccgccucaugucagccgcugugaaggaugagagagccguucacgcagacaugggauacuggaucgagagucagaaaaacggcagcuggaagcuggaaaaagcgucccuaauagaggugaagaccugcacuuggccuaagucucauacccuguggucgaaugguguacucgaaagcgauaugaucauuccaaaaucccuggccggcccgaucucacagcacaaccauaggcccggguaucacacacaaacugcuggaccuuggcaccuuggcaaguuggagcuggacuuuaauuacugcgaggggaccacagucgugauuacggaaaacuguggaacccguggcccaaguuuacggacuacaaccgugucugguaaacucauccaugaguggugcugucgaagcugcacucugcccccucuuagauauaugggggaagauggauguugguacggcauggagauaaggccaauuuccgaaaaggaggagaauauggucaaaucacugguuagcgccgguucuggcaagguggacaacuucacaauggggguauugugccucgcaauccuguuugaagaggugaugcgcggaaaguucggcaaaaagcacaugaucgcuggggucuucuuuaccuucgugcuacugcucuccggacagauuacguggcgggauauggcccauacucugaucaugauuggcaguaaugcaagcgacagaauggguauggggguuaccuaucuugccuugauagcuacauuuaaaauccagcccuuccuggcguuaggauuuuuccucaggaagcugaccucucgcgaaaaccuucugcuaggcgugggccucgccauggcaacuacacugcaauugccggaggauauugaacagauggcuaaugggaucgcccugggauuaauggcccucaaacugauuacccaguuugagacauaccagcuuuggacugcucugaucuccuugaccuguucaaacacgauguucacacucaccgucgcauggcgaacugccacccugauacuagcgggugugagucugcuuccuguuugccaaagcucguccaugcggaagacagacuggcucccaauggcuguggccgcaaugggcguccccccucugcccuuguuuaucuucucucugaaggauacuuuaaaacguagaagcuggccacucaaugaggggguaauggccgugggacugguuucaauucuugcuaguucccuguugaggaacgacgugccuauggcaggcccccucgucgccggugggcugcuaaucgcguguuaugugauuaccggaacgucugcugaucugacaguagaaaaggccgcagacaucaccugggaggaagaggccgaacagacuggcgugagccacaaccuuaugauaacagucgacgaugacggcaccaugcgcauuaaagaugacgagacugagaauauccucacaguucuguugaagaccgcuuuacugaucguguccgggguguuuccauacucaauuccggccacgcuccuggucuggcauacuuggcagaaacagacccaacggagcggagugcuuugggauguuccuagucccccagaaacacagaaggcagagcuggaagaggguguauacagaauaaaacagcagggcaucuucgggaagacccaagugggagucggcgugcagaaggaggguguuuuucacacaauguggcacgugacuaggggggcugucuugaccuauaacggaaaacgacuagaacccaauugggccucugugaagaaagaccugauuuccuacggcggcggguggcgccucagcgcgcaguggcaacggggagaggaaguacaggucaucgccguggagccugguaagaacccaaaaaauuuccagacgaugcccggcacauuccagacuaccacaggggaaauuggagcaaucgcucuggauuuuaagccuggcaccucggguucaccgauaaucaacagagaggggaagguugugggacuuuauggcaauggcgucgugacuaaaaacgggggauacguuucugguauugcccaaaccaaugcugagccagacggccccacaccugaauuagaggaagagauguucaagaaaaggaaccugacgaucauggaucuccauccagggaguggaaagacucguaaauauuugcccgcaauugugcgcgaagccaucaagcggagacugaggacccucauacuggccccuacacgagucguggcugcggagauggaggaagcacuuaagggccugccgauucgguaccagaccacugccacaaaauccgagcacaccggucgcgaaaucguagacuugaugugccaugcuacguuuacuaugagacuacugagccccgugaggguuccaaauuauaaccucaucauuauggaugaggcccacuucacagacccugcaucuaucgccgcucggggguacauaagcacccgagucggaaugggcgaagcggccgcaauuuuuaugaccgcuacucccccaggcacagccgaugcauucccucaguccaaugcccccauccaggacgaggagagagacauuccagaacgcucauggaacagugggaaugaguggaucaccgauuuugcuggaaagacagugugguucgugccgagcauaaaagccgguaacgacauugcgaacuguuuaaggaagaauggcaaaaaggucauccaacugucucguaagacuuuugauacggaauaccagaaaaccaagcuuaacgacugggauuucguagugacaacugacaucuccgagaugggggcaaauuuuaaagccgaucggguuauugacccuagaaggugccugaagcccgugauccucaccgauggaccagagcgcgucauuuuggcuggccccaugccugugacagccgcuucagcagcccagcgaagaggucggguugggaggaacccacagaaagaaaaugaccaauauauauucaccggccagccccugaacaaugaugaggaccaugcucacuggacugaagccaagaugcuccuggacaacaucaauacgccugagggaauuaucccggcacuuuucgaaccagagcgcgagaagagugcggccaucgauggcgaauaccgucuaaaaggggagagcagaaagaccuuuguggaacugaugcggaggggagacuugcccgucugguuagcucacaaaguggccuccgaggguauuaaguauacagaucgcaaauggugcuucgacggccagcgaaacaaucagauacuggaagagaacauggauguagagaucuggacuaaggaaggggagaaaaagaagcucagaccucgguggcuggacgcaaggaccuacucugauccccuugcucugaaagaauuuaaggacuucgccgcaggacgcaaaucgauugcccucgauuuggugacagagaucggcagaguuccaagccaucuggcucacaggacccggaaugcgcuagacaaccuggucaugcuccauacuucagaacacggugggcgugccuaucgccacgcaguggaggagcuuccugaaacaauggagacgcuguuauugcugggccucaugauucugcuuaccggaggcgcuaugcuguuucucaucuccgggaagggaauagguaaaacuaguaucggcuugauuugugugaucgccucuagcgggaugcuguggauggccgaaauucccuuacaauggaucgcauccgcuauaguccuagaguucuuuaugaugguucugcucauuccagagccugaaaagcagcgaacaccgcaggauaaucaacuugccuacgugguaaucggaauucugaccuuggcggcuaucauagccgcaaacgagaugggccugcucgaaaccacaaagagagaccuggguaugucaaaagagcccgggguggucucuccaacuagcuaucuugauguggaccuccauccugccagugcuuggacgcuguacgcaguugccaccacagugaucacucccauguugaggcacaccauugaaaauuccacagcgaacgucagccuggcugccaucgcaaaccaggccguaguguuaaugggccuagacaagggauggccaauuucuaaaauggaucugggcguuccucuccuugcucuggggugcuacucacaggugaaucccuugacccugacugccgcaguccuccugcuuaucacgcauuaugcuauaauuggaccgggcuuacaggccaaggcgacacgggaggcccaaaaacgcaccgcagcugguaucaugaagaacccaacuguggacgggaucaugaccauugaucuggacccugucaucuacgauuccaaguucgagaaacagcucggacaggugauguugcugguucuaugugccgugcagcugcuccuuaugagaacaaguugggcacugugcgaagcuuugacucuggccaccggccccauaacaacgcucugggaggguagcccaggcaaguuuuggaauaccacuauugccguaucgauggcgaacaucuucagggggucuuaucuggcuggagcaggcuuagccuuuuccauuaugaaaagcguggggacaggaaagcggggcaccgguucacaaggggaaacucuuggagagaaauggaagaagaaacugaaucagcucagucgaaaggaauucgaccuauacaaaaagucuggcaucacagaggucgauagaaccgaggcuaaagaaggucugaagcgcggcgagacgacccaccaugccguuuccagggggagcgcaaaauugcagugguuuguggaacggaacauggucauacccgagggacgugugaucgaccugggcugugggagaggaggcuggucauauuacugcgccggucucaagaagguaacagaagugaggggguauacuaaaggaggcccuggccacgaggagccgguucccaugaguaccuacggguggaauauugugaagcuuaugagcggaaaagaugucuucuaccugccaccugaaaagugugacacauugcugugcgauaucggugaguccucucccagcccuauuguggaagagucccgcacuauccggguccucaaaaugguggagccaugguuaaagaacaaucaguucuguauuaagguucugaaccccuauaugccuaccguaaucgaacaccuugagcgacugcaaagaaaacauggcgggaugcuagugaggaauccacucucacgcaacucuacacacgaaauguacuggauaaguaauggaaccggcaacauugucgcuucggugaauaugguuagccggcuguugcugaacagauuuacuaugacgcaucguaggcccacaaucgagaaggacguggaucucggugcggggacccggcacgucaacgccgaaccggagacuccuaauauggacgugaucggagagcgcauuaaacgaauaaaggaagagcacaacuccaccuggcauuaugacgaugaaaauccauacaaaacaugggcauaucacggcucuuacgagguaaaggcuacgggcucagccagcuccaugaucaacggggugguuaagcuucugaccaaacccugggacgucgugccuauggugacucagauggcaaugacagauaccacuccauucggacagcaaagagucuuuaaggaaaaaguugacacaaggaccccccggaguaugccggguacacgcagagugaugggcauuacugccgagugguuauggaggacccuggggcgaaauaagaaaccucgguugugcacgcgugaggaauucaccaagaagguaagaacaaacgcugccaugggagcgguguuuacugaggaaaaucagugggauucugcaaaagccgcugucgaggacgaagauuucuggaagcucguggaccgcgagagggagcugcauaaacuaggcaagugugguagcugcguuuauaacaugauggggaaacgggaaaagaaacuuggagaguuuggcaaggccaagggcucaagagcaaucugguacauguggcugggggcucgcuaccucgaauucgaggcccugggauuuuugaaugaggaucacugguucuccagggaaaacaguuauagcgguguggagggcgaagggcugcauaaacucggauacauucuucgagacaucucuaagauacccggcggugcuauguaugccgaugacaccgcagggugggacacacggaucacugaggaugaccugcacaaugaagagaaaauuacccagcagauggauccagagcacagacaauuagcgaacgccaucuuuaagcugacguaccagaauaaagucgugaagguacagaggccuacacccaccggaacuguuauggacauuaucucccgcaaggaucagcguggcucaggccaaguggggacauauggauugaacaccuucacuaauauggaagcucagcucauacggcagauggagggugaaggcguccugagcaaagccgaccuagagaacccacaucuucccgaaaagaaaauuacccaguggcuggagacaaaggggguggagagacucaaaaggauggcaaucucgggagaugacugcguggucaagccuaucgaugaccgcuuugcuaacgcccuguuggcauuaaaugauaugggcaagguucgaaaagacauuccacaauggcagccgucuaaggguuggcacgauuggcagcaggugcccuucuguagucaucacuuccacgaacugauaaugaaagacgggcggaagcucguagugccuugcagaccacaagacgagcuuaucggaagggcccgcauuucccagggcgcgggcuggagccugagagaaacggcuugucuagggaaagccuacgcacagauguggucacugauguauuuucaucggagggaucuccguuuggccuccaacgcuaucugcucugccguccccgugcacuggguuccuaccagccgaacuacauggaguauucaugcacaccaucaauggaugaccacugaggacaugcugacaguguggaaucgcgucuggaucgaagauaacccauggauggaggacaagacccccgugacgacaugggagaauguaccuuaccuuggaaagagagaagaucaguggugugguucccugauaggccucaccagccgggcuacuugggcccagaacaucccgaccgcgauucagcaaguuaggucuuuaaucgggaaugaggaauuccuggacuacaugccaucaaugaaacgcuuuagaaaggaggaggaaagugagggagcuauuugguga

SEQ ID NO: 15142 - RNA, 9873 nt, Artificial Sequence
  derived and/or modified CDS sequence (opt3) from DENV-3__KF955473__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccauccuuaggaaacuguguauugagggaaagaucacaaacauaaccacggauagccggugcccuacccagggcgaagcugucuugccagaggaacaggaccagaauuauguuuguaaacacacauacguggaucgcgguugggggaacggaugcggccucuucggcaaggggagucugguaacuugcgccaaguuucaauguuuagagcccauugagggaaaagugguccaguaugaaaaucugaaguacaccgugaucauuacaguucauacuggugaccagcaccaggugggcaacgagacccaaggggucacagcagaaaucaccccucaggcuuccacuacggaggccauccucccagaauauggaacacuuggccuggagugcucuccgcgaaccgguuuggacuucaaugagaugauucuacugacuaugaaaaacaaggcguggauggugcauagacagugguuuuucgaucucccccugccuuggaccagcggggccacaaccgaaacuccaacauggaauaggaaagagcuucugguaacguuuaagaacgcacacgcuaaaaagcaagaaguuguggucuugggcucccaggagggagccaugcacaccgcucucacuggcgccacagaaauacagaauucagggggaaccaguaucuucgcaggucaucugaagugucgguuaaaaauggacaagcuggagcuaaaaggcaugagcuacgccaugugcacaaacacuuuugugcucaagaaagaggucucugaaacccagcacgggacgauucugaucaagguggaguacaagggagaagaugcucccuguaaaauaccuuucuccaccgaggacggccaagguaaggcgcauaacgggcgucuuauuacagcaaauccaguugugacuaaaaaggaggaacccguaaacaucgaggccgaaccgccuuucggcgagucaaauaucgucauuggaaucggcgauaacgcuuugaaaauuaauugguauaagaaggggagcaguauaggaaaaauguuugaagccaccgcacgcggugccagaaggauggcuauccugggcgacacagccugggauuucgggucugugggaggcguucucaacucccuggguaagauggugcaccagauuuuugggagcgcauacacugcgcuuuucucgggcgucucuugggugaugaaaaucggaaucggcguacuguugaccuggauugggcucaauuccaagaacacgucaaugaguuuuagcugcauagcuaucggaauuaucacacuguauuuaggcgccgugguucaggcagacauggguugugucauuaauuggaaagggaaggagcugaagugcggauccggcaucuucgugaccaacgaggugcauacuuggacagaacaguacaaauuucaagccgauucucccaagcggcuagcuaccgccauagcaggugcuugggagaauggcgucugugggauccgaagcacuacccgcauggaaaaccuccuguggaaacagauugccaaugagcuuaacuauaucuugugggaaaauaacauuaagcugacaguuguggugggagacaucauaggcguacucgagcaggggaaaagaacgcugaccccacagccuauggaguuaaaguacucauggaaaacuuggggaaaggcgaagauugucacagccgaaacccaaaacaguuccuucaucauugauggccccaauacaccagagugccccagcgcuucuagggcauggaacgugugggaaguugaggacuaugguuuugggguguucacuaccaauaucuggcugaaacuucgggaagucuacacgcaguugugugaccaccgccucaugucagccgcugugaaggaugagagagccguucacgcagacaugggauacuggauagagagucagaaaaacggcagcuggaagcuggaaaaagcgucccuaaucgaggugaagacaugcaccuggccuaagucucauacucuguggucgaaugguguacucgaaagcgauaugauuaucccaaaaucccuggccggcccgauuucacagcacaaccauaggcccggguaucacacccaaacagcuggaccuuggcaccuuggcaaguuggagcuggacuuuaauuacugcgaggggacuaccgucgugaucacagaaaacuguggaacgcguggcccaaguuuacggaccacuacagugucugguaaacucauacaugaguggugcugucgaagcugcacccugcccccucuuagauauaugggggaagauggauguugguacggcauggagauuaggccaaucuccgaaaaggaggagaauauggucaaaucacugguuagcgccgguucuggcaagguggacaacuucacuauggggguauugugccucgcaauccuguuugaagaggugaugcgcggaaaguucggcaaaaagcacaugauugcuggggucuucuuuacauucgugcuacugcucuccggacagaucaccuggcgggauauggcccauacgcugauuaugauaggcaguaaugcaagcgacagaauggguauggggguuacuuaucuugccuugaucgcuaccuuuaaaauucagcccuuccuggcguuaggauuuuuccucaggaagcugacaucucgcgaaaaccuucugcuaggcgugggccucgccauggcaaccacucugcaauugccggaggauaucgaacagauggcuaaugggauugcccugggauuaauggcccucaaacugaucacacaguuugagaccuaccagcuuuggacagcucugauauccuugacuuguucaaacaccauguucacgcucacagucgcauggcgaaccgccacucugauccuagcgggugugagucugcuuccuguuugccaaagcucguccaugcggaagaccgacuggcucccaauggcuguggccgcaaugggcguccccccucugcccuuguuuauuuucucucugaaggauacauuaaaacguagaagcuggccacucaaugaggggguaauggccgugggacugguuucaauccuugcuaguucccuguugaggaacgacgugccuauggcaggcccccucgucgccggugggcugcuaauugcguguuaugugaucacuggaaccucugcugaucugacgguagaaaaggccgcagacauaacaugggaggaagaggccgaacagaccggcgugagccacaaccuuaugauuacugucgacgaugacggcacaaugcgcaucaaagaugacgagaccgagaauauccucacuguucuguugaagacagcuuuacugauuguguccgggguguuuccauacucaauaccggccacccuccuggucuggcauacguggcagaaacagacucaacggagcggagugcuuugggauguuccuagucccccagaaacccagaaggcagagcuggaagaggguguauacagaaucaaacagcagggcauuuucgggaagacacaagugggagucggcgugcagaaggaggguguuuuucacaccauguggcacgugacaaggggggcugucuugacuuauaacggaaaacgacuagaacccaauugggccucugugaagaaagaccugaucuccuacggcggcggguggcgccucagcgcgcaguggcaaaagggagaggaaguacaggucauugccguggagccugguaaaaacccaaagaauuuccagaccaugcccggcacguuccagacaacuaccggggaaaucggagcaauagcucuggauuuuaagccuggcacaucggguucaccgaucauuaaccgggaggggaaaguugugggacuuuauggcaauggcgucgugaccaagaacgggggauacguuucugguaucgcccaaacuaaugcugagccagacggccccaccccugaauuagaggaagagauguucaaaaagagaaaccugacaauuauggaucuccauccagggaguggaaaaacgaggaaguauuugcccgcaaucgugcgugaagccauaaagcgccggcugagaacucucauucuggccccuaccagggucguggcugcggagauggaggaagcacuuaaaggccugccgauccgauaccagacaaccgccacuaaguccgagcacacaggucgggaaaucguagacuugaugugccaugcuaccuuuacgaugcgccuacugagccccgugagaguuccaaauuauaaccucauuaucauggaugaggcccacuucacugacccugcaucuauagccgcuaggggguacauuagcacacgggucggaaugggcgaagcggccgcaaucuuuaugaccgcuacccccccaggcacugccgaugcauucccucaguccaaugcccccauucaggacgaggagcgagacaucccagaaagaucauggaacagugggaaugaguggauaacagauuuugcuggaaaaaccgugugguucgugccgagcauuaaggccgguaacgacaucgcgaacuguuuacgcaaaaauggcaagaaggucauccaacugucuaggaaaacauuugauacugaauaccagaagacgaaacuuaacgacugggauuucguagugaccacagacauuuccgagaugggggcaaauuuuaaggccgaucguguuaucgacccucggagaugccugaaacccgugauucucacugauggaccagagagggucauauuggcuggccccaugccugugaccgccgcuucagcagcccagcgccgagguagaguugggcggaacccacagaaggaaaaugaccaauauaucuucacaggccagccccugaacaaugaugaggaccaugcucacuggaccgaagccaagaugcuccuggacaacauuaauacuccugagggaaucaucccggcacuuuucgaaccagagagggagaaaagugcggccauugauggcgaauaccgccuaaagggggagagccguaaaacguuuguggaacugaugagacggggagacuugcccgucugguuagcucacaagguggccuccgaggguauaaaauauaccgauaggaaguggugcuucgacggccagcgcaacaaucagauccuggaagagaacauggauguagagauuuggacaaaagaaggggagaagaagaaacuccgaccuagauggcuggacgcacggacuuacucugauccccuugcucugaaggaauuuaaagacuucgccgcaggaaggaagucgaucgcccucgauuuggugaccgagauuggccgcguuccaagccaucuggcucacagaacaaggaaugcgcuagacaaccuggucaugcuccauaccucagaacacggugggcgggccuaucgucacgcaguggaggagcuuccugaaacuauggagacacuguuauugcugggccucaugauccugcuuacgggaggcgcuaugcuguuucucauauccgggaaaggaaucgguaagaccaguauuggcuugaucugugugauugccucuagcgggaugcuguggauggccgaaauccccuuacaauggauagcauccgcuauuguccuagaguucuuuaugaugguucugcucaucccagagccugaaaagcagcgcacuccgcaggauaaucaacuugccuacgugguaauuggaauccugacauuggcggcuauaaucgccgcaaacgagaugggccugcucgaaaccaccaaacgagaccuggguaugucaaaggagcccgggguggucucuccaacaagcuaucuugauguggaccuccauccugccagugcuuggacucuguacgcaguugccacgaccgugauuacacccauguugagacacacuaucgaaaauuccaccgcgaacgucagccuggcugccauugcaaaccaggccguaguguuaaugggccuagacaaaggauggccaaucucuaagauggaucugggcguuccucuccuugcucuggggugcuacucacaggugaaucccuugacacugaccgccgcaguccuccugcuuauaacucauuaugcuauuaucggaccgggcuuacaggccaaagcgacgagggaggcccaaaagcggacagcagcugguaucaugaagaacccaaccguggacgggauuaugacuaucgaucuggacccugucauauacgauuccaaauucgagaagcagcucggacaggugauguugcugguucuaugugccgugcagcugcuccuuaugcgcaccaguugggcacugugcgaagcuuugacacuggccacuggccccauuaccacacucugggaggguagcccaggcaaauuuuggaauacgaccaucgccguaucgauggcgaacauuuucagagggucuuaucuggcuggagcaggcuuagccuuuuccaucaugaagagcguggggacuggaaaaaggggcacagguucacaaggggaaacccuuggagagaaguggaagaaaaagcugaaucagcucagucggaaagaauucgaccuauacaagaaaucuggcauaacugaggucgaucgaacagaggcuaaggaaggucugaaaagaggcgagaccacgcaccaugccguuucccgcgggagcgcaaaguugcagugguuuguggaaaggaacauggucauccccgagggacgggugauugaccugggcugugggcguggaggcuggucauauuacugcgccggucucaagaaaguaaccgaagugagaggguauacaaagggaggcccuggccacgaggagccgguucccaugaguacuuacggguggaauaucgugaaacuuaugagcggaaaggaugucuucuaccugccaccugaaaaaugugacaccuugcugugcgauauuggugaguccucucccagcccuacaguggaagaguccaggacuauccgcguccucaagaugguggagccaugguuaaagaacaaucaguucuguauuaaaguucugaaccccuauaugccuaccguaaucgaacaccuugagcggcugcaacgaaagcauggcgggaugcuagugagaaauccacucucaaggaacucuacacacgaaauguacuggauaaguaauggaaccggcaacauugucgcuucggugaauaugguuagccgccuguugcugaaccgguuuacuaugacgcauagacgucccacaaucgagaaagacguggaucucggugcggggaccaggcacgucaacgccgaaccggagacuccuaauauggacgugaucggagagcggauuaagcgcauaaaagaagagcacaacuccaccuggcauuaugacgaugaaaauccauacaagacaugggcauaucacggcucuuacgagguaaaggcuacgggcucagccagcuccaugaucaacggggugguuaaacuucugaccaagcccugggacgucgugccuauggugacucagauggcaaugacagauaccacuccauucggacagcaacgagucuuuaaagaaaagguugacacaagaacccccaggaguaugccggguacacggcgcgugaugggcauuacugccgagugguuauggagaacccuggggaggaauaaaaagccucgauugugcacgcgggaggaauucaccaagaaaguacguacaaacgcugccaugggagcgguguuuacugaggaaaaucagugggauucugcaaaggccgcugucgaggacgaagauuucuggaaacucguggacagagagcgcgagcugcauaagcuaggcaaaugugguagcugcguuuauaacaugauggggaagagggaaaaaaagcuuggagaguuuggcaaggccaaaggcucacgggcaaucugguacauguggcugggggcuagauaccucgaauucgaggcccugggauuuuugaaugaggaucacugguucucccgcgaaaacaguuauagcgguguggagggcgaagggcugcauaagcucggauacauucuuagggacaucucuaaaauacccggcggugcuauguaugccgaugacaccgcagggugggacacacgaaucacugaggaugaccugcacaaugaagagaagauuacccagcagauggauccagagcaccggcaauuagcgaacgccaucuuuaaacugacguaccagaauaaggucgugaagguacagagaccuacacccaccggaacuguuauggacauuaucuccaggaaagaucagcgcggcucaggccaaguggggacauauggauugaacaccuucacuaauauggaagcucagcucauacgucagauggagggugaaggcguccugagcaaggccgaccuagagaacccacaucuucccgaaaaaaagauuacccaguggcuggagacaaaagggguggagcggcucaagagaauggcaaucucgggagaugacugcguggucaagccuaucgaugacagguuugcuaacgcccuguuggcauuaaaugauaugggcaaaguucgcaaggacauuccacaauggcagccgucuaaagguuggcacgauuggcagcaggugcccuucuguagucaucacuuccacgaacugauaaugaaggacgggcgaaaacucguagugccuugccggccacaagacgagcuuaucggaagagccaggauuucccagggcgcgggcuggagccugcgcgaaacggcuugucuagggaaggccuacgcacagauguggucacugauguauuuucauagacgggaucucagguuggccuccaacgcuaucugcucugccguccccgugcacuggguuccuaccagccguacuacauggaguauucaugcacaccaucaauggaugaccacugaggacaugcugacaguguggaaucgagucuggaucgaagauaacccauggauggaggacaagacccccgugacgacaugggagaauguaccuuaccuuggaaaacgcgaagaucaguggugugguucccugauaggccucaccagcagagcuacuugggcccagaacaucccgaccgcgauucagcaaguucggucuuuaaucgggaaugaggaauuccuggacuacaugccaucaaugaagagguuucgcaaagaggaggaaagugagggagcuauuugguga

SEQ ID NO: 15143 - RNA, 9873 nt, Artificial Sequence
  derived and/or modified CDS sequence (opt3) from DENV-3__FJ850079__SS-prME
accagccugugccucaugaugauccuucccgccgcucuggcauuccacuugaccuccagagacggcgaaccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccagacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucagcuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucaaaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagauguucccuguaaaaucccuuucuccacagaggacggccaagguaaggcucauaacgggcgucuuauaacugcgaauccagugguaaccaaaaaggaggaacccgucaacguggaggcagaaccgccuuucggcgagucaaauauuguuaucggaaucggcgauaacgccuugaaaauuaauugguauaagaaggggagcaguaucggaaaaauguuugaagcuacagcccgcggugcaagaaggauggccauucugggcgacacugcuugggauuucgggucugugggaggcguccucaacucccuggguaagauggugcaccagauauuugggagcgccuacaccgcacuuuucucgggcguaucuugggugaugaaaaucggaauuggcguucuguugacguggaucgggcucaauuccaagaacacaucaaugaguuuuagcugcaucgcgauuggaauaaucacccuguauuuaggcgcugucgugcaggccgacauggguugugugauuaauuggaaagggaaggagcugaagugcggauccggcaucuucgucacuaacgagguucauacauggaccgaacaguacaaauuucaagcagauucucccaagcggcuagccacugcuauugccggugcaugggagaauggcgugugugggauccgaagcaccacacgcauggaaaaccuccuguggaaacagauagcuaaugagcuuaacuauaucuugugggaaaauaacauuaagcugacggugguagucggagacaucaccggcgugcucgagcaggggaaaagaacucugacaccacagccuauggaguuaaaguacucauggaaaaccuggggaaaggccaagauuguuacagcggaaacucaaaacaguuccuucaucauagauggccccaauaccccagagugccccagcgccucuagggcuuggaacgugugggaagucgaggacuaugguuuugggguguucacgacaaauauuuggcugaaacuucgggaaguuuacacccaguugugugaccaccgccucaugucagcagccgugaaggaugagagagcuguacacgccgacaugggauacuggaucgagagucagaaaaacggcagcuggaagcuggaaaaagcaucccuaauugaggucaagacuugcaccuggccuaagucucauacacuguggucgaauggugugcucgaaagcgauaugaucauaccaaaaucccuggcgggcccgaucucacagcacaacuauaggcccggguaccauacucaaaccgccggaccuuggcaccuuggcaaguuggagcuggacuuuaauuauugcgaggggacaacgguggucauuaccgaaaacuguggaacucguggcccaaguuuacggacaaccacuguuucugguaaacucauccacgaguggugcugucgaagcugcacacugcccccucuuagauacaugggggaagauggauguugguauggcauggagauuaggccaaucuccgaaaaggaggagaauauggugaaaucacugguaagcgcugguucuggcgaaguggacaacuucaccaugggggucuugugccucgccauacuguuugaggaagugaugcgcggaaaguucggcaagaaacauaugauugcagggguuuucuuuacguucgugcuacugcucuccggacagaucacuuggcgggauauggcucacacccugaucaugauuggcaguaaugccagcgacagaauggguaugggggucacauaccuugcauugaucgccaccuuuaagauucagcccuuccuggcuuuaggauuuuuccucaggaaacugacuucucgcgagaaccuucugcuaggcgugggccucgcgauggccacaacccugcaauugccggaagauauagagcagauggcaaaugggaucgcucugggauuaauggcccucaagcugauuacacaguuugagacuuaucagcuuuggaccgcccugaucuccuugacguguucaaacacaauuuucacccucacuguugcuuggcgaaccgcaacacugauccuagccggugugagucugcuuccugucugccaaagcucguccaugcggaaaacugacuggcucccaaugaccguagcggcuaugggcgugcccccucugcccuuguuuauauucucucugaaggauacguuaaagcguagaagcuggccacucaaugaagggguuauggccgugggacuggucucaauccuugcaaguucccuguugaggaacgacgugccuauggccggcccccucguagcuggugggcugcuaauugcauguuacgugaucacaggaaccucugccgaucugacugucgagaaagcggcugacguuacaugggaagaggaagccgagcagaccggcgugagccauaaccuuaugauuacuguggacgaugacggcacaaugcgcaucaaggaugacgagaccgaaaauauacucacgguccuguugaaaacugcauuacugauuguguccgggaucuuuccauacucaaucccggccacccuccugguuuggcacacauggcagaagcagacccaacggagcggaguacuuugggaugugccuagucccccagagacacagaaagcugaacuggaggagggugucuauagaauuaagcagcagggcauauucgggaaaacucaagugggaguuggcgugcagaaggaaggugucuuucauaccauguggcacgugacgagaggggccguauugacauacaacggaaagcgacuagagcccaauugggcaucugucaaaaaggaccugaucuccuauggcggcggguggcgccucagcgcucaguggcaaaaaggagaagaggugcagguuauugccguggaaccugguaagaaccccaagaauuuccagacuaugcccggcaccuuccagacaaccacuggggagaucggagcgauugcccuggauuuuaagccuggcaccucggguucaccgaucauaaaccgggaggggaaggucgugggacuuuacggcaauggcguugugaccaagaacgggggauaugucucugguaucgcacaaacgaaugcugaaccagacggccccacuccugaguuagaagaggaaauguucaagaaaagaaaccugaccauuauggaucuccacccagggaguggaaagacaaggaaauacuugcccgccaucgugcgugaggcuauuaagcgccggcugagaacccucauccuggcaccuacuaggguaguggccgccgagauggaagaggcucuuaagggccugccgauacgauaucagacaaccgcgacgaaauccgaacauacuggucgggagauuguugacuugaugugccacgcaacauuuaccaugcgccuacugagccccgucagagugccaaauuacaaccucaucaucauggaugaagcccauuucaccgacccugcuucuauugccgcaaggggguacaucagcacucgggugggaaugggcgaggccgcugcgauauuuaugacagccacaccaccaggcacagcagaugcuuucccucaguccaaugcccccauucaggacgaggaacgagacaucccagagagaucauggaacagugggaaugaauggauuacugauuuugcaggaaagacggucugguucguaccgagcaucaaagccgguaacgacauagcuaacuguuuacgcaagaauggcaaaaaggugauucaacugucuaggaagaccuuugauacagaguaucagaaaacuaaacuuaacgacugggauuucguugugaccacagacaucuccgagaugggggccaauuuuaaagcggaucgugucaucgacccucggagaugccugaagcccgugauucucaccgauggaccagaaaggguuaucuuggcaggccccaugccugugacugccgcuucagccgcucagcgccgagguagagucgggcggaacccacagaaagagaaugaccaauacauuuucacgggccagccccugaacaaugaugaagaccacgcacauuggaccgaggccaagaugcuccuggacaacauaaauacaccugaaggaaucauuccggcucuuuucgagccagagagggaaaagagugccgcaaucgauggcgaguaucgccuaaaaggggaaagccguaagacuuuuguggagcugaugagacggggagacuugcccguaugguuagcgcacaaaguggccuccgaagguaucaaguacaccgauaggaaauggugcuucgacggccagcgcaacaaucagauucuggaggagaacauggauguugaaauauggacaaaggagggggagaaaaagaagcuccgaccuagauggcuggacgcucggaccuauucugauccccuugcccugaaagaguuuaaggacuucgcagcuggaaggaaaucgaucgcccucgauuuggucacugaaauuggccgcgugccaacacaccuggcacauagaacgaggaaugcccuagacaaccuggugaugcuccacaccagcgagcauggugggaaggcuuaccggcacgcggucgaggaacuuccugagacuauggaaacacuguuauugcugggccucaugauccugcuuaccggaggcgccaugcuguuucucauuucagggaaaggaaucgguaagaccuccauaggcuugaucuguguuauugcaaguucugggaugcuguggauggcugagauccccuuacaauggauugccagcgccaucgugcuagaguucuuuaugaugguacugcucauaccagaaccugagaagcagcguacaccgcaggauaaucaacuugcauauguggucauuggaauccugacuuuggcugccauuaucgcggcuaacgaaaugggccugcucgagacgaccaaacgcgaccuggguauguccaaggaacccggggugguuucaccaacaucuuaccuugauguggaccuccacccugccagcgcauggacucuguacgccgucgcuaccacaguaauaacccccauguugcgacauacuaucgagaauaguacggcaaacgugucccuggccgcgauugcuaaccaggccguuguguuaaugggccuagacaaaggauggccaaucagcaagauggaucugggcgucccucuccuugcacuggggugcuauucucaggugaaucccuugacacugaccgccgcuguccuccugcuuauuacucacuacgccaucauaggaccgggcuuacaggcaaaagcuaccagagaggcccaaaagaggacagcggccgguauuaugaagaacccaacuguggacgggaucaugaccaucgaucuggacccuguuauuuaugauucaaaauucgaaaagcagcucggacaggugauguugcugguacuaugugcagugcagcugcuccuuaugcggacauccugggcucugugcgaggccuugacgcuggcaaccggccccaucacuacacucugggaagguaguccaggcaaauuuuggaauaccacuauagcugucagcauggccaacauuuuccgcgggucguaccuggccggagcgggcuuagcuuuuucuaucaugaaguccguugggacaggaaaaagaggcaccgguagccaaggggagacgcuuggagaaaaguggaagaaaaagcugaaucagcucucaaggaaagaguucgaccuauauaagaaaaguggcauuaccgagguggaucggacagaagcaaaggagggucugaaacgaggcgaaaucacucaucacgccgucucuagaggguccgcuaaguugcagugguuuguggagcgcaacaugguaauacccgaaggaagggugaucgaccugggcugugggcggggaggcuggagcuacuauugcgccggucucaagaaaguuaccgaggugcguggguacacaaagggaggcccuggccaugaggaaccgguccccaugucaacuuacggguggaauauugugaaacuuaugaguggaaaggaugucuucuaucugccaccugagaaaugugacaccuugcugugcgauaucggugaaagcucccccucuccuacaguggaggagagcagaaccauuaggguucucaagaugguagaaccaugguuaaagaacaaucaguucuguaucaaagugcugaaccccuacaugccuacugucauugagcaccuugaacgccugcaacggaagcacggcgggaugcuagugcgaaauccacucuccagaaacucaacgcaugagauguauuggaucucuaauggaacaggcaacauaguugcaagugugaauauggucucgaggcuguugcugaaccgcuuuaccaugacucaccggagacccaccauugaaaaagacguggaucucggugccgggacacgucauguaaacgcugagccggagacgccuaauauggacgugaucggagaaaggaucaagcggauuaaagaggaacacgacagcaccuggcacuacgaugacgagaacccauauaagacuugggcguaccauggcuccuaugaaguuaaggccacaggcucugcaucaagcaugauaaauggggucgugaaacuucugaccaagcccugggauguggucccuaugguuacucagauggcuaugacagacaccacaccauucggacagcaacgcguguuuaaagagaagguagauacucgaacccccagauccaugccggguacgaggcgggugaugggcaucaccgccgagugguuauggcgcacacuggggagaaacaaaaagccuagguugugcacucgagaagaguucaccaagaaaguccggacaaaugcagccaugggagcuguguuuacugaagagaaccagugggacagugccaaggcggcaguugaagaugaggacuucuggaaacucguggaucgugagagagaacugcacaagcuaggcaaaugugguucuugcgucuacaauaugauggggaagcgcgagaagaaacuuggagaauuuggcaaagccaaaggcagcagggcuauuugguacauguggcugggggcccgguaucucgaguucgaggcacugggauuuuugaacgaagaccauugguucucaagagaaaauuccuacagugguguggagggcgaggggcugcacaagcucggauauauccuucgcgauauuagcaaaauccccggcggugcuauguacgccgacgacaccgcugggugggauacgaggauaacagaagacgaucugcauaacgaggagaagaucacccagcagauggacccagaacaccgacaauuagccaaugcaauuuuuaaacugacuuaucagaacaagguaguuaaggugcagcggccuacacccaccggaacugucauggauaucauuucuagaaaagaccagaggggcuccggccaaguggggaccuacggauugaauacauucacgaacauggaggcgcagcucauccgccagauggaaggugagggcgugcugucaaaggccgaucuagaaaauccacaccuucccgagaaaaagauaacccaguggcuggagacuaaaggggucgaacgucucaagcggauggcuauuagcggagacgauugcguugugaagccuaucgacgauagauuugccaacgcacuguuggcuuuaaacgacaugggcaaaguaaggaaggauaucccacaauggcagccgucgaaagguuggcaugacuggcaacaggugcccuucuguucucaccauuuccacgagcugauuaugaaggacgggcgcaaacucgucgugccuugccgaccacaagaugaacuuauaggacgggccagaaucagucagggcgcaggcuggucccugagggagacagccugucuagggaaggcguaugcucagauguggagccugauguacuuucaccgcagagaccuccgguuggccucaaaugcaauuugcuccgccguucccgugcauugggucccuaccucuaggacuacauggagcauccacgcucaucaccaauggaugaccacggaagauaugcugacaguguggaaccguguauggauugaggacaauccauggauggaggauaagacccccguuacuaccugggaaaacgugccuuaccuuggaaaacgagaggaccaguggugugguagucugaucggccucacaucccgcgccacuugggcacagaauauaccgaccgcuauccagcaagucaggagcuuaauugggaacgaagaguuccuggauuauaugccaucuaugaagcgguuuaggaaagaggaagagucagaaggagccaucugguga

SEQ ID NO: 15144 - RNA, 9873 nt, Artificial Sequence
  derived and/or modified CDS sequence (opt3) from DENV-3__FJ850080__SS-prME
accagccugugccucaugaugauccuucccgccgcucuggcauuccacuugacauccagagacggcgagccuaggaugauuguggggaagaacgaacggggaaagucuuuacuguuuaagacugccucagguauaaauauguguacgcuaaucgcgauggaucucggcgagaugugcgacgauaccgucaccuacaaguguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccagacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucaaaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagaugcucccuguaaaaucccuuucuccacagaggacggccaagguaaggcgcauaacgggcgucuuauaacugcaaauccaguugugaccaaaaaggaugagcccguaaacauugaagccgagccgccuuucggcgaaucaaauaucgucaucggaauuggcgacaacgcuuugaaaaucaauugguauaagaaggggagcaguauuggaaaaauguuugaggccacagcacgcggugccagaaggauggcuauacugggcgauacugccugggacuucgggucugugggaggcguucucaacucccuggguaagauggugcaccagaucuuugggagcgcauacaccgcgcuuuucucgggcgucucuugggugaugaaaauuggaaucggcguacuguugacguggaucgggcucaauuccaagaacacaucaaugaguuuuagcugcauugcuauaggaaucauuacccuguauuuaggcgccgugguucaggcagauauggguugugucaucaauuggaaagggaaggaacugaagugcggauccggcauuuucgugacuaacgaggugcauacauggaccgagcaguacaaauuucaagccgacucucccaagcggcuagcuacugccaucgccggugcuugggaaaauggcgucugugggauacgaagcaccacacgcauggagaaccuccuguggaaacagguugccaaugaacuuaacuauaucuugugggagaauaacauuaagcugacgguggugguaggagauaucauuggcguccucgaacaggggaaaagaacccugacuccacagccuauggaguuaaaguacucauggaaaacauggggaaaggcgaagaucgugaccgccgagacacaaaacaguuccuucauaauugacggccccaauacuccagaaugccccagcgcuucuagggcauggaacguuugggagguggaagacuaugguuuuggggucuucaccacgaauaucuggcugaaacuucgggagguguacacacaguugugugaucaccgccucaugucagccgcuguuaaggacgaaagagccgugcacgcagauaugggauacuggauugagagucagaaaaacggcagcuggaagcuggagaaagcgucccuaaucgaaguaaagaccugcacuuggccuaagucucauacccuguggucgaaugguguccucgagagcgacaugauaaucccaaaaucccuggccggcccgauuucacagcacaaccauaggcccggguaucacacacaaacugcuggaccuuggcaccuuggcaaguuggaacuggauuuuaauuacugcgaggggaccacaguggugaucacggagaacuguggaacccguggcccaaguuuacggacuacaaccgucucugguaaacucauucaugaauggugcugucgaagcugcacucugcccccucuuagauauaugggggaggacggauguugguacggcauggaaaucaggccaauauccgagaaggaagagaauaugguuaaaucacuggugagcgccgguucuggcaagguagauaacuucacaauggggguguugugccucgcaauucuguuugaggaagucaugcgcggaaaguucggcaaaaagcacaugaucgcugggguguucuuuauguucguucuacugcucuccggacagaucaccuggcgggacauggcccauacgcugauuaugaucggcaguaaugcaagcgauagaauggguaugggggugacuuaucuugccuugauugcuaccuuuaaaauacagcccuuccuggcguuaggauuuuuccucaggaagcugacaucucgcgagaaccuucugcuaggcgucggccucgccauggcaaccacucugcaauugccggaagacaucgagcagauggcuaaugggauugcccugggauuaauggcccucaaacugaucacacaguuugaaaccuaccagcuuuggacagcucugauuuccuugacuuguucaaacaccauguucacgcucacaguggcauggcgaaccgccacucugauccuagcggguguuagucugcuuccugugugccaaagcucguccaugcggaagaccgauuggcucccaauggcugucgccgcaaugggcguacccccucugcccuuguuuauauucucucugaaggacacauuaaaacguagaagcuggccacucaaugagggggugauggccguuggacuggugucaauccuugcuaguucccuguugaggaacgaugucccuauggcaggcccccucguggccggugggcugcuaauugcguguuauguaaucacuggaaccucugcugaccugacgguggagaaggccgcagacauuacaugggaagaggaagccgagcagaccggcgucagccacaaccuuaugaucacuguugaugacgauggcacaaugcgcauaaaagacgaugaaaccgagaauauucucacugugcuguugaagacagcuuuacugaucguguccggggucuuuccauacucaaucccggccacccuccugguguggcauacguggcagaaacagacucaacggagcggaguucuuugggacguaccuagucccccagagacccagaaggcagaacuggaggaagguguguacagaauuaaacagcagggcauauucgggaagacacaagucggagugggcguucagaaggaggguguguuucacaccauguggcacgucacaagaggggcuguguugacuuauaacggaaaacgacuagagcccaauugggccucuguaaagaaagaucugaucuccuacggcggcggguggcgccucagcgcgcaguggcaaaagggagaagagguccaggugauugccguugaaccugguaaaaacccaaagaauuuccagaccaugcccggcacguuccagacaacuaccggggagaucggagcaauugcucuggacuuuaagccuggcacaucggguucaccgaucauaaaccgggaagggaaaguggucggacuuuauggcaauggcgugguuaccaagaacgggggauacgugucugguaucgcccaaacuaaugcugagccagauggccccaccccugaguuagaagaggaaauguucaaaaagagaaaccugacaauuauggaccuccauccagggaguggaaaaacgaggaaguauuugcccgcaaucguccgugaggccauuaagcgccggcugagaacucucauccuggccccuaccagggugguagcugcggaaauggaggaggcacuuaaaggccugccgauacgauaccagacaaccgccacuaaguccgaacacacaggucgggagauuguggauuugaugugccaugcuaccuuuacgaugcgccuacugagccccguuagagucccaaauuauaaccucaucaucauggacgaagcccacuucacugauccugcaucuauugccgcuaggggguacaucagcacacgggugggaaugggcgaggcggccgcaauauuuaugaccgcuacacccccaggcacugccgacgcauucccucaguccaaugcccccauucaggacgaggaacgagauaucccagagagaucauggaacagugggaaugaauggauuacagacuuugcuggaaaaaccgugugguucgucccgagcaucaaggccgguaacgauauagcgaacuguuuacgcaaaaauggcaagaagguaauucaacugucuaggaaaacauuugacacugaguaccagaagacgaaacuuaacgauugggacuucgugguuaccacagauaucuccgaaaugggggcaaauuuuaaggccgaccgugugaucgauccucggagaugccugaaacccgucauucucacugacggaccagagagggugaucuuggcuggccccaugccuguuaccgccgcuucagcagcccagcgccgagguagaguggggcggaacccacagaaggagaaugaucaauauauuuucacaggccagccccugaacaaugacgaagaccaugcucacuggaccgaggccaagaugcuccuggauaacauaaauacuccugaaggaaucauuccggcacuuuucgagccagaaagggagaaaagugcggccaucgacggcgaguaccgccuaaagggggaaagccguaaaacguuugucgagcugaugagacggggagauuugcccgugugguuagcucacaagguagccuccgaagguaucaaauauaccgacaggaaguggugcuucgauggccagcgcaacaaucagauucuggaggaaaacauggacguggagauauggacaaaagagggggaaaagaagaaacuccgaccuagauggcuggaugcacggacuuacucugacccccuugcucugaaggaguuuaaagauuucgccgcaggaaggaagucgaucgcccucgacuugguuaccgaaauuggccgcgucccaagccaucuggcucacagaacaaggaaugcgcuagauaaccuggugaugcuccauaccucagagcacggugggcgggccuaucgucacgcaguggaggaacuuccugagacuauggaaacacuguuauugcugggccucaugauccugcuuacgggaggcgcuaugcuguuucucauuuccgggaaaggaaucgguaagaccaguauaggcuugaucugugucauugccucuagcgggaugcuguggauggccgagauccccuuacaauggauugcauccgcuaucguucuagaguucuuuaugauggugcugcucauaccagagccugagaagcagcgcacuccgcaggacaaucaacuugccuacguagugauuggaauccugacauuggcggcuauuaucgccgcaaacgaaaugggccugcucgagaccaccaaacgagaucuggguaugucaaaggaacccggggucgugucuccaacaagcuaucuugacguugaccuccauccugccagugcuuggacucuguacgcaguggccacgaccgucauaacacccauguugagacacacuaucgaaaauuccaccgcgaacguaagccuggcugccauugcaaaccaggccgugguuuuaaugggccuagauaaaggauggccaaucucuaagauggaccugggcgugccucuccuugcucuggggugcuacucacaggucaaucccuugacacugaccgccgcagugcuccugcuuauuacucauuaugcuaucauaggaccgggcuuacaggccaaagcgacgagggaagcccaaaagcggacagcagcugguauuaugaagaacccaaccgucgaugggaucaugacuaucgaccuggauccugugauuuacgacuccaaauucgagaagcagcucggacagguuauguugcuggugcuaugugccguacagcugcuccuuaugcgcaccaguugggcacugugcgaggcuuugacacuggccacuggccccaucaccacacucugggaagguagcccaggcaaauuuuggaauacgaccauagccgugucgauggcgaacauuuucagagggucuuaucuggcuggagcaggcuuagccuuuuccaucaugaaaagcgucgggacuggaaaaaggggcacagguucacaaggggagacccuuggagaaaaguggaagaaaaagcugaaucagcucagucggaaagaguucgaucuauacaagaaaucuggcauuacugaaguugaccgaacagaggcuaaggagggucugaaaagaggcgaaaccacgcaccaugccgugucccgcgggagcgcaaaguugcagugguuugucgagaggaacauggugauccccgaaggacggguaauagaucugggcugugggcguggaggcuggucauauuacugcgccggucucaagaaagugaccgagguuagaggguauacaaagggaggcccuggccacgaggaaccggugcccaugaguacuuacggguggaauaucauuaaacuuaugagcggaaaggacgucuucuaccugccaccugagaaaugugauaccuugcugugcgacaucggugaauccucucccagcccuacaguggaggaauccaggacuauucgcguccucaagaugguggagccaugguuaaagaacaaucaguucuguaucaaaauucugaaccccuauaugccuaccguuaucgagcaccuugaacggcugcaacgaaagcauggcgggaugcuaguaagaaauccacucucaaggaacucuacacacgagauguacuggauaaguaauggaaccggcaacauuguggcuucggucaauauggugagccgccuguugcugaaccgguuuacuaugacgcauagacgucccacaaucgaaaaagauguugaccucggugcggggaccaggcacgugaacgccgagccggaaacuccuaauauggacgucaucggagagcggauuaagcgcauaaaagaggaacacaacuccaccuggcauuaugaugacgagaauccauacaagacaugggcauaucacggcucuuacgaagugaaggcuacgggcucagccagcuccaugaucaacgggguagugaaacuucugaccaagcccugggauguugucccuauggugacucagauggcaaugacagacaccacuccauucggacagcaacgaguguuuaaagagaaggucgauacaagaacccccaggaguaugccggguacacggcgcguuaugggcauuacugccgaaugguuauggagaacccuggggaggaauaaaaagccucgauugugcacgcgggaggaguucaccaagaaagugcguacaaacgcugccaugggagcgguauuuacugaagagaaucagugggacucugcaaaggccgcuguggaagaugaggacuucuggaaacucgucgauagagaacgcgagcugcauaagcuaggcaaaugugguagcugcguguauaacaugauggggaagagggagaagaaacuuggagaauuuggcaaagccaaaggcucacgggcaaucugguacauguggcugggggcuagauaccucgaguucgaagcccugggauuuuugaaugaggaccacugguucucccgcgagaacaguuauagcgguguugaaggcgaggggcugcauaagcucggauacauucuuagggauaucucuaaaauacccggcggugcuauguaugccgacgacaccgcagggugggauacacgaaucacugaagacgaucugcacaaugaggaaaagauuacccagcagauggacccagagcaccggcaauuagcgaacgccaucuuuaaacugacguaccagaauaagguggucaaggugcagagaccuacacccaccggaacuguaauggauauuaucuccaggaaagaccagcgcggcucaggccaaguugggacauauggauugaacaccuucacuaauauggaggcucagcucauacgucagauggaaggugagggcgugcugagcaaggccgaucuagaaaacccacaucuucccgagaaaaagauuacccaguggcuggaaacaaaaggggucgagcggcucaagagaauggcaaucucgggagacgauugcguggugaagccuaucgacgauagguuugcuaacgcccuguuggcauuaaaugacaugggcaaaguccgcaaggauauuccacaauggcagccgucuaaagguuggcacgacuggcagcagguucccuucuguagucaucacuuccacgagcugauaaugaaggacgggcgaaaacucgugguaccuugccggccacaagaugaacuuaucggaagggcaaggauuucccagggcgcgggcuggagccugcgcgagacggcuugucuagggaaggccuacgcacagauguggucacugauguauuuucauagacgggaccucagguuggccuccaacgcuaucugcucugccgugcccguccacugggugccuaccagccguacuacauggaguauucaugcacaccaucaauggaugaccacugaagauaugcugacaguuuggaaucgaguguggaucgaggacaacccauggauggaagauaagacccccgucacgacaugggaggacgugccuuaccuuggaaaacgcgaggaucaguggugugguucccugauaggccucaccagcagagcuacuugggcccagaauaucccgaccgcgauucagcaaguacggucuuuaaucgggaacgaagaguuccuggacuacaugccaucaaugaagagguuucgcaaagaagaggagagugaaggagcuauuugguga

SEQ ID NO: 15145 - RNA, 9873 nt, Artificial Sequence
  derived and/or modified CDS sequence (opt3) from DENV-3__FJ850083__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccagcaugaaaaucugaaguauacagugauuaucacuguucacaccggugaccagcaucaggugggcaacgagacacaaggggucaccgcagaaauuacuccucaggcuuccacgacagaggccauccucccagaauacggaacccuuggccuggagugcucuccgcgaacugguuuggacuucaaugagaugauccuacugaccaugaaaaacaaggcguggauggugcacagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcauacugcucucacaggcgccaccgaaauucagaauucagggggaacaaguauauucgcaggucaccugaagugucgguuaaaaauggacaagcuggagcuaaaaggcaugagcuaugccaugugcacuaacaccuuugugcucaagcgugaggucucugaaacgcagcaugggaccauccugauuaaaguggaguacaagggagaagaugcucccuguaagaucccuuucuccacagaggacggccaagguaaagcgcacaacgggcgccuuauaacugcaaauccaguugugaccaagaaagaugagcccguaaacauugaagccgagccgccuuucggcgaaucaaauaucgucaucggaauuggcgacaacgcuuugaagaucaauugguacaaaaaggggagcaguauuggaaagauguuugaggccacagcaagaggugccaggcggauggcuauacugggcgauacugccugggacuucgggucugugggaggcguucucaacucccuggguaaaauggugcaucagaucuuugggagcgcauauaccgcgcuuuucucgggcgucucuugggugaugaagauuggaaucggcguacuguugacguggaucgggcucaauuccaaaaacacaucaaugaguuuuagcugcauugcuauaggaaccaucacucuguacuuaggcgccgugguucaggcagauauggguugugucauuaauuggaaggggaaagaacugaagugcggauccggcaucuucgugacaaacgaggugcacaccuggacugagcaguauaaguuucaagccgacucucccaaacgacuagcuaccgccauugcaggugcuugggaaaauggcgucugugggauccgcagcacaacgagaauggagaaccuccuguggaagcagauagccaaugaacuuaacuacaucuugugggagaauaacauuaaacugaccguuguggugggagauaucauuggcguacucgaacaggggaagaggacucugacaccacagccuauggaguuaaaauauucauggaagaccuggggaaaagcgaagaucgucacagccgagacucaaaacaguuccuucauaauugacggccccaauaccccagaaugccccagcgcuucucgggcauggaacgugugggagguugaagacuacgguuuugggguguucacgacaaauaucuggcugaagcuucgcgaggucuauacccaguugugugaucacagacucaugucagccgcugugaaagacgaaagggccguucaugcagauaugggauacuggauugagagucagaagaacggcagcuggaaacuggagaaggcgucccuaaucgaagugaaaacuugcaccuggccuaagucucacacacuguggucgaaugguguacucgagagcgacaugauaaucccaaagucccuggccggcccgauuucacagcauaaccaccgucccggguaccacacucaaaccgcuggaccuuggcaucuuggcaaauuggaacuggauuuuaauuauugcgaggggacaacggucgugaucaccgagaacuguggaacucggggcccaaguuuacgaacaaccacugugucugguaagcucauucacgaauggugcuguagaagcugcacacugcccccucuuagguacaugggggaggacggauguugguauggcauggaaauccgcccaauauccgagaaagaagagaauauggucaagucacugguuagcgccgguucuggcaaaguggauaacuucaccauggggguauugugccucgcaauucuguuugaggaagugaugcggggaaaguucggcaagaaacauaugaucgcuggggucuucuuuacguucgugcuacugcucuccggacagaucacuuggagagacauggcccacacccugauuaugaucggcaguaaugcaagcgauaggauggguauggggguuacauaccuugccuugauugcuaccuuuaagauacagcccuuccuggcguuaggauuuuuccuccgcaaacugacuucucgagagaaccuucugcuaggcgugggccucgccauggcaacaacccugcaauugccggaagacaucgagcagauggcuaaugggauugcccugggauuaauggcccucaagcugaucacacaguuugaaacuuaucagcuuuggaccgcucugauuuccuugacguguucaaacacaauguucacccucacugucgcauggcggaccgccacacugauccuagcgggugugagucugcuuccuguuugccaaagcucguccaugcguaaaacugauuggcucccaauggcuguggccgcaaugggcguccccccucugcccuuguuuauauucucucugaaggacaccuuaaagagaaggagcuggccacucaaugaggggguaauggccgugggacugguuucaauccuugcuaguucccuguugcgcaacgaugugccuauggcaggcccccucgucgccggugggcugcuaauugcguguuacgugaucacgggaacaucugcugaccugaccguagagaaagccgcagacauuacuugggaagaggaagccgagcagacaggcgugagccauaaccuuaugaucaccgucgaugacgauggcacuaugcggauaaaggacgaugaaacagagaauauucucaccguucuguugaaaacggcuuuacugaucguguccgggguguuuccauauucaaucccggccacucuccuggucuggcacaccuggcagaagcagacacaaagaagcggagugcuuugggacguuccuagucccccagagacccagaaagcagaacuggaggaagguguauacaggauuaagcagcagggcauauucgggaaaacacaagugggagucggcgugcagaaggaggguguuuuucacacuauguggcaugugacccgaggggcugucuugacguacaacggaaagcgccuagagcccaauugggccucugugaaaaaggaucugaucuccuauggcggcggguggcggcucagcgcgcaguggcaaaaaggagaagagguacaggucauugccguggaaccugguaagaacccaaaaaauuuccagacaaugcccggcacuuuccagaccacaaccggggagaucggagcaauugcucuggacuuuaagccuggcacuucggguucaccgaucauaaacagagaagggaagguugugggacuuuacggcaauggcgucgugaccaaaaacgggggauauguuucugguaucgcccaaacaaaugcugagccagauggccccacgccugaguuagaagaggaaauguucaagaaaaggaaccugacuauuauggaccuccacccagggaguggaaagacccguaaauacuugcccgcaaucgugcgcgaggccauuaagcggagacugaggacacucauccuggccccuacccgagucguggcugcggaaauggaggaggcacuuaagggccugccgauacgguaucagacuacagccaccaaauccgaacauacgggucgcgagauuguagauuugaugugccacgcuacuuuuacaaugagacuacugagccccgugaggguuccaaauuacaaccucaucaucauggacgaagcccauuucaccgauccugcaucuauugccgcucggggguauaucagcacccgagucggaaugggcgaggcggccgcaauauuuaugacugcuacacccccaggcaccgccgacgcauucccucaguccaaugcccccauucaggacgaagagagagauaucccagagcgcucauggaacagugggaaugaauggauuacagacuuugcuggaaagacugugugguucgugccgagcaucaaagccgguaacgauauagcgaacuguuuaaggaagaauggcaaaaaggucauucaacugucucguaagacguuugacaccgaguaccagaaaacaaagcuuaacgauugggacuucguagugacuaccgauaucuccgaaaugggggcaaauuuuaaagccgaccggguuaucgauccuagaaggugccugaagcccgugauucucacagacggaccagagcgcgucaucuuggcuggccccaugccugugaccgccgcuucagcagcccagcgaagaggucggguugggaggaacccacagaaagagaaugaucaauacauuuucacuggccagccccugaacaaugacgaagaccacgcucacuggacggaggccaagaugcuccuggauaacauaaauaccccugaaggaaucauuccggcacuuuucgagccagaacgcgagaagagugcggccaucgacggcgaguaucgucuaaaaggggaaagcagaaagacauuuguggagcugaugcggaggggagauuugcccgucugguuagcucauaaaguggccuccgaagguaucaaguacacugaccgcaaauggugcuucgauggccagcgaaacaaucagauucuggaggaaaacauggacguagagauauggaccaaggagggggaaaaaaagaagcucagaccucgguggcuggaugcaaggacauauucugacccccuugcucugaaagaguuuaaggauuucgccgcaggacgcaaaucgaucgcccucgacuuggugaccgaaauuggcagaguuccaagccaccuggcucauaggacucggaaugcgcuagauaaccuggucaugcuccacacaucagagcacggugggcgugccuaccgccaugcaguggaagagcuuccugagacgauggaaacccuguuauugcugggccucaugauccugcuuacuggaggcgcuaugcuguuucucauuuccgggaagggaaucgguaaaacaaguauaggcuugaucugugugauugccucuagcgggaugcuguggauggccgagauccccuuacaauggauugcauccgcuaucguccuagaauucuuuaugaugguucugcucauaccagagccugagaagcagcgaaccccgcaggacaaucaacuugccuaugugguaauuggaauccugaccuuggcggcuauuaucgccgcaaacgaaaugggccugcucgagacaacuaagagagaucuggguaugucaaaagaacccgggguggucucuccaacgagcuaccuugacguggaccuccacccugccagugcuuggacccuguaugcaguugccacaacugugauaacccccauguugaggcauacaaucgagaauuccaccgcgaacgucagccuggcugccauugcaaaccaggccguaguguuaaugggccuagauaagggauggccaaucucuaaaauggaccugggcguuccucuccuugcucuggggugcuacucacaggugaaucccuugacucugacggccgcaguccuccugcuuauuacacacuacgcuaucauaggaccgggcuuacaggccaaggcgacccgggaagcccaaaaacgcacugcagcugguauuaugaagaacccaaccguggaugggaucaugacaaucgaccuggauccugucauuuaugacuccaaguucgagaaacagcucggacaggugauguugcugguucuaugugccgugcagcugcuccuuaugagaacuaguugggcacugugcgaggcuuugacccuggccacaggccccaucacgacccucugggaagguagcccaggcaaguuuuggaauacuacaauagccguaucgauggcgaacauuuucagggggucuuaccuggcuggagcaggcuuagccuuuuccaucaugaaaagcguggggaccggaaagcggggcacugguucacaaggggagacacuuggagaaaaauggaagaagaaacugaaucagcucagucgaaaggaguucgaucuauauaaaaagucuggcauuaccgaagucgacagaacggaggcuaaagagggucugaagcgcggcgaaaccacacaucacgccguuuccagggggagcgcaaaauugcagugguuuguggagcggaacauggucauccccgaaggacgugugauagaucugggcugugggagaggaggcuggucauacuauugcgccggucucaagaagguaacugaggugaggggguacaccaaaggaggcccuggccacgaagagccgguucccaugaguacauauggguggaauaucgugaagcuuaugagcggaaaagacgucuucuaccugccaccugagaagugugauacuuugcugugcgacauuggugaauccucucccagcccuaccguggaggaaucccgcacaauccggguccucaaaaugguggagccaugguuaaagaacaaucaguucuguauuaagauccugaaccccuacaugccuaccguuauugagcaucuugaacgacugcaaagaaaacacggcgggaugcuaguaaggaauccacucucacgcaacucuacucaugagauguauuggaucaguaauggaacgggcaacauaguggcuucggucaauauggugagccggcuguugcugaacagauuuacaaugacccaccguaggcccacuauugaaaaggauguugaccucggugcggggacccggcacgugaacgccgagccggaaacaccuaauauggacgucaucggagagcgcaucaaacgaauuaaggaggaacauaacuccacguggcacuacgaugacgagaauccauauaaaaccugggcauaccauggcucuuaugaagugaaggcuacuggcucagccagcuccaugauaaacgggguagugaagcuucugacaaaacccugggauguugucccuauggugacccagauggcaaugacugacacaaccccauucggacagcaaagaguguuuaaggagaaagucgauacaaggacuccccggaguaugccggguacccgcagaguuaugggcaucacggccgaaugguuauggaggacccuggggcgaaauaagaaaccucgguugugcacacgugaggaguucacuaagaaggugagaaccaacgcugccaugggagcgguauuuacagaagagaaucagugggacucugcaaaagccgcuguggaagaugaggacuucuggaagcucgucgaucgcgaaagggagcugcacaaacuaggcaagugugguagcugcguguacaacaugauggggaaacgggagaagaaacuuggagaauuuggcaaggccaagggcucaagagcaauuugguauauguggcugggggcucgcuaccucgaguucgaagcccugggauuuuugaaugaggaccauugguucuccagggagaacaguuacagcgguguugaaggcgaggggcugcacaaacucggauauauccuucgagauauuucuaagauccccggcggugcuauguacgccgacgacacugcagggugggauacccggauaacggaagacgaucugcacaaugaggaaaaaaucacacagcagauggacccagagcauagacaauuagcgaacgccauuuuuaagcugaccuaucagaauaaaguggucaaggugcagaggccuacucccacaggaaccguaauggauaucauuucccgcaaggaccagcguggcucaggccaaguugggacuuacggauugaacaccuucacaaauauggaggcucagcucauccggcagauggaaggugagggcgugcugagcaaagccgaucuagaaaacccacaccuucccgagaagaaaauaacgcaguggcuggaaaccaagggggucgagagacucaaaaggauggcaauuucgggagacgauugcguggugaagccuaucgacgaucgcuuugcuaacgcccuguuggcauuaaaugacaugggcaagguccgaaaagauaucccacaauggcagccgucuaaggguuggcaugacuggcagcagguucccuucuguagucaccacuuccaugagcugauuaugaaagacgggcggaagcucgugguaccuugcagaccacaagaugaacuuauaggaagggcccgcaucucccagggcgcgggcuggagccugagagagacugcuugucuagggaaagccuaugcacagauguggucacugauguacuuucaccggagggaccuccguuuggccuccaacgcuauuugcucugccgugcccguccauugggugccuacaagccgaaccacuuggaguauccacgcacaucaccaauggaugacaaccgaagauaugcugacgguuuggaaucgcguguggauugaggacaacccauggauggaagauaagacacccgucaccacuugggaggacgugccuuaucuuggaaagagagaggaucaguggugugguucccugaucggccucaccagccgggcuacaugggcccagaauauaccgacugcgauccagcaaguaaggucuuuaauugggaacgaagaguuccuggacuacaugccaucaaugaaacgcuuuagaaaggaagaggagagugaaggagcuaucugguga

SEQ ID NO: 15146 - RNA, 9873 nt, Artificial Sequence
  derived and/or modified CDS sequence (opt3) from DENV-3__FJ850086__SS-prME
accagccugugccucaugaugauccuucccgccgcucuggcauuccacuugacauccagagacggcgagccuaggaugauuguggggaagaacgaacggggaaagucuuuacuguuuaagacugccucagguauaaauauguguacgcuaaucgcgauggaucucggcgagaugugcgacgauaccgucaccuacaaguguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccagacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgagcggguuuggacuucaaugagaugauccuacugacuaugaaaaacaaggccuggauggugcauagacagugguuuuucgaucucccccugccuuggaccagcggggcaacaaccgaaacuccaacauggaauaggaaagagcuucugguaacguuuaagaacgcucacgccaaaaagcaagaaguuguggucuugggcucccaggagggagcuaugcacaccgcccucacuggcgcaacagaaauucaaaauucagggggaaccaguauauucgccggucaucugaagugucgguuaaaaauggacaagcuggagcuaaaaggcaugagcuacgcuaugugcacaaacacuuuugugcucaagaaagaggucucugaaacccagcacgggacgauccugauuaagguggaguacaagggagaagaugcgcccuguaaaaucccuuucuccaccgaggacggccaagguaaggcacauaacgggcgucuuauaacagccaauccaguugugacuaaaaaggaugagcccguaaacauugaagcugagccgccuuucggcgaaucaaauaucgucaucggaauuggcgacaacgccuugaaaaucaauugguauaagaaggggagcaguauuggaaaaauguuugaggcaaccgcccgcggugcuagaaggauggccauacugggcgauacagcaugggacuucgggucugugggaggcguucucaacucccuggguaagacugugcaccagaucuuugggagcgcguacaccgcucuuuucucgggcgucucuugggugaugaaaauuggaaucggcguacuguugacguggaucgggcucaauuccaagaacacaucaaugaguuuuagcugcauugccauaggaaucauuacccuguauuuaggcgcagugguucaggccgauauggguugugucaucaauuggaaagggaaggaacugaagugcggauccggcauuuucgugacuaacgaggugcauacauggaccgagcaguacaaauuucaagcugacucucccaagcggcuagccacugcaaucgcuggugccugggaaaauggcgucugugggauacgaagcaccacacgcauggagaaccuccuguggaaacagguugcgaaugaacuuaacuauaucuugugggagaauaacauuaagcugacgguggugguaggagauaucauuggcguccucgaacaggggaaaagaacccugacuccacagccuauggaguuaaaguacucauggaaaacauggggaaaggccaagaucgugaccgcugagacacaaaacaguuccuucauaauugacggccccaauacuccagaaugccccagcgcaucuagggccuggaacguuugggagguggaagacuaugguuuuggggucuucaccacgaauaucuggcugaaacuucgggagguguacacacaguugugugaucaccgccucaugucagcugccguuaaggacgaaagagcagugcacgcggauaugggauacuggauugagagucagaaaaacggcagcuggaagcuggagaaagccucccuaaucgaaguaaagaccugcacuuggccuaagucucauacccuguggucgaaugguguccucgagagcgacaugauaaucccaaaaucccuggcuggcccgauuucacagcacaaccauaggcccggguaucacacacaaacugccggaccuuggcaccuuggcaaguuggaacuggauuuuaauuacugcgaggggaccacaguggugaucacggagaacuguggaacccguggcccaaguuuacggacuacaaccgucucugguaaacucauucaugaauggugcugucgaagcugcacucugcccccucuuagauauaugggggaggacggauguugguacggcauggaaaucaggccaauauccgagaaggaagagaauaugguuaaaucacuggugagcgcagguucuggcaagguagauaacuucacaauggggguguugugccucgcuauucuguuugaggaagucaugcgcggaaaguucggcaaaaagcacaugaucgccgggguguucuuuauguucguucuacugcucuccggacagaucaccuggcgggacauggcacauacgcugauuaugaucggcaguaaugccagcgauagaauggguaugggggugacuuaucuugcuuugauugcgaccuuuaaaauacagcccuuccuggccuuaggauuuuuccucaggaagcugacaucucgcgagaaccuucugcuaggcgucggccucgcaauggcuaccacucugcaauugccggaagacaucgagcagauggccaaugggauugcccugggauuaauggcucucaaacugaucacacaguuugaaaccuaccagcuuuggacagcacugauuuccuugacuuguucaaacaccauguucacgcucacaguggccuggcgaaccgcgacucugauccuagcugguguuagucugcuuccugugugccaaagcucguccaugcggaagaccgauuggcucccaauggccgucgcagccaugggcguacccccucugcccuuguuuauauucucucugaaggacacauuaaaacguagaagcuggccacucaaugagggggugauggcuguuggacuggugucaauccuugcaaguucccuguugaggaacgaugucccuauggccggcccccucguggcgggugggcugcuaauugcuuguuauguaaucacuggaaccucugccgaccugacgguggagaaggcagccgacauuacaugggaagaggaagcugagcagaccggcgucagccacaaccuuaugaucacuguugaugacgauggcacaaugcgcauaaaagacgaugaaaccgagaauauucucacugugcuguugaagacagccuuacugaucguguccggggucuuuccauacucaaucccggcaacccuccugguguggcauacguggcagaaacagacucaacggagcggaguucuuugggacguaccuagucccccagagacccagaaggcugaacuggaggaagguguguacagaauuaaacagcagggcauauucgggaagacacaagucggagugggcguucagaaggaggguguguuucacaccauguggcacgucacaagaggggccguguugacuuauaacggaaaacgacuagagcccaauugggcgucuguaaagaaagaucugaucuccuacggcggcggguggcgccucagcgcccaguggcaaaagggagaagagguccaggugauugcaguugaaccugguaaaaacccaaagaauuuccagaccaugcccggcacguuccagacaacuaccggggagaucggagcuauugcccuggacuuuaagccuggcacaucggguucaccgaucauaaaccgggaagggaaaguggucggacuuuauggcaauggcgugguuaccaagaacgggggauacgugucugguaucgcucaaacuaaugcagagccagauggccccaccccugaguuagaagaggaaauguucaaaaagagaaaccugacaauuauggaccuccauccagggaguggaaaaacgaggaaguauuugcccgccaucguccgugaggccauuaagcgccggcugagaacucucauccuggcuccuaccagggugguagcggcagaaauggaggaggcccuuaaaggccugccgauacgauaccagacaaccgcuacuaaguccgaacacacaggucgggagauuguggauuugaugugccaugccaccuuuacgaugcgccuacugagccccguuagagucccaaauuauaaccucaucaucauggacgaagcacacuucacugauccugccucuauugcugcgaggggguacaucagcacacgggugggaaugggcgaggccgcagcuauauuuaugaccgccacacccccaggcacugcagacgccuucccucaguccaaugcucccauucaggacgaggaacgagauaucccagagagaucauggaacagugggaaugaauggauuacagacuuugccggaaaaaccgugugguucgucccgagcaucaaggcggguaacgauauagcaaacuguuuacgcaaaaauggcaagaagguaauucaacugucuaggaaaacauuugacacugaguaccagaagacgaaacuuaacgauugggacuucgugguuaccacagauaucuccgaaaugggggccaauuuuaaggcugaccgugugaucgauccucggagaugccugaaacccgucauucucacugacggaccagagagggugaucuuggccggccccaugccuguuaccgcugcaucagccgcucagcgccgagguagaguggggcggaacccacagaaggagaaugaucaauauauuuucacaggccagccccugaacaaugacgaagaccaugcccacuggaccgaggcaaagaugcuccuggauaacauaaauacuccugaaggaaucauuccggcgcuuuucgagccagaaagggagaaaagugccgcuaucgacggcgaguaccgccuaaagggggaaagccguaaaacguuugucgagcugaugagacggggagauuugcccgugugguuagcccacaagguagcauccgaagguaucaaauauaccgacaggaaguggugcuucgauggccagcgcaacaaucagauucuggaggaaaacauggacguggagauauggacaaaagagggggaaaagaagaaacuccgaccuagauggcuggaugcucggacuuacucugacccccuugcccugaaggaguuuaaagauuucgcagccggaaggaagucgaucgcucucgacuugguuaccgaaauuggccgcgucccaagccaucuggcgcacagaacaaggaaugcccuagauaaccuggugaugcuccauaccucagagcacggugggcgggcauaucgucacgcuguggaggaacuuccugagacuauggaaacacuguuauugcugggccucaugauccugcuuacgggaggcgccaugcuguuucucauuuccgggaaaggaaucgguaagaccaguauaggcuugaucugugucauugccucuagcgggaugcuguggauggcagagauccccuuacaauggauugcuuccgccaucguucuagaguucuuuaugauggugcugcucauaccagagccugagaagcagcgcacuccgcaggacaaucaacuugcguacguagugauuggaauccugacauuggcugccauuaucgcagccaacgaaaugggccugcucgagaccaccaaacgagaucuggguaugucaaaggaacccggggucgugucuccaacaagcuaucuugacguugaccuccauccugcuagugcauggacucuguacgccguggcgacgaccgucauaacacccauguugagacacacuaucgaaaauuccaccgcuaacguaagccuggccgcaauugccaaccaggcugugguuuuaaugggccuagauaaaggauggccaaucucuaagauggaccugggcgugccucuccuugcccuggggugcuacucacaggucaaucccuugacacugaccgcagcugugcuccugcuuauuacucauuaugccaucauaggaccgggcuuacaggcgaaagccacgagggaagcacaaaagcggacagcugccgguauuaugaagaacccaaccgucgaugggaucaugacuaucgaccuggauccugugauuuacgacuccaaauucgagaagcagcucggacagguuauguugcuggugcuaugugcaguacagcugcuccuuaugcgcaccaguugggcucugugcgaggccuugacacuggccacuggccccaucaccacacucugggaagguagcccaggcaaauuuuggaauacgaccauagcggugucgauggcuaacauuuucagagggucuuaucuggcaggagccggcuuagcuuuuuccaucaugaaaagcgucgggacuggaaaaaggggcacagguucacaaggggagacccuuggagaaaaguggaagaaaaagcugaaucagcucagucggaaagaguucgaucuauacaagaaaucuggcauuacugaaguugaccgaacagaggccaaggagggucugaaaagaggcgaaaccacgcaccaugcagugucccgcgggagcgccaaguugcagugguuugucgagaggaacauggugauccccgaaggacggguaauagaucugggcugugggcguggaggcuggucauauuacugcgcuggucucaagaaagugaccgagguuagaggguauacaaagggaggcccuggccacgaggaaccggugcccaugaguacuuacggguggaauaucauuaaacuuaugagcggaaaggacgucuucuaccugccaccugagaaaugugauaccuugcugugcgacaucggugaauccucucccagcccuacaguggaggaauccaggacuauucgcguccucaagaugguggagccaugguuaaagaacaaucaguucuguaucaaaauucugaaccccuauaugccuaccguuaucgagcaccuugaacggcugcaacgaaagcauggcgggaugcuaguaagaaauccacucucaaggaacucuacacacgagauguacuggauaaguaauggaaccggcaacauuguggcgucggucaauauggugagccgccuguugcugaaccgguuuacuaugacgcauagacgucccacaaucgaaaaagauguugaccucggugccgggaccaggcacgugaacgcagagccggaaacuccuaauauggacgucaucggagagcggauuaagcgcauaaaagaggaacacaacuccaccuggcauuaugaugacgagaauccauacaagacaugggcuuaucacggcucuuacgaagugaaggccacgggcucagcaagcuccaugaucaacgggguagugaaacuucugaccaagcccugggauguugucccuauggugacucagauggccaugacagacaccacuccauucggacagcaacgaguguuuaaagagaaggucgauacaagaacccccaggaguaugccggguacacggcgcguuaugggcauuacugcugaaugguuauggagaacccuggggaggaauaaaaagccucgauugugcacgcgggaggaguucaccaagaaagugcguacaaacgccgcgaugggagcaguauuuacugaagagaaucagugggacucugccaaggcugccguggaagaugaggacuucuggaaacucgucgauagagaacgcgagcugcauaagcuaggcaaaugugguagcugcguguauaacaugauggggaagagggagaagaaacuuggagaauuuggcaaagcaaaaggcucacgggcuaucugguacauguggcugggggccagauaccucgaguucgaagcucugggauuuuugaaugaggaccacugguucucccgcgagaacaguuauagcgguguugaaggcgaggggcugcauaagcucggauacauucuuagggauaucucuaaaauacccggcggugccauguaugcagacgacaccgcggggugggauacacgaaucacugaagacgaucugcacaaugaggaaaagauuacccagcagauggacccagagcaccggcaauuagccaacgcuaucuuuaaacugacguaccagaauaagguggucaaggugcagagaccuacacccaccggaacuguaauggauauuaucuccaggaaagaccagcgcggcucaggccaaguugggacauauggauugaacaccuucacuaauauggaggcccagcucauacgucagauggaaggugagggcgugcugagcaaggcagaucuagaaaacccacaucuucccgagaaaaagauuacccaguggcuggaaacaaaaggggucgagcggcucaagagaauggcuaucucgggagacgauugcguggugaagccuaucgacgauagguuugccaacgcacuguuggccuuaaaugacaugggcaaaguccgcaaggauauuccacaauggcagccgucuaaagguuggcacgacuggcagcagguucccuucuguagucaucacuuccacgagcugauaaugaaggacgggcgaaaacucgugguaccuugccggccacaagaugaacuuaucggaagggcgaggauuucccagggcgcuggcuggagccugcgcgagacggccugucuagggaaggcauacgcccagauguggucacugauguauuuucauagacgggaccucagguuggcuuccaacgccaucugcucugcagugcccguccacugggugccuaccagccguacuacauggaguauucaugcucaccaucaauggaugaccacugaagauaugcugacaguuuggaaucgaguguggaucgaggacaacccauggauggaagauaagacccccgucacgacaugggaggacgugccuuaccuuggaaaacgcgaggaucaguggugugguucccugauaggccucaccagcagagccacuugggcgcagaauaucccgaccgcuauucagcaaguacggucuuuaaucgggaacgaagaguuccuggacuacaugccaucaaugaagagguuucgcaaagaagaggagagugaaggagccauuugguga

SEQ ID NO: 15147 - RNA, 9873 nt, Artificial Sequence
  derived and/or modified CDS sequence (opt3) from DENV-3__FJ850089__SS-prME
accagccugugccucaugaugauccuucccgcagcucuggcauuccacuugacuuccagagacggagagccuaggaugauuguggggaagaacgaacggggaaagucuuuacuguuuaagacugcaucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccagacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucagcuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccagcaugaaaaucugaaguauacagugauuaucacuguucacaccggugaccagcaucaggugggcaacgagacacaaggggucaccgcagaaauuacuccucaggcuuccacgacagaggugauccucccagaauacggaacccuuggccuggagugcucuccgcgaacugguuuggacuucaaugagaugauccuacugaccaugaaaaacaaggccuggaugguacacagacagugguuuuucgaucucccccugccuuggacaagcggggcgaccacugaaacaccaacguggaauaggaaagagcuucugguuaccuuuaagaacgcccacgccaagaagcaagaaguggucguguugggcucccaggagggagcuaugcauacugcccucacaggcgcuaccgaaauucaaaauucagggggaacaaguauauucgccggucaccugaagugucgguuaaaaauggacaagcuggagcuaaaaggcaugagcuaugcaaugugcacuaacaccuuuguccucaagaaagaggugucugaaacgcagcaugggaccauccugauuaagguugaguacaagggagaagaugcccccuguaaaaucccuuucuccacagaggacggccaagguaaggcucacaacgggcgucuuauaacugcgaauccagugguaaccaaaaaggaugagcccgucaacauugaagcagagccgccuuucggcgaaucaaauaucgugaucggaauuggcgacaacgccuugaaaaucaauugguacaagaaggggagcaguauuggaaaaauguuugaggcuacagcccgcggugcaagaaggauggccauacugggcgauacugcuugggacuucgggucuguuggaggcgugcucaacucccuggguaagaugguccaucagaucuuugggagcgccuauaccgcacuuuucucgggcgugucuuggguaaugaaagugggaauuggcguucuguugacguggaucgggcucaauuccaagaacacaucaaugaguuuuagcugcaucgcgauuggaauaaucacccuguacuuaggcgcugucgugcaggccgauauggguugugugauuaauuggaaagggaaggaacugaagugcggauccggcaucuucgucacuaacgagguucacacauggaccgagcaguauaaauuucaagcagacucucccaagcggcuagccacugcuauugccggugcaugggaaaauggcgugugugggauccgaagcaccacacgcauggagaaccuccuguggaaacagauagcuaaugaacuuaacuacaucuugugggagaauaacauuaagcugacggugguagucggagauaucauuggcgugcucgaacaggggaaaagaacccugacuccacagccuauggaguuaaaguauucauggaaaacauggggaaaggccaagaucguuaccgcggagacacaaaacaguuccuucauaauugacggccccaauacuccagaaugccccagcgccucuagggcuuggaacgugugggaggucgaagacuacgguuuugggguguucaccacgaauaucuggcugaaacuucgggagguuuauacacaguugugugaucaccgccucaugucagcagccgugaaggacgaaagagcuguacaugccgauaugggauacuggauugagagucagaaaaacggcagcuggaagcuggagaaagcaucccuaaucgaagucaagaccugcacuuggccuaagucucacacccuguggucgaauggugugcucgagagcgacaugauaaucccaaaaucccuggcgggcccgauuucacagcauaaccacaggcccggguaccacacacaaacugccggaccuuggcaucuuggcaaguuggaacuggauuuuaauuauugcgaggggaccacaguggucaucacggagaacuguggaacccguggcccaaguuuacggacuacaaccguuucugguaaacucauucacgaauggugcugucgaagcugcacucugcccccucuuagauacaugggggaggacggauguugguauggcauggaaaucaggccaauauccgagaaggaagagaauauggugaaaucacugguaagcgcugguucuggcaagguggauaacuucacaaugggggucuugugccucgccauucuguuugaggaagugaugcgcggaaaguucggcaaaaagcauaugaucgcagggguuuucuuuaccuucgugcuacugcucuccggacagaucacguggcgggacauggcucacacucugauuaugaucggcaguaaugccagcgauagaauggguaugggggucaccuaccuugcauugauugccacauuuaaaauacagcccuuccuggcuuuaggauuuuuccucaggaagcugaccucucgcgagaaccuucugcuaggcgugggccucgcgauggccacuacacugcaauugccggaagacaucgagcagauggcaaaugggauugcucugggauuaauggcccucaaacugaucacccaguuugaaacauaucagcuuuggacugcccugauuuccuugaccuguucaaacacgauguucacacucaccguugcuuggcgaacugcaacccugauccuagccggugugagucugcuuccugucugccaaagcucguccaugcggaagacagauuggcucccaauggcgguagcugccaugggcgugcccccucugcccuuguuuauauucucucugaaggacacuuuaaaacguagaagcuggccacucaaugaggggguuauggcagugggacuggucucaauccuugccaguucccuguugaggaacgaugugccuauggcuggcccccucguagccggugggcugcuaauugccuguuacgugaucaccggaacgucugcggaccugacagucgagaaggcugccgacauuaccugggaagaggaagcagagcagacuggcguuagccauaaccuuaugaucacaguggaugacgauggcaccaugcgcauaaaagacgaugaaacugagaauauucucacagugcuguugaagaccgccuuacugaucgucuccgggguguuuccauauucaaucccggcuacgcuccugguuuggcacacuuggcagaaacagacccaacggagcggaguacuuugggacgugccuagucccccagagacacagaaggccgaacuggaggaaggugucuacagaauuaaacagcagggcauauucgggaagacccaagugggaguuggcgugcagaaggagggugucuuucacacaauguggcaugugacuagaggggcaguauugaccuacaacggaaaacgacuagagcccaauugggcuucugucaagaaagaucugaucuccuauggcggcggguggcgccucagcgcccaguggcaaaagggagaagaggugcagauuaucgcgguugaaccugguaaaaacccaaagaauuuccagacgaugcccggcacauuccagacuaccacaggggagauuggagccaucgcacuggacuuuaagccuggcaccucggguucaccgauaaucaaccgggaagggaaaguggucggacuuuacggcaauggcgugguuacuaagaacgggggauaugugucugguauugcucaaaccaaugccgagccagauggccccacaccugaguuagaagaggaaauguucaaaaagagaaaccugacgaucauggaccuccacccagggaguggaaaaacuaggaaguacuugcccgcuauuguccgugaggcaaucaagcgccggcugagaacccucauacuggccccuacaagggugguagccgcugaaauggaggaggcgcuuaaaggccugccgauucgauaucagaccacugcaacaaaguccgaacauaccggucgggagaucguggauuugaugugccacgccacguuuacuaugcgccuacugagccccguuagagucccaaauuacaaccucaucauuauggacgaagcucauuucacagauccugccucuaucgcagccaggggguauauaagcacccgggugggaaugggcgaggcugcggccauuuuuaugaccgcaacucccccaggcacagcugacgccuucccucaguccaaugcacccauccaggacgaggaacgagauauuccagagagaucauggaacagugggaaugaauggaucaccgacuuugccggaaaaacagugugguucgucccgagcauaaaggcugguaacgauauugccaacuguuuacgcaaaaauggcaagaagguaauccaacugucuaggaaaacuuuugacacggaguaccagaagaccaaacuuaacgauugggacuucgugguuacaacugauaucuccgaaaugggggcgaauuuuaaggcagaccgugugauugauccucggagaugccugaaacccgucauccucaccgacggaccagagagggugauuuuggccggccccaugccuguuacagcugccucagcugcacagcgccgagguagaguggggcggaacccacagaaggagaaugaucaauacauauucaccggccagccccugaacaaugacgaagaccacgcccacuggacugaggcuaagaugcuccuggauaacaucaauacgccugaaggaauuaucccggcccuuuucgagccagaaagggagaaaagugcagcgaucgacggcgaguaucgccuaaagggggaaagccguaaaaccuuugucgagcugaugagacggggagauuugcccgugugguuagcccauaagguagcuuccgaagguauuaaauacacagacaggaaguggugcuucgauggccagcgcaacaaucagauacuggaggaaaacauggacguggagaucuggacuaaagagggggaaaagaagaaacuccgaccuagauggcuggaugcccggaccuauucugacccccuugcacugaaggaguuuaaagauuucgcugccggaaggaagucgauugcacucgacuugguuacagaaaucggccgcgucccaagccaccuggcccauagaaccaggaaugcucuagauaaccuggugaugcuccacacuucagagcacggugggcgggcguaccgucaugccguggaggaacuuccugagacaauggaaacgcuguuauugcugggccucaugauucugcuuaccggaggcgcaaugcuguuucucaucuccgggaaaggaauagguaagacaaguaucggcuugauuugugucaucgcuucuagcgggaugcuguggauggccgagauucccuuacaauggaucgccuccgcaauaguucuagaguucuuuaugauggugcugcucauuccagagccugagaagcagcgcacaccgcaggacaaucaacuugcuuauguagugaucggcauucugaccuuggccgcgaucauagcugccaacgaaaugggccugcucgagaccacaaaacgagaucuggguaugucaaaggaacccggggucgugucuccaacuagcuaccuugacguugaccuccacccugcaagugccuggacgcuguaugcuguggcaaccacagucaucacucccauguugagacauaccauugaaaauuccacagccaacguaagccuggcggcuaucgccaaccaggcagugguuuuaaugggccuagauaaaggauggccaauuucuaagauggaccugggcgugccucuccuugcccuggggugcuacucacaggucaaucccuugacccugacugcugccgugcuccugcuuaucacgcacuacgcaauaauuggaccgggcuuacaggcuaaagccacaagggaagcgcaaaagcggaccgccgcagguaucaugaagaacccaacugucgaugggaucaugaccauugaccuggauccugugaucuaugacuccaaauucgagaagcagcucggacagguuauguugcuggugcuaugugcuguacagcugcuccuuaugcgcacaaguugggcccugugcgaggcauugacucuggcuaccggccccauaacaacgcucugggaagguagcccaggcaaauuuuggaauaccacuauugccgugucgauggccaacaucuucagagggucuuaccuggcgggagcuggcuuagcauuuuccauuaugaaaagcgucgggacaggaaaaaggggcaccgguucacaaggggagacucuuggagaaaaguggaagaaaaagcugaaucagcucagucggaaagaguucgaucuauauaagaaaucuggcaucacagaaguugaccgaaccgaggccaaggagggucugaaaagaggcgaaacgacccaucacgcugugucccgcgggagcgccaaguugcagugguuugucgagaggaacauggugauacccgaaggacggguaaucgaucugggcugugggcguggaggcuggucauacuauugcgcaggucucaagaaagugacagagguuagaggguacacuaagggaggcccuggccacgaggaaccggugcccaugaguaccuauggguggaauauugucaaacuuaugagcggaaaggacguguucuaccugccaccugagaaaugugauacauugcugugcgacaucggugaauccucucccagcccuacugucgaggaauccaggaccauucgcgugcucaagaugguugagccaugguuaaagaacaaucaguucuguaucaaaauucugaaccccuacaugccuacaguaaucgagcaucuugaacggcugcaacgaaagcacggcgggaugcuagugagaaauccacucucaaggaacucuacccaugagauguauuggauaaguaauggaacuggcaacauugucgccucggugaauaugguuagccgccuguugcugaaccgguuuacgaugacacacagacgucccaccaucgaaaaagauguggaccucggugcugggacuaggcacgucaacgcggagccggaaaccccuaauauggacgugaucggagagcggauuaagcgcauaaaagaggaacauaacuccacauggcacuacgaugacgagaauccauauaagacgugggccuaccauggcucuuaugaaguaaaggcaaccggcucagcuagcuccaugaucaacggggugguuaaacuucugacuaagcccugggaugucgugccuauggugacacagauggccaugaccgacacuacaccauucggacagcaacgagucuuuaaagagaagguugauaccagaacacccaggaguaugccggguacucggcgcgugaugggcauuaccgcagaaugguuauggagaacgcuggggaggaauaaaaagccucgauugugcacccgggaggaguucacaaagaaaguacguacuaacgccgcuaugggagccguguuuaccgaagagaaucagugggacucugcgaaggcagccgucgaagaugaggacuucuggaaacucguggauagagaacgcgagcugcacaagcuaggcaaaugugguagcugcguuuacaacaugauggggaagagggagaagaaacuuggagaauuuggcaaagcuaaaggcucacgggccaucugguauauguggcugggggcaagauaccucgaguucgaagcucugggauuuuugaaugaggaccauugguucucccgcgagaacaguuacagcgguguggaaggcgaggggcugcacaagcucggauauauucuuagggauaucucuaaaauacccggcggugccauguacgcugacgacacagccgggugggauacucgaaucaccgaagacgaucugcacaaugaggaaaagauuacgcagcagauggacccagagcaucggcaauuagcaaacgcgaucuuuaaacugacauaucagaauaaggucgugaagguacagagaccuacccccacuggaacaguuauggauauuaucuccaggaaagaccagcgcggcucaggccaaguggggaccuacggauugaacacuuucaccaauauggaggcccagcucauacgucagauggaaggugagggcguccugagcaaggcugaucuagaaaacccacaccuucccgagaaaaagauuacacaguggcuggaaacgaaagggguggagcggcucaagagaauggccaucucgggagacgauugcguggucaagccuaucgacgauagguuugcaaacgcucuguuggccuuaaaugacaugggcaaaguucgcaaggauauuccacaauggcagccgucuaaagguuggcaugacuggcaacaggugcccuucuguagucaccacuuccaugagcugauaaugaaggacgggcgaaaacucguagugccuugccggccacaagaugaacuuaucggaagggcaaggauuucccagggcgccggcuggagccugcgcgagaccgcgugucuagggaaggcuuaugcccagauguggucacugauguacuuucacagacgggaccucagguuggcauccaacgccaucugcucugcuguccccgugcauuggguuccuacuagccguacaaccuggaguauucacgcccaucaccaauggaugacuacagaagauaugcugaccguguggaaucgagucuggaucgaggacaacccauggauggaagauaagacgcccgugacaaccugggaggacguaccuuaucuuggaaaacgcgaggaucaguggugugguucccugauaggccucacuagcagagcaaccugggcucagaauaucccgacagccauucagcaaguucggucuuuaaucgggaacgaagaguuccuggacuacaugccaucaaugaagagguuucgcaaagaagaggagagugaaggagcgauuugguga

SEQ ID NO: 15148 - RNA, 9873 nt, Artificial Sequence
  derived and/or modified CDS sequence (opt3) from DENV-3__FJ850092__SS-prME
accagccugugccucaugaugauccuucccgccgcucuggcauuccacuugacauccagagacggagagccuaggaugauuguggggaagaacgaacggggaaagucuuuacuguuuaagacugccucagguauaaauauguguacgcuaaucgcgauggaucucggcgagaugugcgacgauaccgucaccuacaaguguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccagacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucagcuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccagcaugaaaaucugaaguauacagugauuaucacuguucacaccggugaccagcaucaggugggcaacgagacacaaggggucaccgcagaaauuacuccucaggcuuccacgacagaggugauccucccagaauacggaacccuuggccuggagugcucuccgcgaacugguuuggacuucaaugagaugauccuacugaccaugaaaaacaaggccuggaugguacacagacagugguuuuucgaucucccccugccuuggacaagcgggguuaccacugaaacaccaacguggaauaggaaagagcuucuggugaccuuuaagaacgcgcacgccaaaaagcaagaagucguggucuugggcucccaggagggagcaaugcauacugcucucacaggcgccaccgaaauucaaaauucagggggaacaaguauauucgcuggucaccugaagugucgguuaaaaauggacaagcuggagcuaaaaggcaugagcuaugccaugugcacuaacaccuuugugcucaagaaagagguuucugaaacgcagcaugggaccauccugauuaagguggaguacaagggagaagaugcacccuguaaaaucccuuucuccacagaggacggccaagguaaggcccacaacgggcgucuuauaacugcuaauccaguagucaccaaaaaggaugagcccgugaacauugaagcggagccgccuuucggcgaaucaaauaucguuaucggaauuggcgacaacgcauugaaaaucaauugguacaagaaggggagcaguauuggaaaaauguuugaggccacagcucgcggugccagaaggauggcaauacugggcgauacugccugggacuucgggucugugggaggcguccucaacucccuggguaagauggugcaucagaucuuugggagcgcuuauaccgcccuuuucucgggcguaucuugggugaugaaaguuggaauuggcguccuguugacguggaucgggcucaauuccaagaacacaucaaugaguuuuagcugcaucgcaauuggaauaaucacccuguacuuaggcgcgguggugcaggcugauauggguugugucauuaauuggaaagggaaggaacugaagugcggauccggcaucuucguuacuaacgaggugcacacauggaccgagcaguauaaauuucaagccgacucucccaagcggcuagcaacugccauugcuggugccugggaaaauggcgugugugggauccgaagcaccacacgcauggagaaccuccuguggaaacagauagcaaaugaacuuaacuacaucuugugggagaauaacauuaagcugacgguagucgugggagauaucauuggcguucucgaacaggggaaaagaacccugacuccacagccuauggaguuaaaguauucauggaaaacauggggaaaggcuaagaucgugaccgccgagacacaaaacaguuccuucauaauugacggccccaauacuccagaaugccccagcgcgucuagggccuggaacgucugggagguggaagacuacgguuuugggguuuucaccacgaauaucuggcugaaacuucgggagguguauacacaguugugugaucaccgccucaugucagcugcaguaaaggacgaaagagccguccaugcugauaugggauacuggauugagagucagaaaaacggcagcuggaagcuggagaaagccucccuaaucgaagugaagaccugcacuuggccuaagucucacacccuguggucgaauggugugcucgagagcgacaugauaaucccaaaaucccuggcaggcccgauuucacagcauaaccacaggcccggguaccacacacaaacugcgggaccuuggcaucuuggcaaguuggaacuggauuuuaauuauugcgaggggaccacagucguuaucacggagaacuguggaacccguggcccaaguuuacggacuacaaccgugucugguaaacucauucacgaauggugcugucgaagcugcacucugcccccucuuagauacaugggggaggacggauguugguauggcauggaaaucaggccaauauccgagaaggaagagaauaugguaaaaucacuggugagcgccgguucuggcaaggucgauaacuucacaauggggguguugugccucgcuauucuguuugaggaaguuaugcgcggaaaguucggcaaaaagcauaugaucgccgggguguucuuuaccuucguccuacugcucuccggacagaucacguggcgggacauggcacacacucugauuaugaucggcaguaaugcuagcgauagaauggguaugggggugaccuaccuugccuugauugcaacauuuaaaauacagcccuuccuggccuuaggauuuuuccucaggaagcugaccucucgcgagaaccuucugcuaggcguuggccucgcuauggcgacuacacugcaauugccggaagacaucgagcagauggccaaugggauugcacugggauuaauggcucucaaacugaucacccaguuugaaacauaucagcuuuggacugcccugauuuccuugaccuguucaaacacgauguucacacucaccguggccuggcgaacugcuacccugauccuagccggugucagucugcuuccuguaugccaaagcucguccaugcggaagacagauuggcucccaauggccguggcggcuaugggcguucccccucugcccuuguuuauauucucucugaaggacacuuuaaaacguagaagcuggccacucaaugagggggugauggccgucggacuggugucaauccuugcaaguucccuguugaggaacgauguaccuauggccggcccccucguggcuggugggcugcuaauugcauguuacgucaucaccggaacgucugccgaccugauuguugagaaggcggcugacaucacaugggaagaggaagccgagcagaccggcgugagccauaaccuuaugauaacuguggaugacgauggcacaaugcgcauuaaagacgaugaaaccgagaauauccucacuguccuguugaagacagcauuacugaucguguccgggguuuuuccauauucaauuccggccacccuccugguauggcacacguggcagaaacagacucaacggagcggagugcuuugggacgucccuagucccccagagacccagaaggcugaacuggaggaagguguguacagaauaaaacagcagggcaucuucgggaagacacaaguuggagugggcguccagaaggaggguguguuucacaccauguggcauguaacaagaggggcagucuugacuuacaacggaaaacgacuagagcccaauugggcaucugugaagaaagaucugauuuccuauggcggcggguggcgccucagcgcucaguggcaaaagggagaagagguucaggugaucgccgucgaaccugguaaaaacccaaagaauuuccagaccaugcccggcacguuccagacaacuaccggggagauuggagcgaucgcccuggacuuuaagccuggcacaucggguucaccgauaaucaaccgggaagggaaagugguuggacuuuacggcaauggcguggucaccaagaacgggggauaugugucugguauugcacaaacuaaugcugagccagauggccccaccccugaguuagaagaggaaauguucaaaaagagaaaccugacaaucauggaccuccacccagggaguggaaaaacgaggaaguacuugcccgccauuguacgugaggcuaucaagcgccggcugagaacucucauacuggcaccuaccagggugguugccgccgaaauggaggaggcucuuaaaggccugccgauucgauaucagacaaccgcgacuaaguccgaacauacaggucgggagaucgucgauuugaugugccacgcaaccuuuacgaugcgccuacugagccccgugagagugccaaauuacaaccucaucauuauggacgaagcccauuucacugauccugcuucuaucgccgcaaggggguauauaagcacacgggucggaaugggcgaggccgcugcgauuuuuaugaccgccacacccccaggcacugcagacgcuuucccucaguccaaugcccccauccaggacgaggaacgagauauuccagagagaucauggaacagugggaaugaauggaucacagacuuugcaggaaaaaccguaugguucgugccgagcauaaaggccgguaacgauauugcuaacuguuuacgcaaaaauggcaagaagguuauccaacugucuaggaaaacauuugacacugaguaccagaagacgaaacuuaacgauugggacuucguggucaccacagauaucuccgaaaugggggccaauuuuaaggcggaccgugugauugauccucggagaugccugaaacccguuauccucacugacggaccagagagggugauuuuggcaggccccaugccugucaccgccgcuucagccgcucagcgccgagguagaguggggcggaacccacagaaggagaaugaucaauacauauucacaggccagccccugaacaaugacgaagaccacgcacacuggaccgaggccaagaugcuccuggauaacaucaauacuccugaaggaauuaucccggcucuuuucgagccagaaagggagaaaagugccgcaaucgacggcgaguaucgccuaaagggggaaagccguaaaacguuuguagagcugaugagacggggagauuugcccgugugguuagcgcauaagguugccuccgaagguauuaaauacaccgacaggaaguggugcuucgauggccagcgcaacaaucagauacuggaggaaaacauggacgucgagaucuggacaaaagagggggaaaagaagaaacuccgaccuagauggcuggaugcucggacuuauucugacccccuugcccugaaggaguuuaaagauuucgcagcuggaaggaagucgauugcccucgacuuggugaccgaaaucggccgcgugccaagccaccuggcacauagaacaaggaaugcccuagauaaccuggucaugcuccacaccucagagcacggugggcgggcuuaccgucaugcgguugaggaacuuccugagacuauggaaacacuguuauugcugggccucaugauucugcuuacgggaggcgccaugcuguuucucaucuccgggaaaggaauagguaagaccaguaucggcuugauuugugugaucgcaucuagcgggaugcuguggauggcugagauucccuuacaauggaucgccuccgccauaguacuagaguucuuuaugauggugcugcucauuccagagccugagaagcagcgcacuccgcaggacaaucaacuugcauaugucgugaucggcauucugacauuggcugccaucauagcggcuaacgaaaugggccugcucgagaccaccaaacgagaucuggguaugucaaaggaacccgggguugugucuccaacaagcuaccuugacgucgaccuccacccugccagugcauggacucuguaugccguagcuacgaccgugaucacacccauguugagacauacuauugaaaauuccaccgcaaacguuagccuggccgcgaucgcuaaccaggccguggucuuaaugggccuagauaaaggauggccaauuucuaagauggaccugggcgugccucuccuugcacuggggugcuacucacaggucaaucccuugacacugaccgccgcugugcuccugcuuaucacucacuacgccauaauuggaccgggcuuacaggcaaaagcuacgagggaagcccaaaagcggacagcggccgguaucaugaagaacccaaccguugaugggaucaugacuauugaccuggauccugugaucuaugacuccaaauucgagaagcagcucggacagguaauguugcuggugcuaugugcaguccagcugcuccuuaugcgcaccaguugggcucugugcgaggccuugacacuggcaacuggccccauaaccacacucugggaagguagcccaggcaaauuuuggaauacgaccauugcuguuucgauggccaacaucuucagagggucuuaccuggccggagcgggcuuagcuuuuuccauuaugaaaagcguggggacuggaaaaaggggcacagguucacaaggggagacccuuggagaaaaguggaagaaaaagcugaaucagcucagucggaaagaguucgaucuauauaagaaaucuggcaucacugaagucgaccgaacagaggcaaaggagggucugaaaagaggcgaaaccacgcaucacgccgugucccgcgggagcgcuaaguugcagugguuuguagagaggaacauggugauacccgaaggacggguuaucgaucugggcugugggcguggaggcuggucauacuauugcgccggucucaagaaagugaccgaggucagaggguacacaaagggaggcccuggccacgaggaaccggugcccaugaguacuuauggguggaauauugucaaacuuaugagcggaaaggacguguucuaccugccaccugagaaaugugauaccuugcugugcgacaucggugaauccucucccagcccuacaguugaggaauccaggacuauucgcguacucaagaugguggagccaugguuaaagaacaaucaguucuguaucaaaauucugaaccccuacaugccuaccgucaucgagcaucuugaacggcugcaacgaaagcacggcgggaugcuagugagaaauccacucucaaggaacucuacacaugagauguauuggauaaguaauggaaccggcaacauuguugcaucggugaauauggucagccgccuguugcugaaccgguuuacuaugacgcacagacgucccacaaucgaaaaagauguggaccucggugccgggaccaggcacguaaacgcugagccggaaacuccuaauauggacgugaucggagagcggauuaagcgcauaaaagaggaacauaacuccaccuggcacuacgaugacgagaauccauauaagacaugggcguaccauggcucuuaugaaguuaaggccacgggcucagcaagcuccaugaucaacggggucgugaaacuucugaccaagcccugggauguggucccuaugguuacucagauggcuaugacagacaccacuccauucggacagcaacgaguguuuaaagagaagguagauacaagaacccccaggaguaugccggguacacggcgcgugaugggcauuacugccgaaugguuauggagaacccuggggaggaauaaaaagccucgauugugcacgcgggaggaguucaccaagaaaguccguacaaacgcagccaugggagcuguguuuacugaagagaaucagugggacucugccaaggcggcaguugaagaugaggacuucuggaaacucguggauagagaacgcgagcugcacaagcuaggcaaaugugguagcugcgucuacaacaugauggggaagagggagaagaaacuuggagaauuuggcaaagccaaaggcucacgggcuaucugguauauguggcugggggccagauaccucgaguucgaagcacugggauuuuugaaugaggaccauugguucucccgcgagaacaguuacagcgguguggaaggcgaggggcugcacaagcucggauauauucuuagggauaucucuaaaauacccggcggugcuauguacgccgacgacaccgcugggugggauacacgaaucacugaagacgaucugcacaaugaggaaaagauuacccagcagauggacccagagcaucggcaauuagccaacgcaaucuuuaaacugacguaucagaauaagguaguuaaggugcagagaccuacacccaccggaacugucauggauauuaucuccaggaaagaccagcgcggcucaggccaaguggggacauacggauugaacaccuucacuaauauggaggcgcagcucauacgucagauggaaggugagggcgugcugagcaaggccgaucuagaaaacccacaccuucccgagaaaaagauuacccaguggcuggaaacaaaaggggucgagcggcucaagagaauggcuaucucgggagacgauugcguugugaagccuaucgacgauagguuugccaacgcacuguuggcuuuaaaugacaugggcaaaguacgcaaggauauuccacaauggcagccgucuaaagguuggcaugacuggcaacaggugcccuucuguagucaccacuuccaugagcugauaaugaaggacgggcgaaaacucgucgugccuugccggccacaagaugaacuuaucggaagggccaggauuucccagggcgcaggcuggagccugcgcgagacggccugucuagggaaggcguaugcucagauguggucacugauguacuuucacagacgggaccucagguuggccuccaacgcaaucugcucugccguucccgugcauugggucccuaccagccguacuacauggaguauucacgcucaucaccaauggaugaccacugaagauaugcugacaguguggaaucgaguauggaucgaggacaacccauggauggaagauaagacccccguuacgacaugggaggacgugccuuaucuuggaaaacgcgaggaucaguggugugguucccugauaggccucaccagcagagccacuugggcacagaauaucccgaccgcuauucagcaaguccggucuuuaaucgggaacgaagaguuccuggacuacaugccaucaaugaagagguuucgcaaagaagaggagagugaaggagccauuugguga

SEQ ID NO: 15149 - RNA, 9873 nt, Artificial Sequence
  derived and/or modified CDS sequence (opt3) from DENV-3__FJ850094__SS-prME
accagccugugccucaugaugauccuucccgccgcucuggcauuccacuugacuuccagagacggcgaaccuaggaugauuguggggaagaacgaacggggaaaaucuuuacuguuuaagacugccucagguauaaauauguguacgcuaaucgcgauggaucucggcgaaaugugcgacgauaccguaacauacaaauguccacauauuacugaaguugaaccggaagacaucgauugcugguguaaccugaccaguacaugggugaccuaugggacuugcaaucaggcuggagagcaccgccgagacaagcguagcguagcccuugcaccccaugugggcaugggucuggauacaagaacccagacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucagcuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacuggcacaccaacguggaauaggaaagaacuucugguaaccuuuaagaacgcacacgcuaaaaagcaagagguuguggucuugggaucccaggaaggcgccaugcacacugcucucacaggggccaccgagauucaaaauucaggagguacaaguauauucgcaggccaucugaagugucgguuaaaaauggacaagcuggaacuaaaagggaugagcuacgccaugugcacuaacaccuuugugcucaagaaagaggucucugagacgcagcacggaaccauccugauuaagguggaauacaagggcgaggaugcucccuguaaaaucccuuucuccacagaagacggucaagggaaggcgcauaacggccgucuuauaacugcaaauccaguugugaccaaaaaggaugagcccguaaacauugaggccgaaccgccuuucggagagucaaauaucgucaucggcauuggggacaacgcuuugaaaaucaauugguauaagaagggaagcaguauugguaaaauguuugaagccacagcacgcggcgccagaaggauggcuauacugggggauacugccugggacuucggaucugugggcgguguucucaacucccuggggaagauggugcaccagaucuuuggcagcgcauacaccgcgcuuuucucgggagucucuugggugaugaaaauuggcaucgggguacuguugacguggaucggacucaauuccaagaacacaucaaugaguuuuagcugcauugcuauaggcaucauuacccuguauuuaggugccgugguucaggcagauauggggugugucgugaauuggaaaggaaaggagcugaagugcggcuccgguaucuucgugacuaacgaaguccauacauggaccgagcaguacaaauuucaagccgacucucccaagcggcuagcuacugccauugcaggcgcuugggagaaugggguuuguggaauccgaagcaccacacgcauggaaaaccuccuguggaaacagauagccaaugagcuuaacuauaucuugugggaaaauaacauuaagcugacgguggugguaggcgauaccaucgggguccucgagcagggaaaaagaacucugacaccacagccuauggaauuaaaguacucauggaaaaccuggggcaaggcgaagauugugacagccgagacucaaaacaguuccuucaucauagacggucccaauaccccagagugccccagcgcuucuagggcauggaacguuugggaaguggaggacuauggguuuggagucuucacgacaaauauuuggcugaaacuucgggaaguguacacccaguugugugaucaccgccucaugucagccgcuguuaaggacgagagagccgugcacgcagauaugggcuacuggaucgaaagucagaaaaacgguagcuggaagcuggagaaagcgucccuaauugagguaaagacuugcaccuggccuaagucucauacacuguggucgaauggcguccucgaaagcgacaugaucauaccaaaaucccuggccgggccgaucucacagcacaacuauaggcccggauaccauacucaaaccgcuggcccuuggcaccuugggaaguuggagcuggauuuuaauuauugcgaaggaacaacgguggugauuaccgagaacuguggcacucgugguccaaguuuacggacaaccacugucucugggaaacucauccacgaguggugcugucgaagcugcacacugcccccucuuagauacaugggagaagacggcuguugguaugguauggagauuaggccaaucuccgaaaaggaggaaaauaugguuaaaucacuggugagcgccggcucugggaagguagauaacuucaccaugggaguguugugccucgcaauacuguuugaggaggucaugcgcggcaaguucgggaaaaagcauaugauugcuggaguguucuuuacguucguucuacugcucuccggccagaucacuuggcgggacauggcccacacccugaucaugauugguaguaaugcaagcgauagaauggggaugggagugacauaccuugccuugaucgcuaccuuuaaaauucagcccuuccuggcguuaggcuuuuuccucaggaagcugacuucucgcgaaaaccuucugcuaggcgucgggcucgccauggcaacaacccugcaauugccggaggacauagaacagauggcuaauggaaucgcccuggguuuaauggcccucaaacugauuacacaguuugagacuuaucagcuuuggaccgcucugaucuccuugacguguucaaacacaauguucacccucacuguggcauggcgaaccgccacacugauucuagcgggcguuagucugcuuccugugugccaaagcucguccaugcggaagacugauuggcucccaauggcugucgccgcaauggggguacccccucugcccuuguuuaucuucucucugaaggacaccuuuaaacguagaagcuggccauuaaaugaaggagugauggccguuggccucgugucaauacuggcuaguucccuucugaggaacgaugucccuauggcaggucccuugguggccgggggacuccugaucgcguguuacguaauuacgggcacaucugcugaccuaaccguggagaaggccgcagacaucacuugggaggaagaggccgaacagacaggcgucagccauaaccugaugauuaccguugaugacgaugggacuaugcgcaucaaagacgaugagacagaaaauauacuuaccgugcuccugaagacggcuuuguuaauuguguccggagucuucccauacucaaucccggccacucugcucguguggcacaccuggcagaaacagacacaacggagcgguguucugugggacguaccuagucccccagagacccagaaggcagagcuugaagagggcguguauagaaucaaacagcaggggauuuuuggaaagacacaagucggcguggguguucagaaggaagggguguuccauacuauguggcacgucaccaggggagcugugcugacguacaacggcaaacgauuggagcccaauugggccucuguaaagaaagaucuaauauccuauggcgggggauggcgccugagcgcgcaguggcaaaagggugaggaaguccaggugaucgccguugagccuggcaaaaacccaaagaauuuccagacaaugcccgggacuuuucagaccacaaccggagaaauuggcgcaaucgcucucgacuucaagccugguacuucggggucaccgauuaucaaccgggagggaaaaguggucggccuguacggcaauggggugguuaccaagaacggagguuaugugucuggcauagcccaaacaaaugcugaaccagaugggcccacgccugagcuugaggaagagauguuuaaaaagagaaacuuaacuaucauggaccugcacccaggaaguggcaaaaccaggaaguaccuccccgcaauuguccgugaagccaucaagcgccgguugagaacacugauucucgccccuaccagggugguagcugcggagauggaagaggcacugaaaggucuuccgauccgauaucagacuacagccaccaaguccgagcauacggggcgggaaauaguggaucugaugugccacgcuacuuucacaaugcgcuugcuaagccccguuagagucccaaauuacaaccugauuaucauggacgaggcccauuuuaccgauccugcaucuaucgccgcuaggggauacauuagcacccgggugggcaugggcgaagcggccgcaaucuucaugacugcuacacccccagggaccgccgacgcauuuccucaguccaaugcccccauacaggacgaggaacgagauauuccagagagaucauggaacaguggaaaugaguggaucacagacuucgcugguaaaacugugugguuugucccgagcauuaaggccggcaacgggaucgcgaacugucuccgcaaaaauggaaagaagguaauacaauuaucuaggaaaacguucgauaccgaauaucagaagacaaaacugaacgacugggauuuugugguuacuaccgacauuuccgagaugggcgcaaauuucaaggccgaucgugugaucgacccucggagaugccuuaaacccgucauccugacagaugguccagaaagggugauucucgcugggcccaugccuguuaccgccgcuucagcagcccagcgccgaggcagagugggacggaacccacagaaggagaaugaccaauacaucuucacuggccagcccuugaacaaugaugaggaccacgcucauuggacggaagccaagaugcugcucgacaacauuaauaccccugaggggauaaucccggcacuguuugaaccagagagggagaagagugcggccauugauggagaguaucgccuuaagggugagagccguaaaacauucgucgaacuaaugagacggggcgaccugcccgugugguuggcucacaagguagccuccgaggggaucaaauacacugauaggaaguggugcuuugacggacagcgcaacaaucagaucuuagaagagaacauggauguggaaauuuggaccaaagagggcgagaagaagaaacugcgaccuagauggcucgacgcacggacauauucugauccccuggcucuuaaggaguucaaagacuuugccgcagguaggaagucgauagcccuggaucucguuaccgagaucgggcgcgucccaagccacuuggcucauagaacuaggaaugcgcuggacaaccuagugaugcugcacacaucagaacauggcggacgggccuaccgucacgcaguggaggaacucccugagacgauggagacccuucuguuauugggccugaugauucuccugacugggggagcuaugcuuuuccugaucuccgguaaaggcauugggaagacaaguaucggacucauaugugucaucgccucuagcggcauguuguggauggccgaaauuccccugcaauggaucgcauccgcuauuguuuuagaguuuuucaugauggugcuacugaucccagaaccugagaagcagcgcaccccgcaggauaaucaacucgccuauguagugauagguauucuuacccuggcggcuaucauugccgcaaacgagaugggguugcuggaaacaacuaaacgagaccucggcaugucaaaggagcccggagucgugucuccaacgagcuaccuggauguugaccuucacccugccagugcuuggacccucuacgcaguggccacaacugucaucacccccaugcugagacauacaauagaaaauuccaccgcgaacgucagcuuggcugccaucgcaaaccaggccgugguucugaugggcuuagacaaaggguggccaauuucuaagauggaucuaggagugccucugcucgcucuuggcugcuauucacaggucaauccccugacuuugacggccgcagugcugcuccugaucacacacuacgcuauuaucgguccggggcuucaggccaaagcgaccagggaggcccaaaagcggacugcagcuggaauaaugaagaacccaaccgucgacggcauuaugacaaucgauuuagacccugugaucuaugauuccaaauuugaaaagcagcugggucagguuaugcucuuggugcugugugccguacagcuacugcucaugcgcacaaguugggcacuuugcgaggcucugaccuuggccacaggccccauuacgacccugugggaggggagcccaggaaaauucuggaauacuacaaucgccgugucgauggcgaacauauuuagaggcucuuaccucgcuggggcaggacuggccuucuccauuaugaaaagcgucggcaccgguaaaagggggacuggaucacaaggcgaaacauuaggugagaaguggaagaagaaacuuaaucagcugagucggaaagaauuugaccucuauaagaaaucuggcaucaccgagguugaucgaacggaagcuaaagaggggcuaaaaagaggagagaccacacaucacgccgugucccgcggcagcgcaaagcugcagugguucgucgaaaggaacauggugauucccgaggggcggguaaucgacuugggauguggccgugguggguggucauacuauugcgccggacugaagaaagugacugaaguuagaggcuacaccaagggcgggccuggacaugaggaaccggugcccaugaguacauacgguuggaauauagucaaacucaugagcggcaaggauguguucuaucuuccaccugagaaaugugacacucuguugugcgauaucggggaguccucucccagcccuaccgucgaagaguccaggacaauucgcgugcugaagaugguugaaccauggcucaagaacaaucaguuuuguaucaaaauuuuaaaccccuacaugccuaccguaaucgagcaccuggagcggcuucaacgaaagcacggaggcaugcuggugagaaauccacuaucaaggaacucuacucaugaaauguauuggauuaguaaugguacggggaacaucgucgcuucggugaauaugguuagccgccuccuguugaaccgguucacaaugacccacagacgucccacuauagagaaagacguggaucugggagcgggcaccaggcaugucaacgccgaaccggagacaccuaauauggacgugauuggcgaacggaucaagcgcaucaaagaggagcacaacuccacguggcacuacgacgaugaaaauccauauaagaccugggcauaccaugggucuuaugagguaaaggcuacuggaucagccagcuccaugauuaacggugugguuaaacuccuuacaaagcccugggacgucgugccuauggugacccagauggcaaugacugauacaaccccauuuggccagcaacgagucuucaaagaaaagguugacacaagaacucccaggaguaugccggggacccggcgcgugaugggaauaacggccgaguggcuguggagaaccuuaggcaggaauaaaaagccucgacugugcacacgggaagaguuuacuaagaaaguacguaccaacgcugccaugggugcgguguucacagaggaaaaucagugggauucugcaaaggccgcugucgaggacgaagauuuuuggaaauugguggacagagagcgcgaacuccacaagcuggggaaauguggaagcugcguuuacaacaugaugggcaagagggagaaaaagcuaggcgaguucgggaaggccaaaggaucacgggcaaucugguacauguggcuuggugcuagauaucuggaauuugaggcccucggcuuccugaaugaagaucauugguuuucccgcgagaacaguuacagcgggguggagggagaaggcuugcacaagcuggguuauauucucagggacaucucuaaaauucccgggggagcuauguacgccgaugacacugcaggcugggacacccgaaucacggaggaugaccuucauaaugaagagaagauaacacagcagauggauccagaacaccggcaacuggcgaacgccaucuucaaauuaaccuaucagaauaaggucgugaagguacagagaccuacucccacaggcaccguuauggacauuaucuccaggaaagaucagcgcgggucaggacaaguggguacuuacggccugaacaccuuuacaaauauggaggcucaguugauucgucagauggagggggaaggaguccucagcaaggccgaccuggagaacccacaccuacccgagaagaagaucacgcaguggcuugagaccaaaggcguggaacggcugaagagaauggcaauaucgggugaugacugcguggucaagccuauugaugacagguucgcuaacgcccuccuggcauugaaugauauggggaaaguucgcaaggacaucccacaauggcagccgucuaaaggauggcaugauuggcaacaggugcccuucuguagucaccauuuucacgaguuaaucaugaaggacggccgaaaacugguagugccuugccggccacaagacgagcucauuggcagagccaggauaucccagggggcgggauggagccuucgcgaaacugcuugucuggguaaggccuaugcacagauguggucacuaauguacuuccacagacgggaucugaggcucgccuccaacgcuaucugcucugccguccccgugcauuggguuccuacaagccguaccacuuggaguauucacgcacaucaccaauggaugacaaccgaggacauguugacgguguggaaucgagucuggaucgaagauaacccauggauggaggacaagacacccgugaccacuugggaagauguaccuuaccugggcaaacgcgaggaccaguggugugggucccuuauuggacugaccagcagagcuacaugggcccagaauaucccgacugcgauacagcaaguucggucucucaucggcaacgaggaauuuuuagauuauaugccaucaaugaagagguuccgcaaagaggaagagagugagggugcuauuugguga

SEQ ID NO: 15150 - RNA, 9873 nt, Artificial Sequence
  derived and/or modified CDS sequence (opt3) from DENV-3__FJ898446__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcgccgacgugacaagagaagcguagcccuugcaccccacgugggcaugggucuggauacaaggacccaaacguggauguccgccgagggggcuuggcggcaggucgaaaaaguggagacuugggcauugcgccauccuggauucaccauucucgcccuguuucuggcucacuacaucggcacaucucucacucagaagguugugauauucaucuuacugaugcuugucaccccaucgaugacaaugagaugugugggcguagggaacagggacuuuguugaaggauugucaggugccaccuggguggaugucgugcuggagcauggcgggugcgugacgacuauggcgaagaauaaacccacacuagacauugagcuccagaagaccgaagcaacucaacuggccacacuucggaaacuguguaucgagggaaagauuaccaacaucacgaccgauagccgcugcccuacacagggcgaagcugucuugccagaggaacaggaccagaauuauguuuguaaacacacuuacguggaucgagguugggggaacggaugcggccucuucggcaaggggagucugguaaccugcgccaaguuucaauguuuagagcccauagagggaaaagugguccaguaugaaaaucugaaguacacagugauuaucacuguucacaccggugaccagcaucaggugggcaacgagacacaaggggucaccgcagaaauuacuccucaggcuuccacgacagaggccauccucccagaauauggaacccuuggccuggagugcucuccgagaacugguuuggacuucaaugagaugauccuacugaccaugaaaaacaaggcguggauggugcacaggcagugguuuuucgaucucccccugccuuggacaagcggggccaccacugaaacaccaacguggaaucggaaagagcuucugguaaccuuuaagaacgcacaugcuaaaaagcaagaaguuguggucuugggcucccaggagggagccaugcacacugcucucacaggcgccaccgaaauucagaauucagggggaacaaguauauucgcaggucaccugaagugucguuuaaaaauggacaagcuggagcuaaaaggcaugagcuacgccaugugcacuaacaccuuugugcucaagaaagaggucucugaaacgcagcaugggaccauccugauuaagguggaguacaagggagaagaugcucccuguaaaaucccuuucuccacagaggacggccaagguaaggcgcacaacgggcgccuuauaacugcaaauccaguugugaccaaaaaggaggaacccguaaacauugaggccgaaccgccuuucggcgagucaaauaucgucaucggaacaggcgauaacgcuuugaaaauuaauugguauaagaaggggagcaguaucggaaaaauguuugaaacuaccgccagaggugcaaggcggauggccauucugggcgacacggcuugggauuucgggucugugggaggcguucucaacucccuggguaagauggugcaucagauauuugggagcgccuacacagcacuuuucucgggcgucucuugggugaugaaaaucggaauuggcguacuguugaccuggaucgggcucaauuccaagaacacuucaaugaguuuuagcugcaucgcgauuggaauaaucacacuguauuuaggcgcugugguucaggccgacauggguugugucauuaauuggaaagggaaggagcugaagugcggauccggcaucuucgugaccaacgaggugcacacuuggaccgaacaguacaaauuucaagcagauucucccaagcgacuagccacagcuauugccggugcaugggagaauggcgucugugggauccgcagcacgaccagaauggaaaaccuccuguggaaacagauagcuaaugagcuuaacuauaucuugugggaaaauaacauuaagcugacuguuguggugggagacaucauuggcguacucgagcaggggaaaaggacacugaccccacagccuauggaguuaaaguacucauggaaaacauggggaaaggccaagaucgucacugcggaaacccaaaacaguuccuucauaauugauggccccaauacgccagagugccccagcgccucucgggcuuggaacgugugggaaguugaggacuaugguuuugggguguucacaaccaauaucuggcugaaacuucgcgaagucuacacucaguugugugaccauagacucaugucagcagccgugaaggaugagagggcuguucacgccgacaugggauacuggauugagagucagaaaaacggcagcuggaagcuggaaaaagcaucccuaaucgaggugaagaccugcacauggccuaagucucacacucuguggucgaaugguguacucgaaagcgauaugauaaucccaaaaucccuggcgggcccgauuucacagcauaaccaccgucccggguaucauacccaaacagccggaccuuggcaccuuggcaaguuggagcuggacuuuaauuacugcgaggggacgaccgucgugaucacugaaaacuguggaacacggggcccaaguuuacgaaccacuacagugucugguaaacucauucacgaguggugcuguagaagcugcacccugcccccucuuagguauaugggggaagauggauguugguacggcauggagauccgcccaauauccgaaaaggaggagaauauggucaaaucacugguuagcgcugguucuggcaagguggacaacuucacgauggggguauugugccucgccauucuguuugaagaggugaugcggggaaaguucggcaaaaagcauaugaucgcaggggucuucuuuacuuucgugcuacugcucuccggacagaucaccuggagagauauggcucacacacugauuaugaucggcaguaaugccagcgacaggauggguauggggguuaccuaucuugcauugauugccacuuuuaaaauacagcccuuccuggcuuuaggauuuuuccuccgcaagcugacaucucgagaaaaccuucugcuaggcgugggccucgcgauggccaccacacugcaauugccggaggauaucgaacagauggcaaaugggauugcucugggauuaauggcccucaaacugaucacucaguuugagaccuaccagcuuuggacggcccugauuuccuugacauguucaaacaccauguucacucucaccgucgcuuggcggacagcaacucugauccuagccggugugagucugcuuccuguuugccaaagcucguccaugcguaagaccgacuggcucccaauggcgguggcugccaugggcguccccccucugcccuuguuuauauucucucugaaggauacguuaaaaagaaggagcuggccacucaaugaggggguaauggcagugggacugguuucaauccuugccaguucccuguugcgcaacgacgugccuauggcuggcccccucgucgcaggugggcugcuaauugccuguuaugugaucacaggaaccucugcggaucugacuguagaaaaggcugccgacauuacaugggaggaagaggcagaacagaccggcgugagccauaaccuuaugaucacugucgacgaugacggcacaaugcggauaaaagaugacgagaccgagaauauucucacgguucuguugaagacugccuuacugaucguguccgggguguuuccauacucaaucccggcuacccuccuggucuggcacacauggcagaaacagacccaaagaagcggagugcuuugggauguuccuagucccccagaaacacagaaggccgagcuggaagaggguguauacaggauuaaacagcagggcauauucgggaagacucaagugggagucggcgugcagaaggaggguguuuuucauaccauguggcacgugacgcgaggggcagucuugacauauaacggaaaacgccuagaacccaauugggcuucugugaagaaagaccugaucuccuacggcggcggguggcggcucagcgcccaguggcaaaagggagaggaaguacaggucauugcgguggagccugguaaaaacccaaagaauuuccagacuaugcccggcaccuuccagacaaccacuggggaaaucggagccauugcacuggauuuuaagccuggcaccucggguucaccgaucauaaacagagaggggaaaguugugggacuuuauggcaauggcgucgugacaaagaacgggggauacguuucugguaucgcucaaacgaaugccgagccagacggccccacuccugaauuagaggaagagauguucaaaaagaggaaccugaccauuauggaucuccacccagggaguggaaaaacacguaaguauuugcccgcuaucgugcgcgaagcaauuaagcggagacugaggacccucauccuggccccuacucgagucguggccgcugagauggaggaagcgcuuaaaggccugccgauacgguaccagacaaccgcaacgaaguccgagcauacuggucgcgaaauuguagacuugaugugccacgccacauuuaccaugagacuacugagccccgugaggguuccaaauuauaaccucaucaucauggaugaggcucauuucaccgacccugccucuauugcagcccggggguacaucagcacucgagucggaaugggcgaagcugcggccauauuuaugacagcaacccccccaggcacagcugaugccuucccucaguccaaugcacccauucaggacgaggagagagacaucccagaacgcucauggaacagugggaaugaguggauuacugauuuugccggaaaaacggugugguucgugccgagcaucaaggcugguaacgacauagccaacuguuuaaggaaaaauggcaagaaggucauucaacugucucguaaaaccuuugauacagaauaccagaagacuaaacuuaacgacugggauuucguagugaccacagacaucuccgagaugggggcgaauuuuaaggcagaucggguuaucgacccuagaaggugccugaaacccgugauucucaccgauggaccagagcgcgucaucuuggccggccccaugccugugacugcugccucagcugcacagcgaagaggucggguugggaggaacccacagaaggaaaaugaccaauauauuuucacgggccagccccugaacaaugaugaggaccacgcccauuggaccgaagcuaagaugcuccuggacaacauaaauacaccugagggaaucauuccggcccuuuucgaaccagagcgcgagaaaagugcagcgaucgauggcgaauaccgucuaaagggggagagcagaaaaacuuuuguggaacugaugcggaggggagacuugcccgucugguuagcccacaagguggcuuccgaggguaucaaauauaccgaucgcaaguggugcuucgacggccagcgaaacaaucagauucuggaagagaacauggauguagagauauggacaaaagaaggggagaagaagaaacucagaccucgguggcuggacgccaggaccuacucugauccccuugcacugaaggaauuuaaagacuucgcugccggacgcaagucgaucgcacucgauuuggugacugagauuggcagaguuccaagccaccuggcccauaggacacggaaugcucuagacaaccuggucaugcuccacacgucagaacauggugggcgugcguaucgccacgccguggaggagcuuccugaaaccauggagacucuguuauugcugggccucaugauccugcuuacaggaggcgcaaugcuguuucucauuuccgggaaaggaaucgguaagaccaguauaggcuugaucugugugauugcuucuagcgggaugcuguggauggccgaaauccccuuacaauggauugccuccgcaaucguccuagaguucuuuaugaugguucugcucauaccagagccugaaaagcagcgaaccccgcaggauaaucaacuugcuuacgugguaauuggaauccugacauuggccgcgauuaucgcugccaacgagaugggccugcucgaaacuacgaaaagagaccuggguaugucaaaggagcccgggguggucucuccaaccagcuaucuugauguggaccuccacccugcaagugccuggacacuguacgcuguugcaacuaccgugauaacacccauguugaggcauaccaucgaaaauuccacugccaacgucagccuggcggcuauugccaaccaggcaguaguguuaaugggccuagacaaaggauggccaaucucuaagauggaucugggcguuccucuccuugcccuggggugcuacucacaggugaaucccuugacgcugacagcugccguccuccugcuuauuacccacuaugcaaucauaggaccgggcuuacaggcuaaagccacucgggaggcgcaaaagcgcaccgccgcagguauuaugaagaacccaacaguggacgggaucaugacuaucgaucuggacccugucauuuacgauuccaaauucgagaagcagcucggacaggugauguugcugguucuaugugcugugcagcugcuccuuaugagaaccaguugggcccugugcgaagcauugacacuggcuacgggccccaucaccacucucugggaggguagcccaggcaaauuuuggaauacaaccauagccguaucgauggccaacauuuucagggggucuuaucuggcgggagcuggcuuagcauuuuccaucaugaagagcguggggacuggaaaacggggcacagguucacaaggggaaacccuuggagagaaguggaagaaaaagcugaaucagcucagucgaaaagaauucgaccuauacaagaaaucuggcauuacggaggucgauagaaccgaggccaaggaaggucugaaacgcggcgagaucacacaucacgcuguuuccagggggagcgccaaguugcagugguuuguggaacggaacauggucauacccgagggacgugugaucgaccugggcugugggagaggaggcuggucauauuacugcgcaggucucaagaaaguaacugaagugaggggguauaccaagggaggcccuggccaugaggagccgguucccaugaguacauacggguggaauauugugaaacuuaugagcggaaaggaugucuucuaccugccaccugaaaaaugugacacuuugcugugcgauaucggugaguccucucccagcccuaccguggaagagucccgcacaauucggguccucaagaugguggagccaugguuaaagaacaaucaguucuguaucaaaguucugaaccccuauaugccuaccguaauugaacaccuugagcgacugcaaagaaagcacggcgggaugcuagugaggaauccacucucacgcaacucuacucaugaaauguacuggaucaguaauggaacgggcaacauagucgccucggugaauaugguuagccggcuguugcugaacagauuuacaaugacccaccguaggcccacuauugagaaagacguggaucucggugcugggacccggcaugucaacgcggaaccggagacaccuaauauggacgugaucggagagcgcaucaagcgaauuaaagaagagcacaacuccacguggcacuaugacgaugaaaauccauacaagaccugggccuaucauggcucuuacgagguaaaggcaacuggcucagcuagcuccaugauaaacggggugguuaaacuucugacaaagcccugggacgucgugccuauggugacccagauggccaugacugauacaaccccauucggacagcaaagagucuuuaaagaaaagguugacacaaggacuccccggaguaugccggguacccgcagagugaugggcaucacggcagagugguuauggaggacccuggggcgaaauaaaaagccucgguugugcacacgugaggaauucacuaagaaaguaagaaccaacgccgcuaugggagccguguuuacagaggaaaaucagugggauucugcgaaggcagccgucgaggacgaagauuucuggaaacucguggaccgcgagagggagcugcacaagcuaggcaaaugugguagcugcguuuauaacaugauggggaagcgggaaaaaaagcuuggagaguuuggcaaggcuaaaggcucaagagccauuugguacauguggcugggggcacgcuaccucgaauucgaggcucugggauuuuugaaugaggaucauugguucuccagggaaaacaguuauagcgguguggagggcgaagggcugcacaagcucggauacauccuucgagacauuucuaaaauccccggcggugccauguaugcugaugacacugccgggugggacacccggauaacggaggaugaccugcauaaugaagagaagaucacacagcagauggauccagagcacagacaauuagcaaacgcgauuuuuaaacugaccuaccagaauaaggucgugaagguacagaggccuacucccacaggaaccguuauggacaucauuucccgcaaagaucagcguggcucaggccaaguggggacuuauggauugaacaccuucacaaauauggaagcccagcucauccggcagauggagggugaaggcguccugagcaaggcugaccuagagaacccacaccuucccgaaaaaaagauaacgcaguggcuggagaccaaagggguggagagacucaagaggauggccauuucgggagaugacugcguggucaagccuaucgaugaccgcuuugcaaacgcucuguuggccuuaaaugauaugggcaaaguucgaaaggacaucccacaauggcagccgucuaaagguuggcaugauuggcagcaggugcccuucuguagucaccauuuccacgaacugauuaugaaggacgggcggaaacucguagugccuugcagaccacaagacgagcuuauaggaagggcacgcaucucccagggcgccggcuggagccugagagaaacugcgugucuagggaaggcuuacgcccagauguggucacugauguauuuucaccggagggaucuccguuuggcauccaacgccauuugcucugcuguccccgugcauuggguuccuacaagccgaaccacuuggaguauccacgcccaucaccaauggaugacaaccgaggacaugcugacgguguggaaucgcgucuggauugaagauaacccauggauggaggacaagacacccgugaccacuugggagaauguaccuuaccuuggaaaaagagaagaucaguggugugguucccugaucggccucaccagccgggcaacaugggcucagaacauaccgacugccauccagcaaguuaggucuuuaauugggaaugaggaauuccuggacuacaugccaucaaugaagcgcuuuagaaaagaggaggaaagugagggagcgaucugguga

SEQ ID NO: 15151 - RNA, 9873 nt, Artificial Sequence
  derived and/or modified CDS sequence (opt3) from DENV-3__GU131844__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcgccgacgugacaagagaagcguagcccuugcaccccacgugggcaugggucuggauacaaggacccaaacguggauguccgccgagggggcuuggcggcaggucgaaaaaguggagacuugggcauugcgccauccuggauucaccauucucgcccuguuucuggcucacuacaucggcacaucucucacucagaagguugugauauucaucuuacugaugcuugucaccccaucgaugacaaugagaugugugggcguagggaacagggacuuuguugaaggauugucaggugccaccuggguggaugucgugcuggagcauggcgggugcgugacgacuauggcgaagaauaaacccacacuagacauugagcuccagaagaccgaagcaacucaacuggccacacuucggaaacuguguaucgagggaaagauuaccaacaucacgaccgauagccgcugcccuacacagggcgaagcugucuugccagaggaacaggaccagaauuauguuuguaaacacacuuacguggaucgagguugggggaacggaugcggccucuucggcaaggggagucugguaaccugcgccaaguuucaauguuuagagcugauagagggaaaagugguccaguaugaaaaucucaaguacacagugauuaucacuguucacaccggugaccagcaucaggugggcaacgagacacaaggggucaccgcagaaauuacuccccaggcuuccacgacagaggccauccuuccugaauauggaacccugggcuuggagugcucuccaagaacuggucuagacuucaaugagaugauccugcucaccaugaaaaacaaggcguggauggugcacaggcagugguuuuucgaucugccgcuucccuggacaagcggggccaccacugaaacaccuacguggaaucggaaagagcuguugguaaccuuuaagaacgcacaugcuaaaaagcaagaaguugugguccucggcucccaggagggagccaugcacacugcucugacaggcgccaccgaaauucagaauucagggggaacaaguauauucgcaggucacuuaaagugucgucugaaaauggacaagcuagagcucaaaggcaugagcuacgccaugugcacuaacaccuuugugcugaagaaagaggucucugaaacgcagcaugggaccauccuuauuaagguggaguacaagggagaagaugcuccauguaaaauccccuucuccacagaggacggccaagguaaggcgcacaacgggcgcuugauaacugcaaauccuguugugaccaaaaaggaggaaccaguaaacauugaggccgaacccccguucggcgagucaaauaucgucaucggaacaggcgauaacgcucugaaaauuaauugguauaagaaggggagcaguaucggaaaaauguuugaagccacugcaagaggugccaggcggauggcuauucucggcgacaccgccugggauuucgggucugugggaggcguucugaacucccuugguaagauggugcaucagauauuugggagcgcauacacggcgcuguucucgggcgucucuugggugaugaaaaucggaauuggcguauugcucacauggaucgggcugaauuccaagaacaccucaaugaguuuuagcugcaucgcuauuggaauaaucacuuuauaucugggcgccgugguucaggcagacauggguugugucauuaauuggaaagggaaggagcuaaagugcggauccggcaucuucgugacaaacgaggugcacaccuggacugaacaguacaaauuucaagccgauucuccuaagcgacucgcuaccgccauugcaggugcuugggagaauggcgucugugggauccgcagcacaacgagaauggaaaaccugcuuuggaaacagauagccaaugaguugaacuauauccugugggaaaauaacguuaagcucaccguggugguaggagacauuaucggcguccuggagcaggggaaaaggacuuuaacaccccagccaauggagcugaaguacucauggaaaaccuggggaaaggcgaagauugugacagccgaaacucaaaacaguuccuucaucauagauggcccuaauacccccgagugcccaagcgcuucucgggcauggaacguuugggaaguggaggacuaugguuuuggggucuucacgacaaauauuuggcuuaaauugcgcgaaguguacacccagcucugugaccauagacugaugucagccgcuguuaaggaugagagggccgugcacgcagacaugggauacuggaucgagagucagaaaaacggcagcuggaagcuagaaaaagcgucccugauugagguaaagacuugcaccuggcccaagucucacacacucuggucgaaugguguccuggaaagcgauaugaucauaccuaaaucccuugccggcccaaucucacagcauaaccaccguccgggguaucauacucaaaccgcuggacccuggcacuugggcaagcuggaguuagacuuuaauuacugcgaggggacaacgguggugauuaccgaaaacuguggaacucggggcccuagucuccgaacaaccacugucucugguaaacugauccacgaguggugcuguagaagcugcacacuuccaccccugagguauaugggggaagauggauguugguacggcauggagauucgcccuaucuccgaaaaggaggagaauaugguuaaaucauuggugagcgccgguucuggcaagguagacaacuucaccaugggggugcucugccuggcaauacuauuugaagaggucaugcggggaaaguucggcaaaaagcauaugauugcugggguguucuuuacguucguucugcuccuguccggacagaucacuuggagagauauggcccacacccuuaucaugauuggcaguaaugcaagcgacaggauggguaugggggugacauauuuggcccugaucgcuaccuuuaaaauucagccauucuuagcgcucggauuuuuccugcgcaagcuuacuucucgagaaaaccugcuacucggcgucggccuggccauggcaacaaccuugcaacugcccgaggauauagaacagauggcuaaugggaucgccuuaggacucauggcccugaaacuuauuacacaguuugagacuuaccagcuguggaccgcuuugaucucccucacguguucaaacacaauguucacccugacuguggcauggcggaccgccacacuaauucuggcggguguuagucuucucccggugugccaaagcucguccaugcguaagacugacuggcugccuauggcugucgccgcaaugggcguaccacccuugccucuguuuaucuucucuuuaaaggauacccucaaaagaaggagcuggccccugaaugagggggugauggccguuggacuugugucaauacuggcuaguuccuugcuccgcaacgacgucccaauggcaggcccucugguggccggugggcuacugaucgcguguuauguaauuacgggaacaucugcugaucuuaccguggaaaaggccgcagacaucacuugggaggaagaggccgaacagacaggcgucagccauaaccucaugauuaccguugacgaugacggcacuaugcggaucaaagaugacgagacagagaauauacugaccguguuguuaaagacggcucugcucauuguguccggggucuuucccuacucaaucccagccacucugcuuguguggcacaccuggcagaaacagacacaaagaagcggaguucugugggauguaccgaguccucccgaaacccagaaggcagaguuggaagaggguguguacaggaucaaacagcagggcauuuucgggaagacacaagucggagugggcguucagaaggaggguguguuucauacuauguggcacgucacccgaggggcugugcuaacguauaacggaaaacgccuggaaccaaauugggccucuguaaagaaagaccucauauccuacggcggcggguggcggcugagcgcgcaguggcaaaagggagaggaaguccaggugaucgccguugagcccgguaaaaacccuaagaauuuccagacaaugccaggcacuuuccagaccacaaccggggaaauuggagcaaucgcucuugauuuuaagcccggcacuucggguucaccuauuaucaacagagaggggaaaguggucggauuauauggcaauggcgugguuaccaagaacgggggauacgugucugguauagcccaaacaaaugcugagccggacggcccaacgcccgaacuggaggaagagauguucaaaaagaggaaccucacuaucauggauuugcacccugggaguggaaaaacccguaaguaucugccagcaauuguccgcgaagccaucaagcggagacucaggacacugauucuugcccccacccgagugguagcugcggagauggaggaagcacugaaaggcuugccuauccgguaccagacuacagccaccaaguccgagcauacgggucgcgaaauaguggaccuaaugugccacgcuacuuuuacaaugagacugcucagcccgguuaggguccccaauuauaacuuaauuaucauggaugaggcccauuucaccgacccagcaucuaucgccgcucggggguacauuagcacccgagugggaaugggcgaagcggccgcaaucuuuaugacugcuacaccucccggcaccgccgaugcauucccacaguccaaugccccuauacaggacgaggagagagacauucccgaacgcucauggaacagugggaaugaguggaucacagauuuugcuggaaaaacugugugguucgucccaagcauuaaggccgguaacgacaucgcgaacugucugaggaaaaauggcaagaagguaauacaacuuucucguaaaacguuugauaccgaauaccagaagacaaaacugaacgacugggauuucgugguuacuaccgacauuuccgagaugggggcaaauuuuaaggccgaucgggugaucgacccgagaaggugccucaaaccugucaucuugacagauggacccgagcgcgugauucuggcuggcccaaugcccguuaccgccgcuucagcagcccagcgaagaggucggguggggaggaacccucagaaggaaaaugaccaauauaucuucacuggccagccacucaacaaugaugaggaccacgcucauuggacggaagccaagaugcugcuugacaacauuaauacccccgagggaauaaucccugcacuauucgaaccggagcgcgagaaaagugcggccauugauggcgaauaccgucugaagggggagagcagaaaaacauuugucgaauugaugcggaggggagacuuaccaguguggcuggcucacaagguagccuccgaggguaucaaauauacugaucgcaaguggugcuucgacggccagcgaaacaaucagauccucgaagagaacauggauguggagauuuggaccaaagaaggggagaagaagaaacugagaccccgguggcuugacgcaaggacauacucugauccucuggcucucaaggaauuuaaagacuucgccgcaggacgcaagucgauagccuuggaucugguuaccgagaucggcagaguccccagccaccuagcucauaggacucggaaugcgcuggacaaccucgugaugcuucacacaucagaacauggugggcgugccuaucgccacgcaguggaggagcugccagaaacgauggagaccuuauugcugcucggccugaugauucuucugacuggaggcgcuaugcucuuuuugaucuccgggaaaggaauugguaagacaaguaucggccugauaugugucaucgccucuagcgggauguuauggauggccgaaauuccucuacaauggaucgcauccgcuauuguucuggaguucuuuaugauggugcuccuuauccccgagccagaaaagcagcgaaccccucaggauaaucaacuggccuacguagugauaggaauuuugacccuggcggcuaucauugccgcaaacgagaugggccuccuggaaacaacuaaaagagaccuugguaugucaaaggagccgggggucgugucucccacgagcuaucucgauguugaccugcacccagccagugcuuggaccuuguacgcaguggccacaacugucaucaccccuaugcugaggcauacaauagaaaauuccaccgcgaacguaagcuuagcugccaucgcaaaccaggccgugguucuaaugggccuggacaaaggauggcccauuucuaagauggaucucggcgugccacuucuggcuuuggggugcuacucacaggucaauccucugacucucacggccgcagugcugcuuuuaaucacacacuaugcuauuaucggacccggccugcaggccaaagcgacccgggaggcccaaaagcgcacugcagcugguauaaugaagaacccgaccgucgacgggauuaugacaaucgaucucgacccagugaucuacgauuccaaauucgagaagcaguugggacagguuaugcugcuagugcugugugccgcacagcuccuucugaugagaacuaguugggcuuugugcgaagcccugacccucgccacaggcccuauuacgacccugugggaggguagccccggcaaauuuuggaauacuacaaucgcgguaucgauggcuaacauauucagggggucuuauuuagcaggagccggccuugcuuuuuccauuaugaagagcguggggaccggaaaacggggcacugguucacaaggggaaacacugggagagaaguggaagaaaaagcucaaucagcuaagucgaaaagaauucgaccuguacaagaaaucuggcaucaccgaggucgauagaacggaggccaaggaagguuugaaacgcggcgagauuacccaucacgcaguuuccagggggagcgccaagcugcagugguuuguggaacggaacauggucaucccagagggacgugugauagaccucggcugugggagaggaggcuggucauauuacugcgcuggucuuaagaaaguaacagaagugaggggguauacuaagggaggccccggccaugaggagccuguuccgaugaguaccuacggguggaauaucgugaaacugaugagcggaaaggaugucuucuacuugcccccagaaaaaugugacacacugcucugcgauauuggugaguccucuccuagccccacuguggaagagucccgcaccauccgggucuuaaagaugguggagccuuggcugaagaacaaucaguucuguauuaaaguucuuaacccauauaugcccacaguaaucgaacaccuggagcgacuacaaagaaagcacggcgggaugcucgugaggaauccucugucacgcaacucuacccaugaaauguacuggauuaguaauggaacuggcaacaucgucgcgucggugaauaugguuagccgguugcugcucaacagauuuacgaugacacaccguaggccaaccauagagaaagacguggaucuuggugccgggacucggcaugucaacgcagaacccgagaccccgaauauggacgugauuggagagcgcaucaagcgaaucaaagaagagcacaacuccacauggcacuaugacgaugaaaauccuuacaagacgugggcuuaucauggcucuuacgagguaaaggccaccggcucagcaagcuccaugauuaacggggugguuaaacuguuaacuaagccaugggacgucgugcccauggugacacagauggccaugaccgauacuacaccuuucggacagcaaagagucuuuaaagaaaagguugacaccaggacaccacggaguaugcccgguacucgcagagugaugggcauaaccgcugaguggcuguggaggacguuggggcgaaauaaaaagccgcggcucugcacccgugaggaauucacaaagaaaguaagaacuaacgccgcgaugggagcaguguuuaccgaggaaaaucagugggauucugccaaggcugccgucgaggacgaagauuucuggaaacugguggaccgcgagagggagcuacacaagcuuggcaaaugugguagcugcguuuauaacaugauggggaagcgggaaaaaaagcugggagaguuuggcaaggcaaaaggcucaagagcuaucugguacauguggcucggggcccgcuaccuggaauucgaggcuuugggauuucugaaugaggaucauugguucuccagggaaaacaguuauagcgguguggagggcgaagggcuccacaagcuuggauacauucugcgagacaucucuaaaauuccuggcggugccauguaugcagaugacacagcggggugggacacucggaucaccgaggaugacuuacauaaugaagagaagauaacgcagcagauggaucccgagcacagacaacuggccaacgcuaucuuuaaauugacauaccagaauaaggucgugaagguacagaggccaaccccuacuggaacaguuauggacauuaucucccgcaaagaucagcguggcucaggccaaguggggaccuauggacucaacacuuucaccaauauggaagcccagcugauucggcagauggagggugaaggcguccuaagcaaggcagaccuugagaacccccaccugccagaaaaaaagaucgcucaguggcucgagacaaaagggguggagagacugaagaggauggccauaucgggagaugacugcguggucaagcccauugaugaccgcuuugcaaacgccuuguuagcgcugaaugauaugggcaaaguucgaaaggacaucccucaauggcagccaucuaaagguuggcaugauuggcagcaggugccguucuguagucaccauuuccacgaacucaucaugaaggacgggcggaaacuuguagugcccugcagaccucaagacgagcugauuggaagggcucgcauaucccagggcagcggcuggucacuaagagaaacggccugucuggggaaggcauacgcccagauguggucccucauguauuuucaccggagggauuugcgucuggcuucuaacgccaucugcagcgcagucccagugcauuggguucccaccagucgaacuacaugguccauucacgcucaucaccaauggaugaccacugaggacaugcuugccguguggaaucgcgucuggaucgaagauaacccuuggauggaggacaagacaccagugaccacgugggagaauguacccuaccugggaaaaagagaagaucaguggugugguagccucauuggcuuaacaucucgggcgaccugggcucagaacaucccuacugccauacagcaaguuaggucacugaucgggaaugaggaauucuuggacuacaugccgaguaugaagcgcuuuagaaaagaggaggaauccgagggagcaauuugguga

SEQ ID NO: 15152 - RNA, 9873 nt, Artificial Sequence
  derived and/or modified CDS sequence (opt3) from DENV-3__GU131849__SS-prME
accagccugugccucgugaugauccuucccgccgcucuggcauuccacuugacauccagagacggcgagccuaggaugauugucgggaagaacgaacggggaaaaucuuuacuguuuaagacugccucagguauaaauauguguacgcuaaucgcgauggaucucggcgagaugugcgacgauaccguuacauacaaauguccacauauuacugaaguggagccggaagacaucgauugcugguguaaccugaccaguacauggguaaccuaugggacuugcaaucaggcuggagagcgccgacgugacaagagaagcguggcccuugcaccccacgucggcaugggucuggauacaaggacccaaacguggauguccgccgagggggcuuggcggcagguggaaaaaguugagacuugggcauugcgccauccuggauucaccauucucgcccuguuucuggcucacuacaucggcacaucucucacucagaagguggucauauucaucuuacugaugcuugugaccccaucgaugacaaugagauguguaggcguugggaacagggacuuuguggaaggauugucaggugccaccugggucgauguggugcuggagcauggcgggugcgucacgacuauggcgaagaauaaacccacacuagacauugagcuccagaagaccgaagcaacucaacuggccacacuucggaaacuguguaucgagggaaagauuaccaacaucacgaccgauagccgcugcccuacacagggcgaagcuguuuugccagaggaacaggaccagaauuauguguguaaacacacuuacguagaucgagguugggggaacggaugcggccucuucggcaaggggagucuggugaccugcgccaaguuucaauguuuagagcccauagagggaaaagucgugcaguaugaaaaucugaaguacacaguuauuaucacugugcacaccggugaccagcaucaggucggcaacgagacacaaggggugaccgcagaaauuacuccucaggcuuccacgaucgaggccauccucccagaauauggaacacuuggccuggagugcucuccgagaaccgguuuggacuucaaugagaugauucuacugacuaugaaaaacaaggcguggaugguacacaggcagugguuuuucgaucucccccugccuuggaccagcggggccacaaccgaaacuccaacauggaaucggaaagagcuucugguuacguuuaagaacgcacaugcuaaaaagcaagaaguggucguguugggcucccaggagggagccaugcacaccgcucucacuggcgccacagaaauacagaauucagggggaaccaguaucuucgcaggucaccugaagugucguuuaaaaauggacaagcuggagcuaaaaggcaugagcuacgccaugugcacaaacacuuuuguccucaagaaagaggugucugaaacccagcaugggacgauucugaucaagguugaguaccgcggagaagaugcucccuguaagauaccuuucuccaccgaggacggccaagguaaagcgcacaacgggagacuuauuacagcaaauccagugguaacuaagaaagaggaacccgucaacaucgaggccgaaccgccuuucggcgagucaaauaucgugauuggaaucggcgauaacgcuuugaagauuaauugguauaaaaaggggagcaguauaggaaagauguuugaagccaccgcaaggggugcccggcgaauggcuauccugggcgacacagccugggauuucgggucuguuggaggcgugcucaacucccuggguaaaaugguccaucagauuuuugggagcgcauacacugcgcuuuucucgggcgugucuuggguaaugaagaucggaaucggcauucuguugaccuggauagggcucaauuccaaaaacacgucaaugaguuuuagcugcaucgcuauuggaaucauuacacuguauuuaggcgccgugguucaggcagacauggguugugucaucaauuggaaggggaaagagcugaagugcggauccggcauauucgugaccaacgaggugcacacuuggacagaacaguacaaguuucaagccgauucucccaaacgccuagcuaccgccaucgcaggugcuugggagaauggcgucugugggauuagaagcacuaccaggauggaaaaccuccuguggaagcagaucgccaaugagcuuaacuauauuuugugggaaaauaacaucaaacugacaguuguggugggagacauaauuggcguacucgagcaggggaagcggacgcugaccccacagccuauggaguuaaaauacucauggaagacuuggggaaaagcgaagaucgucacagccgaaacccaaaacaguuccuucauuaucgauggccccaauacaccagagugccccagcgcuucucgcgcauggaacgugugggaaguugaggacuaugguuuugggguguucacuaccaauauauggcugaagcuuagagaagucuacacgcaguugugugaccauaggcucaugucagccgcugugaaagaugagcgugccguucacgcagacaugggauacuggaucgagagucagaagaacggcagcuggaaacuggaaaaggcgucccuaauugaggugaaaacaugcaccuggccuaagucucacacucuguggucgaaugguguacucgaaagcgauaugaucauuccaaagucccuggccggcccgaucucacagcauaaccaccggcccggguaucauacccaaacagcuggaccuuggcaccuuggcaaauuggagcuggacuuuaauuacugcgaggggacuaccgucgugauaacagaaaacuguggaacgcgaggcccaaguuuaagaaccacuacagugucugguaagcucauucacgaguggugcuguaggagcugcacccugcccccucuucgcuauaugggggaagauggauguugguacggcauggagauccggccaaucuccgaaaaagaggagaauauggucaagucacugguuagcgccgguucuggcaaaguggacaacuucacuauggggguauugugccucgcaauucuguuugaagaggugaugagaggaaaguucggcaagaaacauaugaucgcuggggucuucuuuacauucgugcuacugcucuccggacagauuaccuggagggauaugacgcacacucugauaaugaucggcaguaaugccagcgaccgcauggguauggggguuaccuaucuugcauugauugccacauuuaagauccagcccuuccuggcuuuaggauuuuuccuccgaaaacugaccucucgggaaaaccuucugcuaggcgugggccucgcgauggccacuaugcugcaauugccggaggauauugaacagauggcaaaugggaucgcucugggauuaauggcccucaagcugauaacacaguuugagaccuaccagcuuuggacagcccugaucuccuugacuuguucaaacaccauguucacgcucacagucgcuuggcguaccgcaacucugauucuagccggugugagucugcuuccuguuugccaaagcucguccaugagaaaaaccgacuggcucccaauggcgguggcugccaugggcguccccccucugcccuuguuuaucuucucucugaaggauacauuaaagaggcgcagcuggccacucaaugaggggguaauggcagugggacugguuucaauucuugccaguucccuguugcggaacgacgugccuauggcuggcccccucgucgcaggugggcugcuaaucgccuguuaugugauaacuggaaccucugcggaucugacgguagaaaaagcugccgacauuacaugggaggaagaggcagaacagaccggcgugagccauaaccuuaugaucacugucgacgaugacggcacaaugagaaucaaggaugacgagaccgagaauauucucacuguucuguugaaaacagccuuacugauaguguccgggguguuuccauacucaaucccggcuacccuccuggucuggcacacguggcagaagcagacucaaaggagcggagugcuuugggauguuccuagucccccagaaacccagaaagccgagcuggaagaggguguauaccgaauuaagcagcagggcaucuucgggaaaacacaagugggagucggcgugcagaaggaggguguuuuucauaccauguggcacgugacacgcggggcagucuugacuuauaacggaaagcggcuagaacccaauugggcuucugugaaaaaggaccugauuuccuacggcggcggguggagacucagcgcccaguggcaaaaaggagaggaaguacaggucaucgcgguggagccugguaagaacccaaaaaauuuccagaccacgcccggcacauuccagacuaccacaggggaaauaggagccaucgcacuggauuuuaagccuggcaccucggguucaccgauuaucaacagggaggggaagguugugggacuuuauggcaauggcgucgugacuaaaaacgggggauacguuucugguauugcucaaaccaaugccgagccagacggccccacaccugaauuagaggaagagauguucaagaaacguaaccugacgaucauggaucuccacccagggaguggaaagacucgcaaauauuugcccgcuauaauucgggaagcaaucaagagaaggcugcgaacccucauccuggccccuacacggguggucgccgcugagauggaggaagcgcuuaagggccugccgauucgcuaccagaccacugcaacaaaauccgagcauaccgguagagaaaucguggacuugaugugccacgccacguuuacuaugaggcuacugagccccguacgggugccaaauuauaaccucauaauuauggaugaggcucauuucacagacccugccucuaucgcagcccgaggguacauuagcaccagaguuggaaugggcgaagcugcggccaucuuuaugaccgcaacucccccaggcacagcugaugccuucccucaguccaaugcacccauacaggacgaggagcgcgacauuccagaaaggucauggaacagugggaaugaguggaucaccgauuuugccggaaagacagucugguucgugccgagcaucaaagcugguaacgacauugccaacuguuuacguaagaauggcaaaaaggugauccaacugucucggaagacuuuugauacggaauaccagaaaaccaagcuuaacgacugggauuucgucguaacaacugacauuuccgagaugggggcgaauuuuaaagcagauagagugauagacccuaggcgcugccugaagcccguuauccucaccgauggaccagagcgagugauuuuggccggccccaugccugucacagcugccucagcugcacagagacgggguaggguggggcgcaacccacagaaagaaaaugaccaauauaucuucaccggccagccccugaacaaugaugaggaccacgcccauuggacugaagcuaagaugcuccuggacaacaucaauacgccugagggaauuauaccggcccuuuucgaaccagagcgugagaagagugcagcgaucgauggcgaauacagacuaaaaggggagagccggaagaccuuuguugaacugaugaggcgcggagacuugcccgugugguuagcccacaaagucgcuuccgaggguauuaaguauacagaucgaaaauggugcuucgacggccagagaaacaaucagauccuggaagagaacauggauguggagauuuggacuaaggaaggggagaaaaagaagcuccggccuagguggcuggacgcccgcaccuacucugauccccuugcacugaaagaauuuaaggacuucgcugccggaagaaaaucgaucgcacucgauuugguaacagagauaggcagggugccaagccaccuggcccaucggacccguaaugcucuagacaaccugguuaugcuccacacuucagaacauggugggcgcgcguaucgacacgccgucgaggagcuuccugaaacaauggagacgcuguuauugcugggccucaugauccugcuuaccggaggcgcaaugcuguuucucauuuccgggaagggaaucgguaaaacuaguauuggcuugaucugugugauagcuucuagcgggaugcuguggauggccgaaauucccuuacaauggaucgccuccgcaauugugcuagaguucuuuaugaugguccugcucaucccagagccugaaaagcagagaacaccgcaggauaaucaacuugcuuacguugugauaggaauccugaccuuggccgcgauuaucgcugccaacgagaugggccugcucgaaaccacaaagagggaccuggguaugucaaaagagcccgggguagugucuccaacuagcuaucuugaugucgaccuccacccugcaagugccuggacgcuguacgcuguggcaaccacaguuauuacucccauguugcggcauaccaucgaaaauuccacagccaacgugagccuggcggcuauagccaaccaggcagucguauuaaugggccuagacaagggauggccaauuucuaaaauggaucugggcgugccucuccuugcccuggggugcuacucacagguuaaucccuugacccugacugcugccgugcuccugcuuaucacgcacuaugcaaucauuggaccgggcuuacaggcuaaggccacacgcgaggcgcaaaaaagaaccgccgcagguaucaugaagaacccaacugucgacgggauaaugaccauugaucuggacccugugaucuacgauuccaaguucgagaaacagcucggacaggucauguugcuggugcuaugugcuguucagcugcuccuuaugaggacaaguugggcccugugcgaagcauugacucuggcuaccggccccauuacaacgcucugggaggguagcccaggcaaguuuuggaauaccacuaucgccgugucgauggccaacauauuccgggggucuuaucuggcgggagcuggcuuagcauuuuccaucaugaaaagcguagggacaggaaagcgaggcaccgguucacaaggggaaacucuuggagagaaauggaagaagaaacugaaucagcucaguagaaaggaauucgaccuauacaaaaagucuggcauuacagagguggaucgcaccgaggccaaagaaggucugaagaggggcgagaucacgcaucacgcugucucccgggggagcgccaaauugcagugguuuguugaacguaacauggugauucccgagggaagagucaucgaccugggcugugggaggggaggcuggucauauuacugcgcaggucucaagaaggugaccgaaguacgcggguauacaaaaggaggcccuggccaugaggagccggugcccaugaguacuuacggguggaauauuguuaagcuuaugagcggaaaagauguguucuaccugccaccugaaaagugugacaccuugcugugcgauaucggugaguccucucccagcccuacagucgaagagucccggacuauacgagugcucaaaauggucgagccaugguuaaagaacaaucaguucuguauuaaggugcugaaccccuauaugccuaccguuaucgaacaccuugagagacugcaaaggaaacacggcgggaugcuaguacgcaauccacucucacggaacucuacacaugaaauguacuggaucaguaauggaaccggcaacauuguggccucggucaauauggugagcagacuguugcugaaccguuuuacuaugacgcacaggcggcccacaauagagaaggacguugaucucggugcugggacccgccaugugaacgcggaaccggagacuccuaauauggacgucaucggagagcgaauuaaaagaaucaaggaagagcacaacuccaccuggcacuaugacgaugaaaauccauacaaaacaugggccuaucauggcucuuacgaggugaaggcaacgggcucagcuagcuccaugauuaacgggguagugaagcuucugaccaaacccugggacguugucccuauggugacucagauggccaugacagauaccacuccauucggacagcaaaggguguuuaaggaaaaagucgacacacggaccccccgcaguaugccggguacaagaaggguuauggagaucacugcagagugguuauggcgaacccugggccggaauaagaaaccucguuugugcacgagagaagaguucaccaagaaggugcgcacaaacgccgcuaugggggccguauuuacugaagagaaucagugggauucugcgaaagcagccguggaagacgaggauuucuggaagcucgucgacagggagcgggaacugcacaaacuaggaaaguguggcagcugcguguauaacaugauggguaaaagagagaagaaacuuggggaauuuggaaaggcuaagggcucacgcgccauaugguacauguggcugggcgcaagguaccucgaguucgaggcucugggguuuuugaaugaagaucauugguucucccgagagaacaguuauagcggaguugaaggugagggccugcacaaacucggguacauccuucgggacauuucuaagauccccggaggcgccauguaugcugaugacaccgccgguugggacacaagaauuacugaagaugaccugcauaaugaggagaaaaucacccagcagauggauccagaacacaggcaauuagcaaacgcgauauuuaagcugacguaccagaauaaaguggucaaggugcagcgcccuacacccaccgggacuguaauggacauuaucucccguaaggaucagcggggaucaggccaaguuggcacauauggguugaacaccuucacuaauauggaggcccagcucaucagacagauggaaggagagggugugcugagcaaagcugaccuagaaaacucgcaccuuccagagaagaaaauuacccaguggcuggagacaaagggcgucgaaaggcucaaacgcauggccauaucuggggaugacugcguggugaagcccaucgaugaccgauuugcaaacgcucuguuggccuuaaaugauaugggaaagguccggaaagacauuccucaauggcagccaaguaagggcuggcaugauuggcagcagguuccguucuguucccaccauuuccacgagcugaucaugaaagacgguagaaagcucgugguacccugcaggccucaagacgaacuuauugggcgcgcaagaaucagccagggagccggcuggucacugcgggagacggcgugucuaggcaaagcuuacgcccagauguggucccugauguauuuucacaggcgugaucuccgauuggcaucuaacgccauaugcagcgcugugccaguccauugggugcccaccagucgcacuacaugguccauccacgcccaucaccaauggaugaccacugaagacaugcugacaguuuggaauagaguguggauugaggauaacccuuggauggaggacaagaccccagucacgacaugggaaaaugugcccuaccuugggaagcgggaggaucagugguguggaagccugaucggucucaccucuagggcaacuugggcucagaacauuccuaccgccauccagcaaguacgcucauuaauuggcaaugaagaguuccuggacuacaugccgaguaugaaaagauuucggaaggaggaagaguccgaaggggcgauaugguga

SEQ ID NO: 15153 - RNA, 9873 nt, Artificial Sequence
  derived and/or modified CDS sequence (opt3) from DENV-3__GQ868546__SS-prME
accagccugugccucgugaugauccuucccgccgcucuggcauuccacuugacauccagagacggcgagccuaggaugauugucgggaagaacgaacggggaaaaucuuuacuguuuaagacugccucagguauaaauauguguacgcuaaucgcgauggaucucggcgagaugugcgacgauaccguuacauacaaauguccacauauuacugaaguggagccggaagacaucgauugcugguguaaccugaccaguacauggguaaccuaugggacuugcaaucaggcuggagagcgccgacgugacaagagaagcguggcccuugcaccccacgucggcaugggucuggauacaaggacccaaacguggauguccgccgagggggcuuggcggcagguggaaaaaguugagacuugggcauugcgccauccuggauucaccauucucgcccuguuucuggcucacuacaucggcacaucucucacucagaagguggucauauucaucuuacugaugcuugugaccccaucgaugacaaugagauguguaggcguugggaacagggacuuuguggaaggauugucaggugccaccugggucgauguggugcuggagcauggcgggugcgucacgacuauggcgaagaauaaacccacacuagacauugagcuccagaagaccgaagcaacucaacuggccacacuucggaaacuguguaucgagggaaagauuaccaacaucacgaccgauagccgcugcccuacacagggcgaagcuguuuugccagaggaacaggaccagaauuauguguguaaacacacuuacguagaucgagguugggggaacggaugcggccucuucggcaaggggagucuggugaccugcgccaaguuucaauguuuagagcccauagagggaaaagucgugcaguaugaaaaucugaaguacacaguuauuaucacugugcacaccggugaccagcaucaggucggcaacgagacacaaggggugaccgcagaaauuacuccucaggcuuccacgacagaggccauccucccagaauauggaacccuuggccuggagugcucuccgagaacugguuuggacuucaaugagaugauccuacugaccaugaaaaacaaggcguggaugguacacaggcagugguuuuucgaucucccccugccuuggacaagcggggccaccacugaaacaccaacguggaaucggaaagagcuucugguuaccuuuaagaacgcacaugcuaaaaagcaagaaguggucguguugggcucccaggagggagccaugcacacugcucucacaggcgccaccgaaauucagaauucagggggaacaaguauauucgcaggucaccugaagugucguuuaaaaauggacaagcuggagcuaaaaggcaugagcuacgccaugugcacuaacaccuuuguccucaagaaagaggugucugaaacgcagcaugggaccauccugauuaagguugaguaccgcggagaagaugcucccuguaagaucccuuucuccacagaggacggccaagguaaagcgcacaacgggagacuuauaacugcaaauccagugguaaccaagaaagaggaacccgucaacauugaggccgaaccgccuuucggcgagucaaauaucgugaucggaauuggcgauaacgcuuugaagaucaauugguauaaaaaggggagcaguauuggaaagauguuugaagccacagcaaggggugcccggcgaauggcuauacugggcgacacugccugggauuucgggucuguuggaggcgugcucaacucccuggguaaaaugguccaucagaucuuugggagcgcauacaccgcgcuuuucucgggcgugucuuggguaaugaagauuggaaucggcauccuguugacguggauugggcucaauuccaaaaacacaucaaugaguuuuagcugcauagcuaucggaauuaucacccuguauuuaggcgccgugguucaggcagacauggguugugucauuaauuggaaggggaaagagcugaagugcggauccggcaucuucgugacuaacgaggugcacacauggaccgaacaguacaaguuucaagccgauucucccaaacgccuagcuacugccauagcaggugcuugggagaauggcgucugugggaucagaagcaccacaaggauggaaaaccuccuguggaagcagauugccaaugagcuuaacuauaucuugugggaaaauaacauuaaacugacgguuguggugggagacaucauaggcguacucgagcaggggaagcggacccugacuccacagccuauggaguuaaaauacucauggaagacauggggaaaagcgaagauugucaccgccgaaacacaaaacaguuccuucaucauugauggccccaauacuccagagugccccagcgcuucucgcgcauggaacgugugggaaguugaggacuaugguuuugggguguucaccacgaauaucuggcugaagcuuagagaagucuacacacaguugugugaccauaggcucaugucagccgcugugaaagaugagcgugccguucacgcagacaugggauacuggauagagagucagaagaacggcagcuggaaacuggaaaaggcgucccuaaucgaggugaaaaccugcacuuggccuaagucucacacccuguggucgaaugguguacucgaaagcgauaugauuaucccaaagucccuggccggcccgauuucacagcauaaccaccggcccggguaucauacacaaacugcuggaccuuggcaccuuggcaaauuggagcuggacuuuaauuacugcgaggggaccacagucgugaucacggaaaacuguggaacccgaggcccaaguuuaagaacuacaaccgugucugguaagcucauacacgaguggugcuguaggagcugcacucugcccccucuucgcuauaugggggaagauggauguugguacggcauggagauucggccaaucuccgaaaaagaggagaauauggucaagucacugguuagcgccgguucuggcaaaguggacaacuucacaauggggguauugugccucgcaauccuguuugaagaggugaugagaggaaaguucggcaagaaacauaugauugcuggggucuucuuuaccuucgugcuacugcucuccggacagaucacguggagggauaugacucacacccugauuaugauaggcaguaaugccagcgaccgcauggguauggggguuacauaucuugcauugaucgccaccuuuaagauucagcccuuccuggcuuuaggauuuuuccuccgaaaacugacuucucgggaaaaccuucugcuaggcgugggccucgcgauggccacaacccugcaauugccggaggauaucgaacagauggcaaaugggauugcucugggauuaauggcccucaagcugaucacacaguuugagacuuaccagcuuuggaccgcccugauauccuugacguguucaaacacaauguucacccucacugucgcuuggcguaccgcaacacugauccuagccggugugagucugcuuccuguuugccaaagcucguccaugagaaaaacugacuggcucccaauggcgguggcugccaugggcguccccccucugcccuuguuuauuuucucucugaaggauaccuuaaagaggcgcagcuggccacucaaugaggggguaauggcagugggacugguuucaauccuugccaguucccuguugcggaacgacgugccuauggcuggcccccucgucgcaggugggcugcuaauugccuguuaugugaucacgggaacaucugcggaucugaccguagaaaaagcugccgacauaacuugggaggaagaggcagaacagacaggcgugagccauaaccuuaugauuaccgucgacgaugacggcacuaugagaaucaaggaugacgagacagagaauauccucaccguucuguugaaaacggccuuacugauuguguccgggguguuuccauacucaauaccggcuacucuccuggucuggcacaccuggcagaagcagacacaaaggagcggagugcuuugggauguuccuagucccccagaaacccagaaagccgagcuggaagaggguguauaccgaaucaagcagcagggcauuuucgggaaaacacaagugggagucggcgugcagaaggaggguguuuuucauacuauguggcacgugacccgcggggcagucuugacguauaacggaaagcggcuagaacccaauugggcuucugugaaaaaggaccugaucuccuacggcggcggguggagacucagcgcccaguggcaaaaaggagaggaaguacaggucauugcgguggagccugguaagaacccaaaaaauuuccagacaacucccggcaccuuccagacaaccacuggggaaaucggagccauagcacuggauuuuaagccuggcaccucggguucaccgaucauuaacagggaggggaagguugugggacuuuauggcaauggcgucgugacaaaaaacgggggauacguuucugguaucgcucaaacgaaugccgagccagacggccccacuccugaauuagaggaagagauguucaagaaacguaaccugaccauuauggaucuccacccagggaguggaaagacacgcaaauauuugcccgcuaucauacgggaagcaauuaagagaaggcugcgaacccucauccuggccccuacucggguggucgccgcugagauggaggaagcgcuuaagggccugccgauccgcuaccagacaaccgcaacgaaauccgagcauacugguagagaaauuguggacuugaugugccacgccacauuuaccaugaggcuacugagccccguacgggugccaaauuauaaccucaucauaauggaugaggcucauuucaccgacccugccucuauugcagcccgaggguacaucagcacuagaguuggaaugggcgaagcugcggccauuuuuaugacagcaacccccccaggcacagcugaugccuucccucaguccaaugcacccauccaggacgaggagcgcgacauaccagaaaggucauggaacagugggaaugaguggauuacugauuuugccggaaagacggucugguucgugccgagcaucaaagcugguaacgacaucgccaacuguuuacguaagaauggcaaaaaggugauucaacugucucggaagaccuuugauacagaauaccagaaaacuaagcuuaacgacugggauuucgucguaaccacagacaucuccgagaugggggcgaauuuuaaagcagauagagugauugacccuaggcgcugccugaagcccguuauacucaccgauggaccagagcgagugaucuuggccggccccaugccugucacugcugccucagcugcacagagacgggguaggguggggcgcaacccacagaaagaaaaugaccaauauauuuucacgggccagccccugaacaaugaugaggaccacgcccauuggaccgaagcuaagaugcuccuggacaacaucaauacaccugagggaaucauuccggcccuuuucgaaccagagcgugagaagagugcagcgauagauggcgaauacagacuaaaaggggagagccggaagacuuuuguugaacugaugaggcgcggagacuugcccgugugguuagcccacaaagucgcuuccgaggguaucaaguauaccgaucgaaaauggugcuucgacggccagagaaacaaucagauucuggaagagaacauggauguggagaucuggacaaaggaaggggagaaaaagaagcuccggccuagguggcuggacgcccgcaccuacucugauccccuugcacugaaagaauuuaaggacuucgcugccggaagaaaaucgauugcacucgauuugguaacugagaucggcagggugccaagccaccuggcccaucggacacguaaugcucuagacaaccugguuaugcuccacacgucagaacauggugggcgcgcguaucgacacgccgucgaggagcuuccugaaaccauggagacucuguuauugcugggccucaugauacugcuuacaggaggcgcaaugcuguuucucaucuccgggaagggaauugguaaaaccaguaucggcuugauuugugugaucgcuucuagcgggaugcuguggauggccgaaauacccuuacaauggauugccuccgcaaucgugcuagaguucuuuaugaugguccugcucauuccagagccugaaaagcagagaaccccgcaggauaaucaacuugcuuacguugugaucggaauacugacauuggccgcgaucauugcugccaacgagaugggccugcucgaaacuacgaagagggaccuggguaugucaaaagagcccgggguagugucuccaaccagcuaucuugaugucgaccuccacccugcaagugccuggacacuguacgcuguggcaacuaccguuaucacacccauguugcggcauaccauugaaaauuccacugccaacgugagccuggcggcuaucgccaaccaggcagucguauuaaugggccuagacaagggauggccaauaucuaaaauggaucugggcgugccucuccuugcccuggggugcuacucacagguuaaucccuugacgcugacagcugccgugcuccugcuuauuacccacuaugcaaucaucggaccgggcuuacaggcuaaggccacucgcgaggcgcaaaaaagaaccgccgcagguauuaugaagaacccaacagucgacgggaucaugacuauagaucuggacccugugauuuacgauuccaaguucgagaaacagcucggacaggucauguugcuggugcuaugugcuguucagcugcuccuuaugaggaccaguugggcccugugcgaagcauugacacuggcuacgggccccaucaccacucucugggaggguagcccaggcaaguuuuggaauacaaccauugccgugucgauggccaacaucuuccgggggucuuaucuggcgggagcuggcuuagcauuuuccauaaugaaaagcguagggacuggaaagcgaggcacagguucacaaggggaaacccuuggagagaaauggaagaagaaacugaaucagcucaguagaaaggaauucgaccuauacaaaaagucuggcaucacggagguggaucgcaccgaggccaaagaaggucugaagaggggcgagauuacacaucacgcugucucccgggggagcgccaaauugcagugguuuguugaacguaacauggugauccccgagggaagagucauugaccugggcugugggaggggaggcuggucauauuacugcgcaggucucaagaaggugacugaaguacgcggguauaccaaaggaggcccuggccaugaggagccggugcccaugaguacauacggguggaauaucguuaagcuuaugagcggaaaagauguguucuaccugccaccugaaaagugugacacuuugcugugcgauauuggugaguccucucccagcccuaccgucgaagagucccggacaauccgagugcucaaaauggucgagccaugguuaaagaacaaucaguucuguauaaaggugcugaaccccuauaugccuaccguuauugaacaccuugagagacugcaaaggaaacacggcgggaugcuaguacgcaauccacucucacggaacucuacucaugaaauguacuggaucaguaauggaacgggcaacaucguggccucggucaauauggugagcagacuguugcugaaccguuuuacaaugacccacaggcggcccacuauugagaaggacguugaucucggugcugggacccgccaugugaacgcggaaccggagacaccuaauauggacgucauaggagagcgaaucaaaagaauuaaggaagagcacaacuccacguggcacuaugacgaugaaaauccauacaaaaccugggccuaucauggcucuuacgaggugaaggcaacuggcucagcuagcuccaugaucaacgggguagugaagcuucugacaaaacccugggacguugucccuauggugacccagauggccaugacugauacaaccccauucggacagcaaaggguguuuaaggaaaaagucgacacacggacuccccgcaguaugccggguaccagaaggguuauggagauuacggcagagugguuauggcgaacccugggccggaauaagaaaccucguuugugcacaagagaagaguucacuaagaaggugcgcaccaacgccgcuaugggggccguauuuacagaagagaaucagugggauucugcgaaagcagccguggaagacgaggauuucuggaagcucgucgacagggagcgggaacugcacaaacuaggaaaguguggcagcugcguguauaacaugauggguaaaagagagaagaaacuuggggaauuuggaaaggcuaagggcucacgcgccaucugguacauguggcugggcgcaagguaccucgaguucgaggcucugggguuuuugaaugaagaucauugguucucccgagagaacaguuauagcggaguugaaggugagggccugcacaaacucggguacauacuucgggacaucucuaagauucccggaggcgccauguaugcugaugacacugccgguugggacaccagaaucacggaagaugaccugcauaaugaggagaaaauuacacagcagauggauccagaacacaggcaauuagcaaacgcgaucuuuaagcugaccuaccagaauaaaguggucaaggugcagcgcccuacucccacagggaccguaauggacauaauuucccguaaggaucagcggggaucaggccaaguuggcacuuauggguugaacaccuucacaaauauggaggcccagcucaucagacagauggaaggagagggugugcugagcaaagcugaccuagaaaacccacaccuucccgagaagaaaaucacgcaguggcuggagaccaagggcgucgaaaggcucaaacgcauggccauuucgggggaugacugcguggugaagccuauagaugaccgauuugcaaacgcucuguuggccuuaaaugauaugggaaagguccggaaagacaucccacaauggcagccgucuaagggcuggcaugauuggcagcagguucccuucuguagucaccauuuccacgagcugauuaugaaagacgguagaaagcucgugguaccuugcaggccacaagacgaacuuaucgggcgcgcaagaauuucccagggagccggcuggagccugcgggagacugcgugucuaggcaaagcuuacgcccagauguggucacugauguauuuucacaggcgugaucuccgauuggcauccaacgccaucugcucugcugugcccguccauugggugccuacaagccgcaccacuuggaguauacacgcccaucaccaauggaugacaaccgaagacaugcugacgguuuggaauagaguguggaucgaggauaacccauggauggaggacaagacacccgucaccacuugggaaaaugugccuuaccuugggaagcgggaggaucagugguguggaucccugauuggucucaccagcagggcaacaugggcucagaacaucccgacugccauucagcaaguacgcucuuuaaucggcaaugaagaguuccuggacuacaugccaucaaugaaaagauuucggaaggaggaagagagugaaggggcgauuugguga

SEQ ID NO: 15154 - RNA, 9873 nt, Artificial Sequence
  derived and/or modified CDS sequence (opt3) from DENV-3__GU131850__SS-prME
accagccugugccucgugaugauccuucccgccgcucuggcauuccacuugacauccagagacggcgagccuaggaugauugucgggaagaacgaacggggaaaaucuuuacuguuuaagacugccucagguauaaauauguguacgcuaaucgcgauggaucucggcgagaugugcgacgauaccguuacauacaaauguccacauauuacugaaguggagccggaagacaucgauugcugguguaaccugaccaguacauggguaaccuaugggacuugcaaucaggcuggagagcgccgacgugacaagagaagcguggcccuugcaccccacgucggcaugggucuggauacaaggacccaaacguggauguccgccgagggggcuuggcggcagguggaaaaaguugagacuugggcauugcgccauccuggauucaccauucucgcccuguuucuggcucacuacaucggcacaucucucacucagaagguggucauauucaucuuacugaugcuugugaccccaucgaugacaaugagauguguaggcguugggaacagggacuuuguggaaggauugucaggugccaccugggucgauguggugcuggagcauggcgggugcgucacgacuauggcgaagaauaaacccacacuagacauugagcuccagaagaccgaagcaacucaacuggccacacuucggaaacuguguaucgagggaaagauuaccaacaucacgaccgauagccgcugcccuacacagggcgaagcuguuuugccagaggaacaggaccagaauuauguguguaaacacacuuacguagaucgagguugggggaacggaugcggccucuucggcaaggggagucuggugaccugcgccaaguuucaauguuuagagcccauagagggaaaagucgugcaguaugaaaaucugaaguacacaguuauuaucacugugcacaccggugaccagcaucaggucggcaacgagacacaaggggugaccgcagaaauuacuccucaggcuuccacgacagaggccauccucccagaauauggaacccuuggccuggagugcucuccgagaacugguuuggacuucaaugagaugauccuacugaccaugaaaaacaaggcguggaugguacacaggcagugguuuuucgaucucccccugccuuggacaagcggggccaccacugaaacaccaacguggaaucggaaagagcuucugguuaccuuuaagaacgcacaugcuaaaaagcaagaaguggucguguugggcucccaggagggagccaugcacacugcucucacaggcgccaccgaaauucagaauucagggggaacaaguauauucgcaggucaccugaagugucguuuaaaaauggacaagcuggagcuaaaaggcaugagcuacgccaugugcacuaacaccuuuguccucaagaaagaggugucugaaacgcagcaugggaccauccugauuaagguugaguaccgcggagaagaugcucccuguaagaucccuuucuccacagaggacggccaagguaaagcgcacaacgggagacuuauaacugcaaauccagugguaauuaagaaagaggaacccgucaacaucgaggccgaaccgccuuucggcgagucaaauaucgugauuggaaucggcgauaacgcuuugaagauuaauugguauaaaaaggggagcaguauaggaaagauguuugaagccaccgcaaggggugcccggcgaauggcuauccugggcgacacagccugggauuucgggucuguuggaggcgugcucaacucccuggguaaaaugguccaucagauuuuugggagcgcauacacugcgcuuuucucgggcgugucuuggguaaugaagaucggaaucggcauucuguugaccuggauagggcucaauuccaaaaacacgucaaugaguuuuagcugcaucgcuauuggaaucauuacacuguauuuaggcgccgugguucaggcagacaucgguugugucauaaauuggaaggggaaagagcugaagugcggauccggcaucuucgugaccaacgaggugcacacuuggacagaacaguacaaguuucaagccgauucucccaaacgccuagcuaccgccauugcaggugcuugggagaauggcgucugugggaucagaagcacuaccaggauggaaaaccuccuguggaagcagauugccaaugagcuuaacuauaucuugugggaaaauaacauaaaacugacaguuguggugggagacauuaucggcguacucgagcaggggaagcggacgcugaccccacagccuauggaguuaaaauacucauggaagacuuggggaaaagcgaagauugucacagccgaaacccaaaacaguuccuucaucauagauggccccaauacaccagagugccccagcgcuucucgcgcauggaacgugugggaaguugaggacuaugguuuugggguguucacuaccaauaucuggcugaagcuuagagaagucuacacgcaguugugugaccauaggcucaugucagccgcugugaaagaugagcgugccguucacgcagacaugggauacuggauugagagucagaagaacggcagcuggaaacuggaaaaggcgucccuaaucgaggugaaaacaugcaccuggccuaagucucacacucuguggucgaaugguguacucgaaagcgauaugauuaucccaaagucccuggccggcccgauaucacagcauaaccaccggcccggguaucauacccaaacagcuggaccuuggcaccuuggcaaauuggagcuggacuuuaauuacugcgaggggacuaccgucgugauuacagaaaacuguggaacgcgaggcccaaguuuaagaaccacuacagugucugguaagcucauccacgaguggugcuguaggagcugcacccugcccccucuucgcuauaugggggaagauggauguugguacggcauggagauccggccaauuuccgaaaaagaggagaauauggucaagucacugguuagcgccgguucuggcaaaguggacaacuucacuauggggguauugugccucgcaauccuguuugaagaggugaugagaggaaaguucggcaagaaacauaugauugcuggggucuucuuuacauucgugcuacugcucuccggacagauaaccuggagggauaugacgcacacucugaucaugauuggcaguaaugccagcgaccgcauggguauggggguuaccuaucuugcauugaucgccacauuuaagauucagcccuuccuggcuuuaggauuuuuccuccgaaaacugaccucucgggaaaaccuucugcuaggcgugggccucgcgauggccacuacacugcaauugccggaggauaucgaacagauggcaaaugggauagcucugggauuaauggcccucaagcugaucacccaguuugagacauaccagcuuuggacugcccugauuuccuugaccuguucaaacacgauguucacacucaccgucgcuuggcguacugcaacccugauccuagccggugugagucugcuuccuguuugccaaagcucguccaugagaaaaacagacuggcucccaauggcgguggcugccaugggcguccccccucugcccuuguuuauuuucucucugaaggauacuuuaaagaggcgcagcuggccacucaaugaggggguaauggcagugggacugguuucaauccuugccaguucccuguugcggaacgacgugccuauggcuggcccccucgucgcaggugggcugcuaauagccuguuaugugauuaccggaacgucugcggaucugacaguagaaaaagcugccgacaucaccugggaggaagaggcagaacagacuggcgugagccauaaccuuaugaucacagucgacgaugacggcaccaugagaauuaaggaugacgagacugagaauauacucacaguucuguugaaaaccgccuuacugaucguguccgggguguuuccauacucaauuccggcuacgcuccuggucuggcacacuuggcagaagcagacccaaaggagcggagugcuuugggauguuccuagucccccagaaacacagaaagccgagcuggaagaggguguauaccgaaucaagcagcagggcauuuucgggaaaacccaagugggagucggcgugcagaaggaggguguuuuucauacaauguggcacgugacucgcggggcagucuugaccuauaacggaaagcggcuagaacccaauugggcuucugugaaaaaggaccugaucuccuacggcggcggguggagacucagcgcccaguggcaaaaaggagaggaaguacaggucauagcgguggagccugguaagaacccaaaaaauuuccagacgaugcccggcacauuccagacuaccacaggggaaaucggagccauugcacuggauuuuaagccuggcaccucggguucaccgaucauuaacagggaggggaagguugugggacuuuauggcaauggcgucgugacuaaaaacgggggauacguuucugguaucgcucaaaccaaugccgagccagacggccccacaccugaauuagaggaagagauguucaagaaacguaaccugacgauaauggaucuccacccagggaguggaaagacucgcaaauauuugcccgcuauuauccgggaagcaaucaagagaaggcugcgaacccucauucuggccccuacacggguggucgccgcugagauggaggaagcgcuuaagggccugccgauccgcuaccagaccacugcaacaaaauccgagcauaccgguagagaaauaguggacuugaugugccacgccacguuuacuaugaggcuacugagccccguacgggugccaaauuauaaccucauuaucauggaugaggcucauuucacagacccugccucuauugcagcccgaggguacaucagcaccagaguuggaaugggcgaagcugcggccauauuuaugaccgcaacucccccaggcacagcugaugccuucccucaguccaaugcacccauucaggacgaggagcgcgacaucccagaaaggucauggaacagugggaaugaguggaucaccgauuuugucggaaagacagugugguucgugccgagcauuaaagccgguaacgacaucgcuaacuguuuacguaagaauggcaaaaaggucauucaacugucucggaagacuuuugauacggaauaccagaaaaccaagcuuaacgacugggauuucguagugacaacugacauauccgagaugggggccaauuuuaaagcggauagaguuaucgacccuaggcgcugccugaagcccgugauucucaccgauggaccagagcgagucaucuuggcaggccccaugccugugacagccgcuucagccgcucagagacgggguaggguugggcgcaacccacagaaagaaaaugaccaauauaucuucaccggccagccccugaacaaugaugaggaccacgcacauuggacugaagccaagaugcuccuggacaacauuaauacgccugagggaauaaucccggcucuuuucgaaccagagcgugagaagagugccgcaauugauggcgaauacagacuaaaaggggagagccggaagaccuuuguggaacugaugaggcgcggagacuugcccgucugguuagcgcacaaaguggccuccgaggguaucaaguauacagaucgaaaauggugcuucgacggccagagaaacaaucagauucuggaagagaacauggauguagagaucuggacuaaggaaggggagaaaaagaagcuccggccuagguggcuggacgcucgcaccuacucugauccccuugcccugaaagaauuuaaggacuucgcagcuggaagaaaaucgauagcccucgauuuggugacagagaucggcaggguuccaagccaccuggcacaucggacccguaaugcccuagacaaccuggucaugcuccacacuucagaacauggugggcgcgcuuaucgacacgcgguggaggagcuuccugaaacaauggagacgcuguuauugcugggccucaugauucugcuuaccggaggcgccaugcuguuucucaucuccgggaagggaauugguaaaacuaguaucggcuugauaugugugauugcaucuagcgggaugcuguggauggcugaaauccccuuacaauggauugccuccgccaucguccuagaguucuuuaugaugguucugcucauaccagagccugaaaagcagagaacaccgcaggauaaucaacuugcauacgugguaaucggaauucugaccuuggcugccaucauugcggcuaacgagaugggccugcucgaaaccacaaagagggaccuggguaugucaaaagagcccgggguggucucuccaaauagcuaucuugauguggaccuccacccugccagugcauggacucuguacgccguugcuacgaccgugaucacacccauguugcggcauacuauagaaaacuccaccgcaaacgucagccuggccgcgauugcuaaucaggccguaguguuaaugggccuagacaagggauggccaaucucuaaaauggaucugggcguuccucuccuugcacuggggugcuacucacaggugaaccccuugacacugaccgccgcuguccuccugcuuaucacucacuaugccauuaucggaccgggcuuacaggcaaaggcuacgcgcgaggcccaaaaaagaacagcggccgguauaaugaagaauccaaccguggacgggauuaugacuaucgaucuggacccugucauuuacgauuccaaguucgagaaacagcucggacaggugauguugcugguucuaugugcagugcagcugcuccuuaugaggaccaguugggcucugugcgaagccuugacacuggcaacuggccccaucaccacacucugggaggguagcccaggcaaguuuuggaacacgaccauagcuguaucgauggccaauaucuuccgggggucuuaucuggccggagcgggcuuagcuuuuuccauuaugaaaagcguggggacuggaaagcgaggcacagguucacaaggggaaacccuuggagagaaauggaagaagaaacugaaccagcucaguagaaaggaauucgaccuauacaaaaagucuggcaucacugaggucgaucgcacagaggcaaaagaaggucugaagaaaggcgagauuacccaucacgccguuuccagggggagcgcuaaguugcagugguuuguggaacggaauauggucauccccgagggacgugugauugaccugggcugugggagaggaggcuggucauauuacugcgccggucucaagaaaguaacggaagugaggggguauaccaagggaggcccuggccaugaggagccgguucccaugaguacauacggguggaacaucgugaaacuuaugagcggaaaggaugucuucuaccugccaccugaaaaaugugacacuuugcugugcgauauaggugaguccucucccagcccuaccguggaagagucccgcacaauucggguccucaagaugguggagccaugguuaaagaauaaccaguucuguaucaaaguucugaaucccuauaugccuacuguaaucgaacaccuugagcgacugcaaagaaagcacggcgggaugcuagugaggaacccacucucacgcaauucuacccaugaaauguacuggauuaguaacggaacaggcaauauagucgcaucggugaacaugguuagccggcuguugcugaacagauuuaccaugacucaccguaggcccacgaucgagaaagacguggaucucggugccgggacacggcaugucaaugcugaaccggagaccccuaacauggacgugauuggagagcgcaucaagcgaauuaaagaagagcacaauuccacuuggcacuaugacgaugaaaacccauacaagaccugggcguaucauggcucuuacgagguaaaggccacaggcucagcaagcuccaugaucaauggggugguuaaacuucugacgaagcccugggacgucgugccuauggugacccagauggcuaugacugauacaaccccauucggacagcaaagagucuuuaaagaaaagguugacacuaggacaccccggaguaugccggguacccgcagagugaugggcauaacagccgagugguuauggaggacucuggggcgaaacaaaaagccucgguugugcacccgugaggaauucacgaagaaaguaagaaccaaugcagccaugggagcuguguuuacagaggaaaaccagugggauucugccaaggcggcagucgaggacgaagauuucuggaaacucguggaccgcgagagggagcugcacaagcuaggcaaaugugguagcugcguuuauaauaugauggggaagcgggaaaaaaagcuuggagaguuuggcaaggccaaaggcucaagagcuaucugguacauguggcugggggcccgcuaccucgaauucgaggcacugggauuuuugaacgaggaucauugguucuccagggaaaauaguuauagcgguguggagggcgaagggcugcacaagcucggauacauucuucgagacaucucuaaaauucccggcggugcuauguaugccgaugacacugcugggugggacacccggaucacagaggaugaccugcauaacgaagagaagauaacucagcagauggauccagagcacagacaauuagccaaugcaauuuuuaaacugaccuaccagaacaaggucgugaagguacagaggccuacgcccacaggaaccguuauggacaucaucucccgcaaagaucagcguggcucaggccaaguggggacuuauggauugaauacauucaccaacauggaagcgcagcucauucggcagauggagggugaaggcguccugagcaaggccgaccuagagaacccacaccuucccgaaaaaaagauaacucaguggcuggagaccaaagggguggagagacucaagaggauggcuaucucgggagaugacugcguggucaagccuauugaugaccgcuuugccaaugcacuguuggcuuuaaacgauaugggcaaaguucgaaaggacaucccacaauggcagccgucuaaagguuggcaugauuggcagcaggugcccuucuguagucaccauuuccacgaacugauuaugaaggacgggcggaaacucguagugccuugcagaccacaagacgagcuuaucggaagggcccgcauaucccagggcgcaggcuggagccugagagaaacagccugucuagggaaggcguacgcucagauguggucacugauguauuuucaccggagggaucuccguuuggccuccaaugcaaucugcucugccguccccgugcauuggguuccuacgagccgaaccacuuggaguauucacgcucaucaccaauggaugacaaccgaggacaugcugacuguguggaaccgcgucuggaucgaagauaauccauggauggaggacaagacacccgugaccacgugggagaacguaccuuaccuuggaaaaagagaagaucaguggugugguucccugauuggccucacaagccgggccaccugggcacagaauaucccgacugcuauucagcaaguuaggucuuuaauagggaacgaggaauuccuggacuacaugccaucaaugaagcgcuuuagaaaagaggaggaaagugagggagccaucugguga

SEQ ID NO: 15155 - RNA, 9873 nt, Artificial Sequence
  derived and/or modified CDS sequence (opt3) from DENV-3__GU131851__SS-prME
accagccugugccucgugaugauccuucccgccgcucuggcauuccacuugacauccagagacggcgagccucauaugauugucgggaagaacgaaaggggaaaaucuuuacuguuuaagacugccucagguauaaauauguguacgcuaaucgcgauggaucucggcgagaugugcgacgauaccguuacauacaaauguccacacauuacugaaguggagccggaagacaucgauugcugguguaaccugaccaguacauggguaaccuaugggacuugcaaucaggcuggagagcggcgccgagacaagcguagcguggcccuugcaccccaugucggcaugggucuggauacaagaacccaaacguggauguccgccgagggggcuuggaggcagguggaaaaaguugagacuugggcauugcggcacccuggauucaccauucucgcccuguuucuggcucauuacaucggcacaucucucacucagaagguggucauauucaucuuacugaugcuugugaccccaucgaugacaaugcgcuguguaggcguugggaacagagacuuuguggaaggauugucaggugccaccugggucgauguggugcuggagcacggcgggugcgucacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcuguuuugccagaggaacaggaccagaauuauguguguaaacacacuuacguagaucgcgguugggggaacggaugcggccucuucggcaaggggagucuggugaccugcgccaaguuucaauguuuagagcccauagagggaaaagucgugcaguaugaaaaucugaaguacacaguuauuaucacugugcauaccggugaccagcaccaggucggcaacgagacacaaggggugaccgcagaaauuacuccucaggcuuccacgacagaggccauccucccagaauauggaacccuuggccuggagugcucuccgcgaacugguuuggacuucaaugagaugauccuacugaccaugaaaaacaaggcguggaugguacauagacaguggcucuuugaucugccccuuccuuggacaagcggggccaccacugaaacaccaacguggaauaggaaagagcuguugguuaccuucaagaacgcacacgcuaaaaagcaagaaguggucgugcucggcucccaggagggagccaugcacacugcucugacaggcgccaccgaaauucagaauucagggggaacaaguauauuugcaggucauuuaaagugucggcugaaaauggacaagcuagagcucaaaggcaugagcuacgccaugugcacuaacaccuucguccugaagaaagaggugucugaaacgcagcacgggaccauccuuauuaagguugaguaccguggagaagaugcucccuguaagaucccuuuuuccacagaggacggccaagguaaagcgcauaacgggcgcuugauaacugcaaauccagugguaaccaagaaagaggaacccgucaacauugaggccgaaccgccuuucggcgagucaaauaucgugaucggaauuggcgauaacgcucugaagaucaauugguauaaaaaggggagcaguauuggaaagauguucgaagccacagcaagaggugccaggcggauggcuauacucggcgacacugccugggauuuugggucuguuggaggcgugcugaacucccuugguaaaaugguccaccagaucuucgggagcgcauacaccgcgcuguuuucgggcgugucuuggguaaugaagauuggaaucggcaucuugcucacguggauugggcugaauuccaaaaacacaucaaugaguuucagcugcauagcuaucggaauuaucaccuuauaucugggcgccgugguucaggcagacauggguugugucauuaauuggaaggggaaagagcuaaagugcggauccggcaucuuugugacuaacgaggugcauacauggaccgaacaguacaaguuccaagccgauucucccaaacgacucgcuacugccauagcaggugcuugggagaauggcgucugugggauccgcagcaccacaagaauggaaaaccugcuuuggaagcagauugccaaugaguugaacuauauccugugggaaaauaacauuaaacucacgguuguggugggagacaucauaggcguacuggagcaggggaagaggaccuuaacuccacagccuauggagcugaaauacucauggaagacauggggaaaagcgaagauugucaccgccgaaacacaaaacaguuccuuuaucauugauggccccaauacuccagagugccccagcgcuucucgggcauggaacgugugggaaguugaggacuaugguuucgggguguuuaccacgaauaucuggcuuaaguugcgcgaagucuacacacagcucugugaccacagacugaugucagccgcugugaaagaugagagggccguucacgcagacaugggauacuggauagagagucagaagaacggcagcuggaaacuagaaaaggcgucccugaucgaggugaaaaccugcacuuggccuaagucucauacccucuggucgaaugguguacuggaaagcgauaugauuaucccaaagucccuugccggcccgauuucacagcacaaccaucgucccggguaucacacacaaacugcuggaccuuggcacuugggcaaacuggaguuagacuucaauuacugcgaggggaccacagucgugaucacggaaaacuguggaacccggggcccaagucuccgaacuacaaccgugucugguaagcugauacaugaguggugcuguagaagcugcacucuucccccucugagguauaugggggaagauggauguugguacggcauggagauucgcccaaucuccgaaaaagaggagaauauggucaagucauugguuagcgccgguucuggcaaaguggacaacuuuacaauggggguacucugccuggcaauccuauucgaagaggugaugcggggaaaguuuggcaagaaacacaugauugcuggggucuucuucaccuuugugcugcuccuguccggacagaucacguggagagauaugacucauacccuuauuaugauaggcaguaaugccagcgacaggauggguauggggguuacauauuuggcacugaucgccaccuucaagauucagcccuuuuuagcucucggauucuuucugcgcaaacuuacuucucgagaaaaccugcuacucggcgugggccuggcgauggccacaaccuugcaacugccggaggauaucgaacagauggcaaaugggauugcuuuaggacucauggcccugaagcuuaucacacaguucgagacuuaccagcuguggaccgccuugauaucccucacguguucaaacacaauguuuacccugacugucgcuuggcggaccgcaacacuaauccuggccggugugagucuucucccuguuugccaaagcucguccaugcguaaaacugacuggcugccaauggcgguggcugccaugggcguccccccuuugccccuguucauuuuuucuuuaaaggauacccucaagagaaggagcuggccacugaaugaggggguaauggcagugggacuuguuucaauccuggccaguuccuugcuccgcaacgacgugccuauggcuggcccccuggucgcaggugggcuacugauugccuguuaugugaucacgggaacaucugcggaucuuaccguagaaaaagcugccgacauaacuugggaggaagaggcagaacagacaggcgugagccacaaccucaugauuaccgucgacgaugacggcacuaugcggaucaaggaugacgagacagagaauauccugaccguuuuguuaaaaacggcccugcucauuguguccgggguguucccauacucaauaccggcuacucugcuugucuggcauaccuggcagaagcagacacaaagaagcggagugcugugggauguuccuagucccccagaaacccagaaagccgaguuggaagaggguguauacaggaucaagcagcagggcauuuuugggaaaacacaagugggagucggcgugcagaaggaggguguuuuccacacuauguggcacgugacccgaggggcaguccuaacguauaacggaaagcgccuggaacccaauugggcuucugugaaaaaggaccucaucuccuacggcggcggguggcggcugagcgcccaguggcaaaaaggagaggaaguacaggucauugcgguggagccugguaagaacccaaaaaauuuucagacaacucccggcaccuuccagacaaccacuggggaaaucggagccauagcacuugauuucaagccuggcaccucggguucaccgaucauuaacagagaggggaagguugugggauuauauggcaauggcgucgugacaaaaaacgggggauacguuucugguaucgcucaaacgaaugccgagccagacggccccacuccugaacuggaggaagagauguuuaagaaaaggaaccucaccauuauggauuugcauccagggaguggaaagacacguaaauaucugcccgcuaucauacgcgaagcaauuaagcggagacucaggacccugauccuugccccuacucgaguggucgccgcugagauggaggaagcgcugaagggcuugccgauccgguaccagacaaccgcaacgaaauccgagcacacuggucgcgaaauuguggaccuaaugugccaugccacauucaccaugagacugcucagccccguaagggugccaaauuauaacuuaaucauaauggaugaggcucacuuuaccgacccugccucuauugcagcccggggguacaucagcacucgaguuggaaugggcgaagcugcggccauuuucaugacagcaacccccccaggcacagcugaugccuuuccucaguccaaugcacccauccaggacgaggagagagacauaccagaacgcucauggaacagugggaaugaguggauuacugauuucgccggaaagacggucugguuugugccgagcaucaaagcugguaacgacaucgccaacugucugaggaagaauggcaaaaaggugauucaacuuucucguaagaccuucgauacagaauaccagaaaacuaagcugaacgacugggauuuugucguaaccacagacaucuccgagaugggggcgaauuucaaagcagaucgggugauugacccuagaaggugccucaagcccguuauauugaccgauggaccagagcgcgugauccuggccggccccaugccugucacugcugccucagcugcacagcgaagaggucggguggggaggaacccacagaaagaaaaugaccaauauauuuuuacgggccagccccucaacaaugaugaggaccaugcccacuggaccgaagcuaagaugcugcuugacaacaucaauacaccugagggaaucauuccggcccuauucgaaccagagcgcgagaagagugcagcgauagauggcgaauaccgucugaaaggggagagcagaaagacuuucguugaauugaugcggaggggagacuuacccguguggcuggcccacaaagucgcuuccgaggguaucaaguauaccgaucgcaaauggugcuuugacggccagcgaaacaaucagauucucgaagagaacauggauguggagaucuggacaaaggaaggggagaaaaagaagcugagaccucgguggcuugacgccaggaccuacucugauccccuggcacucaaagaauucaaggacuuugcugccggacgcaaaucgauugcauuggaucugguaacugagaucggcagagugccaagccaucuagcccacaggacacggaaugcucuggacaaccucguuaugcuucauacgucagaacacggugggcgugcguaucgccacgccgucgaggagcugccugaaaccauggagacuuuauugcugcucggccugaugauacuucugacaggaggcgcaaugcucuucuugaucuccgggaagggaauugguaaaaccaguaucggccugauuugugugaucgcuucuagcgggauguuauggauggccgaaauaccccuacaauggauugccuccgcaaucgugcuggaguuuuucaugaugguccuccuuauuccagagccugaaaagcagcgaaccccgcaggauaaucaacuggcuuacguugugaucggaauauugacacuggccgcgaucauugcugccaacgagaugggccuccuggaaacuacgaagagagaccuugguaugucaaaagagcccgggguagugucuccaaccagcuaucucgaugucgaccugcauccugcaagugccuggacauuguacgcuguggcaacuaccguuaucacacccaugcugaggcacaccauugaaaauuccacugccaacgugagcuuagcggcuaucgccaaccaggcagucguacuaaugggccuggacaagggauggccaauaucuaaaauggaucucggcgugccucuucuggccuuggggugcuacucacagguuaauccccugacgcucacagcugccgugcugcuuuuaauuacccauuaugcaaucaucggaccgggccugcaggcuaaggccacucgggaggcgcaaaaacgcaccgccgcagguauuaugaagaacccaacagucgacgggaucaugacuauagaucucgacccugugauuuacgauuccaaguuugagaaacaguugggacaggucaugcugcuagugcugugugcuguucagcuccuucugaugagaaccaguugggccuugugcgaagcacugacacucgcuacgggccccaucaccacucugugggaggguagcccaggcaaguucuggaauacaaccauugccgugucgauggccaacaucuuuagggggucuuauuuagcgggagcuggccuugcauucuccauaaugaaaagcguagggacuggaaagcggggcacagguucacaaggggaaacccugggagagaaauggaagaagaaacucaaucagcuaagucgaaaggaauuugaccuguacaaaaagucuggcaucacggagguggauagaaccgaggccaaagaagguuugaagcgcggcgagauuacacaccaugcugucuccagggggagcgccaaacugcagugguucguugaacggaacauggugauccccgagggacgugucauugaccucggcugugggagaggaggcuggucauauuacugcgcaggucuuaagaaggugacugaaguaaggggguauaccaaaggaggcccuggccacgaggagccggugcccaugaguacauacggguggaauaucguuaagcugaugagcggaaaagauguguuuuacuugccaccugaaaagugugacacucugcucugcgauauuggugaguccucucccagcccuaccgucgaagagucccgcacaauccggguguuaaaaauggucgagccauggcugaagaacaaucaguucuguauaaaggugcuuaaccccuauaugccuaccguuauugaacaccuggagcgacuacaaagaaaacauggcgggaugcucguaaggaauccacugucacgcaacucuacucacgaaauguacuggaucaguaauggaacgggcaacaucguggccucggucaauauggugagccgguugcugcucaacagauucacaaugacccaucguaggcccacuauugagaaggacguugaucuuggugcugggacccggcacgugaacgcggaaccggagacaccuaauauggacgucauaggagagcgcaucaaacgaauuaaggaagagcacaacuccacguggcauuaugacgaugaaaauccauacaaaaccugggccuaucacggcucuuacgaggugaaggcaacuggcucagcuagcuccaugaucaacgggguagugaagcuguuaacaaaacccugggacguugucccuauggugacccagauggccaugacugauacaaccccauuuggacagcaaagaguguucaaggaaaaagucgacacaaggacuccccggaguaugccggguacccgcagaguuauggagauuacggcagaguggcuguggaggaccuugggccgaaauaagaaaccucggcucugcacacgugaagaguuuacuaagaaggugagaaccaacgccgcuaugggggccguauucacagaagagaaucagugggauucugcgaaagcagccguggaagacgaggauuuuuggaagcuggucgaccgcgagagggaacuacauaaacuuggaaaguguggcagcugcguguauaacaugauggguaaacgggagaagaaacugggggaauucggaaaggcuaagggcucaagagccaucugguacauguggcucggcgcacgcuaccuggaguuugaggcuuugggguuccugaaugaagaucacugguuuuccagggagaacaguuauagcggaguugaaggugagggccuccauaaacuuggguacauacugcgagacaucucuaagauucccggaggcgccauguaugcugaugacacugccgguugggacacccggaucacggaagaugacuuacacaaugaggagaaaauuacacagcagauggauccagaacacagacaacuggcaaacgcgaucuucaaguugaccuaccagaauaaaguggucaaggugcagaggccuacucccacagggaccguaauggacauaauuucccgcaaggaucagcguggaucaggccaaguuggcacuuaugggcucaacaccuuuacaaauauggaggcccagcugauccggcagauggaaggagagggugugcuaagcaaagcugaccuugaaaacccacaucugcccgagaagaaaaucacgcaguggcucgagaccaagggcgucgaaagacugaaaaggauggccauuucgggggaugacugcguggugaagccuauagaugaccgcuucgcaaacgcuuuguuagcccugaaugauaugggaaagguccgaaaagacaucccacaauggcagccgucuaagggcuggcacgauuggcagcagguucccuuuuguagucaucacuuccacgagcucauuaugaaagacggucggaagcuugugguaccuugcagaccacaagacgaacugaucgggagggcacgcauuucccagggagccggcuggagccuaagagagacugcgugucugggcaaagcuuacgcccagauguggucacucauguauuuccaucggagggauuugcgucuggcauccaacgccaucugcucugcugugcccguccacugggugccuacaagccgaaccacuuggaguauacaugcccaccaucaauggaugacaaccgaagacaugcuuacgguuuggaaucgcguguggaucgaggauaacccauggauggaggacaagacacccgucaccacuugggaaaaugugccuuaccuggggaagagagaggaucagugguguggaucccucauugguuuaaccagccgggcaacaugggcucagaacaucccgacugccauucagcaaguaaggucucugaucggcaaugaagaguuuuuggacuacaugccaucaaugaaacgcuucagaaaggaggaagagagugaaggggcgauuugguga

SEQ ID NO: 15156 - RNA, 9873 nt, Artificial Sequence
  derived and/or modified CDS sequence (opt3) from DENV-3__GQ868547__SS-prME
accagccugugccucgugaugauccuucccgccgcucuggcauuccacuugacauccagagacggcgagccuaggaugauugucgggaagaacgaacggggaaaaucuuuacuguuuaagacugccucagguauaaauauguguacgcuaaucgcgauggaucucggcgagaugugcgacgauaccguuacauacaaauguccacauauuacugaaguggagccggaagacaucgauugcugguguaaccugaccaguacauggguaaccuaugggacuugcaaucaggcuggagagcgccgacgugacaagagaagcguggcccuugcaccccacgucggcaugggucuggauacaaggacccaaacguggauguccgccgagggggcuuggcggcagguggaaaaaguugagacuugggcauugcgccauccuggauucaccauucucgcccuguuucuggcucacuacaucggcacaucucucacucagaagguggucauauucaucuuacugaugcuugugaccccaucgaugacaaugagauguguaggcguugggaacagggacuuuguggaaggauugucaggugccaccugggucgauguggugcuggagcauggcgggugcgucacgacuauggcgaagaauaaacccacacuagacauugagcuccagaagaccgaagcaacucaacuggccacacuucggaaacuguguaucgagggaaagauuaccaacaucacgaccgauagccgcugcccuacacagggcgaagcuguuuugccagaggaacaggaccagaauuauguguguaaacacacuuacguagaucgagguugggggaacggaugcggccucuucggcaaggggagucuggugaccugcgccaaguuucaauguuuagagcccauagagggaaaagucgugcaguaugaaaaucugaaguacacaguuauuaucacugugcacaccggugaccagcaucaggucggcaacgagacacaaggggugaccgcagaaauuacuccucaggcuuccacgacagaggccauccucccagaauauggaacccuuggccuggagugcucuccgagaacugguuuggacuucaaugagaugauccuacugaccaugaaaaacaaggcguggaugguacacaggcagugguuuuucgaucucccccugccuuggacaagcggggccaccacugaaacaccaacguggaaucggaaagagcuucugguuaccuuuaagaacgcacaugcuaaaaagcaagaaguggucguguugggcucccaggagggagccaugcacacugcucucacaggcgccaccgaaauucagaauucagggggaacaaguauauucgcaggucaccugaagugucguuuaaaaauggacaagcuggagcuaaaaggcaugagcuacgccaugugcacuaacaccuuuguccucaagaaagaggugucugaaacgcagcaugggaccauccugauuaagguugaguaccgcggagaagaugcucccuguaagaucccuuucuccacagaggacggccaagguaaagcgcacaacgggagacuuauaacugcaaauccagugguaaccaagaaagaggaacccgucaacauugaggccgaaccgccuuucggcgagucaaauaucgugaucggaauuggcgauaacgcuuugaagaucaauugguauaaaaaggggagcaguauuggaaagauguuugaagccacagcaaggggugcccggcgaauggcuauacugggcgacacugccugggauuucgggucuguuggaggcgugcucaacucccuggguaaaaugguccaucagaucuuugggagcgcauacaccgcgcuuuucucgggcgugucuuggguaaugaagauuggaaucggcauccuguugacguggauugggcucaauuccaaaaacacaucaaugaguuuuagcugcauagcuaucggaauuaucacccuguauuuaggcgccgugguucaggcagacauggguugugucauuaauuggaaggggaaagagcugaagugcggauccggcaucuucgugacuaacgaggugcacacauggaccgaacaguacaaguuucaagccgauucucccaaacgccuagcuacugccauagcaggugcuugggagaauggcgucugugggaucagaagcaccacaaggauggaaaaccuccuguggaagcagauugccaaugagcuuaacuauaucuugugggaaaauaacauuaaacugacgguuguggugggagacaucauaggcguacucgagcaggggaagcggacccugacuccacagccuauggaguuaaaauacucauggaagacauggggaaaagcgaagauggucaccgccgaaacacaaaacaguuccuucauuaucgauggccccaauacuccagagugccccagcgcuucucgcgcauggaacgugugggaaguugaggacuaugguuuugggguguucaccacgaauauuuggcugaagcuuagagaaguccauacacaguugugugaccacaggcucaugucagccgcugugaaagaugagcgugccguucacgcagacaugggauacuggaucgagagucagaagaacggcagcuggaaacuggaaaaggcgucccuaauagaggugaaaaccugcacuuggccuaagucucauacccuguggucgaaugguguacucgaaagcgauaugaucauuccaaagucccuggccggcccgaucucacagcacaaccaucggcccggguaccacacacaaacugcuggaccuuggcaccuuggcaaauuggagcuggacuuuaauuauugcgaggggaccacagucgugauuacggaaaacuguggaacccgaggcccaaguuuaagaacuacaaccgugucugguaagcucauccaugaguggugcuguaggagcugcacucugcccccucuucgcuacaugggggaagauggauguugguauggcauggagauacggccaauuuccgaaaaagaggagaauauggucaagucacugguuagcgccgguucuggcaaaguggacaacuucacaauggggguauugugccucgcaauccuguuugaagaggugaugagaggaaaguucggcaagaaacacaugaucgcuggggucuucuuuaccuucgugcuacugcucuccggacagauuacguggagggauaugacucauacccugaucaugauuggcaguaaugccagcgaccgcauggguauggggguuacauaccuugcauugauagccaccuuuaagauccagcccuuccuggcuuuaggauuuuuccuccgaaaacugacuucucgggaaaaccuucugcuaggcgugggccucgcgauggccacaacccugcaauugccggaggauauugaacagauggcaaaugggaucgcucugggauuaauggcccucaagcugauuacacaguuugagacuuaucagcuuuggaccgcccugaucuccuugacguguucaaacacaauguucacccucacugucgcuuggcguaccgcaacacugauacuagccggugugagucugcuuccuguuugccaaagcucguccaugagaaaaacugacuggcucccaauggcgguggcugccaugggcguccccccucugcccuuguuuaucuucucucugaaggauaccuuaaagaggcgcagcuggccacucaaugaggggguaauggcagugggacugguuucaauucuugccaguucccuguugcggaacgacgugccuauggcuggcccccucgucgcaggugggcugcuaaucgccuguuacgugauuacgggaacaucugcggaucugaccguagaaaaagcugccgacaucacuugggaggaagaggcagaacagacaggcgugagccacaaccuuaugauaaccgucgacgaugacggcacuaugagaauuaaggaugacgagacagagaauauccucaccguucuguugaaaacggccuuacugaucguguccgggguguuuccauauucaauuccggcuacucuccuggucuggcauaccuggcagaagcagacacaaaggagcggagugcuuugggauguuccuagucccccagaaacccagaaagccgagcuggaagaggguguauaccgaauaaagcagcagggcaucuucgggaaaacacaagugggagucggcgugcagaaggaggguguuuuucacacuauguggcacgugacccgcggggcagucuugacguacaacggaaagcggcuagaacccaauugggcuucugugaaaaaggaccugauuuccuauggcggcggguggagacucagcgcccaguggcaaaaaggagaggaaguacaggucaucgcgguggagccugguaagaacccaaaaaauuuccagacaacucccggcaccuuccagacaaccacuggggaaauuggagccaucgcacuggauuuuaagccuggcaccucggguucaccgauaaucaacagggaggggaagguugugggacuuuacggcaauggcgucgugacaaaaaacgggggauauguuucugguauugcucaaacgaaugccgagccagacggccccacuccugaauuagaggaagagauguucaagaaacguaaccugaccaucauggaucuccauccagggaguggaaagacacgcaaauacuugcccgcuauuauccgggaagcaauaaagagaaggcugcgaacccucauucuggccccuacucggguggucgccgcugagauggaggaagcgcuuaagggccugccgauccgcuaucagacaaccgcaacgaaauccgagcacacugguagagaaaucguggacuugaugugccaugccacauuuaccaugaggcuacugagccccguacgggugccaaauuacaaccucauuaucauggaugaggcucacuucaccgacccugccucuauagcagcccgaggguauauuagcacuagaguuggaaugggcgaagcugcggccaucuuuaugacagcaacccccccaggcacagcugaugccuucccucaguccaaugcacccauucaggacgaggagcgcgacaucccagaaaggucauggaacagugggaaugaguggauaacugauuuugccggaaagacggucugguucgugccgagcauuaaagcugguaacgacaucgccaacuguuuacguaagaauggcaaaaaggugauccaacugucucggaagaccuuugauacagaauaccagaaaacuaagcuuaacgacugggauuucgucguaaccacagacauuuccgagaugggggcgaauuuuaaagcagauagagugaucgacccuaggcgcugccugaagcccguuauucucaccgauggaccagagcgagugauauuggccggccccaugccugucacugcugccucagcugcacagagacgggguaggguggggcgcaacccacagaaagaaaaugaccaauacaucuucacgggccagccccugaacaaugaugaggaccaugcccacuggaccgaagcuaagaugcuccuggacaacauuaauacaccugagggaaucaucccggcccuuuucgaaccagagcgugagaagagugcagcgauugauggcgaauauagacuaaaaggggagagccggaagacuuuuguugaacugaugaggcgcggagacuugcccgugugguuagcccacaaagucgcuuccgaggguauaaaguacaccgaucgaaaauggugcuucgacggccagagaaacaaucagauccuggaagagaacauggauguggagauuuggacaaaggaaggggagaaaaagaagcuccggccuagguggcuggacgcccgcaccuauucugauccccuugcacugaaagaauuuaaggacuucgcugccggaagaaaaucgaucgcacucgauuugguaacugagauuggcagggugccaagccaucuggcccaccggacacguaaugcucuagacaaccugguuaugcuccauacgucagaacacggugggcgcgcguaccgacacgccgucgaggagcuuccugaaaccauggagacucuguuauugcugggccucaugauccugcuuacaggaggcgcaaugcuguuucucauauccgggaagggaaucgguaaaaccaguauuggcuugaucugugugauugcuucuagcgggaugcuguggauggccgaaauccccuuacaauggauagccuccgcaauugugcuagaguucuuuaugaugguccugcucaucccagagccugaaaagcagagaaccccgcaggauaaucaacuugcuuauguugugauuggaauccugacauuggccgcgauaaucgcugccaacgagaugggccugcucgaaacuacgaagagggaccuggguaugucaaaagagcccgggguagugucuccaaccagcuaccuugaugucgaccuccauccugcaagugccuggacacuguaugcuguggcaacuaccguuauuacacccauguugcggcacaccaucgaaaauuccacugccaacgugagccuggcggcuauugccaaccaggcagucguauuaaugggccuagacaagggauggccaaucucuaaaauggaucugggcgugccucuccuugcccuggggugcuacucacagguuaaucccuugacgcugacagcugccgugcuccugcuuauaacccauuacgcaauuaucggaccgggcuuacaggcuaaggccacucgcgaggcgcaaaaaagaaccgccgcagguaucaugaagaacccaacagucgacgggauuaugacuaucgaucuggacccugugauauaugauuccaaguucgagaaacagcucggacaggucauguugcuggugcuaugugcuguucagcugcuccuuaugaggaccaguugggcccugugcgaagcauugacacuggcuacgggccccauuaccacucucugggaggguagcccaggcaaguuuuggaauacaaccaucgccgugucgauggccaacauuuuccgggggucuuaccuggcgggagcuggcuuagcauuuuccaucaugaaaagcguagggacuggaaagcgaggcacagguucacaaggggaaacccuuggagagaaauggaagaagaaacugaaucagcucaguagaaaggaauucgaccuauauaaaaagucuggcauaacggagguggaucgcaccgaggccaaagaaggucugaagaggggcgagaucacacaccaugcugucucccgggggagcgccaaauugcagugguuuguugaacguaacauggugauucccgagggaagagucaucgaccugggcugugggaggggaggcuggucauacuauugcgcaggucucaagaaggugacugaaguacgcggguacaccaaaggaggcccuggccacgaggagccggugcccaugaguacauauggguggaauauuguuaagcuuaugagcggaaaagauguguucuaccugccaccugaaaagugugacacuuugcugugcgauaucggugaguccucucccagcccuaccgucgaagagucccggacaauucgagugcucaaaauggucgagccaugguuaaagaacaaucaguucuguaucaaggugcugaaccccuacaugccuaccguuauagaacaccuugagagacugcaaaggaaacauggcgggaugcuaguacgcaauccacucucacggaacucuacucacgaaauguauuggauuaguaauggaacgggcaacaucguggccucggucaauauggugagcagacuguugcugaaccguuuuacaaugacccauaggcggcccacuaucgagaaggacguugaucucggugcugggacccgccacgugaacgcggaaccggagacaccuaauauggacgucauuggagagcgaauaaaaagaaucaaggaagagcacaacuccacguggcauuacgacgaugaaaauccauauaaaaccugggccuaccacggcucuuaugaggugaaggcaacuggcucagcuagcuccaugauuaacgggguagugaagcuucugacaaaacccugggacguugucccuauggugacccagauggccaugacugauacaaccccauucggacagcaaaggguguuuaaggaaaaagucgacacacggacuccccgcaguaugccggguaccagaaggguuauggagaucacggcagagugguuauggcgaacccugggccggaauaagaaaccucguuugugcacaagagaagaguucacuaagaaggugcgcaccaacgccgcuaugggggccguauuuacagaagagaaucagugggauucugcgaaagcagccguggaagacgaggauuucuggaagcucgucgacagggagcgggaacugcauaaacuaggaaaguguggcagcugcguguacaacaugauggguaaaagagagaagaaacuuggggaauuuggaaaggcuaagggcucacgcgccauuugguauauguggcugggcgcaagguaccucgaguucgaggcucugggguuuuugaaugaagaucacugguucucccgagagaacaguuacagcggaguugaaggugagggccugcauaaacucggguauauccuucgggacauaucuaagauccccggaggcgccauguacgcugaugacacugccgguugggacaccagaauuacggaagaugaccugcacaaugaggagaaaaucacacagcagauggauccagaacacaggcaauuagcaaacgcgauuuuuaagcugaccuaucagaauaaaguggucaaggugcagcgcccuacucccacagggaccguaauggacaucauaucccguaaggaucagcggggaucaggccaaguuggcacuuacggguugaacaccuucacaaauauggaggcccagcucauuagacagauggaaggagagggugugcugagcaaagcugaccuagaaaacccacaucuucccgagaagaaaaucacgcaguggcuggagaccaagggcgucgaaaggcucaaacgcauggccaucucgggggaugacugcguggugaagccuauugaugaccgauuugcaaacgcucuguuggccuuaaaugauaugggaaagguccggaaagacauaccacaauggcagccgucuaagggcuggcacgauuggcagcagguucccuucuguagucaucacuuccacgagcugaucaugaaagacgguagaaagcucgugguaccuugcaggccacaagacgaacuuauugggcgcgcaagaaucucccagggagccggcuggagccugcgggagacugcgugucuaggcaaagcuuaugcccagauguggucacugauguacuuucauaggcgugaucuccgauuggcauccaacgccauuugcucugcugugcccguccacugggugccuacaagccgcaccacuuggaguauccaugcccaccaucaauggaugacaaccgaagacaugcugacgguuuggaauagaguguggauagaggauaacccauggauggaggacaagacacccgucaccacuugggaaaaugugccuuaucuugggaagcgggaggaucagugguguggaucccugaucggucucaccagcagggcaacaugggcucagaacauuccgacugccauccagcaaguacgcucuuuaauuggcaaugaagaguuccuggacuacaugccaucaaugaaaagauuucggaaggaggaagagagugaaggggcgaucugguga

SEQ ID NO: 15157 - RNA, 9873 nt, Artificial Sequence
  derived and/or modified CDS sequence (opt3) from DENV-3__GU131857__SS-prME
accagccugugccucgugaugauccuucccgccgcucuggcauuccacuugacauccagagacggcgagccuaggaugauugucgggaagaacgaacggggaaaaucuuuacuguuuaagacugccucagguauaaauauguguacgcuaaucgcgauggaucucggcgagaugugcgacgauaccguuacauacaaauguccacauauuacugaaguggagccggaagacaucgauugcugguguaaccugaccaguacauggguaaccuaugggacuugcaaucaggcuggagagcgccgacgugacaagagaagcguggcccuugcaccccacgucggcaugggucuggauacaaggacccaaacguggauguccgccgagggggcuuggcggcagguggaaaaaguugagacuugggcauugcgccauccuggauucaccauucucgcccuguuucuggcucacuacaucggcacaucucucacucagaagguggucauauucaucuuacugaugcuugugaccccaucgaugacaaugagauguguaggcguugggaacagggacuuuguggaaggauugucaggugccaccugggucgauguggugcuggagcauggcgggugcgucacgacuauggcgaagaauaaacccacacuagacauugagcuccagaagaccgaagcaacucaacuggccacacuucggaaacuguguaucgagggaaagauuaccaacaucacgaccgauagccgcugcccuacacagggcgaagcuguuuugccagaggaacaggaccagaauuauguguguaaacacacuuacguagaucgagguugggggaacggaugcggccucuucggcaaggggagucuggugaccugcgccaaguuucaauguuuagagcccauagagggaaaagucgugcaguaugaaaaucugaaguacacaguuauuaucacugugcacaccggugaccagcaucaggucggcaacgagacacaaggggugaccgcagaaauuacuccucaggcuuccacgacagaggccauccucccagaauauggaacccuuggccuggagugcucuccgagaacugguuuggacuucaaugagaugauccuacugaccaugaaaaacaaggcguggaugguacacaggcagugguuuuucgaucucccccugccuuggacaagcggggccaccacugaaacaccaacguggaaucggaaagagcuucugguuaccuuuaagaacgcacaugcuaaaaagcaagaaguggucguguugggcucccaggagggagccaugcacacugcucucacaggcgccaccgaaauucagaauucagggggaacaaguauauucgcaggucaccugaagugucguuuaaaaauggacaagcuggagcuaaaaggcaugagcuacgccaugugcacuaacaccuuuguccucaagaaagaggugucugaaacgcagcaugggaccauccugauuaagguugaguaccgcggagaagaugcucccuguaagaucccuuucuccacagaggacggccaagguaaagcgcacaacgggagacuuauaacugcaaauccagugguaaccaagaaagaggaacccgucaacauugaggccgaaccgccuuucggcgagucaaauaucgugaucggaauuggcgauaacgcuuugaagaucaauugguauaaaaaggggagcaguauuggaaagauguuugaagccacagcaaggggugcccggcgaauggcuauacugggcgacacugccugggauuucgggucuguuggaggcgugcucaacucccuggguaaaaugguccaucagaucuuugggagcgcauacaccgcgcuuuucucgggcgugucuuggguaaugaagauuggaaucggcauccuguugacguggauugggcucaauuccaaaaacacaucaaugaguuuuagcugcauagcuaucggaauuaucacccuguauuuaggcgccgugguucaggcagacauggguugugucauuaauuggaaggggaaagagcugaagugcggauccggcaucuucgugacuaacgaggugcacacauggaccgaacaguacaaguuucaagccgauucucccaaacgccuagcuacugccauagcaggugcuugggagaauggcgucugugggaucagaagcaccacaaggauggaaaaccuccuguggaagcagauugccaaugagcuuaacuauaucuugugggaaaauaacauuaaacugacgguuguggugggagacaucauaggcguacucgagcaggggaagcggacccugacuccacagccuauggaguuaaaauacucauggaagacauggggaaaagcgaagauugucaccgccgaaacacaaaacaguuccuucaucauugauggccccaauacuccagagugccccagcgcuucucgcgcauggaacgugugggaaguugaggacuaugguuuugggguguucaccacgaauaucuggcugaagcuuagagaagucuacacacaguugugugaccauaggcucaugucagccgcugugaaagaugagcgugccguucacgcagacaugggauacuggauagagagucagaagaacggcagcuggaaacuggaaaaggcgucccuaaucgaggugaaaaccugcacuuggccuaagucucacacccuguggucgaaugguguacucgaaagcgauaugauuaucccaaagucccuggccggcccgauuucacagcauaaccaccggcccggguaucauacacaaacugcuggaccuuggcaccuuggcaaauuggagcuggacuuuaauuacugcgaggggaccacagucgugaucacggaaaacuguggaacccgaggcccaaguuuaagaacuacaaccgugucugguaagcucauacacgaguggugcuguaggagcugcacucugcccccucuucgcuauaugggggaagauggauguugguacggcauggagauucggccaaucuccgaaaaagaggagaauauggucaagucacugguuagcgccgguucuggcaaaguggacaacuucacaauggggguauugugccucgcaauccuguuugaagaggugaugagaggaaaguucggcaagaaacauaugauugcuggggucuucuuuaccuucgugcuacugcucuccggacagaucacguggagggauaugacucacacccugauuaugauaggcaguaaugccagcgaccgcauggguauggggguuacauaucuugcauugaucgccaccuuuaagauucagcccuuccuggcuuuaggauuuuuccuccgaaaacugacuucucgggaaaaccuucugcuaggcgugggccucgcgauggccacaacccugcaauugccggaggauaucgaacagauggcaaaugggauugcucugggauuaauggcccucaagcugaucacacaguuugagacuuaccagcuuuggaccgcccugauauccuugacguguucaaacacaauguucacccucacugucgcuuggcguaccgcaacacugauccuagccggugugagucugcuuccuguuugccaaagcucguccaugagaaaaacugacuggcucccaauggcgguggcugccaugggcguccccccucugcccuuguuuauuuucucucugaaggauaccuuaaagaggcgcagcuggccacucaaugaggggguaauggcagugggacugguuucaauccuugccaguucccuguugcggaacgacgugccuauggcuggcccccucgucgcaggugggcugcuaauugccuguuaugugaucacgggaacaucugcggaucugaccguagaaaaagcugccgacauaacuugggaggaagaggcagaacagacaggcgugagccauaaccuuaugauuaccgucgacgaugacggcacuaugagaaucaaggaugacgagacagagaauauccucaccguucuguugaaaacggccuuacugauuguguccgggguguuuccauacucaauaccggcuacucuccuggucuggcacaccuggcagaagcagacacaaaggagcggagugcuuugggauguuccuagucccccagaaacccagaaagccgagcuggaagaggguguauaccgaaucaagcagcagggcauuuucgggaaaacacaagugggagucggcgugcagaaggaggguguuuuucauacuauguggcacgugacccgcggggcagucuugacguauaacggaaagcggcuagaacccaauugggcuucugugaaaaaggaccugaucuccuacggcggcggguggagacucagcgcccaguggcaaaaaggagaggaaguacaggucauugcgguggagccugguaagaacccaaaaaauuuccagacaacucccggcaccuuccagacaaccacuggggaaaucggagccauagcacuggauuuuaagccuggcaccucggguucaccgaucauuaacagggaggggaagguugugggacuuuauggcaauggcgucgugacaaaaaacgggggauacguuucugguaucgcucaaacgaaugccgagccagacggccccacuccugaauuagaggaagagauguucaagaaacguaaccugaccauuauggaucuccacccagggaguggaaagacacgcaaauauuugcccgcuaucauacgggaagcaauuaagagaaggcugcgaacccucauccuggccccuacucggguggucgccgcugagauggaggaagcgcuuaagggccugccgauccgcuaccagacaaccgcaacgaaauccgagcauacugguagagaaauuguggacuugaugugccacgccacauuuaccaugaggcuacugagccccguacgggugccaaauuauaaccucaucauaauggaugaggcucauuucaccgacccugccucuauugcagcccgaggguacaucagcacuagaguuggaaugggcgaagcugcggccauuuuuaugacagcaacccccccaggcacagcugaugccuucccucaguccaaugcacccauccaggacgaggagcgcgacauaccagaaaggucauggaacagugggaaugaguggauuacugauuuugucggaaagacggugugguucgugccgagcaucaaagccgguaacgacaucgcuaacuguuuacguaagaauggcaaaaaggucauucaacugucucggaagaccuuugauacagaauaccagaaaacuaagcuuaacgacugggauuucguagugaccacagacaucuccgagaugggggccaauuuuaaagcggauagaguuauugacccuaggcgcugccugaagcccgugauacucaccgauggaccagagcgagucaucuuggcaggccccaugccugugacugccgcuucagccgcucagagacgggguaggguugggcgcaacccacagaaagaaaaugaccaauauauuuucacgggccagccccugaacaaugaugaggaccacgcacauuggaccgaagccaagaugcuccuggacaacaucaauacaccugagggaaucauuccggcucuuuucgaaccagagcgugagaagagugccgcaauagauggcgaauacagacuaaaaggggagagccggaagacuuuuguggaacugaugaggcgcggagacuugcccgucugguuagcgcacaaaguggccuccgaggguaucaaguauaccgaucgaaaauggugcuucgacggccagagaaacaaucagauucuggaagagaacauggauguagagaucuggacaaaggaaggggagaaaaagaagcuccggccuagguggcuggacgcucgcaccuacucugauccccuugcccugaaagaauuuaaggacuucgcagcuggaagaaaaucgauugcccucgauuuggugacugagaucggcaggguuccaagccaccuggcacaucggacacguaaugcccuagacaaccuggucaugcuccacacgucagaacauggugggcgcgcuuaucgacacgcgguggaggagcuuccugaaaccauggagacucuguuauugcugggccucaugauacugcuuacaggaggcgccaugcuguuucucaucuccgggaagggaauugguaaaaccaguaucggcuugauuugugugaucgcaucuagcgggaugcuguggauggcugaaauacccuuacaauggauugccuccgccaucguccuagaguucuuuaugaugguucugcucauuccagagccugaaaagcagagaaccccgcaggauaaucaacuugcauacgugguaaucggaauacugacauuggcugccaucauugcggcuaacgagaugggccugcucgaaacuacgaagagggaccuggguaugucaaaagagcccgggguggucucuccaaccagcuaucuugauguggaccuccacccugccagugcauggacacuguacgccguugcuacuaccgugaucacacccauguugcggcauaccauugaaaauuccacugcaaacgucagccuggccgcgaucgcuaaccaggccguaguguuaaugggccuagacaagggauggccaauaucuaaaauggaucugggcguuccucuccuugcacuggggugcuacucacaggugaaucccuugacgcugacagccgcuguccuccugcuuauuacccacuaugccaucaucggaccgggcuuacaggcaaaggcuacucgcgaggcccaaaaaagaaccgcggccgguauuaugaagaacccaacaguggacgggaucaugacuauagaucuggacccugucauuuacgauuccaaguucgagaaacagcucggacaggugauguugcugguucuaugugcagugcagcugcuccuuaugaggaccaguugggcucugugcgaagccuugacacuggcaacgggccccaucaccacucucugggaggguagcccaggcaaguuuuggaauacaaccauugcuguaucgauggccaacaucuuccgggggucuuaucuggccggagcgggcuuagcuuuuuccauaaugaaaagcguggggacuggaaagcgaggcacagguucacaaggggaaacccuuggagagaaauggaagaagaaacugaaucagcucaguagaaaggaauucgaccuauacaaaaagucuggcaucacggaggucgaucgcaccgaggcaaaagaaggucugaagaggggcgagauuacacaucacgccguuucccgggggagcgcuaaauugcagugguuuguggaacguaacauggucauccccgagggaagagugauugaccugggcugugggaggggaggcuggucauauuacugcgccggucucaagaagguaacugaagugcgcggguauaccaaaggaggcccuggccaugaggagccgguucccaugaguacauacggguggaauaucgugaagcuuaugagcggaaaagaugucuucuaccugccaccugaaaagugugacacuuugcugugcgauauuggugaguccucucccagcccuaccguggaagagucccggacaauccgaguccucaaaaugguggagccaugguuaaagaacaaucaguucuguauaaagguucugaaccccuauaugccuaccguaauugaacaccuugagagacugcaaaggaaacacggcgggaugcuagugcgcaauccacucucacggaacucuacucaugaaauguacuggaucaguaauggaacgggcaacaucgucgcaucggugaauaugguuagcagacuguugcugaaccguuuuacaaugacccacaggcggcccacuauugagaaggacguggaucucggugccgggacccgccaugucaacgcugaaccggagacaccuaauauggacgugauaggagagcgaaucaaaagaauuaaggaagagcacaacuccacguggcacuaugacgaugaaaauccauacaaaaccugggcguaucauggcucuuacgagguaaaggccacuggcucagcaagcuccaugaucaacggggugguuaagcuucugacaaaacccugggacgucgugccuauggugacccagauggcuaugacugauacaaccccauucggacagcaaagggucuuuaaggaaaaaguugacacacggacuccccgcaguaugccggguaccagaagggugauggagauuacggccgagugguuauggcgaacccugggccggaauaagaaaccucguuugugcacaagagaagaguucacuaagaagguacgcaccaacgcagccaugggggcuguguuuacagaagagaaucagugggauucugccaaagcggcagucgaagacgaggauuucuggaagcucguggacagggagcgggaacugcacaaacuaggaaaguguggcagcugcguuuauaacaugauggguaaaagagagaagaaacuuggggaauuuggaaaggccaagggcucacgcgcuaucugguacauguggcugggcgccagguaccucgaguucgaggcacugggguuuuugaaugaagaucauugguucucccgagagaacaguuauagcggaguggaaggugagggccugcacaaacucggguacauacuucgggacaucucuaagauucccggaggcgcuauguaugccgaugacacugcugguugggacaccagaaucacggaagaugaccugcauaaugaggagaaaauuacacagcagauggauccagaacacaggcaauuagccaacgcaaucuuuaagcugaccuaccagaauaaagucgugaagguacagcgcccuacucccacagggaccguuauggacauaauuucccguaaggaucagcggggaucaggccaagugggcacuuauggguugaacaccuucacaaauauggaggcgcagcucaucagacagauggaaggagaggguguccugagcaaagccgaccuagaaaacccacaccuucccgagaagaaaaucacgcaguggcuggagaccaagggcguggaaaggcucaaacgcauggcuauuucgggggaugacugcguggucaagccuauagaugaccgauuugccaacgcacuguuggcuuuaaaugauaugggaaagguucggaaagacaucccacaauggcagccgucuaagggcuggcaugauuggcagcaggugcccuucuguagucaccauuuccacgagcugauuaugaaagacgguagaaagcucguagugccuugcaggccacaagacgaacuuaucgggcgcgccagaauuucccagggagcaggcuggagccugcgggagacugccugucuaggcaaagcguacgcucagauguggucacugauguauuuucacaggcgugaucuccgauuggccuccaacgcaaucugcucugccguccccgugcauuggguuccuacaagccgcaccacuuggaguauacacgcucaucaccaauggaugacaaccgaagacaugcugacgguguggaauagagucuggaucgaggauaacccauggauggaggacaagacacccgugaccacuugggaaaauguaccuuaccuugggaagcgggaggaucagugguguggaucccugauuggucucaccagcagggccacaugggcacagaacaucccgacugcuauucagcaaguucgcucuuuaaucggcaaugaagaguuccuggacuacaugccaucaaugaaaagauuucggaaggaggaagagagugaaggggccauuugguga

SEQ ID NO: 15158 - RNA, 9873 nt, Artificial Sequence
  derived and/or modified CDS sequence (opt3) from DENV-3__GU131858__SS-prME
accagccugugccucgugaugauccuucccgccgcucuggcauuccacuugacauccagagacggcgagccuaggaugauugucgggaagaacgaacggggaaaaucuuuacuguuuaagacugccucagguauaaauauguguacgcuaaucgcgauggaucucggcgagaugugcgacgauaccguuacauacaaauguccacauauuacugaaguggagccggaagacaucgauugcugguguaaccugaccaguacauggguaaccuaugggacuugcaaucaggcuggagagcgccgacgugacaagagaagcguggcccuugcaccccacgucggcaugggucuggauacaaggacccaaacguggauguccgccgagggggcuuggcggcagguggaaaaaguugagacuugggcauugcgccauccuggauucaccauucucgcccuguuucuggcucacuacaucggcacaucucucacucagaagguggucauauucaucuuacugaugcuugugaccccaucgaugacaaugagauguguaggcguugggaacagggacuuuguggaaggauugucaggugccaccugggucgauguggugcuggagcauggcgggugcgucacgacuauggcgaagaauaaacccacacuagacauugagcuccagaagaccgaagcaacucaacuggccacacuucggaaacuguguaucgagggaaagauuaccaacaucacgaccgauagccgcugcccuacacagggcgaagcuguuuugccagaggaacaggaccagaauuauguguguaaacacacuuacguagaucgagguugggggaacggaugcggccucuucggcaaggggagucuggugaccugcgccaaguuucaauguuuagagcccauagagggaaaagucgugcaguaugaaaaucugaaguacacaguuauuaucacugugcacaccggugaccagcaucaggucggcaacgagacacaaggggugaccgcagaaauuacuccucaggcuuccacgacagaggccauccucccagaauauggaacccuuggccuggagugcucuccgagaacugguuuggacuucaaugagaugauccuacugaccaugaaaaacaaggcguggaugguacacaggcagugguuuuucgaucucccccugccuuggacaagcggggccaccacugaaacaccaacguggaaucggaaagagcuucugguuaccuuuaagaacgcacaugcuaaaaagcaagaaguggucguguugggcucccaggagggagccaugcacacugcucucacaggcgccaccgaaauucagaauucagggggaacaaguauauucgcaggucaccugaagugucguuuaaaaauggacaagcuggagcuaaaaggcaugagcuacgccaugugcacuaacaccuuuguccucaagaaagaggugucugaaacgcagcaugggaccauccugauuaagguugaguaccgcggagaagaugcucccuguaagaucccuuucuccacagaggacggccaagguaaagcgcacaacgggagacuuauaacugcaaauccagugguaauuaagaaagaggaacccgucaacaucgaggccgaaccgccuuucggcgagucaaauaucgugauuggaaucggcgauaacgcuuugaagauuaauugguauaaaaaggggagcaguauaggaaagauguuugaagccaccgcaaggggugcccggcgaauggcuauccugggcgacacagccugggauuucgggucuguuggaggcgugcucaacucccuggguaaaaugguccaucagauuuuugggagcgcauacacugcgcuuuucucgggcgugucuuggguaaugaagaucggaaucggcauucuguugaccuggauagggcucaauuccaaaaacacgucaaugaguuuuagcugcaucgcuauuggaaucauuacacuguauuuaggcgccgugguucaggcagacaucgguugugucauaaauuggaaggggaaagagcugaagugcggauccggcaucuucgugaccaacgaggugcacacuuggacagaacaguacaaguuucaagccgauucucccaaacgccuagcuaccgccauugcaggugcuugggagaauggcgucugugggaucagaagcacuaccaggauggaaaaccuccuguggaagcagauugccaaugagcuuaacuauaucuugugggaaaauaacauaaaacugacaguuguggugggagacauuaucggcguacucgagcaggggaagcggacgcugaccccacagccuauggaguuaaaauacucauggaagacuuggggaaaagcgaagauugucacagccgaaacccaaaacaguuccuucaucauagauggccccaauacaccagagugccccagcgcuucucgcgcauggaacgugugggaaguugaggacuaugguuuugggguguucacuaccaauaucuggcugaagcuuagagaagucuacacgcaguugugugaccauaggcucaugucagccgcugugaaagaugagcgugccguucacgcagacaugggauacuggauugagagucagaagaacggcagcuggaaacuggaaaaggcgucccuaaucgaggugaaaacaugcaccuggccuaagucucacacucuguggucgaaugguguacucgaaagcgauaugauuaucccaaagucccuggccggcccgauaucacagcauaaccaccggcccggguaucauacccaaacagcuggaccuuggcaccuuggcaaauuggagcuggacuuuaauuacugcgaggggacuaccgucgugauuacagaaaacuguggaacgaguggcccaucuuuaaccacuacaaccgugagcgguaagcucauccacgaguggugcugucgauccugcacucugcccccucuuagauauaugggggaagauggauguugguacggcauggagaucaggccaauuucagaaaaagaggagaauauggucaagagccugguuucugccgguuccggcaaaguggacaacuucacaauggggguauugugccucgcaauccuguuugaagaggugaugcgcggaaaguucggcaagaaacauaugauugcuggggucuucuuuaccuucgugcuacugcucaguggacagauaacguggcgggauaugacucacacccugaucaugauuggcagcaaugccucugacagaauggguauggggguuacauaucuugcauugaucgccaccuuuaagauucagcccuuccuggcuuuaggauuuuuccucaggaaacugacuucccgcgaaaaccuucugcuaggcgugggccucgcgauggccacaacccugcaauugccggaggauaucgaacagauggcaaaugggauagcucugggauuaauggcccucaagcugaucacacaguuugagacuuaccagcuuuggaccgcccugauuucauugacguguaguaacacaauguucacccucacugucgcuuggcgaaccgcaacacugauccuagccggugugagccugcuuccuguuugccaaucguccucuaugcggaaaacugacuggcucccaauggcgguggcugccaugggcguccccccucugcccuuguuuauuuucagccugaaggauaccuuaaagcguagaucauggccacucaaugaggggguaauggcagugggacugguuaguauccuugccuccucucuguugaggaacgacgugccuauggcuggcccccucgucgcaggugggcugcuaauagccuguuaugugauuacgggaacaagcgcggaucugaccguagaaaaagcugccgacaucacuugggaggaagaggcagaacagacaggcgugucccauaaccuuaugaucaccgucgacgaugacggcacuaugcgcauuaaggaugacgagacagagaauauacucaccguucuguugaaaacggccuuacugaucgugucagggguguuuccauacagcauuccggcuacucuccuggucuggcacaccuggcagaagcagacacaacggaguggagugcuuugggauguuccuucucccccagaaacccagaaagccgagcuggaagaggguguauacagaaucaagcagcagggcauuuucgggaaaacacaagugggagucggcgugcagaaggaggguguuuuucauacuauguggcacgugaccaggggggcagucuugacguauaacggaaagcgacuagaacccaauugggcuuccgugaaaaaggaccugaucagcuacggcggcggguggcgccucucggcccaguggcaaaaaggagaggaaguacaggucauagcgguggagccugguaagaacccaaaaaauuuccagacaaugcccggcacuuuccagaccacaaccggggaaaucggagccauugcacuggauuuuaagccuggcacuucagguucuccgaucauuaaccgggaggggaagguugugggacuuuauggcaauggcgucgugaccaaaaacgggggauacguuagugguaucgcucaaacaaaugccgagccagacggccccacgccugaauuagaggaagagauguucaagaaaagaaaccugacuauaauggaucuccacccaggguccggaaagaccaggaaauauuugcccgcuauuauccgugaagcaaucaagcgccggcugagaacacucauucuggccccuaccaggguggucgccgcugagauggaggaagcgcuuaagggccugccgauccgauaccagacuacagcaaccaaaagcgagcauacgggucgggaaauaguggacuugaugugccacgccacuuuuacaaugcgccuacugucucccguaagagugccaaauuauaaccucauuaucauggaugaggcucauuucaccgacccugccagcauugcagccaggggguacaucuccacccggguuggaaugggcgaagcugcggccauauuuaugacugcaacacccccaggcaccgcugaugccuucccucagucaaaugcacccauucaggacgaggagcgagacaucccagaaagaaguuggaacagcgggaaugaguggaucacagauuuugucggaaagacugugugguucgugccgucuauuaaagccgguaacgacaucgcuaacuguuuacgcaagaauggcaaaaaggucauucaacuguccaggaagacguuugauaccgaauaccagaaaacaaagcuuaacgacugggauuucguagugacuaccgacauaucagagaugggggccaauuuuaaagcggaucguguuaucgacccucggagaugccugaagcccgugauucucacagauggaccagagagggucaucuuggcaggccccaugccugugaccgccgcuagugccgcucagcgccgagguagaguugggcggaacccacagaaagaaaaugaccaauauaucuucacuggccagccccugaacaaugaugaggaccacgcacauuggacggaagccaagaugcuccuggacaacauuaauaccccugagggaauaaucccggcucuuuucgaaccagagagggagaagagcgccgcaauugauggcgaauaccgccuaaaaggggagucccguaagacauuuguggaacugaugagacggggagacuugcccgucugguuagcgcacaaaguggccucugaggguaucaaguauacugauaggaaauggugcuucgacggccagcgcaacaaucagauucuggaagagaacauggauguagagaucuggaccaaggaaggggagaaaaagaagcuccgaccuagauggcuggacgcucggacauacucggauccccuugcccugaaagaauuuaaggacuucgcagcuggaaggaaaagcauagcccucgauuuggugaccgagaucggccgcguuccaucacaccuggcacauagaacuaggaaugcccuagacaaccuggucaugcuccacacauccgaacauggugggcgggcuuaucgucacgcgguggaggagcuuccugaaacgauggagacccuguuauugcugggccucaugauucugcuuacuggaggcgccaugcuguuucucaucagugggaagggaauugguaaaacaucuaucggcuugauaugugugauugcaagcuccgggaugcuguggauggcugaaauccccuuacaauggauugccucagccaucguccuagaguucuuuaugaugguucugcucauaccagagccugaaaagcagcgcaccccgcaggauaaucaacuugcauacgugguaaucggaauucugaccuuggcugccaucauugcggcuaacgagaugggccugcucgaaacaacuaagcgagaccuggguaugucuaaagagcccgggguggucagcccaaauaguuaucuugauguggaccuccacccugccuccgcauggacgcuguacgccguugcuaccacagugaucacucccauguugagacauaccauagaaaacagcacagcaaacgucucucuggccgcgauugcuaaucaggccguaguguuaaugggccuagacaagggauggccaaucucaaaaauggaucugggcguuccucuccuugcacuggggugcuacucccaggugaaccccuugacccugacugccgcuguccuccugcuuaucacgcacuaugccauuaucggaccgggcuuacaggcaaaggcuacaagggaggcccaaaaacggaccgcggccgguauaaugaagaauccaacuguggacgggauuaugaccaucgaucuggacccugucauuuacgauaguaaguucgagaaacagcucggacaggugauguugcugguucuaugugcagugcagcugcuccuuaugcgcacaagcugggcucugugcgaagccuugacucuggcaaccggccccaucacaacgcucugggaggguucgccaggcaaguuuuggaacaccacuauagcuguaucuauggccaauaucuucagaggguccuaucuggccggagcgggcuuagcuuuuagcauuaugaaaucaguggggacaggaaagaggggcaccgguagucaaggggaaacucuuggagagaaauggaagaagaaacugaaccagcucucucggaaggaauucgaccuauacaaaaaguccggcaucacagaggucgaucgaaccgaggcaaaagaaggucugaagagaggcgagauuacgcaucacgccguuagccgcgggucagcuaaauugcagugguuuguggaaaggaauauggucauccccgagggacgggugauugaccugggcugugggcguggaggcuggaguuauuacugcgccggucucaagaagguaaccgaagugagaggguauacaaaaggaggcccuggccaugaggagccgguucccaugagcacuuacggguggaacaucgugaagcuuauguccggaaaagaugucuucuaccugccaccugaaaagugugacaccuugcugugcgauauaggugagucuagccccuccccuacaguggaagagucaaggacuauucgcguccucaaaaugguggagccaugguuaaagaauaaccaguucuguaucaagguucugaaucccuauaugccuaccguaaucgaacaccuugagcggcugcaacgaaaacacggcgggaugcuagugagaaacccacucucuaggaauaguacacaugaaauguacuggauuucgaacggaaccggcaauauagucgcaagcgugaacaugguuucccgccuguugcugaaccgguuuacuaugacgcacagacgucccacaaucgagaaggacguggaucucggugccgggaccaggcaugucaaugcugaaccggagacuccuaacauggacgugauuggagagcggaucaaacgcauuaaggaagagcacaauucuaccuggcacuaugacgaugaaaacccauacaaaacaugggcguaucauggcucauacgagguaaaggccacgggcagcgcauccaguaugaucaauggggugguuaagcuucugaccaaacccugggacgucgugccuauggugacucagauggcuaugacagauaccacuccauucggacagcaacgagucuuuaaggaaaaaguugacacaagaacccccaggucuaugccggguacacggcgcgugaugggcauaacugccgagugguuauggagaacccuggggaggaacaagaaaccucgauugugcacgcgggaggaauucaccaagaagguacguacaaaugcagccaugggagcuguguuuacugaggaaaaccagugggauagcgccaaagcggcagucgaggacgaagauuucuggaagcucguggacagagagcgcgagcugcacaaacuaggcaagugugguucaugcguuuauaauaugauggggaaaagggaaaagaaacuuggagaguuuggcaaggccaagggcucccgggcuaucugguacauguggcugggggccagauaccucgaauucgaggcacugggauuuuugaacgaggaucauugguucagucgcgaaaauagcuauucugguguggagggcgaagggcugcacaaacucggauacauucuuagggacaucuccaagauucccggcggugcuauguaugccgaugacaccgcugggugggacacacgaaucacugaggaugaccugcauaacgaagagaaaauaacccagcagauggauccagagcaccggcaauuagccaaugcaauuuuuaagcugacguaccagaacaaagucgugaagguacagagaccuacacccaccggaacuguuauggacaucaucucaaggaaggaucagcgcggcagcggccaaguggggacauauggauugaauaccuucacuaacauggaagcgcagcucauucgucagauggagggugaaggcguccugucgaaagccgaccuagagaacccacaccuucccgaaaagaaaauaacccaguggcuggagacaaaggggguggagcggcucaaaagaauggcuaucucuggagaugacugcguggucaagccuauugaugacagguuugccaaugcacuguuggcuuuaaacgauaugggcaagguucgcaaagacaucccacaauggcagccgaguaaggguuggcaugauuggcagcaggugcccuucuguucccaccauuuccacgaacugauuaugaaagacgggcgaaagcucguagugccuugccggccacaagacgagcuuaucggaagagccaggauaagccagggcgcaggcuggucacugcgcgaaacggccugucuagggaaagcguacgcucagauguggucccugauguauuuucacagacgggaucucagguuggccucuaaugcaaucugcagcgccguccccgugcauuggguuccuaccagucguacuacaugguccauucacgcucaucaccaauggaugaccacugaggacaugcugacaguguggaaccgagucuggaucgaagauaauccauggauggaggacaagacccccgugacgacaugggagaacguaccuuaccuuggaaagcgcgaagaucaguggugugguagccugauuggccucaccucuagagccacuugggcacagaauaucccgaccgcuauucagcaaguucggucauuaauagggaacgaggaauuccuggacuacaugccaaguaugaaaagguuucgcaaggaggaggaauccgagggagccaucugguga

SEQ ID NO: 15159 - RNA, 9873 nt, Artificial Sequence
  derived and/or modified CDS sequence (opt3) from DENV-3__GQ868548__SS-prME
accagccugugccucgugaugauccuucccgccgcucuggcauuccacuugacauccagagacggcgagccuaggaugauugucgggaagaacgaacggggaaaaucuuuacuguuuaagacugccucagguauaaauauguguacgcuaaucgcgauggaucucggcgagaugugcgacgauaccguuacauacaaauguccacauauuacugaaguggagccggaagacaucgauugcugguguaaccugaccaguacauggguaaccuaugggacuugcaaucaggcuggagagcgccgacgugacaagagaagcguggcccuugcaccccacgucggcaugggucuggauacaaggacccaaacguggauguccgccgagggggcuuggcggcagguggaaaaaguugagacuugggcauugcgccauccuggauucaccauucucgcccuguuucuggcucacuacaucggcacaucucucacucagaagguggucauauucaucuuacugaugcuugugaccccaucgaugacaaugagauguguaggcguugggaacagggacuuuguggaaggauugucaggugccaccugggucgauguggugcuggagcauggcgggugcgucacgacuauggcgaagaauaaacccacacuagacauugagcuccagaagaccgaagcaacucaacuggccacacuucggaaacuguguaucgagggaaagauuaccaacaucacgaccgauagccgcugcccuacacagggcgaagcuguuuugccagaggaacaggaccagaauuauguguguaaacacacuuacguagaucgagguugggggaacggaugcggccucuucggcaaggggagucuggugaccugcgccaaguuucaauguuuagagcccauagagggaaaagucgugcagcacgaaaaucugaaguauacaguuauuaucacugugcauaccggugaccagcaccaggucggcaacgagacacaaggggugaccgcagaaauuacuccucaggcuuccacgacagaggccauccucccagaauacggaacccuuggccuggagugcucuccgagaacugguuuggacuucaaugagaugauccuacugaccaugaaaaacaaggcguggaugguacauaggcagugguuuuucgaucucccccugccuuggacaagcggggccaccacugaaacaccaacguggaaucggaaagagcuucugguuaccuuuaagaacgcacacgcuaaaaagcaagaaguggucguguugggcucccaggagggagccaugcacacugcucucacaggcgccaccgaaauucagaauucagggggaacaaguauauucgcaggucaucugaagugucguuuaaaaauggacaagcuggagcuaaaaggcaugagcuaugccaugugcacuaacaccuuuguccucaagaaagaggugucugaaacgcagcacgggaccauccugauuaagguugaguaccgcggagaagaugcucccuguaagaucccuuucuccacagaggacggccaagguaaagcgcauaacgggagacuuauaacugcaaauccagugguaaccaagaaagaggaacccgucaacauugaggccgaaccgccuuucggcgagucaaauaucgugaucggaauuggcgauaacgcuuugaagaucaauugguacaaaaaggggagcaguauuggaaagauguuugaagccacagcaaggggugcccggcgaauggcuauacugggcgacacugccugggauuucgggucuguuggaggcgugcucaacucccuggguaaaaugguccaccagaucuuugggagcgcauauaccgcgcuuuucucgggcgugucuuggguaaugaagauuggaaucggcauccuguugacguggauugggcucaauuccaaaaacacaucaaugaguuuuagcugcauagcuaucggaauuaucacccuguacuuaggcgccgugguucaggcagacauggguugugucauuaauuggaaggggaaagagcugaagugcggauccggcaucuucgugacuaacgaggugcauacauggaccgaacaguauaaguuucaagccgauucucccaaacgccuagcuacugccauagcaggugcuugggagaauggcgucugugggaucagaagcaccacaaggauggaaaaccuccuguggaagcagauugccaaugagcuuaacuacaucuugugggaaaauaacauuaaacugacgguuguggugggagacaucauaggcguacucgagcaggggaagcggacccugacuccacagccuauggaguuaaaauauucauggaagacauggggaaaagcgaagauugucaccgccgaaacacaaaacaguuccuucaucauugauggccccaauacuccagagugccccagcgcuucucgcgcauggaacgugugggaaguugaggacuacgguuuugggguguucaccacgaauaucuggcugaagcuuagagaagucuauacacaguugugugaccacaggcucaugucagccgcugugaaagaugagcgugccguucacgcagacaugggauacuggauagagagucagaagaacggcagcuggaaacuggaaaaggcgucccuaaucgaggugaaaaccugcacuuggccuaagucucauacccuguggucgaaugguguacucgaaagcgauaugauuaucccaaagucccuggccggcccgauuucacagcacaaccaucggcccggguaccacacacaaacugcuggaccuuggcaccuuggcaaauuggagcuggacuuuaauuauugcgaggggaccacagucgugaucacggaaaacuguggaacccgaggcccaaguuuaagaacuacaaccgugucugguaagcucauacaugaguggugcuguaggagcugcacucugcccccucuucgcuacaugggggaagauggauguugguauggcauggagauucggccaaucuccgaaaaagaggagaauauggucaagucacugguuagcgccgguucuggcaaaguggacaacuucacaauggggguauugugccucgcaauccuguuugaagaggugaugagaggaaaguucggcaagaaacacaugauugcuggggucuucuuuaccuucgugcuacugcucuccggacagaucacguggagggauaugacucauacccugauuaugauaggcaguaaugccagcgaccgcauggguauggggguuacauaccuugcauugaucgccaccuuuaagauucagcccuuccuggcuuuaggauuuuuccuccgaaaacugacuucucgggaaaaccuucugcuaggcgugggccucgcgauggccacaacccugcaauugccggaggauaucgaacagauggcaaaugggauugcucugggauuaauggcccucaagcugaucacacaguuugagacuuaucagcuuuggaccgcccugauauccuugacguguucaaacacaauguucacccucacugucgcuuggcguaccgcaacacugauccuagccggugugagucugcuuccuguuugccaaagcucguccaugagaaaaacugacuggcucccaauggcgguggcugccaugggcguccccccucugcccuuguuuauuuucucucugaaggauaccuuaaagaggcgcagcuggccacucaaugaggggguaauggcagugggacugguuucaauccuugccaguucccuguugcggaacgacgugccuauggcuggcccccucgucgcaggugggcugcuaauugccuguuacgugaucacgggaacaucugcggaucugaccguagaaaaagcugccgacauaacuugggaggaagaggcagaacagacaggcgugagccacaaccuuaugauuaccgucgacgaugacggcacuaugagaaucaaggaugacgagacagagaauauccucaccguucuguugaaaacggccuuacugauuguguccgggguguuuccauauucaauaccggcuacucuccuggucuggcauaccuggcagaagcagacacaaaggagcggagugcuuugggauguuccuagucccccagaaacccagaaagccgagcuggaagaggguguauaccgaaucaagcagcagggcauuuucgggaaaacacaagugggagucggcgugcagaaggaggguguuuuucacacuauguggcacgugacccgcggggcagucuugacguacaacggaaagcggcuagaacccaauugggcuucugugaaaaaggaccugaucuccuauggcggcggguggagacucagcgcccaguggcaaaaaggagaggaaguacaggucauugcgguggagccugguaagaacccaaaaaauuuccagacaacucccggcaccuuccagacaaccacuggggaaaucggagccauagcacuggauuuuaagccuggcaccucggguucaccgaucauuaacagggaggggaagguugugggacuuuacggcaauggcgucgugacaaaaaacgggggauauguuucugguaucgcucaaacgaaugccgagccagacggccccacuccugaauuagaggaagagauguucaagaaacguaaccugaccauuauggaucuccauccagggaguggaaagacacgcaaauacuugcccgcuaucauacgggaagcaauuaagagaaggcugcgaacccucauccuggccccuacucggguggucgccgcugagauggaggaagcgcuuaagggccugccgauccgcuaucagacaaccgcaacgaaauccgagcacacugguagagaaauuguggacuugaugugccaugccacauuuaccaugaggcuacugagccccguacgggugccaaauuacaaccucaucauaauggaugaggcucacuucaccgacccugccucuauugcagcccgaggguauaucagcacuagaguuggaaugggcgaagcugcggccauuuuuaugacagcaacccccccaggcacagcugaugccuucccucaguccaaugcacccauccaggacgaggagcgcgacauaccagaaaggucauggaacagugggaaugaguggauuacugauuuugucggaaagacggugugguucgugccgagcaucaaagccgguaacgacaucgcuaacuguuuacguaagaauggcaaaaaggucauucaacugucucggaagaccuuugauacagaauaccagaaaacuaagcuuaacgacugggauuucguagugaccacagacaucuccgagaugggggccaauuuuaaagcggauagaguuauugacccuaggcgcugccugaagcccgugauacucaccgauggaccagagcgagucaucuuggcaggccccaugccugugacugccgcuucagccgcucagagacgggguaggguugggcgcaacccacagaaagaaaaugaccaauacauuuucacgggccagccccugaacaaugaugaggaccaugcacacuggaccgaagccaagaugcuccuggacaacaucaauacaccugagggaaucauuccggcucuuuucgaaccagagcgugagaagagugccgcaauagauggcgaauauagacuaaaaggggagagccggaagacuuuuguggaacugaugaggcgcggagacuugcccgucugguuagcgcacaaaguggccuccgaggguaucaaguacaccgaucgaaaauggugcuucgacggccagagaaacaaucagauucuggaagagaacauggauguagagaucuggacaaaggaaggggagaaaaagaagcuccggccuagguggcuggacgcucgcaccuauucugauccccuugcccugaaagaauuuaaggacuucgcagcuggaagaaaaucgauugcccucgauuuggugacugagaucggcaggguuccaagccaucuggcacaccggacacguaaugcccuagacaaccuggucaugcuccauacgucagaacacggugggcgcgcuuaccgacacgcgguggaggagcuuccugaaaccauggagacucuguuauugcugggccucaugauacugcuuacaggaggcgccaugcuguuucucaucuccgggaagggaauugguaaaaccaguaucggcuugauuugugugaucgcaucuagcgggaugcuguggauggcugaaauacccuuacaauggauugccuccgccaucguccuagaguucuuuaugaugguucugcucauuccagagccugaaaagcagagaaccccgcaggauaaucaacuugcauaugugguaaucggaauacugacauuggcugccaucauugcggcuaacgagaugggccugcucgaaacuacgaagagggaccuggguaugucaaaagagcccgggguggucucuccaaccagcuaccuugauguggaccuccauccugccagugcauggacacuguaugccguugcuacuaccgugaucacacccauguugcggcacaccauugaaaauuccacugcaaacgucagccuggccgcgaucgcuaaccaggccguaguguuaaugggccuagacaagggauggccaauaucuaaaauggaucugggcguuccucuccuugcacuggggugcuacucacaggugaaucccuugacgcugacagccgcuguccuccugcuuauuacccauuacgccaucaucggaccgggcuuacaggcaaaggcuacucgcgaggcccaaaaaagaaccgcggccgguauuaugaagaacccaacaguggacgggaucaugacuauagaucuggacccugucauuuaugauuccaaguucgagaaacagcucggacaggugauguugcugguucuaugugcagugcagcugcuccuuaugaggaccaguugggcucugugcgaagccuugacacuggcaacgggccccaucaccacucucugggaggguagcccaggcaaguuuuggaauacaaccauugcuguaucgauggccaacaucuuccgggggucuuaccuggccggagcgggcuuagcuuuuuccauaaugaaaagcguggggacuggaaagcgaggcacagguucacaaggggaaacccuuggagagaaauggaagaagaaacugaaucagcucaguagaaaggaauucgaccuauauaaaaagucuggcaucacggaggucgaucgcaccgaggcaaaagaaggucugaagaggggcgagauuacacaccaugccguuucccgggggagcgcuaaauugcagugguuuguggaacguaacauggucauccccgagggaagagugauugaccugggcugugggaggggaggcuggucauacuauugcgccggucucaagaagguaacugaagugcgcggguacaccaaaggaggcccuggccacgaggagccgguucccaugaguacauauggguggaauaucgugaagcuuaugagcggaaaagaugucuucuaccugccaccugaaaagugugacacuuugcugugcgauauuggugaguccucucccagcccuaccguggaagagucccggacaauccgaguccucaaaaugguggagccaugguuaaagaacaaucaguucuguauaaagguucugaaccccuacaugccuaccguaauugaacaccuugagagacugcaaaggaaacauggcgggaugcuagugcgcaauccacucucacggaacucuacucacgaaauguauuggaucaguaauggaacgggcaacaucgucgcaucggugaauaugguuagcagacuguugcugaaccguuuuacaaugacccauaggcggcccacuauugagaaggacguggaucucggugccgggacccgccacgucaacgcugaaccggagacaccuaauauggacgugauaggagagcgaaucaaaagaauuaaggaagagcacaacuccacguggcauuacgacgaugaaaauccauauaaaaccugggcguaccacggcucuuaugagguaaaggccacuggcucagcaagcuccaugaucaacggggugguuaagcuucugacaaaacccugggacgucgugccuauggugacccagauggcuaugacugauacaaccccauucggacagcaaagggucuuuaaggaaaaaguugacacacggacuccccgcaguaugccggguaccagaagggugauggagauuacggccgagugguuauggcgaacccugggccggaauaagaaaccucguuugugcacaagagaagaguucacuaagaagguacgcaccaacgcagccaugggggcuguguuuacagaagagaaucagugggauucugccaaagcggcagucgaagacgaggauuucuggaagcucguggacagggagcgggaacugcauaaacuaggaaaguguggcagcugcguuuacaacaugauggguaaaagagagaagaaacuuggggaauuuggaaaggccaagggcucacgcgcuaucugguauauguggcugggcgccagguaccucgaguucgaggcacugggguuuuugaaugaagaucacugguucucccgagagaacaguuacagcggaguggaaggugagggccugcauaaacucggguauauacuucgggacaucucuaagauucccggaggcgcuauguacgccgaugacacugcugguugggacaccagaaucacggaagaugaccugcacaaugaggagaaaauuacacagcagauggauccagaacacaggcaauuagccaacgcaaucuuuaagcugaccuaucagaauaaagucgugaagguacagcgcccuacucccacagggaccguuauggacauaauuucccguaaggaucagcggggaucaggccaagugggcacuuacggguugaacaccuucacaaauauggaggcgcagcucaucagacagauggaaggagaggguguccugagcaaagccgaccuagaaaacccacaucuucccgagaagaaaaucacgcaguggcuggagaccaagggcguggaaaggcucaaacgcauggcuauuucgggggaugacugcguggucaagccuauagaugaccgauuugccaacgcacuguuggcuuuaaaugauaugggaaagguucggaaagacaucccacaauggcagccgucuaagggcuggcacgauuggcagcaggugcccuucuguagucaucacuuccacgagcugauuaugaaagacgguagaaagcucguagugccuugcaggccacaagacgaacuuaucgggcgcgccagaauuucccagggagcaggcuggagccugcgggagacugccugucuaggcaaagcguaugcucagauguggucacugauguacuuucauaggcgugaucuccgauuggccuccaacgcaaucugcucugccguccccgugcacuggguuccuacaagccgcaccacuuggaguauacaugcucaccaucaauggaugacaaccgaagacaugcugacgguguggaauagagucuggaucgaggauaacccauggauggaggacaagacacccgugaccacuugggaaaauguaccuuaucuugggaagcgggaggaucagugguguggaucccugauuggucucaccagcagggccacaugggcacagaacaucccgacugcuauucagcaaguucgcucuuuaaucggcaaugaagaguuccuggacuacaugccaucaaugaaaagauuucggaaggaggaagagagugaaggggccauuugguga

SEQ ID NO: 15160 - RNA, 9873 nt, Artificial Sequence
  derived and/or modified CDS sequence (opt3) from DENV-3__GU131861__SS-prME
accagccugugccucgugaugauccuucccgcagcucuggcauuccacuugaccuccagagacggcgagccuaggaugauugucgggaagaacgaacggggaaaaucuuuacuguuuaagacugcaucagguauaaauauguguacguuaaucgcgauggaucucggcgagaugugcgacgauaccguuacauacaaauguccacauauuacugaaguggagccggaagacaucgauugcugguguaaccugaccaguacauggguaaccuaugggacuugcaaucaggcuggagagcgccgacgugacaagagaagcguggcccuugcaccccacgucggcaugggucuggauacaaggacccagacguggauguccgccgagggggcuuggcggcaaguggaaaaaguugagacuugggcauugcgccauccuggauucaccauucucgcccuguuucuggcucacuacaucggcacaucucucacucagaagguggucauauucaucuuacugaugcuugugaccccaucgaugacaaugagauguguaggcguugggaacagggacuuuguggaaggauugucaggugccaccugggucgauguggugcuggagcauggcgggugcgucacgacuauggcgaagaauaaacccacacuagacauugagcuccagaagaccgaagcaacucaacuggccacacuucggaaacuguguaucgagggaaagauuaccaacaucacgaccgauagccgcugcccuacacagggcgaagcuguuuugccagaggaacaggaccagaauuauguguguaaacacacuuacguagaucgagguugggggaacggaugcggccucuucggcaaggggagucuggugaccugcgccaaguuucaauguuuagagcccauagagggaaaagucgugcaguaugaaaaucugaaguacacaguuauuaucacugugcacaccggugaccagcaucaggucggcaacgagacacaaggggugaccgcagaaauuacuccucaggcuuccacgacagaggccauccucccagaauauggaacccuuggccuggagugcucuccgagaacugguuuggacuucaaugagaugauccuacugaccaugaaaaacaaggcguggaugguacacaggcagugguuuuucgaucucccccugccuuggacaagcggggccaccacugaaacaccaacguggaaucggaaagagcuucugguuaccuuuaagaacgcacaugcuaaaaagcaagaaguggucguguugggcucccaggagggagccaugcacacugcucucacaggcgccaccgaaauucaaaauucagggggaacaaguauauucgcaggucaccugaagugucguuuaaaaauggacaagcuggagcuaaaaggcaugagcuacgccaugugcacuaacaccuuuguccucaagaaagaggugucugaaacgcagcaugggaccauccugauuaagguugaguaccgcggagaagaugcucccuguaagaucccuuucuccacagaggacggccaagguaaagcgcacaacgggagacuuauaacugcaaauccagugguaaccaagaaagaggaacccgucaacauugaggccgaaccgccuuucggcgagucaaauaucgugaucggaauuggcgauaacgcuuugaagaucaauugguauaaaaaggggagcaguauuggaaagauguuugaagccacagcaaggggugcccggcgaauggcuauacugggcgacacugccugggauuucgggucuguuggaggcgugcucaacucccuggguaaaaugguccaucagaucuuugggagcgcauacaccgcgcuuuucucgggcgugucuuggguaaugaagauuggaaucggcauccuguugacguggauugggcucaauuccaaaaacacaucaaugaguuuuagcugcauagcuaucggaauuaucacccuguauuuaggcgccgugguucaggcagacauggguugugucauuaauuggaaggggaaagagcugaagugcggauccggcaucuucgugacuaacgaggugcacacauggaccgaacaguacaaguuucaagccgauucucccaaacgccuagcuacugccauagccggugcuugggagaauggcgucugugggaucagaagcaccacaaggauggaaaaccuccuguggaagcagauugccaaugagcuuaacuauaucuugugggaaaauaacauuaaacugacgguuguggugggagacaucauaggcguacucgagcaggggaagcggacccugacuccacagccuauggaguuaaaauacucauggaagacauggggaaaagcgaagauugucaccgccgaaacacaaaacaguuccuucaucauugauggccccaauacuccagagugccccagcgcuucucgcgcauggaacgugugggaaguugaggacuaugguuuugggguguucaccacgaauaucuggcugaaacuuagagaagucuacacacaguugugugaccauaggcucaugucagccgcugugaaagaugagcgugccguucacgcagacaugggauacuggauagagagucagaagaacggcagcuggaaacuggaaaaggcgucccuaaucgaggugaaaaccugcacuuggccuaagucucacacccuguggucgaaugguguacucgaaagcgauaugauuaucccaaagucccuggccggcccgauuucacagcauaaccaccggcccggguaucauacacaaacugcuggaccuuggcaccuuggcaaauuggagcuggacuuuaauuacugcgaggggaccacagucgugaucacggaaaacuguggaacccgaggcccaaguuuaagaacuacaaccgugucugguaagcucauacacgaguggugcuguaggagcugcacucugcccccucuucgcuauaugggggaagauggauguugguacggcauggagauucggccaaucuccgaaaaagaggagaauauggucaagucacugguuagcgccgguucuggcaaaguggacaacuucacaauggggguauugugccucgcaauccuguuugaagaggugaugagaggaaaguucggcaagaaacauaugauugcuggggucuucuuuaccuucgugcuacugcucuccggacagaucacguggagggauaugacucacacccugauuaugauaggcaguaaugccagcgaccgcauggguauggggguuacauaucuugcauugaucgccaccuuuaagauucagcccuuccuggcuuuaggauuuuuccuccgaaaacugacuucucgggaaaaccuucugcuaggcgugggccucgcgauggccacaacccugcaauugccggaggauaucgaacagauggcaaaugggauugcucugggauuaauggcccucaagcugaucacacaguuugagacuuaccagcuuuggaccgcccugauauccuugacguguucaaacacaauguucacccucacugucgcuuggcguaccgcaacacugauccuagccggugugagucugcuuccuguuugccaaagcucguccaugagaaaaacugacuggcucccaauggcgguggcugccaugggcgucccaccucugcccuuguuuauuuucucucugaaggauaccuuaaagaggcgcagcuggccacucaaugaggggguaauggcagugggacugguuucaauccuugccaguucccuguugcggaacgacgugccuauggcuggcccccucgucgccggugggcugcuaauugccuguuaugugaucacgggaacaucugcggaucugaccguagaaaaagcugccgacauaacuugggaggaagaggcagaacagacaggcgugagccauaaccuuaugauuaccgucgacgaugacggcacuaugagaaucaaggaugacgagacagagaauauccucaccguucuguugaaaacggccuuacugauuguguccgggguguuuccauacucaauaccggcuacucuccuggucuggcacaccuggcagaagcagacacaaaggagcggagugcuuugggauguuccuagucccccagaaacccagaaagccgagcuggaagaggguguauaccgaaucaagcagcagggcauuuucgggaaaacacaagugggagucggcgugcagaaggaggguguuuuucauacuauguggcacgugacccgcggggcagucuugacguauaacggaaagcggcuagaacccaauugggcuucugugaaaaaggaccugaucuccuacggcggcggguggagacucagcgcccaguggcaaaaaggagaggaaguacaggucauugcgguggagccugguaagaaccccaagaauuuccagacaacucccggcaccuuccagacaaccacuggggaaaucggagccauagcacuggauuuuaagccuggcaccucggguucaccgaucauuaacagggaggggaagguugugggacuuuauggcaauggcgucgugaccaagaacgggggauacguuucugguaucgcucaaacgaaugccgagccagacggccccacuccugaauuagaggaagagauguucaagaaacguaaccugaccauuauggaucuccacccagggaguggaaagacacgcaaauauuugcccgcuaucauacgggaagcaauuaagagaaggcugcgaacccucauccuggccccuacucggguggucgccgcugagauggaggaagcgcuuaagggccugccgauccgcuaccagacaaccgugacgaaauccgagcauacugguagagaaauuguagacuugaugugccacgcaacauuuaccaugaggcuacugagccccgugcggguuccaaauuauaaccucaucauaauggaugaggcccauuucaccgacccugcuucuauugccgcacgaggguacaucagcacuagagucggaaugggcgaagccgcugcgauuuuuaugacagccacacccccaggcacagcagaugcuuucccucaguccaaugcccccauccaggacgaggagcgcgacauaccagaaaggucauggaacagugggaaugaguggauuacugauuuugcaggaaagacggugugguucgugccgagcaucaaagccgguaacgacaucgcuaacuguuuacguaagaauggcaaaaaggucauucaacugucucggaagaccuuugauacagaauaccagaaaacuaaacuuaacgacugggauuucguagugaccacagacaucuccgagaugggggccaauuuuaaagcggauagaguuauugacccuaggcgcugccugaagcccgugauacucaccgauggaccagagcgagucaucuuggcaggccccaugccugugacugccgcuucagccgcucagagacgggguaggguugggcgcaacccacagaaagaaaaugaccaauauauuuucacgggccagccccugaacaaugaugaggaccacgcacauuggaccgaagccaagaugcuccuggacaacaucaauacaccugagggaaucauuccggcucuuuucgaaccagagcgugagaagagugccgcaauagauggcgaauacagacuaaaaggggagagccggaagacuuuuguggaacugaugaggcgcggagacuugcccgucugguuagcgcacaaaguggccuccgaggguaucaaguauaccgaucgaaaauggugcuucgacggccagagaaacaaucagauucuggaagagaacauggauguagagaucuggacaaaggaaggggagaaaaagaagcuccggccuagguggcuggacgcucgcaccuacucugauccccuugcccugaaagaauuuaaggacuucgcagcuggaagaaaaucgauugcccucgauuuggugacugagaucggcaggguuccaagccaccuggcacaucggacacguaaugcccuagacaaccuggucaugcuccacacgucagaacauggugggcgcgcuuaucgacacgcgguggaggagcuuccugaaaccauggagacucuguuauugcugggccucaugauacugcuuacaggaggcgccaugcuguuucucaucuccgggaagggaauugguaaaaccaguaucggcuugauuugugugaucgcaucuagcgggaugcuguggauggcugaaauacccuuacaauggauugccuccgccgucguucuagaguucuuuaugauggugcugcucaucccagagccugaaaagcagagaaccccgcaggauaaucaacuugcauacguagugauuggaauccugacauuggcugccauaaucgcggcuaacgagaugggccugcucgaaacuacgaagagggaccuggguaugucaaaagagcccggggucgugucuccaaccagcuaucuugauguugaccuccacccugccagugcauggacacuguacgccguggcuacuaccgucauuacacccauguugcggcauaccaucgaaaauuccacugcaaacguaagccuggccgcgauugcuaaccaggccgugguuuuaaugggccuagacaagggauggccaaucucuaaaauggaucugggcgugccucuccuugcacuggggugcuacucacaggucaaucccuugacgcugacagccgcugugcuccugcuuauaacccacuaugccauuaucggaccgggcuuacaggcaaaggcuacucgcgaggcccagaagagaaccgcggccgguaucaugaagaacccaacagucgacgggauuaugacuaucgaucuggacccugugauauacgauuccaaguucgagaaacagcucggacagguuauguugcuggugcuaugugcaguacagcugcuccuuaugaggaccaguugggcucugugcgaagccuugacacuggcaacgggccccauuaccacucucugggaggguagcccaggcaaguuuuggaauacaaccaucgcugugucgauggccaacauuuuccgggggucuuaucuggccggagcgggcuuagcuuuuuccaucaugaaaagcgucgggacuggaaagcgaggcacagguucacaaggggaaacccuuggagagaaauggaagagaaagcugaaucagcucagucgcaaagaguucgaccuauacaagaaaucuggcauaacggagguugauaggaccgaggcaaaggaaggucugaaacggggcgagaucacacaucacgccgugucccgugggagcgcuaaguugcagugguuugucgaaagaaacauggugauucccgagggaaggguaaucgaccugggcugugggcgcggaggcuggucauauuacugcgccggucucaaaaaggugacugaaguucggggguauaccaagggaggcccuggccaugaggagccggugcccaugaguacauacggguggaauauugucaaacuuaugagcggaaaggauguguucuaccugccaccugaaaaaugugacacuuugcugugcgauaucggugaguccucucccagcccuaccgucgaagagucccgaacaauuagagugcucaagaugguugagccauggcugaaaaacaaucaguucuguaucaagguacuaaaccccuauaugccuaccgugauagaacaccuugagaggcugcaacgcaagcacggcgggaugcuaguccggaauccacucucaagaaacucuacucaugaaauguacuggauuaguaauggaacgggcaacaucguggcaucgguuaauauggugagccgucuguugcugaacagguuuacaaugacccaccggcgccccacuaucgagaaagacgucgaucucggugccgggacccgacaugugaacgcugaaccggagacaccuaauauggacguaauuggagagagaauaaagaaaaucaaggaagaacacaacuccacguggcacuaugacgaugaaaauccauacaaaaccugggcguaucauggcucuuacgaggugaaggccacuggcucagcaagcuccaugauuaacgggguugucaaacuucugacaaaacccugggacguggugccuauggucacccagauggcuaugacugauacaaccccauucggacagcaaaggguuuuuaaggaaaaaguggacacacggacuccccgcaguaugccggguaccagaaggguaauggagaucacggccgagugguuauggcgaacccugggccggaauaagaaaccucguuugugcacaagagaagaguucacuaagaaggugcgcaccaacgcagccaugggggcugucuuuacagaagagaaucagugggauucugccaaagcggcaguggaagacgaggauuucuggaagcucguugacagggagcgggaacugcacaaacuaggaaaguguggcagcugcguguauaacaugauggguaaaagagagaagaaacuuggggaauuuggaaaggccaagggcucacgcgcuauuugguacauguggcugggcgccagguaccucgaguucgaggcacugggguuuuugaaugaagaucauugguucucccgagagaacaguuauagcggagucgaaggugagggccugcacaaacucggguacauccuucgggacauaucuaagauccccggaggcgcuauguaugccgaugacacugcugguugggacaccagaauuacggaagaugaccugcauaaugaggagaaaaucacacagcagauggauccagaacacaggcaauuagccaacgcaauuuuuaagcugaccuaccagaauaaagugguaaagguucagcgcccuacucccacagggaccgugauggacaucauaucccguaaggaucagcggggaucaggccaagucggcacuuauggguugaacaccuucacaaauauggaggcgcagcucauuagacagauggaaggagagggugugcugagcaaagccgaccuagaaaacccacaccuucccgagaagaaaaucacgcaguggcuggagaccaagggcguggaaaggcucaaacgcauggcuaucucgggggaugacugcgucguuaagccuauugaugaccgauuugccaacgcacuguuggcuuuaaaugauaugggaaaggugcggaaagacauaccacaauggcagccgucuaagggcuggcaugauuggcagcagguacccuucuguagucaccauuuccacgagcugaucaugaaagacgguagaaagcucguggucccuugcaggccacaagacgaacuuauugggcgcgccagaaucucccagggagcaggcuggagccugcgggagacugccugucuaggcaaagcguacgcucagauguggucacugauguauuuucacaggcgugaucuccgauuggccuccaacgcaauuugcucugccgugcccguucauugggugccuacaagccgcaccacuuggaguauccacgcucaucaccaauggaugacaaccgaagacaugcugacggucuggaauagaguguggauagaggauaacccauggauggaggacaagacacccguaaccacuugggaaaauguuccuuaccuugggaagcgggaggaucagugguguggaucccugaucggucucaccagcagggccacaugggcacagaacauuccgacugcuauccagcaagugcgcucuuuaauuggcaaugaagaguuccuggacuacaugccaucaaugaaaagauuucggaaggaggaagagagugaaggggccaucugguga

SEQ ID NO: 15161 - RNA, 9873 nt, Artificial Sequence
  derived and/or modified CDS sequence (opt3) from DENV-3__GU131862__SS-prME
accagccugugccucgugaugauccuucccgccgcucuggcauuccacuugacauccagagacggcgagccuaggaugauugucgggaagaacgaacggggaaaaucuuuacuguuuaagacugccucagguauaaauauguguacgcuaaucgcgauggaucucggcgagaugugcgacgauaccguuacauacaaauguccacauauuacugaaguggagccggaagacaucgauugcugguguaaccugaccaguacauggguaaccuaugggacuugcaaucaggcuggagagcgccgacgugacaagagaagcguggcccuugcaccccacgucggcaugggucuggauacaaggacccaaacguggauguccgccgagggggcuuggcggcagguggaaaaaguugagacuugggcauugcgccauccuggauucaccauucucgcccuguuucuggcucacuacaucggcacaucucucacucagaagguggucauauucaucuuacugaugcuugugaccccaucgaugacaaugagauguguaggcguugggaacagggacuuuguggaaggauugucaggugccaccugggucgauguggugcuggagcauggcgggugcgucacgacuauggcgaagaauaaacccacacuagacauugagcuccagaagaccgaagcaacucaacuggccacacuucggaaacuguguaucgagggaaagauuaccaacaucacgaccgauagccgcugcccuacacagggcgaagcuguuuugccagaggaacaggaccagaauuauguguguaaacacacuuacguagaucgagguugggggaacggaugcggccucuucggcaaggggagucuggugaccugcgccaaguuucaauguuuagagcccauagagggaaaagucgugcaguaugaaaaucugaaguacacaguuauuaucacugugcacaccggugaccagcaucaggucggcaacgagacacaaggggugaccgcagaaauuacuccucaggcuuccacgacagaggccauccucccagaauauggaacccuuggccuggagugcucuccgagaacugguuuggacuucaaugagaugauccuacugaccaugaaaaacaaggcguggaugguacacaggcagugguuuuucgaucucccccugccuuggacaagcggggccaccacugaaacaccaacguggaaucggaaagagcuucugguuaccuuuaagaacgcacaugcuaaaaagcaagaaguggucguguugggcucccaggagggagccaugcacacugcucucacaggcgccaccgaaauucagaauucagggggaacaaguauauucgcaggucaccugaagugucguuuaaaaauggacaagcuggagcuaaaaggcaugagcuacgccaugugcacuaacaccuuuguccucaagaaagaggugucugaaacgcagcaugggaccauccugauuaagguugaguaccgcggagaagaugcucccuguaagaucccuuucuccacagaggacggccaagguaaagcgcacaacgggagacuuauaacugcaaauccagugguaauuaagaaagaggaacccgucaacaucgaggccgaaccgccuuucggcgagucaaauaucgugauuggaaucggcgauaacgcuuugaagauuaauugguauaaaaaggggagcaguauaggaaagauguuugaagccaccgcaaggggugcccggcgaauggcuauccugggcgacacagccugggauuucgggucuguuggaggcgugcucaacucccuggguaaaaugguccaucagauuuuugggagcgcauacacugcgcuuuucucgggcgugucuuggguaaugaagaucggaaucggcauucuguugaccuggauagggcucaauuccaaaaacacgucaaugaguuuuagcugcaucgcuauuggaaucauuacacuguauuuaggcgccgugguucaggcagacaucgguugugucauaaauuggaaggggaaagagcugaagugcggauccggcaucuucgugaccaacgaggugcacacuuggacagaacaguacaaguuucaagccgauucucccaaacgccuagcuaccgccauugcaggugcuugggagaauggcgucugugggaucagaagcacuaccaggauggaaaaccuccuguggaagcagauugccaaugagcuuaacuauaucuugugggaaaauaacauaaaacugacaguuguggugggagacauuaucggcguacucgagcaggggaagcggacgcugaccccacagccuauggaguuaaaauacucauggaagacuuggggaaaagcgaagauugucacagccgaaacccaaaacaguuccuucaucauagauggccccaauacaccagagugccccagcgcuucucgcgcauggaacgugugggaaguugaggacuaugguuuugggguguucacuaccaauaucuggcugaagcuuagagaagucuacacgcaguugugugaccauaggcucaugucagccgcugugaaagaugagcgugccguucacgcagacaugggauacuggauugagagucagaagaacggcagcuggaaacuggaaaaggcgucccuaaucgaggugaaaacaugcaccuggccuaagucucacacucuguggucgaaugguguacucgaaagcgauaugauuaucccaaagucccuggccggcccgauaucacagcauaaccaccggcccggguaucauacccaaacagcuggaccuuggcaccuuggcaaauuggagcuggacuuuaauuacugcgaggggacuaccgucgugauuacagaaaacuguggaacgcgaggcccaaguuuaagaaccacuacagugucugguaagcucauccacgaguggugcuguaggagcugcacccugcccccucuucgcuauaugggggaagauggauguugguacggcauggagauccggccaauuuccgaaaaagaggagaauauggucaagucacugguuagcgccgguucuggcaaaguggacaacuucacuauggggguauugugccucgcaauccuguuugaagaggugaugagaggaaaguucggcaagaaacauaugauugcuggggucuucuuuacauucgugcuacugcucuccggacagauaaccuggagggauaugacgcacacucugaucaugauuggcaguaaugccagcgaccgcauggguauggggguuaccuaucuugcauugaucgccacauuuaagauucagcccuuccuggcuuuaggauuuuuccuccgaaaacugaccucucgggaaaaccuucugcuaggcgugggccucgcgauggccacuacacugcaauugccggaggauaucgaacagauggcaaaugggauagcucugggauuaauggcccucaagcugaucacccaguuugagacauaccagcuuuggacugcccugauuuccuugaccuguucaaacacgauguucacacucaccgucgcuuggcguacugcaacccugauccuagccggugugagucugcuuccuguuugccaaagcucguccaugagaaaaacagacuggcucccaauggcgguggcugccaugggcguccccccucugcccuuguuuauuuucucucugaaggauacuuuaaagaggcgcagcuggccacucaaugaggggguaauggcagugggacugguuucaauccuugccaguucccuguugcggaacgacgugccuauggcuggcccccucgucgcaggugggcugcuaauagccuguuaugugauuaccggaacgucugcggaucugacaguagaaaaagcugccgacaucaccugggaggaagaggcagaacagacuggcgugagccauaaccuuaugaucacagucgacgaugacggcaccaugagaauuaaggaugacgagacugagaauauacucacaguucuguugaaaaccgccuuacugaucguguccgggguguuuccauacucaauuccggcuacgcuccuggucuggcacacuuggcagaagcagacccaaaggagcggagugcuuugggauguuccuagucccccagaaacacagaaagccgagcuggaagaggguguauaccgaaucaagcagcagggcauuuucgggaaaacccaagugggagucggcgugcagaaggaggguguuuuucauacaauguggcacgugacucgcggggcagucuugaccuauaacggaaagcggcuagaacccaauugggcuucugugaaaaaggaccugaucuccuacggcggcggguggagacucagcgcccaguggcaaaaaggagaggaaguacaggucauagcgguggagccugguaagaacccaaaaaauuuccagacgaugcccggcacauuccagacuaccacaggggaaaucggagccauugcacuggauuuuaagccuggcaccucggguucaccgaucauuaacagggaggggaagguugugggacuuuauggcaauggcgucgugacuaaaaacgggggauacguuucugguaucgcucaaaccaaugccgagccagacggccccacaccugaauuagaggaagagauguucaagaaacguaaccugacgauaauggaucuccacccagggaguggaaagacucgcaaauauuugcccgcuauuauccgggaagcaaucaagagaaggcugcgaacccucauucuggccccuacacggguggucgccgcugagauggaggaagcgcuuaagggccugccgauccgcuaccagaccacugcaacaaaauccgagcauaccgguagagaaauaguggacuugaugugccacgccacguuuacuaugaggcuacugagccccguacgggugccaaauuauaaccucauuaucauggaugaggcucauuucacagacccugccucuauugcagcccgaggguacaucagcaccagaguuggaaugggcgaagcugcggccauauuuaugaccgcaacucccccaggcacagcugaugccuucccucaguccaaugcacccauucaggacgaggagcgcgacaucccagaaaggucauggaacagugggaaugaguggaucaccgauuuugucggaaagacagugugguucgugccgagcauuaaagccgguaacgacaucgcuaacuguuuacguaagaauggcaaaaaggucauucaacugucucggaagacuuuugauacggaauaccagaaaaccaagcuuaacgacugggauuucguagugacaacugacauauccgagaugggggccaauuuuaaagcggauagaguuaucgacccuaggcgcugccugaagcccgugauucucaccgauggaccagagcgagucaucuuggcaggccccaugccugugacagccgcuucagccgcucagagacgggguaggguugggcgcaacccacagaaagaaaaugaccaauauaucuucaccggccagccccugaacaaugaugaggaccacgcacauuggacugaagccaagaugcuccuggacaacauuaauacgccugagggaauaaucccggcucuuuucgaaccagagcgugagaagagugccgcaauugauggcgaauacagacuaaaaggggagagccggaagaccuuuguggaacugaugaggcgcggagacuugcccgucugguuagcgcacaaaguggccuccgaggguaucaaguauacagaucgaaaauggugcuucgacggccagagaaacaaucagauucuggaagagaacauggauguagagaucuggacuaaggaaggggagaaaaagaagcuccggccuagguggcuggacgcucgcaccuacucugauccccuugcccugaaagaauuuaaggacuucgcagcuggaagaaaaucgauaacacucgauuuggugaccgagaucggcaggguuccaagccaccuggcccaucggacucguaaugcacuagacaaccuggucaugcuccacacaucagaacauggugggcgcgccuaucgacacgcuguggaggagcuuccugaaacgauggagacccuguuauugcugggccucaugauucugcuuacuggaggcgcgaugcuguuucucaucuccgggaagggaauugguaaaacaaguaucggcuugauaugugugauugccucuagcgggaugcuguggauggcagaaauccccuuacaauggauugcuuccgccaucguccuagaguucuuuaugaugguucugcucauaccagagccugaaaagcagagaaccccgcaggauaaucaacuugccuacgugguaaucggaauucugaccuuggcagcuaucauugccgcgaacgagaugggccugcucgaaacaacuaagagggaccuggguaugucaaaagagcccgggguggucucuccaaauagcuaucuugauguggaccuccacccugcuagugccuggacgcuguacgcaguugccaccacagugaucacucccauguugcggcauaccauagaaaacuccacagcuaacgucagccuggcagccauugcgaaucaggcuguaguguuaaugggccuagacaagggauggccaaucucuaaaauggaucugggcguuccucuccuugcccuggggugcuacucacaggugaaccccuugacccugacugcagccguccuccugcuuaucacgcacuaugcuauuaucggaccgggcuuacaggccaaggcaacacgcgaggcucaaaaaagaaccgccgcggguauaaugaagaauccaacuguggacgggauuaugaccaucgaucuggacccugucauuuacgauuccaaguucgagaaacagcucggacaggugauguugcugguucuaugugccgugcagcugcuccuuaugaggacaaguugggcacugugcgaagcuuugacucuggccaccggccccaucacaacgcucugggaggguagcccaggcaaguuuuggaacaccacuauagcaguaucgauggcuaauaucuuccgggggucuuaucuggccggagccggcuuagcguuuuccauuaugaaaagcguggggacaggaaagcgaggcaccgguucacaaggggaaacucuuggagagaaauggaagaagaaacugaaccagcucaguagaaaggaauucgaccuauacaaaaagucuggcaucacagaggucgaucgcaccgaggcuaaagaaggucugaagaggggcgagauuacgcaucacgcaguuucccgggggagcgccaaauugcagugguuuguggaacguaauauggucauccccgagggaagagugauugaccugggcugugggaggggaggcuggucauauuacugcgcuggucucaagaagguaaccgaagugcgcggguauacaaaaggaggcccuggccaugaggagccgguucccaugaguacuuacggguggaacaucgugaagcuuaugagcggaaaagaugucuucuaccugccaccugaaaagugugacaccuugcugugcgauauaggugaguccucucccagcccuacaguggaagagucccggacuauucgaguccucaaaaugguggagccaugguuaaagaauaaccaguucuguaucaagguucugaaucccuauaugccuaccguaaucgaacaccuugagagacugcaaaggaaacacggcgggaugcuagugcgcaacccacucucacggaauucuacacaugaaauguacuggauuaguaacggaaccggcaauauagucgccucggugaacaugguuagcagacuguugcugaaccguuuuacuaugacgcacaggcggcccacaaucgagaaggacguggaucucggugcagggacccgccaugucaaugccgaaccggagacuccuaacauggacgugauuggagagcgaaucaaaagaauuaaggaagagcacaauuccaccuggcacuaugacgaugaaaacccauacaaaacaugggcuuaucauggcucuuacgagguaaaggcgacgggcucagccagcuccaugaucaauggggugguuaagcuucugaccaaacccugggacgucgugccuauggugacucagauggcaaugacagauaccacuccauucggacagcaaagggucuuuaaggaaaaaguugacacacggaccccccgcaguaugccggguacaagaagggugaugggcauaacugcugagugguuauggaagacccuggggcgaaacaaaaagccucgguugugcacgcgugaggaauucaccaagaaaguaagaacaaaugccgcaaugggagccguguuuacugaggaaaaccagugggauucugcuaaggccgcggucgaggacgaagauuucuggaaacucguggaccgcgagagggagcugcacaagcuaggcaaaugugguagcugcguuuauaauaugauggggaagcgggaaaaaaagcuuggagaguuuggcaaggcaaaaggcucaagagccaucugguacauguggcugggggcucgcuaccucgaauucgaggcccugggauuuuugaacgaggaucauugguucuccagggaaaauaguuauagcgguguggagggcgaagggcugcacaagcucggauacauucuucgagacaucucuaaaauucccggcggugcaauguaugcugaugacaccgccgggugggacacacggaucacugaggaugaccugcauaacgaagagaagauaacccagcagauggauccagagcacagacaauuagcuaaugccauuuuuaaacugacguaccagaacaaggucgugaagguacagaggccuacacccaccggaacuguuauggacaucaucucccgcaaagaucagcguggcucaggccaaguggggacauauggauugaauaccuucacuaacauggaagcacagcucauucggcagauggagggugaaggcguccugagcaaggcggaccuagagaacccacaccuucccgaaaaaaagauaacccaguggcuggagacaaaagggguggagagacucaagaggauggccaucucgggagaugacugcguggucaagccuauugaugaccgcuuugcuaaugcccuguuggcauuaaacgauaugggcaaaguucgaaaggacaucccacaauggcagccgucuaaagguuggcaugauuggcagcaggugcccuucuguagucaccauuuccacgaacugauuaugaaggacgggcggaaacucguagugccuugcagaccacaagacgagcuuaucggaagggcucgcauaucccagggcgccggcuggagccugagagaaacggcaugucuagggaaggccuacgcgcagauguggucacugauguauuuucaccggagggaucuccguuuggcuuccaaugccaucugcucugcaguccccgugcauuggguuccuaccagccgaacuacauggaguauucacgcccaucaccaauggaugaccacugaggacaugcugacaguguggaaccgcgucuggaucgaagauaauccauggauggaggacaagacccccgugacgacaugggagaacguaccuuaccuuggaaaaagagaagaucaguggugugguucccugauuggccucaccagccgggcuacuugggcccagaauaucccgaccgcaauucagcaaguuaggucuuuaauagggaacgaggaauuccuggacuacaugccaucaaugaagcgcuuuagaaaagaggaggaaagugagggagcuaucugguga

SEQ ID NO: 15162 - RNA, 9873 nt, Artificial Sequence
  derived and/or modified CDS sequence (opt3) from DENV-3__GU131865__SS-prME
accagccugugccucgugaugauccuucccgcagcucuggcauuccacuugaccuccagagacggcgagccuagaaugauugucgggaagaacgaacggggaaaaucuuuacuguuuaagacugcaucagguauaaauauguguacguuaaucgcgauggaucucggcgagaugugcgacgauaccguuacauacaaauguccacauauuacugaaguggagccggaagacaucgauugcugguguaaccugaccaguacauggguaaccuaugggacuugcaaucaggcuggagagcgccgacgugacaagagaagcguggcccuugcaccccacgucggcaugggucuggauacaaggacccagacguggauguccgccgagggggcuuggcggcaaguggaaaaaguugagacuugggcauugcgccauccuggauucaccauucucgcccuguuucuggcucacuacaucggcacaucucucacucagaagguggucauauucaucuuacugaugcuugugaccccaucgaugacaaugagauguguaggcguugggaacagggacuuuguggaaggauugucaggugccaccugggucgauguggugcuggagcauggcgggugcgucacgacuauggcgaagaauaaacccacacuagacauugagcuccagaagaccgaagcaacucagcuggccacacuucggaaacuguguaucgagggaaagauuaccaacaucacgaccgauagccgcugcccuacacagggcgaagcuguuuugccagaggaacaggaccagaauuauguguguaaacacacuuacguagaucgagguugggggaacggaugcggccucuucggcaaggggagucuggugaccugcgccaaguuucaauguuuagagcccauagagggaaaagucgugcaguaugaaaaucugaaguacacaguuauuaucacugugcacaccggugaccagcaucaggucggcaacgagacacaaggggugaccgcagaaauuacuccucaggcuuccacgacagaggccauccucccagaauauggaacccuuggccuggagugcucuccgagaacugguuuggacuucaaugagaugauccuacugaccaugaaaaacaaggcguggaugguacacaggcagugguuuuucgaucucccccugccuuggacaagcggggccaccacugaaacaccaacguggaaucggaaagagcuucugguuaccuuuaagaacgcacaugcuaaaaagcaagaaguggucguguugggcucccaggagggagccaugcacacugcucucacaggcgccaccgaaauucaaaauucagggggaacaaguauauucgcaggucaccugaagugucguuuaaaaauggacaagcuggagcuaaaaggcaugagcuacgccaugugcacuaacaccuuuguccucaagaaagaggugucugaaacgcagcaugggaccauccugauuaagguugaguaccgcggagaagaugcucccuguaagaucccuuucuccacagaggacggccaagguaaagcgcacaacgggagacuuauaacugcaaauccagugguaaccaagaaagaggaacccgucaacauugaggccgaaccgccuuucggcgagucaaauaucgugaucggaauuggcgauaacgcuuugaagaucaauugguauaaaaaggggagcaguauuggaaagauguuugaagccacagcaaggggugcccggcgaauggcuauacugggcgacacugccugggauuucgggucuguuggaggcgugcucaacucccuggguaaaaugguccaucagaucuuugggagcgcauacaccgcgcuuuucucgggcgugucuuggguaaugaagauuggaaucggcauccuguugacguggauugggcucaauuccaaaaacacaucaaugaguuuuagcugcauagcuaucggaauuaucacccuguauuuaggcgccgugguucaggcagacauggguugugucauuaauuggaaggggaaagagcugaagugcggauccggcaucuucgugacuaacgaggugcacacauggaccgaacaguacaaguuucaagccgauucucccaaacgccuagcuacugccauagccggugcuugggagaauggcgucugugggaucagaagcaccacaaggauggaaaaccuccuguggaagcagauugccaaugagcuuaacuauaucuugugggaaaauaacauuaaacugacgguuguggugggagacaucauaggcguacucgagcaggggaagcggacccugacuccacagccuauggaguuaaaauacucauggaagacauggggaaaagcgaagauugucaccgccgaaacacaaaacaguuccuucaucauugauggccccaauacuccagagugccccagcgcuucucgcgcauggaacgugugggaaguugaggacuaugguuuugggguguucaccacgaauaucuggcugaaacuuagagaagucuacacacaguugugugaccauaggcucaugucagccgcugugaaagaugagcgugccguucacgcagacaugggauacuggauagagagucagaagaacggcagcuggaaacuggaaaaggcgucccuaaucgaggugaaaaccugcacuuggccuaagucucacacccuguggucgaaugguguacucgaaagcgauaugauuaucccaaagucccuggccggcccgauuucacagcauaaccaccggcccggguaucauacacaaacugcuggaccuuggcaccuuggcaaauuggagcuggacuuuaauuacugcgaggggaccacagucgugaucacggaaaacuguggaacccgaggcccaaguuuaagaacuacaaccgugucugguaagcucauacacgaguggugcuguaggagcugcacucugcccccucuucgcuauaugggggaagauggauguugguacggcauggagauucggccaaucuccgaaaaagaggagaauauggucaagucacugguuagcgccgguucuggcaaaguggacaacuucacaauggggguauugugccucgcaauccuguuugaagaggugaugagaggaaaguucggcaagaaacauaugauugcuggggucuucuuuaccuucgugcuacugcucuccggacagaucacguggagggauaugacucacacccugauuaugauaggcaguaaugccagcgaccgcauggguauggggguuacauaucuugcauugaucgccaccuuuaagauucagcccuuccuggcuuuaggauuuuuccuccgaaaacugacuucucgggaaaaccuucugcuaggcgugggccucgcgauggccacaacccugcaauugccggaggauaucgaacagauggcaaaugggauugcucugggauuaauggcccucaagcugaucacacaguuugagacuuaccagcuuuggaccgcccugauauccuugacguguucaaacacaauguucacccucacugucgcuuggcguaccgcaacacugauccuagccggugugagucugcuuccuguuugccaaagcucguccaugagaaaaacugacuggcucccaauggcgguggcugccaugggcgucccaccucugcccuuguuuauuuucucucugaaggauaccuuaaagaggcgcagcuggccacucaaugaggggguaauggcagugggacugguuucaauccuugccaguucccuguugcggaacgacgugccuauggcuggcccccucgucgccggugggcugcuaauugccuguuaugugaucacgggaacaucugcggaucugaccguagaaaaagcugccgacauaacuugggaggaagaggcagaacagacaggcgugagccauaaccuuaugauuaccgucgacgaugacggcacuaugagaaucaaggaugacgagacagagaauauccucaccguucuguugaaaacggccuuacugauuguguccgggguguuuccauacucaauaccggcuacucuccuggucuggcacaccuggcagaagcagacacaaaggagcggagugcuuugggauguuccuagucccccagaaacccagaaagccgagcuggaagaggguguauaccgaaucaagcagcagggcauuuucgggaaaacacaagugggagucggcgugcagaaggaggguguuuuucauacuauguggcacgugacccgcggggcagucuugacguauaacggaaagcggcuagaacccaauugggcuucugugaaaaaggaccugaucuccuacggcggcggguggagacucagcgcccaguggcaaaaaggagaggaaguacaggucauugcgguggagccugguaagaaccccaagaauuuccagacaacucccggcaccuuccagacaaccacuggggaaaucggagccauagcacuggauuuuaagccuggcaccucggguucaccgaucauuaacagggaggggaagguugugggacuuuauggcaauggcgucgugaccaagaacgggggauacguuucugguaucgcucaaacgaaugccgagccagacggccccacuccugaauuagaggaagagauguucaagaaacguaaccugaccauuauggaucuccacccagggaguggaaagacacgcaaauauuugcccgcuaucauacgggaagcaauuaagagaaggcugcgaacccucauccuggccccuacucggguggucgccgcugagauggaggaagcgcuuaagggccugccgauccgcuaccagacaaccgugacgaaauccgagcauacugguagagaaauuguagacuugaugugccacgcaacauuuaccaugaggcuacugagccccgugcggguuccaaauuauaaccucaucauaauggaugaggcccauuucaccgacccugcuucuauugccgcacgaggguacaucagcacuagagucggaaugggcgaagccgcugcgauuuuuaugacagccacacccccaggcacagcagaugcuuucccucaguccaaugcccccauccaggacgaggagcgcgacauaccagaaaggucauggaacagugggaaugaguggauuacugauuuugcaggaaagacggugugguucgugccgagcaucaaagccgguaacgacaucgcuaacuguuuacguaagaauggcaaaaaggucauucaacugucucggaagaccuuugauacagaauaccagaaaacuaaacuuaacgacugggauuucguagugaccacagacaucuccgagaugggggccaauuuuaaagcggauagaguuauugacccuaggcgcugccugaagcccgugauacucaccgauggaccagagcgagucaucuuggcaggccccaugccugugacugccgcuucagccgcucagagacgggguaggguugggcgcaacccacagaaagaaaaugaccaauauauuuucacgggccagccccugaacaaugaugaggaccacgcacauuggaccgaagccaagaugcuccuggacaacaucaauacaccugagggaaucauuccggcucuuuucgaaccagagcgugagaagagugccgcaauagauggcgaauacagacuaaaaggggagagccggaagacuuuuguggaacugaugaggcgcggagacuugcccgucugguuagcgcacaaaguggccuccgaggguaucaaguauaccgaucgaaaauggugcuucgacggccagagaaacaaucagauucuggaagagaacauggauguagagaucuggacaaaggaaggggagaaaaagaagcuccggccuagguggcuggacgcucgcaccuacucugauccccuugcccugaaagaauuuaaggacuucgcagcuggaagaaaaucgauugcccucgauuuggugacugagaucggcaggguuccaagccaccuggcacaucggacacguaaugcccuagacaaccuggucaugcuccacacgucagaacauggugggcgcgcuuaucgacacgcgguggaggagcuuccugaaaccauggagacucuguuauugcugggccucaugauacugcuuacaggaggcgccaugcuguuucucaucuccgggaagggaauugguaaaaccaguaucggcuugauuugugugaucgcaucuagcgggaugcuguggauggcugaaauacccuuacaauggauugccuccgccgucguucuagaguucuuuaugauggugcugcucaucccagagccugaaaagcagagaaccccgcaggauaaucaacuugcauacguagugauuggaauccugacauuggcugccauaaucgcggcuaacgagaugggccugcucgaaacuacgaagagggaccuggguaugucaaaagagcccggggucgugucuccaaccagcuaucuugauguugaccuccacccugccagugcauggacacuguacgccguggcuacuaccgucauuacacccauguugcggcauaccaucgaaaauuccacugcaaacguaagccuggccgcgauugcuaaccaggccgugguuuuaaugggccuagacaagggauggccaaucucuaaaauggaucugggcgugccucuccuugcacuggggugcuacucacaggucaaucccuugacgcugacagccgcugugcuccugcuuauaacccacuaugccauuaucggaccgggcuuacaggcaaaggcuacucgcgaggcccagaagagaaccgcggccgguaucaugaagaacccaacagucgacgggauuaugacuaucgaucuggacccugugauauacgauuccaaguucgagaaacagcucggacagguuauguugcuggugcuaugugcaguacagcugcuccuuaugaggaccaguugggcucugugcgaagccuugacacuggcaacgggccccauuaccacucucugggaggguagcccaggcaaguuuuggaauacaaccaucgcugugucgauggccaacauuuuccgggggucuuaucuggccggagcgggcuuagcuuuuuccaucaugaaaagcgucgggacuggaaagcgaggcacagguucacaaggggaaacccuuggagagaaauggaagagaaagcugaaucagcucagucgcaaagaguucgaccuauacaagaaaucuggcauaacggagguugauaggaccgaggcaaaggaaggucugaaacggggcgagaucacacaucacgccgugucccgugggagcgcuaaguugcagugguuugucgaaagaaacauggugauucccgagggaaggguaaucgaccugggcugugggcgcggaggcuggucauauuacugcgccggucucaaaaaggugacugaaguucggggguauaccaagggaggcccuggccaugaggagccggugcccaugaguacauacggguggaauauugucaaacuuaugacuggaaaggauguguucuaccugccaccugaaaaaugugacaccuugcugugcgauaucggugagagcucccccucuccuacagucgaagagagccgaaccauuagagugcucaagaugguugagccauggcuaaagaacaaucaguucuguaucaagguacugaaccccuauaugccuacugugauagaacaccuugagaggcugcaacgcaagcacggcgggaugcuaguccggaauccacucuccagaaacucaacgcaugaaauguacuggauuucuaauggaacaggcaacaucguggcaaguguuaauauggugucgcgucuguugcugaacagguuuaccaugacucaccggcgccccaccaucgagaaagacgucgaucucggugccgggacacgacaugugaacgcugaaccggagacgccuaauauggacguaauuggagagagaauaaagaggaucaaagaagaacacaacagcaccuggcacuaugacgaugaaaauccauacaagacuugggcguaucauggcuccuacgaggugaaagccacaggcucugcaucaagcaugauuaacgggguugucaaacuucugaccaagcccugggacguggugccuauggucacucagauggcuaugacagauaccacaccauucggacagcaacggguuuuuaaagaaaagguggacacucgcacccccagauccaugccggguacgaggcgaguaauggagaucaccgccgagugguuauggcggacacugggccguaauaaaaagccuagauugugcacucgcgaagaguucaccaaaaaggugaggacaaacgcagccaugggggcugucuuuacugaagagaaucagugggauagugccaaggcggcaguggaagacgaggauuucuggaaacucguugaccgggagagagaacugcacaagcuaggaaaauguggcucuugcguguauaacaugauggguaagcgcgagaagaaacuuggggaauuuggaaaagccaaaggcagcagggcuauuugguacauguggcugggcgcccgauaccucgaguucgaggcacugggguuuuugaaugaagaucauugguucucacgggagaacuccuauaguggagucgaaggugagggccugcacaagcucggguacauccuuagagacauaagcaaaauccccggaggcgcuauguaugccgaugacaccgcugguugggacacgaggauuacagaagaugaccugcauaaugaggagaagaucacccagcagauggauccagaacaccgccaauuagccaacgcaauuuuuaaacugacuuaccagaauaaggugguaaaaguucagcguccuacacccaccgggacugugauggacaucauaucucggaaggaucagagaggauccggccaagucggcaccuauggguugaacacauucacgaauauggaggugcagcucauuaggcagauggaaggagagggugugcugucaaaggcggaccuagaaaacccacaccuucccgagaaaaagaucacccaguggcuggagacuaaaggcgucgaacgccucaagcgaauggccaucagcggggaugacugcguugugaaaccuauugaugaccgguuugcuaacgcccuguuggcauuaaaugauaugggaaagguaagaaaggacauaccacaauggcagccgucgaaaggcuggcaugauuggcaacaggugcccuucuguucucaccauuuccacgagcugaucaugaaggacgguaggaaacucgucgugccuugccgcccacaagacgaacuuauugggagagcucggaucagucagggagccggcuggucccugagggagacagcaugucuaggcaaggccuacgcgcagauguggagccugauguauuuucaccgucgagaucuccgcuuggcuucaaacgccauuugcuccgcaguucccgugcauugggucccuaccucuagaacuacauggagcauccacgcccaucaccaauggaugaccacggaagacaugcugacaguguggaaucggguauggauagaggauaacccauggauggaggacaaaacccccguuacuaccugggaaaaugugccuuaccuugggaagagggaggaucagugguguggaagucugaucggucucacaucccgcgcuacuugggcccagaacauuccgaccgcaauccagcaagucaggagcuuaauuggcaaugaagaguuccuggacuacaugccaucuaugaagcgguuuaggaaagaggaagagucagaaggggcuaucugguga

SEQ ID NO: 15163 - RNA, 9873 nt, Artificial Sequence
  derived and/or modified CDS sequence (opt3) from DENV-3__GU131866__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcgccgacgugacagaaggagcguagcccuugcaccccacgugggcaugggucuggauacacggacccaaacguggauguccgccgagggggcuuggcgccaggucgaaaagguggagacuugggcauugagacauccuggauucaccauucucgcccuguuucuggcucacuacaucggcacaucucucacucagaaaguugugauauucaucuuacugaugcuugucaccccaucgaugacaaugaggugugugggcguagggaaccgggacuuuguugaaggauugucaggugccaccuggguggaugucgugcuggagcauggcgggugcgugacgacuauggcgaagaauaagcccacacuagacauugagcuccagaaaaccgaagcaacucaacuggccacacuucgcaagcuguguaucgagggaaaaauuaccaacaucacgaccgauagccgaugcccuacacagggcgaagcugucuugccagaggaacaggaccagaauuauguuuguaagcacacuuacguggauagagguugggggaacggaugcggccucuucggcaaagggagucugguaaccugcgccaaguuucaauguuuagagcugauagagggaaaggugguccaguaugaaaaucucaaauacacagugauuaucacuguucacaccggugaccagcaucaggugggcaacgagacacaaggggucaccgcagaaauuacuccccaggcuuccacgacagaggccauccuuccugaauauggaacccugggcuuggagugcucuccaaggacuggucuagacuucaaugagaugauccugcucaccaugaagaacaaagcguggauggugcaccggcagugguuuuucgaucugccgcuucccuggacaagcggggccaccacugaaacaccuacguggaaucguaaggagcuguugguaaccuuuaaaaacgcacaugcuaagaaacaagaaguugugguccucggcucccaggagggagccaugcacacugcucugacaggcgccaccgaaauucagaauucagggggaacaaguauauucgcaggucacuuaaagugucgccugaagauggacaaacuagagcucaagggcaugagcuacgccaugugcacuaacaccuuugugcugaaaaaggaggucucugaaacgcagcaugggaccauccuuauuaaaguggaguacaagggagaagaugcuccauguaagauccccuucuccacagaggacggccaagguaaagcgcacaacgggagauugauaacugcaaauccuguugugaccaagaaagaggaaccaguaaacauugaggccgaacccccguucggcgagucaaauaucgucaucggaauuggcgauaacgcucugaagaucaauugguauaaaaaggggagcaguauuggaaagauguuugaagccacagcaaggggugcccggcgaauggcuauacucggcgacacugccugggauuucgggucugugggaggcguucugaacucccuugguaaaauggugcaucagaucuuugggagcgcauacaccgcgcuguucucgggcgucucuugggugaugaagauuggaaucggcguauugcucacguggaucgggcugaauuccaaaaacacaucaaugaguuuuagcugcauugcuauaggaaucauuaccuuauaucugggcgccgugguucaggcagacauggguugugucaucaauuggaaggggaaagagcuaaagugcggauccggcauuuucgugacuaacgaggugcacgccuggacagaacaguacaaguuucaagcugauucuccuaaacgccucgccaccgcaaucgcuggugccugggagaauggcgucugugggauaagaagcacuaccaggauggaaaaccugcuuuggaagcagaucgcgaaugaguugaacuauauucugugggaaaauaacaucaaacucacaguuguggugggagacauuaucggcguacuggagcaggggaagcggacguuaaccccccagccaauggagcugaaauacucauggaagacuuggggaaaagccaagauagucacagcugaaacccaaaacaguuccuucauuaucgauggcccuaauacacccgagugcccaagcgcaucucgcgccuggaacgugugggaaguugaggacuaugguuuugggguguucacuaccaauauuuggcuuaaguugagagaagucuacacgcagcucugugaccauaggcugaugucagcugccgugaaagaugagcgugcaguucacgcggacaugggauacuggaucgagagucagaagaacggcagcuggaaacuagaaaaggccucccugauagaggugaaaacaugcaccuggcccaagucucacacucucuggucgaaugguguacuggaaagcgauaugaucauuccuaagucccuugcuggcccaaucucacagcauaaccaccggccgggguaucauacccaaacagccggacccuggcacuugggcaaacuggaguuagacuuuaauuacugcgaggggacuaccgucgugauuacagaaaacuguggaacgcgaggcccuagucucagaaccacuacagugucugguaagcugauccacgaguggugcuguaggagcugcacccuuccaccccugcgcuauaugggggaagauggauguugguacggcauggagauacggccuauuuccgaaaaagaggagaauauggucaagucauugguuagcgcagguucuggcaaaguggacaacuucacuauggggguacucugccuggcuauccuauuugaagaggugaugagaggaaaguucggcaagaaacauaugaucgccggggucuucuuuacauucgugcugcuccuguccggacagauuaccuggagggauauggcacacacgcuuaucaugauuggcaguaaugccagcgaccgcauggguauggggguuacuuauuuggcucugauagcgaccuuuaagauccagccauucuuagcccucggauuuuuccugcgaaaacuuacaucucgggaaaaccugcuacucggcgugggccuggcaauggcuaccacuuugcaacugcccgaggauauugaacagauggccaaugggaucgccuuaggacucauggcucugaagcuuauuacacaguuugagaccuaccagcuguggacagcauugaucucccucacuuguucaaacaccauguucacgcugacagucgccuggcguaccgcgacucuaauacuggcuggugugagucuucucccgguuugccaaagcucguccaugagaaaaaccgacuggcugccuauggccguggcagccaugggcgucccacccuugccucuguuuaucuucucuuuaaaggauacacucaagaggcgcagcuggccccugaaugaggggguaauggcugugggacuuguuucaauucuggcaaguuccuugcuccggaacgacgugccaauggccggcccucuggucgcgggugggcuacugaucgcuuguuaugugauuacuggaaccucugccgaucuuacgguagaaaaagcagccgacaucacaugggaggaagaggcugaacagaccggcgugagccauaaccucaugauaacugucgacgaugacggcacaaugagaauuaaggaugacgagaccgagaauauccugacuguuuuguuaaaaacagcccugcucaucguguccgggguguuucccuacucaauuccagcaacccugcuugucuggcacacguggcagaagcagacucaaaggagcggagugcugugggauguuccgaguccucccgaaacccagaaagcugaguuggaagaggguguauaccgaauaaagcagcagggcaucuucgggaaaacacaagugggagucggcgugcagaaggaggguguuuuucauaccauguggcacgugacacgcggggccguccuaacuuauaacggaaagcggcuggaaccaaauugggcgucugugaaaaaggaccucauuuccuacggcggcggguggagacugagcgcccaguggcaaaaaggagaggaaguacaggucaucgcaguggagcccgguaagaacccuaaaaauuuccagaccaugccaggcacguuccagacaacuaccggggaaauuggagcuaucgcccuugauuuuaagcccggcacaucggguucaccuauaaucaacagggaggggaagguugugggauuauauggcaauggcgucgugaccaaaaacgggggauacguuucugguauugcucaaacuaaugcagagccggacggcccaacccccgaacuggaggaagagauguucaagaaacguaaccucacaaucauggauuugcacccugggaguggaaagacgcgcaaauaucugccagccauugugcgggaagccaucaagagaaggcuccgaacucugauacuugcucccacccgggucguggcggcagagauggaggaagcccugaagggcuugccuauucgcuaccagacaaccgcuacuaaauccgagcauacagguagagaaaucguagaccuaaugugccacgccaccuuuacgaugaggcugcucagcccggugcggguucccaauuauaacuuaaucauuauggaugaggcacauuucacugacccagccucuaucgcugcgcgaggguacauaagcacaagagucggaaugggcgaagccgcagcuauuuuuaugaccgccaccccucccggcacugcagaugccuucccacaguccaaugcuccuauccaggacgaggagcgcgacauucccgaaaggucauggaacagugggaaugaguggaucacagauuuugccggaaagaccgugugguucgugccaagcauaaaagcggguaacgacauugcaaacugucugcguaagaauggcaaaaaggucauccaacuuucucggaagacauuugauacugaauaccagaaaacgaagcugaacgacugggauuucguagugaccacagacaucuccgagaugggggccaauuuuaaagcugauagaguuauugacccgaggcgcugccucaagccugugaucuugacugauggacccgagcgagucauucuggccggcccaaugcccgugaccgcugcaucagccgcucagagacgggguaggguugggcgcaacccucagaaagaaaaugaccaauauauauucacaggccagccacucaacaaugaugaggaccacgcccauuggaccgaagcaaagaugcugcuugacaacaucaauacucccgagggaauuaucccugcgcuauucgaaccggagcgugagaagagugccgcuaucgauggcgaauacagacugaaaggggagagccggaagacguuuguggaauugaugaggcgcggagacuuaccagucuggcuggcccacaaaguggcauccgaggguauuaaguauaccgaucgaaaauggugcuucgacggccagagaaacaaucagauacucgaagagaacauggauguagagaucuggacaaaggaaggggagaaaaagaagcugcggcccagguggcuugacgcucgcacuuacucugauccucuggcccucaaagaauuuaaggacuucgcagccggaagaaaaucgauugcuuuggaucuggugaccgagaucggcaggguucccagccaccuagcgcaucggacacguaaugcccuggacaaccucgucaugcuucacaccucagaacauggugggcgcgcauaucgacacgcuguggaggagcugccagaaacuauggagacauuauugcugcucggccugaugauucuucugacgggaggcgccaugcucuuuuugaucuccgggaagggaauagguaaaaccaguaucggccugauuugugugaucgccucuagcgggauguuauggauggcagaaauuccucuacaauggaucgcuuccgccauaguccuggaguucuuuaugaugguucuccuuauucccgagccagaaaagcagagaacuccucaggauaaucaacuggcguacgugguaaucggaauuuugacacuggcugccaucauagcagccaacgagaugggccuccuggaaaccaccaagagggaccuugguaugucaaaagagccggggguggucucucccacaagcuaucucgauguggaccugcacccagcuagugcauggacuuuguacgccguugcgacgaccgugaucacaccuaugcugcggcauacuauugaaaauuccaccgcuaacgucagcuuagccgcaaucgccaaccaggcuguagugcuaaugggccuggacaagggauggcccauuucuaaaauggaucucggcguuccacuucuggccuuggggugcuacucacaggugaauccucugacacucaccgcagcuguccugcuuuuaaucacucacuaugccauaauuggacccggccugcaggcgaaggccacgcgcgaggcacaaaaaagaacagcugccgguaucaugaagaacccgaccguggacgggaucaugacuauugaucucgacccagucaucuacgauuccaaguucgagaaacaguugggacaggugaugcugcuaguucugugugcagugcagcuccuucugaugaggaccaguugggcuuugugcgaagcccugacacucgccacuggcccuauaaccacacugugggaggguagccccggcaaguuuuggaauacgaccauugcgguaucgauggcuaacaucuuccgggggucuuauuuagcaggagccggccuugcuuuuuccauuaugaaaagcguggggacuggaaagcgaggcacagguucacaaggggaaacccugggagagaaauggaagaagaaacucaaucagcuaaguagaaaggaauucgaccuguacaaaaagucuggcaucacugaggucgaucgcacagaggccaaagaagguuugaagaggggcgagauaacccaucacgcaguuucccgggggagcgccaaacugcagugguuuguggaacguaacauggucaucccagagggaagagugauugaccucggcugugggaggggaggcuggucauauuacugcgcuggucuuaagaagguaacggaagugcgcggguauaccaaaggaggccccggccaugaggagccuguuccgaugaguacauacggguggaauaucgugaagcugaugagcggaaaagaugucuucuacuugcccccagaaaagugugacacucugcucugcgauauuggugaguccucuccuagccccaccguggaagagucccggacaauccgagucuuaaaaaugguggagccuuggcugaagaacaaucaguucuguauuaagguucuuaacccauauaugcccacuguaaucgaacaccuggagagacuacaaaggaaacacggcgggaugcucgugcgcaauccucugucacggaacucuacccaugaaauguacuggauaaguaauggaacaggcaacauugucgcgucggugaauaugguuagcagauugcugcucaaccguuuuaccaugacucacaggcggccaacgaucgagaaggacguggaucuuggugccgggacacgccaugucaacgcagaacccgagaccccgaauauggacgugaucggagagcgaauuaaaagaauaaaggaagagcacaacuccacuuggcacuaugacgaugaaaauccuuacaaaaccugggcuuaucauggcucuuacgagguaaaggccacaggcucagcaagcuccaugaucaacggggugguuaagcuguuaacgaaaccaugggacgucgugcccauggugacccagauggccaugacugauacaaccccuuucggacagcaaagggucuuuaaggaaaaaguugacacucggacaccacgcaguaugcccgguaccagaagggugaugggcauuacagcugaguggcuguggcgaacuuuggggcggaauaagaaaccgcgucucugcaccagagaggaauucacgaagaagguacgcaccaacgccgcgaugggagcaguguuuacagaggaaaaucagugggauucugccaaagcugccgucgaggacgaagauuucuggaagcugguggacagggagcgggagcuacacaaacuuggcaagugugguagcugcguuuauaacaugauggggaaaagagaaaagaaacugggagaguuuggcaaggcaaagggcucacgcgcuaucugguacauguggcucggggccagguaccuggaauucgaggcuuugggauuucugaaugaggaucauugguucucccgagaaaacaguuauagcgguguggagggcgaagggcuccacaaacuuggauacauucugcgggacaucucuaagauaccuggcggugccauguaugcagaugacacugcggggugggacaccagaaucacagaggaugacuuacauaaugaagagaaaauuacucagcagauggaucccgagcacaggaagcuggccaacgcuaucuuuaaauugaccuaccaaaauaaggucgugaagguacagcgcccaacgccuacaggaaccguuauggacauuaucucccguaaagaucagcggggcucaggccagguggggacuuauggacucaacacauucaccaauauggaagcccaacugauaagacagauggagggugaaggcguccuaagcaaggcagaccuugagaacccccaccugccagaaaaaaagauuacucaguggcucgagaccaaagggguggagaggcugaagcgcauggcuaucucgggagaugacugcguggucaagcccaucgaugaccgauuugccaacgcauuguuagcccugaaugauaugggcaaaguucggaaggacauuccucaguggcaaccaucuaaagguuggcaugauuggcagcaggugccguucuguagucaccauuuccacgaacucauaaugaaggacgggagaaaacuuguagugcccugcaggccucaggacgagcugaucggacgcgcgagaauuucccaaggcgcuggcuggagccuacgggaaacagccugucuggggaaggcauacgcccagauguggucacucauguauuuucacaggcgugauuugcgacuggcuuccaacgccaucugcucugcagucccagugcauuggguucccacgagccgcaccacuuggaguauucacgcucaucaccaguggaugacaaccgaggacaugcuuacuguguggaauagagucuggaucgaagauaacccuuggauggaggacaagacaccagugaccacgugggagaauguacccuaccugggaaaacgggaagaucaauggugugguucccucauaggcuuaacaagcagggccaccugggcgcagaacaucccuacugcuauucagcagguucgcucucugaucgggaaugaggaauucuuggacuacaugccgucaaugaagagauuucggaaagaggaggaaagugagggagccauuugguga

SEQ ID NO: 15164 - RNA, 9873 nt, Artificial Sequence
  derived and/or modified CDS sequence (opt3) from DENV-3__GU131868__SS-prME
acuccccugugccucaugaugauccuuccugcagcucuggcauuccacuugaccagcagagacggcgaaccaaggaugauuguggggaagaacgaacggggaaaauccuuacuguuuaagacugccucugguauaaauauguguacgcugaucgcgauggaucucggcgaaaugugcgacgauaccgucacuuacaaauguccgcauauuacugaaguugagcccgaagacaucgauugcugguguaaccugaccucaaccugggugaccuaugggacuugcaaucaggcuggagagcgccgacgugacaagagaaguguagcccuugcaccucacgugggcaugggucuggauacaaggacccagacguggaugagcgccgagggggcuuggcggcaggucgaaaaaguggagacuugggcauugcgccauccaggauucaccauucucgcccuguuucuggcucacuacaucggcacaucccucacucagaagguugugauauucaucuuacugaugcuugucacccccucuaugacaaugagaugugugggcguagggaacagggacuuuguugaaggauugucgggugccaccuggguggaugucgugcuggagcauggcgggugcgugacgacuauggcgaagaauaaaccuacacuagacauugagcuccagaagaccgaagcaacucaacuggccacacuucggaaacuguguaucgagggaaagauuaccaacaucacgaccgauucacgcugcccaacacagggcgaagcugucuugcccgaggaacaggaccagaauuauguuuguaaacacacuuacguggaucgagguugggggaacggaugcggccucuucggcaaggggagccugguaaccugcgccaaguuucaauguuuagagcugauagagggaaaagugguccaguaugaaaaucucaaguacacagugauuaucacuguucacaccggugaccagcaucaggugggcaacgagacacaaggggucaccgcagaaauuacuccucaggcuaguacgacagaggccauccuuccagaauauggaacccugggcuuggagugcuccccgagaacuggucuagacuucaaugagaugauccugcucaccaugaaaaacaaggcguggauggugcacaggcagugguuuuucgaucugccccuuccuuggacaucuggggccaccacugaaacaccaacguggaaucggaaagagcuguugguaaccuuuaacaaugcacaugcuaagaaacaagaaguugugguccucggcagccaggagggagccaugcacacugcucugacaggcgccaccgaaauucagaacuccgggggaacaucaauauucgcaggucacuuaaagugucgucugaagauggacaaacuagagcucaagggcaugaguuacgccaugugcacuaacaccuuugugcugaaaaaggaggucagcgaaacgcagcaugggaccauccuuauuaaaguggaguacaagggagaagaugcucccuguaagaucccuuucucuacagaggacggccaagguaaagcgcacaaugggcgcuugauaacugcaaacccaguugugaccaagaaagaggaacccguaaauauugaggccgaaccgccuuucggcgaguccaacaucgucaucggaauuggcgauaaugcucugaagaucaacugguauaaaaaggggucaagcauuggaaagauguuugaagccacagcaagaggugccaggcggauggcuauacucggcgacacugccugggauuucgggagugugggaggcguucuaaauucucuugguaaaauggugcaucagaucuuuggguccgcauacaccgcgcuguucagcggcgucucgugggugaugaagauuggaaucggcguauugcucacguggaucgggcugaacucuaaaaauacauccaugucauuuaguugcauugcuauaggaaucauuaccuuauaucugggcgccgugguucaggcagacauggguugugucaucaacuggaaggggaaagagcuaaagugcggaagcggcauuuucgugacuaaugaggugcacacauggaccgaacaguacaaguuucaagccgauucccccaaacgacucgcuacugccaucgccggugcuugggagaacggcgucugugggauacgcucuaccacaagaauggaaaaucugcuuuggaagcagaucgccaacgaguugaauuauauucugugggaaaacaacaucaaacucacgguuguggugggagacauuaucggcguacuggagcaggggaagaggaccuuaacuccacagccuauggagcugaaauacagcuggaagacauggggaaaagcgaagauagucaccgccgaaacacaaaauucaaguuucauuaucgauggccccaacacuccagagugccccuccgcuagccgggcauggaaugugugggaaguugaggacuaugguuuugggguguucaccacgaacauuuggcuuaaguugcgcgaagucuacacacagcucugugaccauagacugaugucugccgcugugaaagaugagagggccguucacgcagacaugggauacuggaucgagucacagaagaauggcaguuggaaacuagaaaaggcgagccugauagaggugaaaaccugcacuuggccuaagucccacacccucuggucuaacgguguacuggaaucggauaugaucauuccaaagagccuugccggcccgaucucccagcauaaucaccgucccggguaucauacacaaacugcuggaccuuggcacuugggcaaacuggaguuagacuuuaacuacugcgaggggaccacagucgugauuacggaaaauuguggaacccggggcccaucacuccgaacuacaaccgugagugguaagcugauccacgaguggugcuguagaucuugcacucuucccccucugagguauaugggggaagauggauguugguacggcauggagauacgcccaauuagcgaaaaagaggagaacauggucaaguccuugguuucagccgguagcggcaaaguggacaauuucacaauggggguacucugccuggcaauccuauuugaagaggugaugcggggaaaguucggcaagaaacauaugaucgcuggggucuucuuuaccuucgugcugcuccugucuggacagauuacguggagagauauggcccacacucuuaucaugauuggcuccaacgcaagugacaggauggguauggggguuaccuauuuggcccugauagcuacauuuaagauccagcccuucuuagcgcucggauuuuuccugcgcaaacuuaccagccgagaaaaucugcuacucggcgugggccuggccauggcaacuacauugcaacugccggaggauauugaacagauggcuaacgggaucgccuuaggacucauggcccugaaacuuauuacccaguuugagacauaccagcuguggacugcuuugaucucucucaccuguuccaauacgauguucacacugaccgucgcauggcggacugccacccuaauacuggcgggugugucacuucucccuguuugccaaaguagcucgaugcguaaaacagacuggcugccaauggcuguggccgcaaugggcgucccaccuuugccccuguuuaucuucuccuuaaaggauacucucaagagaaggucuuggccacugaacgaggggguaauggccgugggacuuguuagcauucuggcuucaaguuugcuccgcaacgacgugccuauggcaggcccccuggucgccggugggcuacugaucgcguguuaugugauuaccggaacguccgcugaucuuacaguagaaaaagccgcagacaucaccugggaggaagaggccgaacagacuggcgugucucauaaucucaugauaacagucgacgaugacggcaccaugcggauuaaggaugacgagacugagaacauccugacaguuuuguuaaaaaccgcucugcucaucgugagcgggguguuuccauacuccauuccggccacgcugcuugucuggcacacuuggcagaagcagacccaaagaucaggagugcugugggauguuccuagucccccagaaacacagaaagcagaguuggaagaggguguauacaggauaaagcagcagggcaucuucgggaaaacccaagugggagucggcgugcagaaggaggguguuuuucauacaauguggcacgugacucgaggggcuguccuaaccuauaauggaaagcgccuggaacccaacugggccagugugaaaaaggaccucauuucuuacggcggcggguggcggcuguccgcgcaguggcaaaaaggagaggaaguacaggucaucgccguggagccugguaagaaucccaagaacuuccagacgaugcccggcacauuccagacuaccacaggggaaauuggagcaaucgcucuugauuuuaagccuggcaccagcgguucgccgauaaucaauagagaggggaagguugugggauuauauggcaacggcgucgugacuaaaaaugggggauacguuucagguauugcccaaaccaaggcugagccagacggccccacaccugaacuggaggaagagauguucaaaaagaggaaccucacgaucauggauuugcacccagggucuggaaaaacucguaaguaucugcccgcaauugugcgcgaagccaucaagcggagacucaggacccugauacuugccccuacacgagucguggcugcggagauggaggaagcacugaaaggcuugccgauucgguaccagaccacugccacaaagagugagcauaccggucgcgaaaucguagaccuaaugugccacgcuacguuuacuaugagacugcucucccccgugaggguuccaaauuauaacuuaaucauuauggaugaggcccauuucacagacccugcaagcaucgccgcucggggguacauaucuacccgagucggaaugggcgaagcgagcgccauuuuuaugaccgcaacucccccaggcacagcugaugccuucccucaguccaaugcacccauccaggacgaggagagagacauuccagaacgcucauggaacagugggaaugaguggaucaccgauuuugccggaaaaacagugugguucgugccgagcauaaaggcugguaacgacauugccaacugucugaggaaaaauggcaagaaggucauccaacuuucucguaaaacuuuugauacggaauaccagaagaccaaacugaacgacugggauuucguagugacaacugacaucuccgagaugggggcgaauuuuaaggcagaucggguuauugacccuagaaggugccucaaacccgugaucuugaccgauggaccagagcgcgucauucuggccggccccaugccugugacagcugccucagcugcacagcgaagaggucggguugggaggaacccacagaaggaaaaugaccaauauauauucaccggccagccccucaacaaugaugaggaccacgcccauuggacugaagcuaagaugcugcuugacaacaucaauacgccugagggaauuaucccggcccuauucgaaccagagcgcgagaaaagugcagcgaucgauggcgaauaccgucugaagggggagagcagaaaaaccuuuguggaauugaugcggaggggagacuuacccgucuggcuggcccacaagguggcuuccgaggguauuaaauauacagaucgcaaguggugcuucgacggccagcgaaacaaucagauacucgaagagaacauggauguagagaucuggacuaaagaaggggagaagaagaaacugagaccucgguggcuugacgccaggaccuacucugauccccuggcacucaaggaauuuaaagacuucgcugccggacgcaagucgauugcauuggaucuggugacagagaucggcagaguuccaagccaccuagcccauaggacccggaaugcucuggacaaccucgucaugcuucacacuucagaacauggugggcgugcguaucgccacgccguggaggagcugccugaaacaauggagacguuauugcugcucggccugaugauucuucugaccggaggcgcaaugcucuuuuugaucuccgggaaaggaauagguaagacaagcaucggccugauuugugugaucgcuucuagcgggauguuauggauggccgaaauuccccuacaauggaucgccuccgcaauaguccuggaguucuuuaugaugguucuccuuauuccagagccugaaaagcagcgaacaccgcaggauaaucaacuggcuuacgugguaaucggaauuuugacccuggccgcgaucauagcugccaacgagaugggccuccuggaaaccacaaaaagagaccuugguaugucaaaggagcccucuguggucagcccaacaaguuaucucgauguggaccugcacccugcauccgccuggacguuguacgcuguugcaaccacagugaucacucccaugcugaggcauaccauugaaaauagcacagccaacgucucuuuagcggcuaucgccaaccaggcaguagugcuaauggggcuggacaaaggcuggccaauuucaaagauggaucucggaguuccucuucuggccuugggcugcuacucccaggugaauccccugacccucacugcugccgucuuccugcuuaucacgcacuaugcaauaauugggccgggauuacaggcuaaagccacacgggaggcgcaaaagcgcaccgccgcaggcaucaugaagaacccaacuguggacgguaucaugaccauugaucuggacccugucaucuacgauaguaaauuugagaagcagcucggacaggugauguugcugguucuaugugcugugcagcugcuccuuaugagaacaagcugggcccugugcgaagcauugacucuggcuaccggacccauaacaacgcucugggagggcucgccagguaaauucuggaauaccacuauugccguaucuauggccaacaucuuuaggggcuccuaucuggcgggggcuggauuagcauucagcauuaugaagucagugggcacagggaaacggggaaccggcagucaaggugaaacucuuggggagaaguggaagaaaaagcugaaucagcucucucgaaaagaauuugaccuauacaagaaauccggaaucacagaggucgauagaaccgaggccaaggaaggccugaaacgcggugagauaacgcaucacgcuguuagcaggggcucagccaaguugcagugguucguggaacggaacauggucauccccgaggggcgugugauugaccugggauguggcagagggggauggaguuauuacugcgcaggccucaagaaaguaaccgaagugagggguuauacaaaaggcgggccugggcaugaggagccgguucccaugagcacuuacggcuggaauaucgugaaacuuauguccgggaaggaugucuucuaccugccaccugaaaaaugugacaccuugcugugcgauauuggagagucuagccccuccccuacaguggaagagucacgcacuauccggguccucaagaugguggagccaugguuaaagaacaaucaguuuuguauuaaaguucugaaccccuauaugccuaccguaaucgaacaccuugagcgacugcaaagaaagcacgguggcaugcuagugaggaauccacucucucgcaacaguacacaugaaauguacuggauaucgaaugggaccggaaacauugucgccagcgugaauaugguuucccggcuguugcugaacagauucacuaugacgcaccguaggcccacaaucgagaaagacguggaucucggcgcugguacccggcaugucaacgcggaaccggagacuccuaauauggacgugaucggggagcgcauuaagcgaauaaaagaggaacacaacucuaccuggcacuaugacgaugaaaauccauacaagacaugggccuaucauggaucauacgagguaaaggcaacgggcagcgcuuccaguaugaucaacggcgugguuaaacuucugaccaagcccugggacgucgugccuauggugacucagauggccaugacagauaccacuccauuugggcagcaaagagucuucaaagaaaagguugacacaaggacaccccggucuaugccgggaacacgcagagugauggguauuacugcagagugguuauggaggacccugggccgaaauaaaaagccucgguugugcacgcgugaggaauuuaccaagaaaguaagaacaaacgccgcuaugggggccguguucacugaggaaaaucagugggauagcgcgaaggcagccgucgaggacgaagauuuuuggaaacucguggaccgcgagagggagcugcacaagcuaggaaaauguggcucaugcguuuauaacaugauggguaagcgggagaagaaacuuggggaguucggaaaggcuaaaggcuccagagccaucugguacauguggcugggcgcacgcuaccucgaauuugaggcucugggguucuugaaugaggaucauugguuuaguagggaaaacagcuauucuggaguggagggugaaggccugcacaagcucggguacauucuucgagacaucuccaaaauacccggaggcgccauguaugcugaugacaccgccgguugggacacacggaucacugaggaugaccugcauaaugaagagaagauuacccagcagauggauccagagcacagacaauuagcaaacgcgaucuucaaacugacguaccagaauaaggucgugaagguacagaggccuacacccaccgggacuguuauggacauuaucucacgcaaagaucagcguggaagcggccaagugggcacauauggguugaacaccuuuacuaauauggaagcccagcucauacggcagauggagggagaagguguccugucgaaggcugaccuagagaacccacaccuucccgagaagaagauuacccaguggcuggagacaaaaggcguggagagacucaagaggauggccaucucuggggaugacugcguggucaagccuaucgaugaccgcuucgcaaacgcucuguuggccuuaaaugauaugggaaaaguucgaaaggacauuccacaauggcagccgaguaaaggcuggcaugauuggcaacaggugcccuucuguucccaccauuuucacgaacugauaaugaaggacggucggaaacucguagugccuugcagaccacaagacgagcuuaucgggagggcacgcauuagccagggagccggcuggucacugagagaaacggcgugucuaggcaaggcuuacgcccagauguggucccugauguauuuccaccggagggaucuccguuuggcaucuaacgccaucugcagcgcuguccccgugcauuggguuccuaccagucgaacuacaugguccauucacgcccaucaccaauggaugaccacugaggacaugcugacaguguggaaucgcgucuggaucgaagauaacccauggauggaggacaagacccccgugacgacaugggagaauguaccuuaccuugggaaaagagaagaucagugguguggaagccugauaggucucaccucucgggcaacuugggcucagaacaucccgaccgccauucagcaaguuaggucauuaaucggcaaugaggaauuucuggacuacaugccaaguaugaagcgcuucagaaaagaggaggaauccgagggggcgauuugguga

SEQ ID NO: 15165 - RNA, 9873 nt, Artificial Sequence
  derived and/or modified CDS sequence (opt3) from DENV-3__GU131869__SS-prME
accagccugugccucgugaugauccuucccgcagcucuggcauuccacuugacaucccgggacggcgagccuaggaugauugucgggaagaacgaacggggaaagucuuuacuguuuaagacugcaucagguauaaauauguguacguuaaucgcgauggaucucggcgagaugugcgacgauaccguuacauacaaauguccacauauuacugaaguggagccggaagacaucgauugcugguguaaccugaccaguacauggguaaccuaugggacuugcaaucaggcuggagagcgccgacgugacaagagaagcguggcccuugcaccccacgucggcaugggucuggauacaaggacccagacguggauguccgccgagggggcuuggagacagguggaaaaaguugagacuugggcauugcgccauccuggauucaccauucucgcccuguuucuggcucacuacaucggcacaucucucacucagaagguggucauauucaucuuacugaugcuugugaccccaucgaugacaaugagauguguaggcguugggaacagggacuuuguggaaggauugucaggugccaccugggucgauguggugcuggagcauggcgggugcgucacgacuauggcgaagaauaaacccacacuagacauugagcuccagaagaccgaagcaacucaacuggccacacuucggaaacuguguaucgagggaaagauuaccaacaucacgaccgauagccgcugcccuacacagggcgaagcuguuuugccagaggaacaggaccagaauuauguguguaaacacacuuacguagaucgagguugggggaacggaugcggccucuucggcaaggggagucuggugaccugcgccaaguuucaauguuuagagcccauagagggaaaagucgugcaguaugaaaaucugaaguacacaguuauuaucacugugcacaccggugaccagcaucaggucggcaacgagacacaaggggugaccgcagaaauuacuccucaggcuuccacgacagaggccauccucccagaauauggaacccuuggccuggagugcucuccgagaacugguuuggacuucaaugagaugauccuacugaccaugaaaaacaaggcguggaugguacacaggcagugguuuuucgaucucccccugccuuggacaagcggggccaccacugaaacaccaacguggaaucggaaagagcuucugguuaccuuuaagaacgcacaugcuaaaaagcaagaaguggucguguugggcucccaggagggagccaugcacacugcucucacaggcgccaccgaaauucaaaauucagggggaacaaguauauucgcaggucaccugaagugucguuuaaaaauggacaagcuggagcuaaaaggcaugagcuacgccaugugcacuaacaccuuuguccucaagaaagaggugucugaaacgcagcaugggaccauccugauuaagguugaguaccgcggagaagaugcucccuguaagaucccuuucuccacagaggacggccaagguaaagcgcacaacgggagacuuauaacugcaaauccagugguaaccaagaaagaggaacccgucaacauugaggccgaaccgccuuucggcgagucaaauaucgugaucggaauuggcgauaacgcuuugaagaucaauugguauaaaaaggggagcaguauuggaaagauguuugaagccacagcaaggggugcccggcgaauggcuauacugggcgacaucgccugggauuucgggucuguuggaggcgugcucaacucccuggguaaaaugguccaucagauuuuugggagcgcauacacugcgcuuuucucgggcgugucuuggguaaugaagaucggaaucggcauucuguugaccuggauagggcucaauuccaaaaacacgucaaugaguuuuagcugcaucgcuauuggaaucauuacacuguauuuaggcgccgugguucaggcagacauggguugugucaucaauuggaaggggaaagagcugaagugcggauccggcauauucgugaccaacgaggugcacacuuggacagaacaguacaaguuucaagccgauucucccaaacgccuagcuaccgccaucgccggugcuugggagaauggcgucugugggauuagaagcacuaccaggauggaaaaccuccuguggaagcagaucgccaaugagcuuaacuauauuuugugggaaaauaacaucaaacugacaguuguggugggagacauaauuggcguacucgagcaggggaagcggacgcugaccccacagccuauggaguuaaaauacucauggaagacuuggggaaaagcgaagaucgucacagccgaaacccaaaacaguuccuucauuaucgauggccccaauacaccagagugccccagcgcuucucgcgcauggaacgugugggaaguugaggacuaugguuuugggguguucacuaccaauauauggcugaaacuuagagaagucuacacgcaguugugugaccauaggcucaugucagccgcugugaaagaugagcgugccguucacgcagacaugggauacuggaucgagagucagaagaacggcagcuggaaacuggaaaaggcgucccuaauugaggugaaaacaugcaccuggccuaagucucacacucuguggucgaaugguguacucgaaagcgauaugaucauuccaaagucccuggccggcccgaucucacagcauaaccaccggcccggguaucauacccaaacagcuggaccuuggcaccuuggcaaauuggagcuggacuuuaauuacugcgaggggacuaccgucgugauaacagaaaacuguggaacgcgaggcccaaguuuaagaaccacuacagugucugguaagcucauucacgaguggugcuguaggagcugcacccugcccccucuucgcuauaugggggaagauggauguugguacggcauggagauccggccaaucuccgaaaaagaggagaauauggucaagucacugguuagcgccgguucuggcaaaguggacaacuucacuauggggguauugugccucgcaauucuguuugaagaggugaugagaggaaaguucggcaagaaacauaugaucgcuggggucuucuuuacauucgugcuacugcucuccggacagauuaccuggagggauaugacgcacacucugauaaugaucggcaguaaugccagcgaccgcauggguauggggguuaccuaucuugcauugauugccacauuuaagauccagcccuuccuggcuuuaggauuuuuccuccgaaaacugaccucucgggaaaaccuucugcuaggcgugggccucgcgauggccacuacacugcaauugccggaggauauugaacagauggcaaaugggaucgcucugggauuaauggcccucaagcugauaacccaguuugagacauaccagcuuuggacugcccugaucuccuugaccuguucaaacacgauguucacacucaccgucgcuuggcguacugcaacccugauucuagccggugugagucugcuuccuguuugccaaagcucguccaugagaaaaacagacuggcucccaauggcgguggcugccaugggcgucccaccucugcccuuguuuaucuucucucugaaggauacuuuaaagaggcgcagcuggccacucaaugaggggguaauggcagugggacugguuucaauucuugccaguucccuguugcggaacgacgugccuauggcuggcccccucgucgccggugggcugcuaaucgccuguuaugugauaaccggaacgucugcggaucugacaguagaaaaagcugccgacauuaccugggaggaagaggcagaacagacuggcgugagccauaaccuuaugaucacagucgacgaugacggcaccaugagaaucaaggaugacgagacugagaauauucucacaguucuguugaaaaccgccuuacugauaguguccgggguguuuccauacucaaucccggcuacgcuccuggucuggcacacuuggcagaagcagacccaaaggagcggagugcuuugggauguuccuagucccccagaaacacagaaagccgagcuggaagaggguguauaccgaauuaagcagcagggcaucuucgggaaaacccaagugggagucggcgugcagaaggaggguguuuuucauacaauguggcacgugacucgcggggcagucuugaccuauaacggaaagcggcuagaacccaauugggcuucugugaaaaaggaccugauuuccuacggcggcggguggagacucagcgcccaguggcaaaaaggagaggaaguacaggucaucgcgguggagccugguaagaaccccaagaauuuccagacgacacccggcacuuuccagaccacaaccggggaaauaggagccaucgcacuggauuuuaagccuggcacuucggguucaccgauuaucaacagggaggggaagguugugggacuuuauggcaauggcgucgugaccaaaaacgggggauacguuucugguauugcucaaacaaaugccgagccagacggccccacgccugaauuagaggaagagauguucaagaaacguaaccugacuaucauggaucuccacccagggaguggaaagacccgcaaauauuugcccgcuauaauucgggaagcaaucaagagaaggcugcgaacacucauccuggccccuacccggguggucgccgcugagauggaggaagcgcuuaagggccugccgauucgcuaccagacuacagcaaccagauccgagcauacggguagggaaaucguggacuugaugugccacgccacuuuuacaaugcggcuacugagccccguacgagugccaaauuauaaccucauaauuauggaugaggcucauuucaccgacccugccucuaucgcagccagaggguacauuagcacccgcguuggaaugggcgaagcugcggccaucuuuaugacugcaacacccccaggcaccgcugaugccuucccucaguccaaugcacccauacaggacgaggagagggacauuccagaacguucauggaacagugggaaugaguggaucacagauuuugccggaaaaacugucugguucgugccgagcaucaaggcugguaacgacauugccaacuguuuacggaaaaauggcaagaaagugauccaacugucuagaaagacguuugauaccgaauaccagaagacaaaacuuaacgacugggauuucgucguaacuaccgacauuuccgagaugggggcgaauuuuaaggcagauagggugauagacccucgccgaugccugaaacccguuauccucacagauggaccagagagagugauuuuggccggccccaugccugucaccgcugccucagcugcacagcggaggggucgcguggggcguaacccacagaaggaaaaugaccaauauaucuucacuggccagccccugaacaaugaugaggaccacgcccauuggacggaagcuaaaaugcuccuggacaacaucaauaccccugagggaauuauaccggcccuuuucgaaccagagagagagaagagugcagcgaucgauggcgaauaccggcuaaagggggagagcaggaaaacauuuguugaacugaugcgccgaggagacuugcccgugugguuagcccacaaggucgcuuccgaggguauuaaauauacugauagaaaguggugcuucgacggccagcggaacaaucagauccuggaagagaacauggauguggagauuuggaccaaagaaggggagaagaaaaagcucaggccucgcuggcuggacgccagaacauacucugauccccuugcacugaaggaauuuaaagacuucgcugccggaaggaagucgaucgcacucgauuugguaaccgagauaggccgggugccaagccaccuggcccaucguacucgcaaugcucuagacaaccugguuaugcuccacacaucagaacauggugggcgagcguauagacacgccgucgaggagcuuccugaaacgauggagacccuguuauugcugggccucaugauccugcuuacuggaggcgcaaugcuguuucucauuuccgggaaaggaaucgguaagacaaguauuggcuugaucugugugauagcuucuagcgggaugcuguggauggccgaaauucccuuacaauggaucgccuccgcaauugugcuagaguucuuuaugaugguccugcucaucccagagccugaaaaacagaggaccccgcaggauaaucaacuugcuuacguugugauaggaauccugaccuuggccgcgauuaucgcugccaacgagaugggccugcucgaaacaacuaagcgggaccuggguaugucaaaggagcccgggguagugucuccaacgagcuaucuugaugucgaccuccacccugcaagugccuggacccuguacgcuguggcaacaacuguuauuacccccauguugcgccauacaaucgaaaauuccaccgccaacgugagccuggcggcuauagccaaccaggcagucguauuaaugggccuagacaaaggauggccaauuucuaagauggaucugggcgugccucuccuugcccuggggugcuacucacagguuaaucccuugacucugacggcugccgugcuccugcuuaucacacacuaugcaaucauuggaccgggcuuacaggcuaaagccaccagagaggcgcaaaagaggacugccgcagguaucaugaaaaacccaaccgucgacgggauaaugacaauugaucuggacccugugaucuacgauuccaaguucgagaagcagcucggacaggucauguugcuggugcuaugugcuguucagcugcuccuuaugcggacaaguugggcccugugcgaagcauugacccuggcuacaggccccauuacgacccucugggaggguagcccaggcaaauuuuggaauacuacaaucgccgugucgauggccaacauauuccgagggucuuaucuggcgggagcuggcuuagcauuuuccaucaugaaaagcguagggaccggaaaaagaggcacugguucacaaggggaaacacuuggagagaaguggaaaaagaagcugaaucagcucagucgcaaagaguucgaccuauacaagaaaucuggcauuaccgagguggauaggacggaggccaaggaaggucugaaacggggcgagaucacccaucacgcugucucccgugggagcgccaaguugcagugguuuguugaaagaaacauggugauucccgagggaagggucaucgaccugggcugugggcgcggaggcuggucauauuacugcgcaggucucaaaaaggugacagaaguacggggguauacuaagggaggcccuggccaugaggagccggugcccaugaguaccuacggguggaauauuguuaaacuuaugagcggaaaggauguguucuaccugccaccugaaaaaugugacacauugcugugcgauaucggugaguccucucccagcccuacugucgaagagucccgaaccauaagagugcucaagauggucgagccauggcuaaagaacaaucaguucuguauuaaggugcugaaccccuauaugccuacaguuaucgaacaccuugagaggcugcaacgcaagcacggcgggaugcuaguacggaauccacucucaagaaacucuacccaugaaauguacuggaucaguaauggaacuggcaacauuguggccucggucaauauggugagccgucuguugcugaacagguuuacgaugacacaccggcgccccaccauagagaaagacguugaucucggugcugggacucgacaugugaacgcggaaccggagaccccuaauauggacgucaucggagagagaauuaagaggaucaaagaagaacacaacuccacauggcacuaugacgaugaaaauccauacaagacgugggccuaucauggcucuuacgaggugaaagcaaccggcucagcuagcuccaugauuaacgggguagugaaacuucugacuaagcccugggacguugucccuauggugacacagauggccaugaccgauacuacaccauucggacagcaacggguguuuaaagaaaaggucgacacccgcacacccagaaguaugccggguacuaggcgaguuauggagaucaccgcagagugguuauggcggacgcugggccguaauaaaaagccuagauugugcacccgcgaagaguucacuaagaaggugaggacuaacgccgcuaugggggccguauuuaccgaagagaaucagugggauucugcgaaggcagccguggaagacgaggauuucuggaaacucgucgaccgggagagagaacugcacaagcuaggaaaauguggcagcugcguguauaacaugauggguaagcgcgagaagaaacuuggggaauuuggaaaagcuaaaggcucaagggccauaugguacauguggcugggcgcacgauaccucgaguucgaggcucugggguuuuugaaugaagaucauugguucucccgggagaacaguuauagcggaguugaaggugagggccugcacaagcucggguacauccuuagagacauuucuaaaauccccggaggcgccauguaugcugaugacacagccgguugggacacuaggauuaccgaagaugaccugcauaaugaggagaagaucacgcagcagauggauccagaacaccgccaauuagcaaacgcgauauuuaaacugacauaccagaauaagguggucaaagugcagcguccuacccccacugggacaguaauggacauuaucucccggaaggaucagagaggaucaggccaaguuggcaccuauggguugaacacuuucaccaauauggaggcccagcucaucaggcagauggaaggagagggugugcugagcaaggcugaccuagaaaacccacaccuucccgagaaaaagauuacacaguggcuggagacgaaaggcgucgaacgccucaagcgaauggccauaucgggggaugacugcguggugaaaccuaucgaugaccgguuugcaaacgcucuguuggccuuaaaugauaugggaaaggucagaaaggacauuccacaauggcagccgucuaaaggcuggcaugauuggcagcagguucccuucuguagucaccauuuccacgagcugaucaugaaggacgguaggaaacucgugguaccuugccgcccacaagacgaacuuauugggagagcacggaucucccagggagccggcuggagccugagggagaccgcgugucuaggcaaggcuuacgcccagauguggucacugauguauuuucaccgucgagaucuccgcuuggcauccaacgccauaugcucugcugugcccguccauugggugccuacuagcagaacaaccuggaguauccacgcccaucaccaauggaugacuacagaagacaugcugaccguuuggaaucggguguggauugaggauaacccauggauggaggacaaaacgcccgucacaaccugggaaaaugugccuuaccuugggaagagggaggaucagugguguggaucccugaucggucucacuagccgcgcaaccugggcucagaacauuccgacagccauccagcaaguaagaucuuuaauuggcaaugaagaguuccuggacuacaugccaucaaugaagcgguuuaggaaagaggaagagagugaaggggcgauaugguga

SEQ ID NO: 15166 - RNA, 9873 nt, Artificial Sequence
  derived and/or modified CDS sequence (opt3) from DENV-3__GU131870__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcgccgacgugacaagagaagcguagcccuugcaccccacgugggcaugggucuggauacaaggacccaaacguggauguccgccgagggggcuuggcggcaggucgaaaaaguggagacuugggcauugcgccauccuggauucaccauucucgcccuguuucuggcucacuacaucggcacaucucucacucagaagguugugauauucaucuuacugaugcuugucaccccaucgaugacaaugagaugugugggcguagggaacagggacuuuguugaaggauugucaggugccaccuggguggaugucgugcuggagcauggcgggugcgugacgacuauggcgaagaauaaacccacacuagacauugagcuccagaagaccgaagcaacucaacuggccacacuucggaaacuguguaucgagggaaagauuaccaacaucacgaccgauagccgcugcccuacacagggcgaagcugucuugccagaggaacaggaccagaauuauguuuguaaacacacuuacguggaucgagguugggggaacggaugcggccucuucggcaaggggagucugguaaccugcgccaaguuucaauguuuagagcccauagagggaaaagugguccaguaugaaaaucugaaguacacagugauuaucacuguucacaccggugaccagcaucaggugggcaacgagacacaaggggucaccgcagaaauuacuccucaggcuuccacgacagaggccauccucccagaauauggaacccuuggccuggagugcucuccgagaacugguuuggacuucaaugagaugauccuacugaccaugaaaaacaaggcguggauggugcacaggcagugguuuuucgaucucccccugccuuggacaagcggggccaccacugaaacaccaacguggaaucggaaagagcuucugguaaccuuuaagaacgcacaugcuaaaaagcaagaaguuguggucuugggcucccaggagggagccaugcacacugcucucacaggcgccaccgaaauucagaauucagggggaacaaguauauucgcaggucaccugaagugucguuuaaaaauggacaagcuggagcuaaaaggcaugagcuacgccaugugcacuaacaccuuugugcucaagaaagaggucucugaaacgcagcaugggaccauccugauuaagguggaguaccgcggagaagaugcucccuguaagaucccuuucuccacagaggacggccaagguaaagcgcacaacgggagacuuauaacugcaaauccaguugugaccaagaaagaggaacccguaaacauugaggccgaaccgccuuucggcgagucaaauaucgucaucggaauuggcgauaacgcuuugaagaucaauugguauaaaaaggggagcaguauuggaaagauguuugaagccacagcaaggggugcccggcgaauggcuauacugggcgacacugccugggauuucgggucugugggaggcguucucaacucccuggguaaaauggugcaucagaucuuugggagcgcauacaccgcgcuuuucucgggcgucucuugggugaugaagauuggaaucggcauccuguugacguggauugggcucaauuccaaaaacacaucaaugaguuuuagcugcauagcuaucggaauuaucacccuguauuuaggcgccguagugcaggcagacauggguuguguuauuaauuggaaggggaaagagcugaagugcggauccggcaucuucgucacuaacgaggugcacacauggaccgaacaguacaaguuucaagccgauucucccaaacgccuagcuacugccauagcaggugcuugggagaauggcgugugugggaucagaagcaccacaaggauggaaaaccuccuguggaagcagauugccaaugagcuuaaccauaucuugugggaaaauaacauuaaacugacggucguugugggagacaucauaggcgugcucgagcaggggaagcggacccugacuccacagccuauggaguuaaaauauucauggaagacauggggaaaagcgaagauuguaaccgccgaaacacaaaacaguuccuucaucauugauggccccaauacuccagagugccccagcgcuucucgcgcauggaacgucugggaaguggaggacuacgguuuugggguuuucaccacgaauaucuggcugaagcuuagagaaguguauacacaguugugugaccacaggcucaugucagccgcugucaaagaugagcgugccgugcacgcagacaugggauacuggauagagagucagaagaacggcagcuggaaacuggaaaaggcgucccuaaucgagguuaaaaccugcacuuggccuaagucucauacccuguggucgaauggugugcucgaaagcgauaugauuaucccaaagucccuggccggcccgauuucacagcacaaccaucggcccggguaccacacacaaacugcuggaccuuggcaccuuggcaaauuggagcuggacuuuaauuauugcgaggggaccacaguagucaucacggaaaacuguggaacccgaggcccaaguuuaagaacuacaaccgugucugguaagcucauacaugaguggugcuguaggagcugcacucugcccccucuucgcuacaugggggaagauggauguugguauggcauggagauucggccaaucuccgaaaaagaggagaauauggugaagucacuggucagcgccgguucuggcaaaguugacaacuucacaauggggguguugugccucgcaauccuguuugaagagguaaugagaggaaaguucggcaagaaacacaugauugcugggguguucuuuaccuucguccuacugcucuccggacagaucacguggagggauaugacucauacccugauuaugauaggcaguaaugccagcgaccgcauggguaugggggugacauaccuugcauugaucgccaccuuuaagauucagcccuuccuggcuuuaggauuuuuccuccgaaaacugacuucucgggaaaaccuucugcuaggcguuggccucgcgauggccacaacccugcaauugccggaggauaucgaacagauggcaaaugggauugcucugggauuaauggcccucaagcugaucacacaguuugagacuuaucagcuuuggaccgcccugauauccuugacguguucaaacacaauguucacccucacuguggcuuggcguaccgcaacacugauccuagccggugucagucugcuuccugugugccaaagcucguccaugagaaaaacugacuggcucccaauggcgguugcugccaugggcgugcccccucugcccuuguuuauuuucucucugaaggauaccuuaaagaggcgcagcuggccacucaaugagggggucauggcaguaggacuggugucaauccuugccaguucccuguugcggaacgacguuccuauggcuggcccccucguggcaggugggcugcuaauugccuguuacgucaucacgggaacaucugcggaucugauaguggaaaaagcugccgacauuaccugggaggaagaggcagaacagacuggcguaagccacaaccuuaugaucacaguggacgaugacggcaccaugagaaucaaggaugacgagacugagaauauucucacaguccuguugaaaaccgccuuacugauaguuuccgggguguuuccauauucaaucccggcuacgcuccugguguggcauacuuggcagaagcagacccaaaggagcggaguccuuugggaugugccuagucccccagaaacacagaaagccgagcuggaagaggguguuuaccgaauuaagcagcagggcaucuucgggaaaacccaaguaggagugggcguccagaaggaggguguguuucacacaauguggcacguuacucgcggggcaguguugaccuacaacggaaagcggcuagaacccaauugggcuucugucaaaaaggaccugauuuccuauggcggcggguggagacucagcgcccaguggcaaaaaggagaggaagugcagguaaucgcggucgagccugguaagaacccaaaaaauuuccagacgaugcccggcacauuccagacuaccacaggggaaauaggagccaucgcacuggauuuuaagccuggcaccucggguucaccgauuaucaacagggaggggaaggugguuggacuuuacggcaauggcguggucacuaaaaacgggggauaugugucugguauugcucaaaccaaugccgagccagacggccccacaccugaauuagaggaagagauguucaagaaacguaaccugacgaucauggaucuccauccagggaguggaaagacucgcaaauacuugcccgcuauaauucgggaagcaaucaagagaaggcugcgaacccucauccuggccccuacacggguuguggccgcugagauggaggaagcgcuuaagggccugccgauucgcuaucagaccacugcaacaaaauccgagcacaccgguagagaaaucgucgacuugaugugccaugccacguuuacuaugaggcuacugagccccgugcggguaccaaauuacaaccucauaauuauggaugaggcucacuucacagacccugccucuaucgcagcccgaggguauauuagcaccagagugggaaugggcgaagcugcggccaucuuuaugaccgcaacucccccaggcacagcugaugccuucccucaguccaaugcacccauacaggacgaggagcgcgacauuccagaaaggucauggaacagugggaaugaguggaucaccgauuuugccggaaagacaguuugguucgucccgagcaucaaagcugguaacgacauugccaacuguuuacguaagaauggcaaaaaggugauccaacugucucggaagacuuuugauacggaauaccagaaaaccaagcuuaacgacugggauuucguggucacaacugacauuuccgagaugggggcgaauuuuaaagcagauagaguaauagacccuaggcgcugccugaagcccgugauccucaccgauggaccagagcgaguuauuuuggccggccccaugccugugacagcugccucagcugcacagagacgggguagggucgggcgcaacccacagaaagaaaaugaccaauacaucuucaccggccagccccugaacaaugaugaggaccaugcccacuggacugaagcuaagaugcuccuggacaacaucaauacgccugagggaauuauaccggcccuuuucgaaccagagcgugagaagagugcagcgaucgauggcgaauauagacuaaaaggggagagccggaagaccuuuguggaacugaugaggcgcggagacuugcccguuugguuagcccacaaaguggcuuccgaggguauuaaguacacagaucgaaaauggugcuucgacggccagagaaacaaucagauccuggaagagaacauggaugucgagauuuggacuaaggaaggggagaaaaagaagcuccggccuagguggcuggacgcccgcaccuauucugauccccuugcacugaaagaauuuaaggacuucgcugccggaagaaaaucgaucgcacucgauuuggugacagagauaggcaggguaccaagccaucuggcccaccggacccguaaugcucuagacaaccuggugaugcuccauacuucagaacacggugggcgcgcguaccgacacgccguugaggagcuuccugaaacaauggagacgcuguuauugcugggccucaugauccugcuuaccggaggcgcaaugcuguuucucauuuccgggaagggaaucgguaaaacuaguauuggcuugaucugugucauagcuucuagcgggaugcuguggauggccgaaauucccuuacaauggaucgccuccgcaauugugcuagaguucuuuaugauggugcugcucaucccagagccugaaaagcagagaacaccgcaggauaaucaacuugcuuaugucguuauaggaauccugaccuuggccgcgauuaucgcugccaacgagaugggccugcucgaaaccacaaagagggaccuggguaugucaaaagagcccggggugguaucuccaacuagcuaccuugauguggaccuccauccugcaagugccuggacgcuguaugcugucgcaaccacagugauuacucccauguugcggcacaccaucgaaaauuccacagccaacguuagccuggcggcuauagccaaccaggcaguggucuuaaugggccuagacaagggauggccaauuucuaaaauggaucugggcguaccucuccuugcccuggggugcuacucacaggugaaucccuugacccugacugcugccguucuccugcuuaucacgcauuacgcaaucauuggaccgggcuuacaggcuaaggccacacgcgaggcgcaaaaaagaaccgccgcagguaucaugaagaacccaacuguggacgggauaaugaccauugaucuggacccugucaucuaugauuccaaguucgagaaacagcucggacaggugauguugcugguccuaugugcugugcagcugcuccuuaugaggacaaguugggcccugugcgaagcauugacucuggcuaccggccccauuacaacgcucugggaggguagcccaggcaaguuuuggaauaccacuaucgccguuucgauggccaacauauuccgggggucuuaccuggcgggagcuggcuuagcauuuuccaucaugaaaagcguggggacaggaaagcgaggcaccgguucacaaggggaaacucuuggagagaaauggaagaagaaacugaaucagcucaguagaaaggaauucgaccuauauaaaaagucuggcauuacagagguagaucgcaccgaggccaaagaaggucugaagaggggcgagaucacgcaccaugcugugucccgggggagcgccaaauugcagugguuugucgaacguaacaugguuauucccgagggaagagugaucgaccugggcugugggaggggaggcuggucauacuauugcgcaggucucaagaaggucaccgaagugcgcggguacacaaaaggaggcccuggccacgaggagccgguacccaugaguacuuauggguggaauauugugaagcuuaugagcggaaaagauguuuucuaccugccaccugaaaagugugacaccuugcugugcgauaucggugaguccucucccagcccuacaguggaagagucccggacuauacgaguccucaaaaugguggagccaugguuaaagaacaaucaguucuguauuaagguccugaaccccuacaugccuaccgugaucgaacaccuugagagacugcaaaggaaacauggcgggaugcuaguucgcaauccacucucacggaacucuacacacgaaauguauuggaucaguaauggaaccggcaacauuguagccucggugaauauggucagcagacuguugcugaaccguuuuacuaugacgcauaggcggcccacaauagagaaggacguggaucucggugcugggacccgccacguuaacgcggaaccggagacuccuaauauggacgugaucggagagcgaauuaaaagaaucaaggaagagcacaacuccaccuggcauuacgacgaugaaaauccauauaaaacaugggccuaccacggcucuuaugaggucaaggcaacgggcucagcuagcuccaugauuaacggggugguaaagcuucugaccaaacccugggacgugguuccuauggucacucagauggccaugacagauaccacuccauucggacagcaaaggguguuuaaggaaaaaguggacacacggaccccccgcaguaugccggguacaagaagggucaugggcaucacugcagagugguuauggcgaacccuggggcggaauaagaaaccucguuugugcacgagagaggaauucaccaagaagguucgcacaaacgccgcuaugggagccguguuuacugaggaaaaucagugggauucugcgaaagcagccguagaggacgaagauuucuggaagcucguggacagggagcgggagcugcauaaacuaggcaagugugguagcugcgucuacaacaugauggggaaaagagaaaagaaacuuggagaguuuggcaaggcuaagggcucacgcgccauaugguauauguggcugggggcaagguaccucgaauucgaggcucugggauuuuugaaugaggaucacugguucucccgagaaaacaguuacagcgguguggagggcgaagggcugcauaaacucggauauauccuucgggacauuucuaagauccccggcggugccauguacgcugaugacaccgccgggugggacacaagaauuacugaggaugaccugcacaaugaagagaaaaucacccagcagauggauccagagcacaggcaauuagcaaacgcgauauuuaagcugacguaucagaauaaaguugugaagguccagcgcccuacacccaccggaacugugauggacauuaucucccguaaggaucagcggggcucaggccaaguagggacauacggauugaacaccuucacuaauauggaagcccagcucaucagacagauggagggugaaggcguucugagcaaagcugaccuagagaacccacaucuucccgaaaagaaaauuacccaguggcuggagacaaaggggguggagaggcucaaacgcauggccauaucgggagaugacugcgucgugaagccuaucgaugaccgauuugcaaacgcucugguggccuugaaugauaugggcaagguccggaaagacauuccacaauggcagccgucuaaggguuggcacgauuggcagcagguucccuucuguagucaucacuuccacgaauuaaucaugaaagacgggagaaagcuggugguaccuugcaggccacaagacgagcucauuggacgcgcaagaaucucccagggcgccggcuggagccuucgggaaacggcgugucuggggaaagcuuaugcccagauguggucacuaauguacuuucauaggcgugaucugcgacucgcauccaacgccauaugcucugcugugcccguccacugggugccuaccagccgcacuacauggaguauccaugcccaccaucaauggaugaccacugaggacauguugacaguuuggaauagaguguggauugaagauaacccauggauggaggacaagacccccgucacgacaugggagaaugugccuuaucugggaaagcgggaagaucaguggugugguucccuuaucggccugaccagcagggcaacuugggcucagaacauuccgaccgccauccagcaaguacgcucucucauugggaaugaggaauucuuagacuacaugccaucaaugaaaagauuucggaaggaggaggaaagugagggagcgauaugguga

SEQ ID NO: 15167 - RNA, 9873 nt, Artificial Sequence
  derived and/or modified CDS sequence (opt3) from DENV-3__GU131871__SS-prME
accagccugugccucgugaugauccuucccgcagcucuggcauuccacuugacauccagagacggcgagccuagaaugauugucgggaagaacgaacggggaaagucuuuacuguuuaagacugcaucagguauaaauauguguacguuaaucgcgauggaucucggcgagaugugcgacgauaccguuacauacaaauguccacauauuacugaaguggagccggaagacaucgauugcugguguaaccugaccagcacauggguaaccuaugggacuugcaaucaggcuggagagcgccgacgugacaagagaagcguggcccuugcaccccacgucggcaugggucuggauacaaggacccagacguggauguccgccgagggggcuuggcggcaaguggaaaaaguugagacuugggcauugcgccauccuggauucaccauucucgcccuguuucuggcucacuacaucggcacaucucucacucagaagguggucauauucaucuuacugaugcuugugaccccaucgaugacaaugagauguguaggcguugggaacagggacuuuguggaaggauugucaggugccaccugggucgauguggugcuggagcauggcgggugcgucacgacuauggcgaagaauaaacccacacuagacauugagcuccagaagaccgaagcaacucaacuggccacacuucggaaacuguguaucgagggaaagauuaccaacaucacgaccgauagccgcugcccuacacagggcgaagcuguuuugccagaggaacaggaccagaauuauguguguaaacacacuuacguagaucgagguugggggaacggaugcggccucuucggcaaggggagucuggugaccugcgccaaguuucaauguuuagagcccauagagggaaaagucgugcaguaugaaaaucugaaguacacaguuauuaucacugugcacaccggugaccagcaucaggucggcaacgagacacaaggggugaccgcagaaauuacuccucaggcuuccacgacagaggccauccucccagaauauggaacccuuggccuggagugcucuccgagaacugguuuggacuucaaugagaugauccuacugaccaugaaaaacaaggcguggaugguacacaggcagugguuuuucgaucucccccugccuuggacaaccggggccacuacagaaacgccaaccuggaaucggaaagagcuucugguuacuuuuaagaacgcacaugcuaaaaagcaagaaguggucguguugggcagccaggagggagccaugcacacagcucucaccggcgccacagaaauucaaaauuccgggggaacuucaauauucgcaggucaccugaagugucguuuaaaaauggacaagcuggagcuaaaaggcaugaguuacgccaugugcaccaacacguuuguccucaagaaagaggugagcgaaacccagcaugggacaauccugauuaagguugaguaccgcggagaagaugcucccuguaagaucccuuucucuacugaggacggccaagguaaagcgcacaacgggagacuuauaaccgcaaauccagugguaacaaagaaagaggaacccgucaacauugaggccgaaccgccuuucggcgaguccaauaucgugaucggaauuggcgauaacgcuuugaagaucaauugguauaaaaaggggucaagcauuggaaagauguuugaagccacugcaaggggugcccggcgaauggcuauacugggcgacaccgccugggauuucgggaguguuggaggcgugcucaacucucuggguaaaaugguccaucagaucuuuggguccgcauacacggcgcuuuucagcggcgugucguggguaaugaagauuggaaucggcauccuguugacauggauugggcucaauucuaaaaacaccuccaugucauuuaguugcauagcuaucggaauuaucacucuguauuuaggcgccgugguucaggcagacauggguugugucauuaauuggaaggggaaagagcugaagugcggaagcggcaucuucgugacaaacgaggugcacaccuggacugaacaguacaaguuucaagccgauucccccaaacgccuagcuaccgccauagccggugcuugggagaauggcgucugugggaucagaucuacaacgaggauggaaaaccuccuguggaagcagauugccaaugagcuuaacuauaucuugugggaaaauaacauuaaacugaccguuguggugggagacaucauaggcguacucgagcaggggaagcggacucugacaccacagccuauggaguuaaaauacagcuggaagaccuggggaaaagcgaagauugucacagccgaaacucaaaacucaaguuucaucauugauggccccaauaccccagagugccccuccgcuagccgcgcauggaacgugugggaaguugaggacuaugguuuugggguguucacgacaaauaucuggcugaaacuuagagaagucuacacccaguugugugaccauaggcucaugucugccgcugugaaagaugagcgugccguucacgcagacaugggauacuggauagagucacagaagaacggcaguuggaaacuggaaaaggcgagccuaaucgaggugaaaacuugcaccuggccuaagucccacacacuguggucuaaugguguacucgaaucggauaugauuaucccaaagagccuggccggcccgauuucccagcauaaccaccggcccggguaucauacucaaaccgcuggaccuuggcaccuuggcaaauuggagcuggacuuuaauuacugcgaggggacaacggucgugaucaccgaaaacuguggaacucgaggcccaucauuaagaacaaccacugugagugguaagcucauacacgaguggugcuguaggucuugcacacugcccccucuucgcuauaugggggaagauggauguugguacggcauggagauucggccaaucagcgaaaaagaggagaauauggucaagucccugguuucagccgguagcggcaaaguggacaacuucaccauggggguauugugccucgcaauccuguuugaagaggugaugagaggaaaguucggcaagaaacauaugauugcuggggucuucuuuacguucgugcuacugcucucuggacagaucacuuggagggauaugacccacacacugauuaugauaggcuccaaugccagugaccgcauggguauggggguuaccuaucuugcauugaucgccacuuuuaagauucagcccuuccuggcuuuaggauuuuuccuccgaaaacugacaagccgggaaaaccuucugcuaggcgugggccucgcgauggccaccacacugcaauugccggaggauaucgaacagauggcaaaugggauugcucugggauuaauggcccucaagcugaucacucaguuugagaccuaccagcuuuggacggcccugauaucuuugacauguuccaacaccauguucacucucaccgucgcuuggcguacagcaacucugauccuagccggugugucacugcuuccuguuugccaaaguagcucgaugagaaaaaccgacuggcucccaauggcgguggcugccaugggcgucccaccucugcccuuguuuauuuucucccugaaggauacguuaaagaggcgcucuuggccacucaaugaggggguaauggcagugggacugguuagcauccuugccucaagucuguugcggaacgacgugccuauggcuggcccccucgucgccggugggcugcuaauugccuguuaugugaucacaggaaccuccgcggaucugacuguagaaaaagcugccgacauaacaugggaggaagaggcagaacagaccggcgugucucauaaccuuaugauuacugucgacgaugacggcacaaugagaaucaaggaugacgagaccgagaauauccucacgguucuguugaaaacugccuuacugauugugagcgggguguuuccauacuccauaccggcuacccuccuggucuggcacacauggcagaagcagacccaaaggucaggagugcuuugggauguuccuagucccccagaaacacagaaagccgagcuggaagaggguguauaccgaaucaagcagcagggcauuuucgggaaaacucaagugggagucggcgugcagaaggaggguguuuuucauaccauguggcacgugacgcgcggggcagucuugacauauaacggaaagcggcuagaacccaauugggcuagugugaaaaaggaccugaucucuuacggcggcggguggagacucuccgcccaguggcaaaaaggagaggaaguacaggucauugcgguggagccugguaagaaccccaagaauuuccagacuacccccggcacauuccagaccacuaccggggaaaucggagccauagcacuggauuuuaagccuggcacaagcgguucgccgaucauuaacagggaggggaagguugugggacuuuauggcaauggcgucgugacgaaaaacgggggauacguuucagguaucgcucaaacuaaugccgagccagacggccccaccccugaauuagaggaagagauguucaagaaacguaaccugacaauuauggaucuccacccagggucuggaaagacccgcaaauauuugcccgcuaucauacgggaagcaauuaagagaaggcugcgaacucucauccuggccccuacacggguggucgccgcugagauggaggaagcgcuuaagggccugccgauccgcuaccagaccacggcaacuaaaagugagcauacagguagagaaauuguggacuugaugugccacgccaccuuuaccaugaggcuacugucccccguacgggugccaaauuauaaccucaucauaauggaugaggcucauuucacugacccugccagcauugcagcccgaggguacaucucuacaagaguuggaaugggcgaagcugcggccauuuuuaugaccgcaacacccccaggcacugcugaugccuucccucagagcaaugcacccauccaggacgaggagcgcgacauaccagaaagguccuggaacucagggaaugaguggauuacggauuuugccggaaagaccgucugguucgugccgaguaucaaagcugguaacgacaucgccaacuguuuacguaagaauggcaaaaaggugauucaacugagccggaagacauuugauacugaauaccagaaaaccaaacuuaacgacugggauuucgucguaacaaccgacaucucugagaugggggcgaauuuuaaagcagauagagugauugacccuaggcgcugccugaagcccguuauacucacugauggaccagagcgagugaucuuggccggccccaugccugucacggcugccuccgcugcacagagacgggguaggguggggcgcaacccacagaaagaaaaugaccaauauauuuucaccggccagccccugaacaaugaugaggaccacgcccauuggacagaagcuaagaugcuccuggacaacaucaauacuccugagggaaucauuccggcccuuuucgaaccagagcgugagaagucagcagcgauagauggcgaauacagacuaaaaggggagagucggaagaccuuuguugaacugaugaggcgcggagacuugcccgugugguuagcccacaaagucgcuagcgaggguaucaaguauacagaucgaaaauggugcuucgacggccagagaaacaaucagauucuggaagagaacauggauguggagaucuggaccaaggaaggggagaaaaagaagcuccggccuagguggcuggacgcccgcacuuacuccgauccccuugcacugaaagaauuuaaggacuucgcugccggaagaaaaucuauugcacucgauuugguaacagagaucggcagggugccaucgcaccuggcccaucggacgcguaaugcucuagacaaccugguuaugcuccacaccagcgaacauggugggcgcgcguaucgacacgccgucgaggagcuuccugaaacuauggagacacuguuauugcugggccucaugauacugcuuaccggaggcgcaaugcuguuucucaucucagggaagggaauugguaaaaccuccaucggcuugauuugugugaucgcuaguucugggaugcuguggauggccgaaauacccuuacaauggauugccagcgcaaucgugcuagaguucuuuaugaugguccugcucauuccagagccugaaaagcagagaacaccgcaggauaaucaacuugcuuacguugugaucggaauacugacuuuggccgcgaucauugcugccaacgagaugggccugcucgaaacgaccaagagggaccuggguauguccaaagagcccgggguagugucaccaacaucuuaucuugaugucgaccuccacccugcaagcgccuggacucuguacgcuguggcaaccacaguuaucacccccauguugcggcauacuauugaaaauaguacggccaacgugucccuggcggcuaucgccaaccaggcagucguauuaaugggccuagacaagggauggccaauaagcaaaauggaucugggcgugccucuccuugcccuggggugcuacucucagguuaaucccuugacacugaccgcugccgugcuccugcuuauuacucacuaugcaaucaucggaccgggcuuacaggcuaaggccacccgcgaggcgcagaagagaacagccgcagguauuaugaagaacccaacugucgacgggaucaugaccauagaucuggacccugugauuuacgauucaaaguucgagaaacagcucggacaggucauguugcuggugcuaugugcuguucagcugcuccuuaugaggacauccugggcccugugcgaagcauugacgcuggcuaccggccccaucacuacacucugggaggguaguccaggcaaguuuuggaauaccacuauugccgugagcauggccaacaucuuccgggggucguaucuggcgggagcuggcuuagcauuuucuauaaugaaauccguagggacaggaaagcgaggcaccgguagccaaggggaaacgcuuggagagaaauggaagagaaagcugaaucagcucucacgcaaagaguucgaccuauacaagaaaaguggcaucaccgagguggauaggacagaggccaaggaaggucugaaacggggcgagauuacucaucacgcugucucucguggguccgccaaguugcagugguuuguugaaagaaacauggugauccccgagggaagggucauugaccugggcugugggcgcggaggcuggagcuauuacugcgcaggucucaaaaaggugaccgaaguacggggguauacaaagggaggcccuggccaugaggagccggugcccaugucaacuuacggguggaauaucguuaaacuuaugaguggaaaggauguguucuaccugccaccugaaaaaugugacaccuugcugugcgauauuggugagagcucccccucuccuacagucgaagagagccgaaccaucagagugcucaagauggucgagccauggcuaaagaacaaucaguucuguauaaaggugcugaaccccuauaugccuacuguuauugaacaccuugagaggcugcaacgcaagcacggcgggaugcuaguacggaauccacucuccagaaacucaacgcaugaaauguacuggaucucuaauggaacaggcaacaucguggccagugucaauauggugucgcgucuguugcugaacagguuuaccaugacucaccggcgccccaccauugagaaagacguugaucucggugcugggacacgacaugugaacgcggaaccggagacgccuaauauggacgucauaggagagagaaucaagaggauuaaagaagaacacaacagcaccuggcacuaugacgaugaaaauccauacaagacuugggccuaucauggcuccuacgaggugaaagcaacaggcucugcuucaagcaugaucaacgggguagugaaacuucugaccaagcccugggacguugucccuauggugacucagauggccaugacagauaccacaccauucggacagcaacggguguuuaaagaaaaggucgacacucgcacccccagauccaugccggguacgaggcgaguuauggagauuaccgcagagugguuauggcggacacugggccguaauaaaaagccuagauugugcacucgcgaagaguucaccaaaaaggugaggacaaacgccgcuaugggggccguauuuacugaagagaaucagugggauagugcgaaggcagccguggaagacgaggauuucuggaaacucgucgaccgggagagagaacugcacaagcuaggaaaauguggcucuugcguguauaacaugauggguaagcgcgagaagaaacuuggggaauuuggaaaagcuaaaggcagcagggccaucugguacauguggcugggcgcacgauaccucgaguucgaggcucugggguuuuugaaugaagaucauugguucucacgggagaacuccuauaguggaguugaaggugagggccugcacaagcucggguacauacuuagagacaucagcaaaauucccggaggcgccauguaugcugaugacaccgccgguugggacacgaggaucacagaagaugaccugcauaaugaggagaagauuacccagcagauggauccagaacaccgccaauuagcaaacgcgaucuuuaaacugacuuaccagaauaagguggucaaagugcagcguccuacacccaccgggacuguaauggacauaauuucucggaaggaucagagaggauccggccaaguuggcaccuauggguugaacacauucacgaauauggaggcccagcucaucaggcagauggaaggagagggugugcugucaaaggcugaccuagaaaacccacaccuucccgagaaaaagaucacccaguggcuggagacuaaaggcgucgaacgccucaagcgaauggccauuagcggggaugacugcguggugaaaccuauagaugaccgguuugcaaacgcucuguuggccuuaaaugauaugggaaaggucagaaaggacaucccacaauggcagccgucgaaaggcuggcaugauuggcagcagguucccuucuguucucaccauuuccacgagcugauuaugaaggacgguaggaaacucgugguaccuugccgcccacaagacgaacuuaucgggagagcacggauuagucagggagccggcuggucccugagggagacagcgugucuaggcaaggcuuacgcccagauguggagccugauguauuuucaccgucgagaucuccgcuuggcaucaaacgccaucugcuccgcugugcccguccauugggugccuaccucuagaacuacauggagcauacacgcccaucaccaauggaugaccacggaagacaugcugacaguuuggaaucggguguggaucgaggauaacccauggauggaggacaaaacccccgucacuaccugggaaaaugugccuuaccuugggaagagggaggaucagugguguggaagucugauuggucucacaucccgcgcaacuugggcucagaacaucccgaccgccauucagcaaguaaggagcuuaaucggcaaugaagaguuccuggacuacaugccaucuaugaagcgguuuaggaaagaggaagagucagaaggggcgauuugguga

SEQ ID NO: 15168 - RNA, 9873 nt, Artificial Sequence
  derived and/or modified CDS sequence (opt3) from DENV-3__GU131872__SS-prME
accagccugugccucgugaugauccuucccgccgcucuggcauuccacuugacauccagagacggcgagccuaggaugauugucgggaagaacgaacggggaaaaucuuuacuguuuaagacugccucagguauaaauauguguacgcuaaucgcgauggaucucggcgagaugugcgacgauaccguuacauacaaauguccacauauuacugaaguggagccggaagacaucgauugcugguguaaccugaccaguacauggguaaccuaugggacuugcaaucaggcuggagagcgccgacgugacaagagaagcguggcccuugcaccccacgucggcaugggucuggauacaaggacccaaacguggauguccgccgagggggcuuggcggcagguggaaaaaguugagacuugggcauugcgccauccuggauucaccauucucgcccuguuucuggcucacuacaucggcacaucucucacucagaagguggucauauucaucuuacugaugcuugugaccccaucgaugacaaugagauguguaggcguugggaacagggacuuuguggaaggauugucaggugccaccugggucgauguggugcuggagcauggcgggugcgucacgacuauggcgaagaauaaacccacacuagacauugagcuccagaagaccgaagcaacucaacuggccacacuucggaaacuguguaucgagggaaagauuaccaacaucacgaccgauagccgcugcccuacacagggcgaagcuguuuugccagaggaacaggaccagaauuauguguguaaacacacuuacguagaucgagguugggggaacggaugcggccucuucggcaaggggagucuggugaccugcgccaaguuucaauguuuagagcccauagagggaaaagucgugcaguaugaaaaucugaaguacacaguuauuaucacugugcacaccggugaccagcaucaggucggcaacgagacacaaggggugaccgcagaaauuacuccucaggcuuccacgacagaggccauccucccagaauauggaacccuuggccuggagugcucuccgagaacugguuuggacuucaaugagaugauccuacugaccaugaaaaacaaggcguggaugguacacaggcagugguuuuucgaucucccccugccuuggacaagcggggccaccacugaaacaccaacguggaaucggaaagagcuucugguuaccuuuaagaacgcacaugcuaaaaagcaagaaguggucguguugggcucccaggagggagccaugcacacugcucucacaggcgccaccgaaauucagaauucagggggaacaaguauauucgcaggucaccugaagugucguuuaaaaauggacaagcuggagcuaaaaggcaugagcuacgccaugugcacuaacaccuuuguccucaagaaagaggugucugaaacgcagcaugggaccauccugauuaagguugaguaccgcggagaagaugcucccuguaagaucccuuucuccacagaggacggccaagguaaagcgcacaacgggagacuuauaacugcaaauccagugguaaccaagaaagaggaacccgucaacauugaggccgaaccgccuuucggcgagucaaauaucgugaucggaauuggcgauaacgcuuugaagaucaauugguauaaaaaggggagcaguauuggaaagauguuugaagccacagcaaggggugcccggcgaauggcuauacugggcgacacugccugggauuucgggucuguuggaggcgugcucaacucccuggguaaaaugguccaucagaucuuugggagcgcauacaccgcgcuuuucucgggcgugucuuggguaaugaagauuggaaucggcauccuguugacguggauugggcucaauuccaaaaacacaucaaugaguuuuagcugcauagcuaucggaauuaucacccuguauuuaggcgccgugguucaggcagacauggguugugucauuaauuggaaggggaaagagcugaagugcggauccggcaucuucgugacuaacgaggugcacacauggaccgaacaguacaaguuucaagccgauucucccaaacgccuagcuacugccauagcaggugcuugggagaauggcgucugugggaucagaagcaccacaaggauggaaaaccuccuguggaagcagauugccaaugagcuuaacuauaucuugugggaaaauaacauuaaacugacgguuguggugggagacaucauaggcguacucgagcaggggaagcggacccugacuccacagccuauggaguuaaaauacucauggaagacauggggaaaagcgaagauggucaccgccgaaacacaaaacaguuccuucauuaucgauggccccaauacuccagagugccccagcgcuucucgcgcauggaacgugugggaaguugaggacuaugguuuugggguguucaccacgaauauuuggcugaagcuuagagaagucuacacacaguugugugaccauaggcucaugucagccgcugugaaagaugagcgugccguucacgcagacaugggauacuggaucgagagucagaagaacggcagcuggaaacuggaaaaggcgucccuaauagaggugaaaaccugcacuuggccuaagucucacacccuguggucgaaugguguacucgaaagcgauaugaucauuccaaagucccuggccggcccgaucucacagcauaaccaccggcccggguaucauacacaaacugcuggaccuuggcaccuuggcaaauuggagcuggacuuuaauuacugcgaggggaccacagucgugauuacggaaaacuguggaacccgaggcccaaguuuaagaacuacaaccgugucugguaagcucauccacgaguggugcuguaggagcugcacucugcccccucuucgcuauaugggggaagauggauguugguacggcauggagauacggccaauuuccgaaaaagaggagaauauggucaagucacugguuagcgccgguucuggcaaaguggacaacuucacaauggggguauugugccucgcaauccuguuugaagaggugaugagaggaaaguucggcaagaaacauaugaucgcuggggucuucuuuaccuucgugcuacugcucuccggacagauuacguggagggauaugacucacacccugaucaugauuggcaguaaugccagcgaccgcauggguauggggguuacauaucuugcauugauagccaccuuuaagauccagcccuuccuggcuuuaggauuuuuccuccgaaaacugacuucucgggaaaaccuucugcuaggcgugggccucgcgauggccacaacccugcaauugccggaggauauugaacagauggcaaaugggaucgcucugggauuaauggcccucaagcugauuacacaguuugagacuuaccagcuuuggaccgcccugaucuccuugacguguucaaacacaauguucacccucacugucgcuuggcguaccgcaacacugauacuagccggugugagucugcuuccuguuugccaaagcucguccaugagaaaaacugacuggcucccaauggcgguggcugccaugggcguccccccucugcccuuguuuaucuucucucugaaggauaccuuaaagaggcgcagcuggccacucaaugaggggguaauggcagugggacugguuucaauucuugccaguucccuguugcggaacgacgugccuauggcuggcccccucgucgcaggugggcugcuaaucgccuguuaugugauuacgggaacaucugcggaucugaccguagaaaaagcugccgacaucacuugggaggaagaggcagaacagacaggcgugagccauaaccuuaugauaaccgucgacgaugacggcacuaugagaauuaaggaugacgagacagagaauauccucaccguucuguugaaaacggccuuacugaucguguccgggguguuuccauacucaauuccggcuacucuccuggucuggcacaccuggcagaagcagacacaaaggagcggagugcuuugggauguuccuagucccccagaaacccagaaagccgagcuggaagaggguguauaccgaauaaagcagcagggcaucuucgggaaaacacaagugggagucggcgugcagaaggaggguguuuuucauacuauguggcacgugacccgcggggcagucuugacguauaacggaaagcggcuagaacccaauugggcuucugugaaaaaggaccugauuuccuacggcggcggguggagacucagcgcccaguggcaaaaaggagaggaaguacaggucaucgcgguggagccugguaagaacccaaaaaauuuccagacaacucccggcaccuuccagacaaccacuggggaaauuggagccaucgcacuggauuuuaagccuggcaccucggguucaccgauaaucaacagggaggggaagguugugggacuuuauggcaauggcgucgugacaaaaaacgggggauacguuucugguauugcucaaacgaaugccgagccagacggccccacuccugaauuagaggaagagauguucaagaaacguaaccugaccaucauggaucuccacccagggaguggaaagacacgcaaauauuugcccgcuauuauccgggaagcaauaaagagaaggcugcgaacccucauucuggccccuacucggguggucgccgcugagauggaggaagcgcuuaagggccugccgauccgcuaccagacaaccgcaacgaaauccgagcauacugguagagaaaucguggacuugaugugccacgccacauuuaccaugaggcuacugagccccguacgggugccaaauuauaaccucauuaucauggaugaggcucauuucaccgacccugccucuauagcagcccgaggguacauuagcacuagaguuggaaugggcgaagcugcggccaucuuuaugacagcaacccccccaggcacagcugaugccuucccucaguccaaugcacccauucaggacgaggagcgcgacaucccagaaaggucauggaacagugggaaugaguggauaacugauuuugccggaaagacggucugguucgugccgagcauuaaagcugguaacgacaucgccaacuguuuacguaagaauggcaaaaaggugauccaacugucucggaagaccuuugauacagaauaccagaaaacuaagcuuaacgacugggauuucgucguaaccacagacauuuccgagaugggggcgaauuuuaaagcagauagagugaucgacccuaggcgcugccugaagcccguuauucucaccgauggaccagagcgagugauauuggccggccccaugccugucacugcugccucagcugcacagagacgggguaggguggggcgcaacccacagaaagaaaaugaccaauauaucuucacgggccagccccugaacaaugaugaggaccacgcccauuggaccgaagcuaagaugcuccuggacaacauuaauacaccugagggaaucaucccggcccuuuucgaaccagagcgugagaagagugcagcgauugauggcgaauacagacuaaaaggggagagccggaagacuuuuguugaacugaugaggcgcggagacuugcccgugugguuagcccacaaagucgcuuccgaggguauaaaguauaccgaucgaaaauggugcuucgacggccagagaaacaaucagauccuggaagagaacauggauguggagauuuggacaaaggaaggggagaaaaagaagcuccggccuagguggcuggacgcccgcaccuacucugauccccuugcacugaaagaauuuaaggacuucgcugccggaagaaaaucgaucgcacucgauuugguaacugagauuggcagggugccaagccaccuggcccaucggacacguaaugcucuagacaaccugguuaugcuccacacgucagaacauggugggcgcgcguaucgacacgccgucgaggagcuuccugaaaccauggagacucuguuauugcugggccucaugauccugcuuacaggaggcgcaaugcuguuucucauauccgggaagggaaucgguaaaaccaguauuggcuugaucugugugauugcuucuagcgggaugcuguggauggccgaaauccccuuacaauggauagccuccgcaauugugcuagaguucuuuaugaugguccugcucaucccagagccugaaaagcagagaaccccgcaggauaaucaacuugcuuacguugugauuggaauccugacauuggccgcgauaaucgcugccaacgagaugggccugcucgaaacuacgaagagggaccuggguaugucaaaagagcccgggguagugucuccaaccagcuaucuugaugucgaccuccacccugcaagugccuggacacuguacgcuguggcaacuaccguuauuacacccauguugcggcauaccaucgaaaauuccacugccaacgugagccuggcggcuauugccaaccaggcagucguauuaaugggccuagacaagggauggccaaucucuaaaauggaucugggcgugccucuccuugcccuggggugcuacucacagguuaaucccuugacgcugacagcugccgugcuccugcuuauaacccacuaugcaauuaucggaccgggcuuacaggcuaaggccacucgcgaggcgcaaaaaagaaccgccgcagguaucaugaagaacccaacagucgacgggauuaugacuaucgaucuggacccugugauauacgauuccaaguucgagaaacagcucggacaggucauguugcuggugcuaugugcuguucagcugcuccuuaugaggaccaguugggcccugugcgaagcauugacacuggcuacgggccccauuaccacucucugggaggguagcccaggcaaguuuuggaauacaaccaucgccgugucgauggccaacauuuuccgggggucuuaucuggcgggagcuggcuuagcauuuuccaucaugaaaagcguagggacuggaaagcgaggcacagguucacaaggggaaacccuuggagagaaauggaagaagaaacugaaucagcucaguagaaaggaauucgaccuauacaaaaagucuggcauaacggagguggaucgcaccgaggccaaagaaggucugaagaggggcgagaucacacaucacgcugucucccgggggagcgccaaauugcagugguuuguugaacguaacauggugauucccgagggaagagucaucgaccugggcugugggaggggaggcuggucauauuacugcgcaggucucaagaaggugacugaaguacgcggguauaccaaaggaggcccuggccaugaggagccggugcccaugaguacauacggguggaauauuguuaagcuuaugagcggaaaagauguguucuaccugccaccugaaaagugugacacuuugcugugcgauaucggugaguccucucccagcccuaccgucgaagagucccggacaauucgagugcucaaaauggucgagccaugguuaaagaacaaucaguucuguaucaaggugcugaaccccuauaugccuaccguuauagaacaccuugagagacugcaaaggaaacacggcgggaugcuaguacgcaauccacucucacggaacucuacucaugaaauguacuggauuaguaauggaacgggcaacaucguggccucggucaauauggugagcagacuguugcugaaccguuuuacaaugacccacaggcggcccacuaucgagaaggacguugaucucggugcugggacccgccaugugaacgcggaaccggagacaccuaauauggacgucauuggagagcgaauaaaaagaaucaaggaagagcacaacuccacguggcacuaugacgaugaaaauccauacaaaaccugggccuaucauggcucuuacgaggugaaggcaacuggcucagcuagcuccaugauuaacgggguagugaagcuucugacaaaacccugggacguugucccuauggugacccagauggccaugacugauacaaccccauucggacagcaaaggguguuuaaggaaaaagucgacacacggacuccccgcaguaugccggguaccagaaggguuauggagaucacggcagagugguuauggcgaacccugggccggaauaagaaaccucguuugugcacaagagaagaguucacuaagaaggugcgcaccaacgccgcuaugggggccguauuuacagaagagaaucagugggauucugcgaaagcagccguggaagacgaggauuucuggaagcucgucgacagggagcgggaacugcacaaacuaggaaaguguggcagcugcguguauaacaugauggguaaaagagagaagaaacuuggggaauuuggaaaggcuaagggcucacgcgccauuugguacauguggcugggcgcaagguaccucgaguucgaggcucugggguuuuugaaugaagaucauugguucucccgagagaacaguuauagcggaguugaaggugagggccugcacaaacucggguacauccuucgggacauaucuaagauccccggaggcgccauguaugcugaugacacugccgguugggacaccagaauuacggaagaugaccugcauaaugaggagaaaaucacacagcagauggauccagaacacaggcaauuagcaaacgcgauuuuuaagcugaccuaccagaauaaaguggucaaggugcagcgcccuacucccacagggaccguaauggacaucauaucccguaaggaucagcggggaucaggccaaguuggcacuuauggguugaacaccuucacaaauauggaggcccagcucauuagacagauggaaggagagggugugcugagcaaagcugaccuagaaaacccacaccuucccgagaagaaaaucacgcaguggcuggagaccaagggcgucgaaaggcucaaacgcauggccaucucgggggaugacugcguggugaagccuauugaugaccgauuugcaaacgcucuguuggccuuaaaugauaugggaaagguccggaaagacauaccacaauggcagccgucuaagggcuggcaugauuggcagcagguucccuucuguagucaccauuuccacgagcugaucaugaaagacgguagaaagcucgugguaccuugcaggccacaagacgaacuuauugggcgcgcaagaaucucccagggagccggcuggagccugcgggagacugcgugucuaggcaaagcuuacgcccagauguggucacugauguauuuucacaggcgugaucuccgauuggcauccaacgccauuugcucugcugugcccguccauugggugccuacaagccgcaccacuuggaguauccacgcccaucaccaauggaugacaaccgaagacaugcugacgguuuggaauagaguguggauagaggauaacccauggauggaggacaagacacccgucaccacuugggaaaaugugccuuaccuugggaagcgggaggaucagugguguggaucccugaucggucucaccagcagggcaacaugggcucagaacauuccgacugccauccagcaaguacgcucuuuaauuggcaaugaagaguuccuggacuacaugccaucaaugaaaagauuucggaaggaggaagagagugaaggggcgaucugguga

SEQ ID NO: 15169 - RNA, 9873 nt, Artificial Sequence
  derived and/or modified CDS sequence (opt3) from DENV-3__GU131873__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcgccgacgugacaagagaagcguagcccuugcaccccacgugggcaugggucuggauacaaggacccaaacguggauguccgccgagggggcuuggcggcaggucgaaaaaguggagacuugggcauugcgccauccuggauucaccauucucgcccuguuucuggcucacuacaucggcacaucucucacucagaagguugugauauucaucuuacugaugcuugucaccccaucgaugacaaugagaugugugggcguagggaacagggacuuuguugaaggauugucaggugccaccuggguggaugucgugcuggagcauggcgggugcgugacgacuauggcgaagaauaaacccacacuagacauugagcuccagaagaccgaagcaacucaacuggccacacuucggaaacuguguaucgagggaaagauuaccaacaucacgaccgauagccgcugcccuacacagggcgaagcugucuugccagaggaacaggaccagaauuauguuuguaaacacacuuacguggaucgagguugggggaacggaugcggccucuucggcaaggggagucugguaaccugcgccaaguuucaauguuuagagcugauagagggaaaagugguccaguaugaaaaucucaaguacacagugguuauuacugugcacaccggugaccagcaucaggucggcaacgagacacaagggaucaccgcagaaauuacuccccaggcuuccacgacagaggccauccuuccugaauauggaacccugggcuuggagugcucuccaagaacuggucuagacuucaaugagaugauccugcucaccaugaaaaacaaggcguggauggugcacaggcagugguuuuucgaucugccgcuucccuggacaagcggggccaccacugaaacaccuacguggaaucggaaagagcuguugguaaccuuuaagaacgcacaugcuaaaaagcaagaaguugugguccucggcucccaggagggagccaugcacacugcucugacaggcgccaccgaaauucagaauucagggggaacaaguauauucgcaggucacuuaaagugucgucugaaaauggacaagcuagagcucaaaggcaugagcuacgccaugugcacuaacaccuuugugcugaagaaagaggucucugaaacgcagcaugggaccauccuuauuaagguggaguacaagggagaagaugcuccauguaaaauccccuucuccacagaggacggccaagguaaggcgcacaacgggcgcuugauaacugcaaauccuguugugaccaaaaaggaggaaccaguaaacauugaggccgaacccccguucggcgagucaaauaucgucaucggaauuggcgauaacgcucugaaaaucaauugguauaagaaggggagcaguauuggaaaaauguuugaagccacagcaagaggugccaggcggauggcuauacucggcgacacugccugggauuucgggucugugggaggcguucugaacucccuugguaagauggugcaucagaucuuugggagcgcauacaccgcgcuguucucgggcgucucuugggugaugaaaauuggaaucggcguauugcucacguggaucgggcugaauuccaagaacacaucaaugaguuuuagcugcauugcuauaggaaucauuaccuuauaucugggcgccgugguucaggcagacauggguugugucaucaauuggaaagggaaggagcuaaagugcggauccggcauuuucgugacuaacgaggugcacacauggaccgaacaguacaaauuucaagccgauucuccuaagcgacucgcuacugccaucgcaggugcuugggagaauggcgucugugggauacgcagcaccacaagaauggaaaaccugcuuuggaaacagaucgccaaugaguugaacuauauucugugggaaaauaacaucaagcucacgguuguggugggagacauuaucggcguacuggagcaggggaaaaggaccuuaacuccccagccaauggagcugaaguacucauggaaaacauggggaaaggcgaagauagucaccgccgaaacacaaaacaguuccuucauuaucgauggcccuaauacucccgagugcccaagcgcuucucgggcauggaacgugugggaaguugaggacuaugguuuugggguguucaccacgaauauuuggcuuaaauugcgcgaagucuacacacagcucugugaccauagacugaugucagccgcugugaaggaugagagggccguucacgcagacaugggauacuggaucgagagucagaaaaacggcagcuggaagcuagaaaaagcgucccugauagaggugaagaccugcacuuggcccaagucucacacccucuggucgaaugguguacuggaaagcgauaugaucauuccuaaaucccuugccggcccaaucucacagcauaaccaccguccgggguaucauacacaaacugcuggacccuggcacuugggcaagcuggaguuagacuuuaauuacugcgaggggaccacagucgugauuacggaaaacuguggaacccggggcccuagucuccgaacuacaaccgugucugguaaacugauccacgaguggugcuguagaagcugcacucuuccaccccugagguauaugggggaagauggauguugguacggcauggagauacgcccuauuuccgaaaaggaggagaauauggucaaaucauugguuagcgccgguucuggcaagguggacaacuucacaauggggguacucugccuggcaauccuauuugaagaggugaugcggggaaaguucggcaaaaagcauaugaucgcuggggucuucuuuaccuucgugcugcuccuguccggacagauuacguggagagauauggcccacacucuuaucaugauuggcaguaaugcaagcgacaggauggguauggggguuaccuauuuggcccugauagcuacauuuaaaauccagccauucuuagcgcucggauuuuuccugcgcaagcuuaccucucgagaaaaccugcuacucggcgugggccuggccauggcaacuacauugcaacugcccgaggauauugaacagauggcuaaugggaucgccuuaggacucauggcccugaaacuuauuacccaguuugagacauaccagcuguggacugcuuugaucucccucaccuguucaaacacgauguucacacugaccgucgcauggcggacugccacccuaauacuggcgggugugagucuucucccgguuugccaaagcucguccaugcguaagacagacuggcugccuauggcuguggccgcaaugggcgucccacccuugccucuguuuaucuucucuuuaaaggauacucucaaaagaaggagcuggccccugaaugaggggguaauggccgugggacuuguuucaauucuggcuaguuccuugcuccgcaacgacgugccaauggcaggcccucuggucgccggugggcuacugaucgcguguuaugugauuaccggaacgucugcugaucuuacaguagaaaaggccgcagacaucaccugggaggaagaggccgaacagacuggcgugagccauaaccucaugauaacagucgacgaugacggcaccaugcggauuaaagaugacgagacugagaauauccugacaguuuuguuaaagaccgcucugcucaucguguccgggguguuucccuacucaauuccagccacgcugcuugucuggcacacuuggcagaaacagacccaaagaagcggagugcugugggauguuccgaguccucccgaaacacagaaggcagaguuggaagaggguguauacaggauaaaacagcagggcaucuucgggaagacccaagugggagucggcgugcagaaggaggguguuuuucauacaauguggcacgugacucgaggggcuguccuaaccuauaacggaaaacgccuggaaccaaauugggccucugugaagaaagaccucauuuccuacggcggcggguggcggcugagcgcgcaguggcaaaagggagaggaaguacaggucaucgccguggagcccgguaaaaacccuaagaauuuccagacgaugccaggcacauuccagacuaccacaggggaaauuggagcaaucgcucuugauuuuaagcccggcaccucggguucaccuauaaucaacagagaggggaaaguugugggauuauauggcaauggcgucgugacuaagaacgggggauacguuucugguauugcccaaaccaaugcugagccggacggcccaacacccgaacuggaggaagagauguucaaaaagaggaaccucacgaucauggauuugcacccugggaguggaaaaacucguaaguaucugccagcaauugugcgcgaagccaucaagcggagacucaggacccugauacuugcccccacacgagucguggcugcggagauggaggaagcacugaaaggcuugccuauucgguaccagaccacugccacaaaguccgagcauaccggucgcgaaaucguagaccuaaugugccacgcuacguuuacuaugagacugcucagcccggugaggguucccaauuauaacuuaaucauuauggaugaggcccauuucacagacccagcaucuaucgccgcucggggguacauaagcacccgagucggaaugggcgaagcggccgcaauuuuuaugaccgcuacuccucccggcacagccgaugcauucccacaguccaaugccccuauccaggacgaggagagagacauucccgaacgcucauggaacagugggaaugaguggaucaccgauuuugcuggaaaaacagugugguucgugccaagcauaaaggccgguaacgacauugcgaacugucugaggaaaaauggcaagaaggucauccaacuuucucguaaaacuuuugauacggaauaccagaagaccaaacugaacgacugggauuucguagugacaacugacaucuccgagaugggggcaaauuuuaaggccgaucggguuauugacccgagaaggugccucaaaccugugaucuugaccgauggacccgagcgcgucauucuggcuggcccaaugcccgugacagccgcuucagcagcccagcgaagaggucggguugggaggaacccucagaaggaaaaugaccaauauauauucaccggccagccacucaacaaugaugaggaccacgcucauuggacugaagccaagaugcugcuugacaacgugaauacgcccgagggaaucauuccugcacuauucgaaccggagcgcgagaaaagugcggccaucgauggcgaauaccgucugaagggggagagcagaaaaaccuuugucgaauugaugcggaggggagacuuaccaguguggcuggcucacaagguagccuccgaggguaucaaauauacagaucgcaaguggugcuucgacggccagcgaaacaaucagauucucgaagagaacauggauguggagauauggacuaaagaaggggagaagaagaaacugagaccccgguggcuugacgcaaggaccuacucugauccucuggcucucaaggaauuuaaagacuucgccgcaggacgcaagucgaucgccuuggaucugguuacagagauuggcagaguccccagccaccuagcucauaggacccggaaugcgcuggacaaccucgugaugcuucacacuucagaacauggugggcgugccuaucgccacgcaguggaggagcugccagaaacaauggagacguuauugcugcucggccugaugauccuucugaccggaggcgcuaugcucuuuauuaucuccgggaaaggaauagguaagacuaguaucggcuugauuugugucaucgccucuagcgggaugcuguggauggccgaaauuccuuuacaauggaucgcauccgcuauaguucuagaguucuuuaugauggugcugcucauucccgagccagaaaagcagcgaacaccucaggauaaucaacuugccuacguagugaucggaauucugaccuuggcggcuaucauagccgcaaacgagaugggccugcucgaaaccacaaaaagagaccuggguaugucaaaggagccgggggucgugucucccacuagcuaucuugauguugaccuccacccagccagugcuuggacgcuguacgcaguggccaccacagucaucacuccuauguugaggcauaccauugaaaauuccacagcgaacguaagccuggcugccaucgcaaaccaggccgugguuuuaaugggccuagacaaaggauggcccauuucuaagauggaucugggcgugccacuccuugcucuggggugcuacucacaggucaauccuuugacccugacugccgcagugcuccugcuuaucacgcacuaugcuauaauuggacccggcuuacaggccaaagcgacacgggaggcccaaaagcgcaccgcagcugguaucaugaagaacccgacugucgacgggaucaugaccauugaucuggacccagugaucuacgauuccaaauucgagaagcagcucggacagguuauguugcuggugcuaugugccguacagcugcuccuuaugagaacaaguugggcacugugcgaagcuuugacucuggccaccggcccuauaacaacgcucugggaggguagccccggcaaauuuuggaauaccacuauugccgugucgauggcgaacaucuucagggggucuuaucuggcuggagcaggcuuagccuuuuccauuaugaagagcgucgggacaggaaaacggggcaccgguucacaaggggaaacucuuggagagaaguggaagaaaaagcugaaucagcucagucgaaaagaauucgaccuauacaagaaaucuggcaucacagagguugauagaaccgaggcuaaggaaggucugaaacgcggcgagauaacgcaucacgccguguccagggggagcgcaaaguugcagugguuugucgaacggaacauggugaucccagagggacguguaauugaccugggcugugggagaggaggcuggucauauuacugcgccggucucaagaaagugaccgaaguuaggggguauacaaagggaggccccggccaugaggagccugugccgaugaguacuuacggguggaauaucgucaaacuuaugagcggaaaggauguguucuaccugcccccagaaaaaugugacaccuugcugugcgauauuggugaguccucuccuagccccacagucgaagagucccgcacuauccgggugcucaagaugguugagccuugguuaaagaacaaucaguucuguauuaaaguacugaacccauauaugcccaccgugaucgaacaccuugagcgacugcaaagaaagcacggcgggaugcuagucaggaauccucucucacgcaacucuacacaugaaauguacuggauaaguaauggaaccggcaacauuguggcuucgguuaauauggugagccggcuguugcugaacagauuuacuaugacgcaccguaggccaacaaucgagaaagacgucgaucucggugcggggacccggcaugugaacgccgaacccgagacuccgaauauggacguaaucggagagcgcauuaagcgaauaaaagaagagcacaacuccaccuggcacuaugacgaugaaaauccuuacaagacaugggcauaucauggcucuuacgaggugaaggcuacgggcucagccagcuccaugaucaacgggguugucaaacuucugaccaagccaugggacguggugcccauggucacucagauggcaaugacagauaccacuccuuucggacagcaaagaguuuuuaaagaaaagguggacacaaggaccccacggaguaugcccgguacacgcagaguaaugggcauuacugccgagugguuauggaggacccuggggcgaaauaaaaagccgcgguugugcacgcgugaggaauucaccaagaaagugagaacaaacgcugccaugggagcggucuuuacugaggaaaaucagugggauucugcaaaggccgcuguggaggacgaagauuucuggaaacucguugaccgcgagagggagcugcacaagcuaggcaaaugugguagcugcguguauaacaugauggggaagcgggaaaaaaagcuuggagaguuuggcaaggccaaaggcucaagagcaaucugguacauguggcugggggcucgcuaccucgaauucgaggcccugggauuuuugaaugaggaucauugguucuccagggaaaacaguuauagcggugucgagggcgaagggcugcacaagcucggauacauucuucgagacaucucuaaaauaccuggcggugcuauguaugccgaugacaccgcagggugggacacacggaucacugaggaugaccugcauaaugaagagaagauuacccagcagauggaucccgagcacagacaauuagcgaacgccaucuuuaaacugacguaccagaauaaggugguaaagguucagaggccaacaccuaccggaacugugauggacauuaucucccgcaaagaucagcguggcucaggccaagucgggacauauggauugaacaccuucacuaauauggaagcucagcucauacggcagauggagggugaaggcgugcugagcaaggccgaccuagagaacccccaccuuccagaaaaaaagauuacccaguggcuggagacaaaagggguggagagacucaagaggauggcaaucucgggagaugacugcgucguuaagcccaucgaugaccgcuuugcuaacgcccuguuggcauuaaaugauaugggcaaagugcgaaaggacauuccucaauggcagccaucuaaagguuggcaugauuggcagcagguaccguucuguagucaccauuuccacgaacugauaaugaaggacgggcggaaacucgugguccccugcagaccucaagacgagcuuaucggaagggcccgcauuucccagggcgcgggcuggagccugagagaaacggcuugucuagggaaggccuacgcacagauguggucacugauguauuuucaccggagggaucuccguuuggccuccaacgcuaucugcucugccgugccaguucauugggugcccaccagccgaacuacauggaguauucacgcacaucaccaauggaugaccacugaggacaugcugacagucuggaaucgcguguggaucgaagauaacccuuggauggaggacaagaccccaguaacgacaugggagaauguucccuaccuuggaaaaagagaagaucaguggugugguucccugauaggccucaccagccgggcuacuugggcccagaacaucccuaccgcgauucagcaagugaggucuuuaaucgggaaugaggaauuccuggacuacaugccgucaaugaagcgcuuuagaaaagaggaggaaagugagggagcuauuugguga

SEQ ID NO: 15170 - RNA, 9873 nt, Artificial Sequence
  derived and/or modified CDS sequence (opt3) from DENV-3__GU131874__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcgccgacgugacaagagaagcguagcccuugcaccccacgugggcaugggucuggauacaaggacccaaacguggauguccgccgagggggcuuggcggcaggucgaaaaaguggagacuugggcauugcgccauccuggauucaccauucucgcccuguuucuggcucacuacaucggcacaucucucacucagaagguugugauauucaucuuacugaugcuugucaccccaucgaugacaaugagaugugugggcguagggaacagggacuuuguugaaggauugucaggugccaccuggguggaugucgugcuggagcauggcgggugcgugacgacuauggcgaagaauaaacccacacuagacauugagcuccagaagaccgaagcaacucaacuggccacacuucggaaacuguguaucgagggaaagauuaccaacaucacgaccgauagccgcugcccuacacagggcgaagcugucuugccagaggaacaggaccagaauuauguuuguaaacacacuuacguggaucgagguugggggaacggaugcggccucuucggcaaggggagucugguaaccugcgccaaguuucaauguuuagagcugauagagggaaaagugguccaguaugaaaaucucaaguacacagugauuaucacuguucacaccggugaccagcaucaggugggcaacgagacacaaggggucaccgcagaaauuacuccccaggcuuccacgacagaggccauccuuccugaauauggaacccugggcuuggagugcucuccaagaacuggucuagacuucaaugagaugauccugcucaccaugaaaaacaaggcguggauggugcacaggcagugguuuuucgaucugccgcuucccuggacaagcggggccaccacugaaacaccuacguggaaucggaaagagcuguugguaaccuuuaagaacgcacaugcuaaaaagcaagaaguugugguccucggcucccaggagggagccaugcacacugcucugacaggcgccaccgaaauucagaauucagggggaacaaguauauucgcaggucacuuaaagugucgucugaaaauggacaagcuagagcucaaaggcaugagcuacgccaugugcacuaacaccuuugugcugaagaaagaggucucugaaacgcagcaugggaccauccuuauuaagguggaguacaagggagaagaugcuccauguaaaauccccuucuccacagaggacggccaagguaaggcgcacaacgggcgcuugauaacugcaaauccuguugugaccaaaaaggaggaaccaguaaacauugaggccgaacccccguucggcgagucaaauaucgucaucggaacaggcgauaacgcucugaaaauuaauugguauaagaaggggagcaguaucggaaaaauguuugaagccacugcaagaggugccaggcggauggcuauucucggcgacaccgccugggauuucgggucugugggaggcguucugaacucccuugguaagauggugcaucagauauuugggagcgcauacacggcgcuguucucgggcgucucuugggugaugaaaaucggaauuggcguauugcucacauggaucgggcugaauuccaagaacaccucaaugaguuuuagcugcaucgcuauuggaauaaucacuuuauaucugggcgccgugguucaggcagacauggguugugucauuaauuggaaagggaaggagcuaaagugcggauccggcaucuucgugacaaacgaggugcacaccuggacugaacaguacaaauuucaagccgauucuccuaagcgacucgcuaccgccauugcaggugcuugggagaauggcgucugugggauccgcagcacaacgagaauggaaaaccugcuuuggaaacagauagccaaugaguugaacuauauccugugggaaaauaacauuaagcucaccguuguggugggagacaucauuggcguacuggagcaggggaaaaggacuuuaacaccccagccaauggagcugaaguacucauggaaaaccuggggaaaggcgaagaucgucacagccgaaacucaaaacaguuccuucauaauugauggcccuaauacccccgagugcccaagcacgucucgggcuuggaacgugugggaaguugaggacuaugguuuugggguguucacaaccaauaucuggcuuaaauugcgcgaagucuacacucagcucugugaccauagacugaugucagcagccgugaaggaugagagggcuguucacgccgacaugggauacuggauugagagucagaaaaacggcagcuggaagcuagaaaaagcaucccugaucgaggugaagaccugcacauggcccaagucucacacucucuggucgaaugguguacuggaaagcgauaugauaaucccuaaaucccuugcgggcccaauuucacagcauaaccaccguccgggguaucauacccaaacagccggacccuggcacuugggcaagcuggaguuagacuuuaauuacugcgaggggacgaccgucgugaucacugaaaacuguggaacacggggcccuagucuccgaaccacuacagugucugguaaacugauucacgaguggugcuguagaagcugcacccuuccaccccugagguauaugggggaagauggauguugguacggcauggagauccgcccuauauccgaaaaggaggagaauauggucaaaucauugguuagcgcugguucuggcaagguggacaacuucacgauggggguacucugccuggccauucuauuugaagaggugaugcggggaaaguucggcaaaaagcauaugaucgcaggggucuucuuuacuuucgugcugcuccuguccggacagaucaccuggagagauauggcucacacacuuauuaugaucggcaguaaugccagcgacaggauggguauggggguuaccuauuuggcacugauugccacuuuuaaaauacagccauucuuagcucucggauuuuuccugcgcaagcuuacaucucgagaaaaccugcuacucggcgugggccuggcgauggccaccacauugcaacugcccgaggauaucgaacagauggcaaaugggauugcuuuaggacucauggcccugaaacuuaucacucaguuugagaccuaccagcuguggacggccuugauuucccucacauguucaaacaccauguucacucugaccgucgcuuggcggacagcaacucuaauccuggccggugugagucuucucccgguuugccaaagcucguccaugcguaagaccgacuggcugccuauggcgguggcugccaugggcgucccacccuugccucuguuuauauucucuuuaaaggauacgcucaaaagaaggagcuggccccugaaugaggggguaauggcagugggacuuguuucaauccuggccaguuccuugcuccgcaacgacgugccaauggcuggcccucuggucgcaggugggcuacugauugccuguuaugugaucacaggaaccucugcggaucuuacuguagaaaaggcugccgacauuacaugggaggaagaggcagaacagaccggcgugagccauaaccucaugaucacugucgacgaugacggcacaaugcggauaaaagaugacgagaccgagaauauucugacgguuuuguuaaagacugcccugcucaucguguccgggguguuucccuacucaaucccagcuacccugcuugucuggcacacauggcagaaacagacccaaagaagcggagugcugugggauguuccgaguccucccgaaacacagaaggccgaguuggaagaggguguauacaggauuaaacagcagggcauauucgggaagacucaagugggagucggcgugcagaaggaggguguuuuucauaccauguggcacgugacgcgaggggcaguccuaacauauaacggaaaacgccuggaaccaaauugggcuucugugaagaaagaccucaucuccuacggcggcggguggcggcugagcgcccaguggcaaaagggagaggaaguacaggucauugcgguggagcccgguaaaaacccuaagaauuuccagacuaugccaggcaccuuccagacaaccacuggggaaaucggagccauugcacuugauuuuaagcccggcaccucggguucaccuaucauaaacagagaggggaaaguugugggauuauauggcaauggcgucgugacaaagaacgggggauacguuucugguaucgcucaaacgaaugccgagccggacggcccaacucccgaacuggaggaagagauguucaaaaagaggaaccucaccauuauggauuugcacccugggaguggaaaaacacguaaguaucugccagcuaucgugcgcgaagcaauuaagcggagacucaggacccugauccuugcccccacucgagucguggccgcugagauggaggaagcgcugaaaggcuugccuauacgguaccagacaaccgcaacgaaguccgagcauacuggucgcgaaauuguagaccuaaugugccacgccacauuuaccaugagacugcucagcccggugaggguucccaauuauaacuuaaucaucauggaugaggcucauuucaccgacccagccucuauugcagcccggggguacaucagcacucgagucggaaugggcgaagcugcggccauauuuaugacagcaaccccucccggcacagcugaugccuucccacaguccaaugcaccuauucaggacgaggagagagacauccccgaacgcucauggaacagugggaaugaguggauuacugauuuugccggaaaaacggugugguucgugccaagcaucaaggcugguaacgacauagccaacugucugaggaaaaauggcaagaaggucauucaacuuucucguaaaaccuuugauacagaauaccagaagacuaaacugaacgacugggauuucguagugaccacagacaucuccgagaugggggcgaauuuuaaggcagaucggguuaucgacccgagaaggugccucaaaccugugauuuugaccgauggacccgagcgcgucauccuggccggcccaaugcccgugacugcugccucagcugcacagcgaagaggucggguugggaggaacccucagaaggaaaaugaccaauauauuuucacgggccagccacucaacaaugaugaggaccacgcccauuggaccgaagcuaagaugcugcuugacaacauaaauacacccgagggaaucauuccugcccuauucgaaccggagcgcgagaaaagugcagcgaucgauggcgaauaccgucugaagggggagagcagaaaaacuuuuguggaauugaugcggaggggagacuuaccagucuggcuggcccacaagguggcuuccgaggguaucaaauauaccgaucgcaaguggugcuucgacggccagcgaaacaaucagauucucgaagagaacauggauguagagauauggacaaaagaaggggagaagaagaaacugagaccccgguggcuugacgccaggaccuacucugauccucuggcacucaaggaauuuaaagacuucgcugccggacgcaagucgaucgcauuggaucuggugacugagauuggcagaguucccagccaccuagcccauaggacacggaaugcucuggacaaccucgucaugcuucacacgucagaacauggugggcgugcguaucgccacgccguggaggagcugccagaaaccauggagacuuuauugcugcucggccugaugauccuucugacaggaggcgcaaugcucuuuuugauuuccgggaaaggaaucgguaagaccaguauaggccugaucugugugauugcuucuagcgggauguuauggauggccgaaaucccucuacaauggauugccuccgcaaucguccuggaguucuuuaugaugguucuccuuauacccgagccagaaaagcagcgaaccccucaggauaaucaacuggcuuacgugguaauuggaaucuugacacuggccgcgauuaucgcugccaacgagaugggccuccuggaaacuacgaaaagagaccuugguaugucaaaggagccggggguggucucucccaccagcuaucucgauguggaccugcacccagcaagugccuggacauuguacgcuguugcaacuaccgugauaacaccuaugcugaggcauaccaucgaaaauuccacugccaacgucagcuuagcggcuauugccaaccaggcaguagugcuaaugggccuggacaaaggauggcccaucucuaagauggaucucggcguuccacuucuggccuuggggugcuacucacaggugaauccucugacgcucacagcugccguccugcuuuuaauuacccacuaugcaaucauaggacccggccugcaggcuaaagccacucgggaggcgcaaaagcgcaccgccgcagguauuaugaagaacccgacaguggacgggaucaugacuaucgaucucgacccagucauuuacgauuccaaauucgagaagcaguugggacaggugaugcugcuaguucugugugcugcccagcuccuucugaugagaaccaguugggcauugugcgaagcucugacacucgccacgggcccuaucaccacucugugggaggguagccccggcaaauuuuggaauacaaccauagccgugucgauggcgaacauuuucagggggucuuauuuagcuggagcaggccuugccuuuuccaucaugaagagcguagggacuggaaaacggggcacagguucacaaggggaaacccugggagagaaguggaagaaaaagcucaaucagcuaagucgaaaagaauucgaccuguacaagaaaucuggcauuacggagguggauagaaccgaggcuaaggaagguuugaaacgcggcgagaucacacaucacgccgucuccagggggagcgcaaagcugcagugguuuguugaacggaacauggugauaccagagggacgugucaucgaccucggcugugggagaggaggcuggucauauuacugcgccggucuuaagaaagugacugaaguaaggggguauaccaagggaggccccggccaugaggagccugugccgaugaguacauacggguggaauauuguuaaacugaugagcggaaaggauguguucuacuugcccccagaaaaaugugacacucugcucugcgauaucggugaguccucuccuagccccaccgucgaagagucccgcacaauucggguguuaaagauggucgagccuuggcugaagaacaaucaguucuguaucaaagugcuuaacccauauaugcccaccguuauugaacaccuggagcgacuacaaagaaagcacggcgggaugcucguaaggaauccucugucacgcaacucuacucaugaaauguacuggaucaguaauggaacgggcaacauaguggcuucggucaauauggugagccgguugcugcucaacagauuuacaaugacccaccguaggccaacuauugagaaagacguugaucuuggugcggggacccggcaugugaacgccgaacccgagacaccgaauauggacgucaucggagagcgcaucaagcgaauuaaagaagagcacaacuccacguggcacuaugacgaugaaaauccuuacaagaccugggcauaucauggcucuuacgaggugaaggcuacuggcucagccagcuccaugauaaacgggguagugaaacuguuaacaaagccaugggacguuguccccauggugacccagauggcaaugacugauacaaccccuuucggacagcaaagaguguuuaaagaaaaggucgacacaaggacuccacggaguaugcccgguacccgcagaguuaugggcaucacggccgaguggcuguggaggaccuuggggcgaaauaaacggccgcgucucugcacaagagaggaauucacuaagaaggugcgcaccaacgcugccaugggagcgguauuuacagaggaaaaucagugggauucugcaaaagccgcuguggaggacgaagauuucuggaagcuggucgacagggagcgggagcuacacaaacuuggcaagugugguagcugcguguauaacaugauggggaaaagagaaaagaaacugggagaguuuggcaaggccaagggcucacgcgcaauuugguacauguggcucggggcuagguaccuggaauucgaggccuugggauuucugaaugaggaucauugguucucccgagaaaacaguuauagcgguguugagggcgaagggcuccacaaacuuggauacauccugcgggacauuucuaagaucccuggcggugcuauguaugccgaugacacugcagggugggacaccagaauaacggaggaugacuuacauaaugaagagaaaaucacacagcagauggaucccgagcacaggcaacuggcgaacgccauuuuuaaguugaccuaccagaauaaaguggucaaggugcagcgcccaacuccuacaggaaccguaauggacaucauuucccguaaggaucagcggggcucaggccaaguugggacuuauggacucaacaccuucacaaauauggaagcucagcugaucagacagauggagggugaaggcgugcuaagcaaagccgaccuugagaacccccaccugccagaaaagaaaauagcacaguggcucgagacgaagggggucgagaggcugaaacgcauggcuauuucgggagaugacugcguggugaagcccaucgaugaccgauuugccaacgcauuguuagcccugaaugauaugggcaagguccggaaagacaucccucaauggcagccaucuaaggguuggcaugauuggcagcagguuccguucuguagucaccauuuccacgaacucauuaugaaagacgggagaaagcuugugguacccugcaggccucaagacgagcugauaggacgcgcgagaaucucccagggcagcggcuggucacuacgggaaaccgcuugucuggggaaagccuacgcacagauguggucccucauguauuuucacaggcgugauuugcgacuggccucuaacgcuauuugcagcgccgugccaguccauugggugcccacuagucgcacaaccugguccauccacgcacaucaccaauggaugacuacagaggacaugcuugcuguuuggaauagaguguggauugaagauaacccuuggauggaggacaagaccccagucacgacaugggagaaugugcccuaccugggaaagcgggaagaucaguggugugguagccucaucggcuuaaccucuagggccacuugggcgcagaacauaccuaccgcuauccagcaaguacgcucacugauugggaaugaggaauucuuggacuacaugccgaguaugaaaagauuucggaaggaggaggaauccgagggagccaucugguga

SEQ ID NO: 15171 - RNA, 9873 nt, Artificial Sequence
  derived and/or modified CDS sequence (opt3) from DENV-3__GU131875__SS-prME
accagccugugccucgugaugauccuucccgccgcucuggcauuccacuugacauccagagacggcgagccuaggaugauugucgggaagaacgaacggggaaaaucuuuacuguuuaagacugccucagguauaaauauguguacgcuaaucgcgauggaucucggcgagaugugcgacgauaccguuacauacaaauguccacauauuacugaaguggagccggaagacaucgauugcugguguaaccugaccaguacauggguaaccuaugggacuugcaaucaggcuggagagcgccgacgugacaagagaagcguggcccuugcaccccacgucggcaugggucuggauacaaggacccaaacguggauguccgccgagggggcuuggcggcagguggaaaaaguugagacuugggcauugcgccauccuggauucaccauucucgcccuguuucuggcucacuacaucggcacaucucucacucagaagguggucauauucaucuuacugaugcuugugaccccaucgaugacaaugagauguguaggcguugggaacagggacuuuguggaaggauugucaggugccaccugggucgauguggugcuggagcauggcgggugcgucacgacuauggcgaagaauaaacccacacuagacauugagcuccagaagaccgaagcaacucaacuggccacacuucggaaacuguguaucgagggaaagauuaccaacaucacgaccgauagccgcugcccuacacagggcgaagcuguuuugccagaggaacaggaccagaauuauguguguaaacacacuuacguagaucgagguugggggaacggaugcggccucuucggcaaggggagucuggugaccugcgccaaguuucaauguuuagagcccauagagggaaaagucgugcaguaugaaaaucugaaguacacaguuauuaucacugugcacaccggugaccagcaucaggucggcaacgagacacaaggggugaccgcagaaauuacuccucaggcuuccacgacagaggccauccucccagaauauggaacccuuggccuggagugcucuccgagaacugguuuggacuucaaugagaugauccuacugaccaugaaaaacaaggcguggaugguacacaggcagugguuuuucgaucucccccugccuuggacaagcggggccaccacugaaacaccaacguggaaucggaaagagcuucugguuaccuuuaagaacgcacaugcuaaaaagcaagaaguggucguguugggcucccaggagggagccaugcacacugcucucacaggcgccaccgaaauucagaauucagggggaacaaguauauucgcaggucaccugaagugucguuuaaaaauggacaagcuggagcuaaaaggcaugagcuacgccaugugcacuaacaccuuuguccucaagaaagaggugucugaaacgcagcaugggaccauccugauuaagguugaguaccgcggagaagaugcucccuguaagaucccuuucuccacagaggacggccaagguaaagcgcacaacgggagacuuauaacugcaaauccagugguaaccaagaaagaggaacccgucaacauugaggccgaaccgccuuucggcgagucaaauaucgugaucggaauuggcgauaacgcuuugaagaucaauugguauaaaaaggggagcaguauuggaaagauguuugaagccacagcaaggggugcccggcgaauggcuauacugggcgacacugccugggauuucgggucuguuggaggcgugcucaacucccuggguaaaaugguccaucagaucuuugggagcgcauacaccgcgcuuuucucgggcgugucuuggguaaugaagauuggaaucggcauccuguugacguggauugggcucaauuccaaaaacacaucaaugaguuuuagcugcauagcuaucggaauuaucacccuguauuuaggcgccgugguucaggcagacauggguugugucauuaauuggaaggggaaagagcugaagugcggauccggcaucuucgugacuaacgaggugcacacauggaccgaacaguacaaguuucaagccgauucucccaaacgccuagcuacugccauagcaggugcuugggagaauggcgucugugggaucagaagcaccacaaggauggaaaaccuccuguggaagcagauugccaaugagcuuaacuauaucuugugggaaaauaacauuaaacugacgguuguggugggagacaucauaggcguacucgagcaggggaagcggacccugacuccacagccuauggaguuaaaauacucauggaagacauggggaaaagcgaagauugucaccgccgaaacacaaaacaguuccuucaucauugauggccccaauacuccagagugccccagcgcuucucgcgcauggaacgugugggaaguugaggacuaugguuuugggguguucaccacgaauaucuggcugaagcuuagagaagucuacacacaguugugugaccauaggcucaugucagccgcugugaaagaugagcgugccguucacgcagacaugggauacuggauagagagucagaagaacggcagcuggaaacuggaaaaggcgucccuaaucgaggugaaaaccugcacuuggccuaagucucacacccuguggucgaaugguguacucgaaagcgauaugauuaucccaaagucccuggccggcccgauuucacagcauaaccaccggcccggguaucauacacaaacugcuggaccuuggcaccuuggcaaauuggagcuggacuuuaauuacugcgaggggaccacagucgugaucacggaaaacuguggaacccgaggcccaaguuuaagaacuacaaccgugucugguaagcucauacacgaguggugcuguaggagcugcacucugcccccucuucgcuauaugggggaagauggauguugguacggcauggagauucggccaaucuccgaaaaagaggagaauauggucaagucacugguuagcgccgguucuggcaaaguggacaacuucacaauggggguauugugccucgcaauccuguuugaagaggugaugagaggaaaguucggcaagaaacauaugauugcuggggucuucuuuaccuucgugcuacugcucuccggacagaucacguggagggauaugacucacacccugauuaugauaggcaguaaugccagcgaccgcauggguauggggguuacauaucuugcauugaucgccaccuuuaagauucagcccuuccuggcuuuaggauuuuuccuccgaaaacugacuucucgggaaaaccuucugcuaggcgugggccucgcgauggccacaacccugcaauugccggaggauaucgaacagauggcaaaugggauugcucugggauuaauggcccucaagcugaucacacaguuugagacuuaccagcuuuggaccgcccugauauccuugacguguucaaacacaauguucacccucacugucgcuuggcguaccgcaacacugauccuagccggugugagucugcuuccuguuugccaaagcucguccaugagaaaaacugacuggcucccaauggcgguggcugccaugggcguccccccucugcccuuguuuauuuucucucugaaggauaccuuaaagaggcgcagcuggccacucaaugaggggguaauggcagugggacugguuucaauccuugccaguucccuguugcggaacgacgugccuauggcuggcccccucgucgcaggugggcugcuaauugccuguuaugugaucacgggaacaucugcggaucugaccguagaaaaagcugccgacauaacuugggaggaagaggcagaacagacaggcgugagccauaaccuuaugauuaccgucgacgaugacggcacuaugagaaucaaggaugacgagacagagaauauccucaccguucuguugaaaacggccuuacugauuguguccgggguguuuccauacucaauaccggcuacucuccuggucuggcacaccuggcagaagcagacacaaaggagcggagugcuuugggauguuccuagucccccagaaacccagaaagccgagcuggaagaggguguauaccgaaucaagcagcagggcauuuucgggaaaacacaagugggagucggcgugcagaaggaggguguuuuucauacuauguggcacgugacccgcggggcagucuugacguauaacggaaagcggcuagaacccaauugggcuucugugaaaaaggaccugaucuccuacggcggcggguggagacucagcgcccaguggcaaaaaggagaggaaguacaggucauugcgguggagccugguaagaacccaaaaaauuuccagacaaugcccggcacuuuccagaccacaaccggggaaaucggagccauagcacuggauuuuaagccuggcacuucggguucaccgaucauuaacagggaggggaagguugugggacuuuauggcaauggcgucgugaccaaaaacgggggauacguuucugguaucgcucaaacaaaugccgagccagacggccccacgccugaauuagaggaagagauguucaagaaacguaaccugacuauuauggaucuccacccagggaguggaaagacccgcaaauauuugcccgcuaucauacgggaagcaauuaagagaaggcugcgaacacucauccuggccccuacccggguggucgccgcugagauggaggaagcgcuuaagggccugccgauccgcuaccagacuacagcaaccaaauccgagcauacggguagagaaauuguggacuugaugugccacgccacuuuuacaaugaggcuacugagccccguacgggugccaaauuauaaccucaucauaauggaugaggcucauuucaccgacccugccucuauugcagcccgaggguacaucagcaccagaguuggaaugggcgaagcugcggccauuuuuaugacugcaacacccccaggcaccgcugaugccuucccucaguccaaugcacccauccaggacgaggagcgcgacauaccagaaaggucauggaacagugggaaugaguggauuacagauuuugccggaaagacugucugguucgugccgagcaucaaagcugguaacgacaucgccaacuguuuacguaagaauggcaaaaaggugauucaacugucucggaagacguuugauaccgaauaccagaaaacaaagcuuaacgacugggauuucgucguaacuaccgacaucuccgagaugggggcgaauuuuaaaguggauagaguuauugacccuaggcgcugccugaagcccgugauacucacagauggaccagagcgagucaucuuggcaggccccaugccugugaccgccgcuucagccgcucagagacgggguaggguugggcgcaacccacagaaagaaaaugaccaauauauuuucacuggccagccccugaacaaugaugaggaccacgcacauuggacggaagccaagaugcuccuggacaacaucaauaccccugagggaaucauuccggcucuuuucgaaccagagcgugagaagagugccgcaauagauggcgaauacagacuaaaaggggagagccggaagacauuuguggaacugaugaggcgcggagacuugcccgucugguuagcgcacaaaguggccuccgaggguaucaaguauacugaucgaaaauggugcuucgacggccagagaaacaaucagauucuggaagagaacauggauguagagaucuggaccaaggaaggggagaaaaagaagcuccggccuagguggcuggacgcucgcacauacucugauccccuugcccugaaagaauuuaaggacuucgcagcuggaagaaaaucgauugcccucgauuuggugaccgagaucggcaggguuccaagccaccuggcacaucggacucguaaugcccuagacaaccuggucaugcuccacacaucagaacauggugggcgcgcuuaucgacacgcgguggaggagcuuccugaaacgauggagacccuguuauugcugggccucaugauacugcuuacuggaggcgccaugcuguuucucaucuccgggaagggaauugguaaaacaaguaucggcuugauuugugugaucgcaucuagcgggaugcuguggauggcugaaauacccuuacaauggauugccuccgccaucguccuagaguucuuuaugaugguucugcucauuccagagccugaaaagcagagaaccccgcaggauaaucaacuugcauacgugguaaucggaauacugaccuuggcugccaucauugcggcuaacgagaugggccugcucgaaacaacuaagagggaccuggguaugucaaaagagcccgggguggucucuccaacgagcuaucuugauguggaccuccacccugccagugcauggacccuguacgccguugcuacaacugugaucacccccauguugcggcauacaauugaaaauuccaccgcaaacgucagccuggccgcgaucgcuaaccaggccguaguguuaaugggccuagacaagggauggccaauaucuaaaauggaucugggcguuccucuccuugcacuggggugcuacucacaggugaaucccuugacucugacggccgcuguccuccugcuuauuacacacuaugccaucaucggaccgggcuuacaggcaaaggcuacccgcgaggcccaaaaaagaacugcggccgguauuaugaagaacccaaccguggacgggaucaugacaauagaucuggacccugucauuuacgauuccaaguucgagaaacagcucggacaggugauguugcugguucuaugugcagugcagcugcuccuuaugaggacuaguugggcucugugcgaagccuugacccuggcaacaggccccaucacgacccucugggaggguagcccaggcaaguuuuggaauacuacaauugcuguaucgauggccaacaucuuccgggggucuuaucuggccggagcgggcuuagcuuuuuccauaaugaaaagcguggggaccggaaagcgaggcacugguucacaaggggaaacacuuggagagaaauggaagaagaaacugaaucagcucaguagaaaggaauucgaccuauacaaaaagucuggcaucaccgaggucgaucgcacggaggcaaaagaaggucugaagaggggcgagauuacccaucacgccguuucccgggggagcgcuaaauugcagugguuuguggaacguaacauggucauccccgagggaagagugauugaccugggcugugggaggggaggcuggucauauuacugcgccggucucaagaagguaacagaagugcgcggguauacuaaaggaggcccuggccaugaggagccgguucccaugaguaccuacggguggaauaucgugaagcuuaugagcggaaaagaugucuucuaccugccaccugaaaagugugacacauugcugugcgauauuggugaguccucucccagcccuacuguggaagagucccggaccauccgaguccucaaaaugguggagccaugguuaaagaacaaucaguucuguauaaagguucugaaccccuauaugccuacaguaauugaacaccuugagagacugcaaaggaaacacggcgggaugcuagugcgcaauccacucucacggaacucuacccaugaaauguacuggaucaguaauggaacuggcaacaucgucgcaucggugaauaugguuagcagacuguugcugaaccguuuuacgaugacacacaggcggcccaccauugagaaggacguggaucucggugccgggacucgccaugucaacgcugaaccggagaccccuaauauggacgugauaggagagcgaaucaaaagaauuaaggaagagcacaacuccacauggcacuaugacgaugaaaauccauacaaaacgugggcguaucauggcucuuacgagguaaaggccaccggcucagcaagcuccaugaucaacggggugguuaagcuucugacuaaacccugggacgucgugccuauggugacacagauggcuaugaccgauacuacaccauucggacagcaaagggucuuuaaggaaaaaguugacacccggacaccccgcaguaugccggguacuagaagggugaugggcauuaccgccgagugguuauggcgaacgcuggggcggaauaagaaaccucguuugugcaccagagaggaauucacaaagaagguacgcacuaacgcagccaugggagcuguguuuaccgaggaaaaucagugggauucugccaaagcggcagucgaggacgaagauuucuggaagcucguggacagggagcgggagcugcacaaacuaggcaagugugguagcugcguuuauaacaugauggggaaaagagaaaagaaacuuggagaguuuggcaaggccaagggcucacgcgcuaucugguacauguggcugggggccagguaccucgaauucgaggcacugggauuuuugaaugaggaucauugguucucccgagaaaacaguuauagcgguguggagggcgaagggcugcacaaacucggauacauacuucgggacaucucuaagauucccggcggugcuauguaugccgaugacacagcugggugggacacuagaaucaccgaggaugaccugcauaaugaagagaaaauuacgcagcagauggauccagagcacaggcaauuagccaacgcaaucuuuaagcugacauaccagaauaaagucgugaagguacagcgcccuacccccacuggaacaguuauggacauaauuucccguaaggaucagcggggcucaggccaaguggggaccuauggauugaacacuuucaccaauauggaagcgcagcucaucagacagauggagggugaaggcguccugagcaaagccgaccuagagaacccacaccuucccgaaaagaaaaucacacaguggcuggagacgaaggggguggagaggcucaaacgcauggcuauuucgggagaugacugcguggucaagccuauagaugaccgauuugccaacgcacuguuggcuuuaaaugauaugggcaagguucggaaagacaucccacaauggcagccgucuaaggguuggcaugauuggcagcaggugcccuucuguagucaccauuuccacgaacugauuaugaaagacgggagaaagcucguagugccuugcaggccacaagacgagcuuaucggacgcgccagaauuucccagggcgcaggcuggagccugcgggaaaccgccugucuagggaaagcguacgcucagauguggucacugauguauuuucacaggcgugaucuccgauuggccuccaacgcaaucugcucugccguccccgugcauuggguuccuacuagccgcacaaccuggaguauacacgcucaucaccaauggaugacuacagaggacaugcugaccguguggaauagagucuggaucgaagauaacccauggauggaggacaagacgcccgugacaaccugggagaauguaccuuaccuuggaaagcgggaagaucaguggugugguucccugauuggccucacuagcagggccaccugggcacagaacaucccgacagcuauucagcaaguucgcucuuuaaucgggaaugaggaauuccuggacuacaugccaucaaugaaaagauuucggaaggaggaggaaagugagggagccauuugguga

SEQ ID NO: 15172 - RNA, 9873 nt, Artificial Sequence
  derived and/or modified CDS sequence (opt3) from DENV-3__GU131877__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcgccgacgugacaagagaagcguagcccuugcaccccacgugggcaugggucuggauacaaggacccaaacguggauguccgccgagggggcuuggcggcaggucgaaaaaguggagacuugggcauugcgccauccuggauucaccauucucgcccuguuucuggcucacuacaucggcacaucucucacucagaagguugugauauucaucuuacugaugcuugucaccccaucgaugacaaugagaugugugggcguagggaacagggacuuuguugaaggauugucaggugccaccuggguggaugucgugcuggagcauggcgggugcgugacgacuauggcgaagaauaaacccacacuagacauugagcuccagaagaccgaagcaacucaacuggccacacuucggaaacuguguaucgagggaaagauuaccaacaucacgaccgauagccgcugcccuacacagggcgaagcugucuugccagaggaacaggaccagaauuauguuuguaaacacacuuacguggaucgagguugggggaacggaugcggccucuucggcaaggggagucugguaaccugcgccaaguuucaauguuuagagcccauagagggaaaagugguccaguaugaaaaucugaaguacacagugauuaucacuguucacaccggugaccagcaucaggugggcaacgagacacaaggggucaccgcagaaauuacuccucaggcuuccacgacagaggccauccucccagaauauggaacccuuggccuggagugcucuccgagaacugguuuggacuucaaugagaugauccuacugaccaugaaaaacaaggcguggauggugcacaggcagugguuuuucgaucucccccugccuuggacaagcggggccaccacugaaacaccaacguggaaucggaaagagcuucugguaaccuuuaagaacgcacaugcuaaaaagcaagaaguuguggucuugggcucccaggagggagccaugcacacugcucucacaggcgccaccgaaauucagaauucagggggaacaaguauauucgcaggucaccugaagugucguuuaaaaauggacaagcuggagcuaaaaggcaugagcuacgccaugugcacuaacaccuuugugcucaagaaagaggucucugaaacgcagcaugggaccauccugauuaagguggaguaccgcggagaagaugcucccuguaagaucccuuucuccacagaggacggccaagguaaagcgcacaacgggagacuuauaacugcaaauccaguugugaccaagaaagaggaacccguaaacauugaggccgaaccgccuuucggcgagucaaauaucgucaucggaauuggcgauaacgcuuugaagaucaauugguauaaaaaggggagcaguauuggaaagauguuugaagccacagcaaggggugcccggcgaauggcuauacugggcgacacugccugggauuucgggucugugggaggcguucucaacucccuggguaaaauggugcaucagaucuuugggagcgcauacaccgcgcuuuucucgggcgucucuugggugaugaagauuggaaucggcguacuguugacguggaucgggcucaauuccaaaaacacaucaaugaguuuuagcugcauugcuauaggaaucauuacccuguauuuaggcgccgugguucaggcagacauggguugugucaucaauuggaaggggaaagagcugaagugcggauccggcauuuucgugacuaacgaggugcacacauggaccgaacaguacaaguuucaagccgauucucccaaacgccuagcuacugccaucgcaggugcuugggagaauggcgucugugggauaagaagcaccacaaggauggaaaaccuccuguggaagcagaucgccaaugagcuuaacuauauuuugugggaaaauaacaucaaacugacgguuguggugggagacauuaucggcguacucgagcaggggaagcggacccugacuccacagccuauggaguuaaaauacucauggaagacauggggaaaagcgaagauagucaccgccgaaacacaaaacaguuccuucauuaucgauggccccaauacuccagagugccccagcgcuucucgcgcauggaacgugugggaaguugaggacuaugguuuugggguguucaccacgaauauuuggcugaagcuuagagaagucuacacacaguugugugaccauaggcucaugucagccgcugugaaagaugagcgugccguucacgcagacaugggauacuggaucgagagucagaagaacggcagcuggaaacuggaaaaggcgucccuaauagaggugaaaaccugcacuuggccuaagucucacacccuguggucgaaugguguacucgaaagcgauaugaucauuccaaagucccuggccggcccgaucucacagcauaaccaccggcccggguaucauacacaaacugcuggaccuuggcaccuuggcaaauuggagcuggacuuuaauuacugcgaggggaccacagucgugauuacggaaaacuguggaacccgaggcccaaguuuaagaacuacaaccgugucugguaagcucauccacgaguggugcuguaggagcugcacucugcccccucuucgcuauaugggggaagauggauguugguacggcauggagauacggccaauuuccgaaaaagaggagaauauggucaagucacugguuagcgccgguucuggcaaaguggacaacuucacaauggggguauugugccucgugauccuguuugaagaggucaugagaggaaaguucggcaagaaacauaugaucgcagggguguucuuuaccuucguucuacugcucuccggacagauuacguggagggauauggcucacacucugaucaugauuggcaguaaugccagcgaccgcauggguaugggggugaccuaucuugcauugauagccacauuuaagauccagcccuuccuggcuuuaggauuuuuccuccgaaaacugaccucucgggaaaaccuucugcuaggcgucggccucgcgauggccacuacacugcaauugccggaggauauugaacagauggcaaaugggaucgcucugggauuaauggcccucaagcugauuacccaguuugagacauaccagcuuuggacugcccugaucuccuugaccuguucaaacacgauguucacacucaccguggcuuggcguacugcaacccugauacuagccgguguuagucugcuuccugugugccaaagcucguccaugagaaaaacagacuggcucccaauggcggucgcugccaugggcguacccccucugcccuuguuuaucuucucucugaaggauacuuuaaagaggcgcagcuggccacucaaugagggggugauggcaguuggacuggugucaauucuugccaguucccuguugcggaacgacgucccuauggcuggcccccucguggcaggugggcugcuaaucgccuguuauguaauuaccggaacgucugcggaucugacaguggaaaaagcugccgacaucaccugggaggaagaggcagaacagacuggcgucagccauaaccuuaugauaacaguugacgaugacggcaccaugagaauuaaggaugacgagacugagaauauccucacagugcuguugaaaaccgccuuacugaucauuuccgggguguuuccauacucaauaccggcuacgcuccuggucuggcacacuuggcagaagcagacccaaaggagcggagugcuuugggauguuccuagucccccagaaacacagaaagccgagcuggaagaggguguauaccgaaucaagcagcagggcauuuucgggaaaacccaagugggagucggcgugcagaaggaggguguuuuucauacaauguggcacgugacucgcggggcagucuugaccuauaacggaaagcggcuagaacccaauugggcuucugugaaaaaggaccugaucuccuacggcggcggguggagacucagcgcccaguggcaaaaaggagaggaaguacaggucauugcgguggagccugguaagaacccaaaaaauuuccagacgaugcccggcacauuccagacuaccacaggggaaaucggagccauagcacuggauuuuaagccuggcaccucggguucaccgaucauuaacagggaggggaagguugugggacuuuauggcaauggcgucgugacuaaaaacgggggauacguuucugguaucgcucaaaccaaugccgagccagacggccccacaccugaauuagaggaagagauguucaagaaacguaaccugacgauuauggaucuccacccagggaguggaaagacucgcaaauauuugcccgcuaucauacgggaagcaauuaagagaaggcugcgaacccucauccuggccccuacacggguggucgccgcugagauggaggaagcgcuuaagggccugccgauccgcuaccagaccacugcaacaaaauccgagcauaccgguagagaaauuguggacuugaugugccacgccacguuuacuaugaggcuacugagccccguacgggugccaaauuauaaccucaucauaauggaugaggcucauuucacagacccugccucuauugcagcccgaggguacaucagcaccagaguuggaaugggcgaagcugcggccauuuuuaugaccgcaacucccccaggcacagcugaugccuucccucaguccaaugcacccauccaggacgaggagcgcgacauaccagaaaggucauggaacagugggaaugaguggauuaccgauuuuagcggaaagacagucugguucgugccgucuaucaaagccgguaacgacaucgcuaacuguuuacguaagaauggcaaaaaggugauucaacugucccggaagacuuuugauacggaauaccagaaaaccaagcuuaacgacugggauuucgucguaacaacugacaucucagagaugggggccaauuuuaaagcggauagagugauugacccuaggcgcugccugaagcccguuauacucaccgauggaccagagcgagugaucuuggcaggccccaugccugucacagccgcuagugccgcucagagacgggguaggguggggcgcaacccacagaaagaaaaugaccaauauauuuucaccggccagccccugaacaaugaugaggaccacgcacauuggacugaagccaagaugcuccuggacaacaucaauacgccugagggaaucauuccggcucuuuucgaaccagagcgugagaagagcgccgcaauagauggcgaauacagacuaaaaggggagucccggaagaccuuuguugaacugaugaggcgcggagacuugcccgugugguuagcgcacaaagucgccucugaggguaucaaguauacagaucgaaaauggugcuucgacggccagagaaacaaucagauucuggaagagaacauggauguggagaucuggacuaaggaaggggagaaaaagaagcuccggccuagguggcuggacgcucgcaccuacucggauccccuugcccugaaagaauuuaaggacuucgcagcuggaagaaaaagcauugcccucgauuugguaacagagaucggcagggugccaucacaccuggcacaucggacccguaaugcccuagacaaccugguuaugcuccacacuuccgaacauggugggcgcgcuuaucgacacgcggucgaggagcuuccugaaacaauggagacgcuguuauugcugggccucaugauacugcuuaccggaggcgccaugcuguuucucaucagugggaagggaauugguaaaacuucuaucggcuugauuugugugaucgcaagcuccgggaugcuguggauggcugaaauacccuuacaauggauugccucagccaucgugcuagaguucuuuaugaugguccugcucauuccagagccugaaaagcagagaacaccgcaggauaaucaacuugcauacguugugaucggaauacugaccuuggcugccaucauugcggcuaacgagaugggccugcucgaaaccacaaagagggaccuggguaugucuaaagagcccgggguagugagcccaacuaguuaucuugaugucgaccuccacccugccuccgcauggacgcuguacgccguggcuaccacaguuaucacucccauguugcggcauaccauugaaaauagcacagcaaacgugucucuggccgcgaucgcuaaccaggccgucguauuaaugggccuagacaagggauggccaauaucaaaaauggaucugggcgugccucuccuugcacuggggugcuacucccagguuaaucccuugacccugacugccgcugugcuccugcuuauuacgcacuaugccaucaucggaccgggcuuacaggcaaaggcuacacgcgaggcccaaaaaagaaccgcggccgguauuaugaagaacccaacugucgacgggaucaugaccauagaucuggacccugugauuuacgauaguaaguucgagaaacagcucggacaggucauguugcuggugcuaugugcaguucagcugcuccuuaugaggacaagcugggcucugugcgaagccuugacucuggcaaccggccccaucacaacgcucugggaggguucgccaggcaaguuuuggaauaccacuauugcugugucuauggccaacaucuuccggggguccuaucuggccggagcgggcuuagcuuuuagcauaaugaaaucaguagggacaggaaagcgaggcaccgguagucaaggggaaacucuuggagagaaauggaagaagaaacugaaucagcucucuagaaaggaauucgaccuauacaaaaaguccggcaucacagagguggaucgcaccgaggcaaaagaaggucugaagaggggcgagauuacgcaucacgccgucagccgggggucagcuaaauugcagugguuuguugaacguaacauggugauccccgagggaagagucauugaccugggcugugggaggggaggcuggaguuauuacugcgccggucucaagaaggugaccgaaguacgcggguauacaaaaggaggcccuggccaugaggagccggugcccaugagcacuuacggguggaauaucguuaagcuuauguccggaaaagauguguucuaccugccaccugaaaagugugacaccuugcugugcgauauuggugagucuagccccuccccuacagucgaagagucacggacuauccgagugcucaaaauggucgagccaugguuaaagaacaaucaguucuguauaaaggugcugaaccccuauaugccuaccguuauugaacaccuugagagacugcaaaggaaacacggcgggaugcuaguacgcaauccacucucucggaacaguacacaugaaauguacuggaucucgaauggaaccggcaacaucguggcaagcgucaauaugguguccagacuguugcugaaccguuuuacuaugacgcacaggcggcccacaauugagaaggacguugaucucggugccgggacccgccaugugaacgcugaaccggagacuccuaauauggacgucauaggagagcgaaucaaaagaauuaaggaagagcacaacucuaccuggcacuaugacgaugaaaauccauacaaaacaugggcguaucauggcucauacgaggugaaggccacgggcagcgcauccaguaugaucaacgggguagugaagcuucugaccaaacccugggacguugucccuauggugauucagauggcuaugacugauacaaccccauucggacagcaaaggguguuuaaggaaaaagucgacacucggacaccccgcucuaugccggguaccagaaggguuaugggcaucacagccgagugguuauggcgaacucuggggcggaauaagaaaccucguuugugcaccagagaggaauucacgaagaaggugcgcaccaacgcagccaugggagcuguauuuacagaggaaaaucagugggauagcgccaaagcggcaguggaggacgaagauuucuggaagcucgucgacagggagcgggagcugcacaaacuaggcaagugugguucaugcguguauaacaugauggggaaaagagaaaagaaacuuggagaguuuggcaaggccaagggcucccgcgcuauaugguacauguggcugggggccagguaccucgaauucgaggcacugggauuuuugaaugaggaucauugguucagucgagaaaacagcuauucugguguugagggcgaagggcugcacaaacucggauacauccuucgggacauuuccaagauccccggcggugcuauguaugccgaugacacugcugggugggacaccagaauuacagaggaugaccugcauaaugaagagaaaaucacucagcagauggauccagagcacaggcaauuagccaacgcaauauuuaagcugaccuaccagaauaaaguggucaaggugcagcgcccuacgcccacaggaaccguaauggacauuaucucacguaaggaucagcggggcagcggccaaguugggacuuauggauugaacacauucaccaauauggaagcgcagcucaucagacagauggagggugaaggcgugcugucgaaagccgaccuagagaacccacaccuuucugaaaagaaaauuacucaguggcuggagaccaagggggucgagaggcucaaacgcauggcuauaaguggagaugacugcguggugaagcccaucgaugaccgauuugccaacgcacuguuggcuuuaaaugauaugggcaagguccggaaagacauuccucaauggcagccauccaaggguuggcaugauuggcagcagguuccguucuguagccaccauuuccacgaacugaucaugaaagacgggagaaagcucgugguacccugcaggccucaagacgagcuuauuggacgcgccagaaucucacagggcgcaggcuggucccugcgggaaacagccugucuagggaaagcguacgcucagauguggucucugauguauuuucacaggcgugaucuccgauuggccagcaacgcaauaugcagugccgugccaguccauugggugcccacgucccgcaccacuuggagcauccacgcucaucaccaauggaugacaaccgaggacaugcugacuguuuggaauagaguguggauugaagauaacccuuggauggaggacaagacaccagucaccacgugggagaaugugcccuaccuuggaaagcgggaagaucaguggugugguucucugaucggccucacaucaagggccaccugggcacagaacauuccuacugcuauccagcaaguacgcaguuuaauugggaaugaggaauuccuggacuacaugccguccaugaaaagauuucggaaggaggaggaaagcgagggagccauaugguga

SEQ ID NO: 15173 - RNA, 9873 nt, Artificial Sequence
  derived and/or modified CDS sequence (opt3) from DENV-3__GU131878__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcgccgacgugacaagagaagcguagcccuugcaccccacgugggcaugggucuggauacaaggacccaaacguggauguccgccgagggggcuuggcggcaggucgaaaaaguggagacuugggcauugcgccauccuggauucaccauucucgcccuguuucuggcucacuacaucggcacaucucucacucagaagguugugauauucaucuuacugaugcuugucaccccaucgaugacaaugagaugugugggcguagggaacagggacuuuguugaaggauugucaggugccaccuggguggaugucgugcuggagcauggcgggugcgugacgacuauggcgaagaauaaacccacacuagacauugagcuccagaagaccgaagcaacucaacuggccacacuucggaaacuguguaucgagggaaagauuaccaacaucacgaccgauagccgcugcccuacacagggcgaagcugucuugccagaggaacaggaccagaauuauguuuguaaacacacuuacguggaucgagguugggggaacggaugcggccucuucggcaaggggagucugguaaccugcgccaaguuucaauguuuagagcugauagagggaaaagugguccaguaugaaaaucucaaguacacagugauuaucacuguucacaccggugaccagcaucaggugggcaacgagacacaaggggucaccgcagaaauuacuccccaggcuuccacgacagaggccauccuuccugaauauggaacccugggcuuggagugcucuccaagaacuggucuagacuucaaugagaugauccugcucaccaugaaaaacaaggcguggauggugcacaggcagugguuuuucgaucugccgcuucccuggacaagcggggccaccacugaaacaccuacguggaaucggaaagagcuguugguaaccuuuaagaacgcacaugcuaaaaagcaagaaguugugguccucggcucccaggagggagccaugcacacugcucugacaggcgccaccgaaauucagaauucagggggaacaaguauauucgcaggucacuuaaagugucgucugaaaauggacaagcuagagcucaaaggcaugagcuacgccaugugcacuaacaccuuugugcugaagaaagaggucucugaaacgcagcaugggaccauccuuauuaagguggaguacaagggagaagaugcuccauguaaaauccccuucuccacagaggacggccaagguaaggcgcacaacgggcgcuugauaacugcaaauccuguugugaccaaaaaggaggaaccaguaaacauugaggccgaacccccguucggcgagucaaauaucgucaucggaacaggcgauaacgcucugaaaauuaauugguauaagaaggggagcaguaucggaaaaauguuugaagccacugcaagaggugccaggcggauggcuauucucggcgacaccgccugggauuucgggucugugggaggcguucugaacucccuugguaagauggugcaucagauauuugggagcgcauacacggcgcuguucucgggcgucucuugggugaugaaaaucggaauuggcguauugcucacauggaucgggcugaauuccaagaacaccucaaugaguuuuagcugcaucgcuauuggaauaaucacuuuauaucugggcgccgugguucaggcagacauggguugugucauuaauuggaaagggaaggagcuaaagugcggauccggcaucuucgugacaaacgaggugcacaccuggacugaacaguacaaauuucaagccgauucuccuaagcgacucgcuaccgccauugcaggugcuugggagaauggcgucugugggauccgcagcacaacgagaauggaaaaccugcuuuggaaacagauagccaaugaguugaacuauauccugugggaaaauaacauuaagcucaccguuguggugggagacaucauuggcguacuggagcaggggaaaaggacuuuaacaccccagccaauggagcugaaguacucauggaaaaccuggggaaaggcgaagaucgucacagccgaaacucaaaacaguuccuucauaauugauggcccuaauacccccgagugcccaagcgcuucucgggcauggaacgugugggaaguugaggacuaugguuuugggguguucacgacaaauaucuggcuuaaauugcgcgaagucuacacccagcucugugaccauagacugaugucagccgcugugaaggaugagagggccguucacgcagacaugggauacuggauugagagucagaaaaacggcagcuggaagcuagaaaaagcgucccugaucgaggugaagacuugcaccuggcccaagucucacacacucuggucgaaugguguacuggaaagcgauaugauaaucccuaaaucccuugccggcccaauuucacagcauaaccaccguccgggguaucauacucaaaccgcuggacccuggcacuugggcaagcuggaguuagacuuuaauuacugcgaggggacaacggucgugaucaccgaaaacuguggaacucggggcccuagucuccgaacaaccacugugucugguaaacugauucacgaguggugcuguagaagcugcacacuuccaccccugagguauaugggggaagauggauguugguacggcauggagauccgcccuauauccgaaaaggaggagaauauggucaaaucauugguuagcgccgguucuggcaagguggacaacuucaccauggggguacucugccuggcaauucuauuugaagaggugaugcggggaaaguucggcaaaaagcauaugaucgcuggggucuucuuuacguucgugcugcuccuguccggacagaucacuuggagagauauggcccacacccuuauuaugaucggcaguaaugcaagcgacaggauggguauggggguuacauauuuggcccugauugcuaccuuuaaaauacagccauucuuagcgcucggauuuuuccugcgcaagcuuacuucucgagaaaaccugcuacucggcgugggccuggccauggcaacaaccuugcaacugcccgaggauaucgaacagauggcuaaugggauugccuuaggacucauggcccugaaacuuaucacacaguuugagacuuaccagcuguggaccgcuuugauuucccucacguguucaaacacaauguucacccugacugucgcauggcggaccgccacacuaauccuggcgggugugagucuucucccgguuugccaaagcucguccaugcguaagacugacuggcugccuauggcuguggccgcaaugggcgucccacccuugccucuguuuauauucucuuuaaaggauacccucaaaagaaggagcuggccccugaaugaggggguaauggccgugggacuuguuucaauccuggcuaguuccuugcuccgcaacgacgugccaauggcaggcccucuggucgccggugggcuacugauugcguguuaugugaucacgggaacaucugcugaucuuaccguagaaaaggccgcagacauuacuugggaggaagaggccgaacagacaggcgugagccauaaccucaugaucaccgucgacgaugacggcacuaugcggauaaaagaugacgagacagagaauauucugaccguuuuguuaaagacggcucugcucaucguguccgggguguuucccuacucaaucccagccacucugcuugucuggcacaccuggcagaaacagacacaaagaagcggagugcugugggauguuccgaguccucccgaaacccagaaggcagaguuggaagaggguguauacaggauuaaacagcagggcauauucgggaagacacaagugggagucggcgugcagaaggaggguguuuuucauacuauguggcacgugacccgaggggcuguccuaacguauaacggaaaacgccuggaaccaaauugggccucugugaagaaagaccucaucuccuacggcggcggguggcggcugagcgcgcaguggcaaaagggagaggaaguacaggucauugccguggagcccgguaaaaacccuaagaauuuccagacaaugccaggcacuuuccagaccacaaccggggaaaucggagcaauugcucuugauuuuaagcccggcacuucggguucaccuaucauaaacagagaggggaaaguugugggauuauauggcaauggcgucgugaccaagaacgggggauacguuucugguaucgcccaaacaaaugcugagccggacggcccaacgcccgaacuggaggaagagauguucaaaaagaggaaccucacuauuauggauuugcacccugggaguggaaaaacccguaaguaucugccagcaaucgugcgcgaagccauuaagcggagacucaggacacugauccuugcccccacccgagucguggcugcggagauggaggaagcacugaaaggcuugccuauacgguaccagacuacagccaccaaguccgagcauacgggucgcgaaauuguagaccuaaugugccacgcuacuuuuacaaugagacugcucagcccggugaggguucccaauuauaacuuaaucaucauggaugaggcccauuucaccgacccagcaucuauugccgcucggggguacaucagcacccgagucggaaugggcgaagcggccgcaauauuuaugacugcuacaccucccggcaccgccgaugcauucccacaguccaaugccccuauucaggacgaggagagagacauccccgaacgcucauggaacagugggaaugaguggauuacagauuuugcuggaaaaacugugugguucgugccaagcaucaaggccgguaacgacauagcgaacugucugaggaaaaauggcaagaaggucauucaacuuucucguaaaacguuugauaccgaauaccagaagacaaaacugaacgacugggauuucguagugacuaccgacaucuccgagaugggggcaaauuuuaaggccgaucggguuaucgacccgagaaggugccucaaaccugugauuuugacagauggacccgagcgcgucauccuggcuggcccaaugcccgugaccgccgcuucagcagcccagcgaagaggucggguugggaggaacccucagaaggaaaaugaccaauauauuuucacuggccagccacucaacaaugaugaggaccacgcucauuggacggaagccaagaugcugcuugacaacauaaauacccccgagggaaucauuccugcacuauucgaaccggagcgcgagaaaagugcggccaucgauggcgaauaccgucugaagggggagagcagaaaaacauuuguggaauugaugcggaggggagacuuaccagucuggcuggcucacaagguggccuccgaggguaucaaauauacugaucgcaaguggugcuucgacggccagcgaaacaaucagauucucgaagagaacauggauguagagauauggaccaaagaaggggagaagaagaaacugagaccccgguggcuugacgcaaggacauacucugauccucuggcucucaaggaauuuaaagacuucgccgcaggacgcaagucgaucgccuuggaucuggugaccgagauuggcagaguucccagccaccuagcucauaggacucggaaugcgcuggacaaccucgucaugcuucacacaucagaacauggugggcgugccuaucgccacgcaguggaggagcugccagaaacgauggagaccuuauugcugcucggccugaugauccuucugacuggaggcgcuaugcucuuuuugauuuccgggaaaggaaucgguaagacaaguauaggccugaucugugugauugccucuagcgggauguuauggauggccgcaaucccucuacaauggauugcuuccgccaucguccuggaauucuuuaugaugguucuccuuauacccgagccagagaagcagcgaaccccucaggauaaucaacuggcguacgugguaauuggaaucuugacccuggcugccauuaucgcagccaacgaaaugggccuccuggagacaacuaaaagagaccuugguaugucaaaggaaccggggguggucucucccacgagcuaucucgauguggaccugcacccagcuagugcauggaccuuguacgccguugcgacaacugugauaaccccuaugcugaggcauacaaucgagaauuccaccgcuaacgucagcuuagccgcaauugccaaccaggcuguagugcuaaugggccuggacaaaggauggcccaucucuaagauggaucucggcguuccacuucuggccuuggggugcuacucacaggugaauccucugacucucacggcagcuguccugcuuuuaauuacacacuaugccaucauaggacccggccugcaggcgaaagccacccgggaagcacaaaagcgcacugcugccgguauuaugaagaacccgaccguggacgggaucaugacaaucgaucucgacccagucauuuacgauuccaaauucgagaagcaguugggacaggugaugcugcuaguucugugugcagugcagcuccuucugaugagaacuaguugggcuuugugcgaggcccugacccucgccacaggcccuaucacgacccugugggaagguagccccggcaaauuuuggaauacuacaauagcgguaucgauggcuaacauuuucagggggucuuauuuagcaggagccggccuugcuuuuuccaucaugaagagcguggggaccggaaaacggggcacugguucacaaggggagacacugggagaaaaguggaagaaaaagcucaaucagcuaagucgaaaagaguucgaccuguacaagaaaucuggcauuaccgaagucgauagaacggaggccaaggaggguuugaaacgcggcgaaaucacccaucacgcaguuuccagggggagcgccaagcugcagugguuuguggagcggaacauggucauaccagaaggacgugugaucgaccucggcugugggagaggaggcuggucauauuacugcgcuggucuuaagaaaguaacagaggugaggggguauacuaagggaggccccggccaugaagagccuguuccgaugaguaccuacggguggaauauugugaaacugaugagcggaaaggaugucuucuacuugcccccagagaaaugugacacacugcucugcgauaucggugaauccucuccuagccccacuguggaggaaucccgcaccauucgggucuuaaagaugguggagccuuggcugaagaacaaucaguucuguaucaaaguucuuaacccauauaugcccacaguaauugagcaccuggaacgacuacaaagaaagcacggcgggaugcucgugaggaauccucugucacgcaacucuacccaugagauguacuggaucaguaauggaacuggcaacauagucgcgucggugaauaugguuagccgguugcugcucaacagauuuacgaugacacaccguaggccaaccauugaaaaagacguggaucuuggugccgggacucggcaugucaacgcagagcccgaaaccccgaauauggacgugaucggagagcgcaucaagcgaauuaaagaggaacacaacuccacauggcacuaugacgaugagaauccuuacaagacgugggcuuaucauggcucuuacgaaguaaaggccaccggcucagcaagcuccaugauaaacggggugguuaaacuguuaacuaagccaugggacgucgugcccauggugacacagauggccaugaccgauacuacaccuuucggacagcaaagagucuuuaaagagaagguugacaccaggacaccacggaguaugcccgguacucgcagagugaugggcaucaccgcugaauggcuguggaggacguuggggcgaaauaaaaagccgcggcucugcacccgugaggaguucacaaagaaaguaagaacuaacgccgcgaugggagcaguguuuaccgaagagaaucagugggauucugccaaggcugccgucgaagacgaggauuucuggaaacugguggaccgcgaaagggagcuacacaagcuuggcaaaugugguagcugcguuuauaacaugauggggaagcgggagaaaaagcugggagaauuuggcaaggcaaaaggcucaagagcuauuugguacauguggcucggggcccgcuaccuggaguucgaagcuuugggauuucugaaugaggaucauugguucuccagggagaacaguuauagcgguguggaaggcgaggggcuccacaagcuuggauacauccugcgagacauuucuaaaaucccuggcggugccauguaugcagaugacacagcggggugggacacucggauaaccgaagaugacuuacauaaugaggaaaagaucacgcagcagauggaucccgagcacagacaacuggccaacgcuauuuuuaaauugacauaccagaauaaggucgugaagguacagaggccaaccccuacuggaacaguuauggacaucauuucccgcaaagaucagcguggcucaggccaaguggggaccuauggacucaacacuuucaccaauauggaggcccagcugauccggcagauggaaggugagggcguccuaagcaaggcagaccuugaaaacccccaccugccagagaaaaagauaacacaguggcucgaaacgaaagggguggagagacugaagaggauggcuauuucgggagaugacugcguggucaagcccaucgaugaccgcuuugccaacgcauuguuagcccugaaugauaugggcaaaguucgaaaggacaucccucaauggcagccaucuaaagguuggcaugauuggcagcaggugccguucuguagucaccauuuccacgagcucauuaugaaggacgggcggaaacuuguagugcccugcagaccucaagacgaacugauaggaagggcgcgcaucucccagggcgcuggcuggagccuaagagagaccgccugucuggggaaggcauacgcccagauguggucacucauguauuuucaccggagggauuugcgucuggcuuccaacgccauuugcucugcagucccagugcauuggguucccacuagccgaacaaccuggaguauccacgcucaucaccaauggaugacuacagaagacaugcuuaccguguggaaucgcgucuggauugaggauaacccuuggauggaagacaagacgccagugacaaccugggagaauguacccuaccugggaaaaagagaggaucaguggugugguucccucaucggcuuaacuagccgggccaccugggcgcagaacauaccuacagcuauccagcaaguuaggucucugauugggaaugaagaguucuuggacuacaugccgucaaugaagcgcuuuagaaaagaagaggagagugaaggagccaucugguga

SEQ ID NO: 15174 - RNA, 9873 nt, Artificial Sequence
  derived and/or modified CDS sequence (opt3) from DENV-3__FJ898455__SS-prME
accagccugugccucaugaugaugcuucccgccacacuggcuuuccacuugacuucccgagacggagaaccuaggaugaucguggggaagaacgaacggggaaaaucuuuacuguuuaagacggcaucagguauuaauauguguacccugauagccauggaucucggcgagaugugcgacgauacagucacuuacaaauguccacugaucaccgaaguugagccggaagacauugauugcugguguaaccuuacaaguaccugggugacuuaugggacaugcaaucaggcgggagagcaucgccgagacaagcguagcguagcucuggcaccccacgugggcauggguuuggauaccagaacgcaaacuuggauguccgcagagggggccuggaggcaggucgaaaaaguggagaccugggcuuuccggcauccuggauuuacaauccucgcacuguuccuggcccacuacauuggcacuucucucacccagaagguugugaucuuuauauuacugaugcuugucacaccaucgaugaccaugcgcugugugggcguagggaaccgggacuucguugaaggauugucaggugcuacguggguggaugucgugcuggagcauggcgggugcgugacuacaauggccaagaauaaacccacccucgacaucgagcuccagaagacugaagcgacacaacuggcaacccuuaggaaacuguguauugagggaaagaucacgaacgucaccacagauagccggugcccuacucagggcgaagccauuuugccagaggaacaggaccagaauuauguuuguaaacacaccuacguggaucgcgguugggggaacggaugcggccucuuuggcaaggggagucugguaacaugcgcuaaguuccaauguuuagaguccaucgagggaaaagccgugcagcacgaaaaucugaaguauacugucauaauuaccgugcauacaggugaccagcaccagguuggcaacgagacccaaggggugacugcagaaaucacgccccaggcuucuacagucgaggccauucucccugaauacggaacccuuggccuggagugcagcccacgaacugguuuggacuuuaaugagaugauccuacugaccaugaaaaacaaggcguggauggugcauagacagugguucuuugaucucccgcugcccuggacauccggggccaccacugaaacaccuacguggaauaaaaaggagcuucugguaaccuucaaaaacgcacacgcuaagaagcaagaaguuguggucuugggcucacaggagggagccaugcacacugcucucacaggcgccaccgaaauccagacaagugggggaacuagcauuuuugcaggucaucugaaauguagguuaaagauggacaaacuggagcuaaagggcaugucuuaugccaugugccucaaugcuuucgugcugaaaaaggaggucuccgaaacccagcacgggacgauacuuaucaagguggaguacaaaggagaagaugcgccauguaagauucccuucucaaccgaggacggccaagguaaagcacauaacgggcgguugaucacagccaacccuauaguuacuaagaaagaggaaccagugaauauugaggcugaacccccguuuggcgagagcaacaucguaaucggaauuggcgauaaggcccugaagaucaauugguacaaaaaggggaguucuauuggaaaaauguucgaagcaaccgcccguggugcucgcagaauggccauacucggcgacacagcaugggauuuuggguccgucggaggcgugcugaacagccuugguaagaugguucaccagaucuucgggucggcguauacugcucuguuuucuggcguguccuggauuaugaaaaucggaaucggcgucuugcucaccuggauugggcuaaauucaaagaacacgaguaugagcuucuccugcauagugaucggaauuaucacauuauaccugggcgccguagugcaggcagacauggguuguguuauuaauuggaaggggaaagagcuaaagugcggaucuggcaucuuugucaccaacgaggugcauacuuggacagaacaguauaaauuccaagccgauagcccuaagaggcucgcuaccgccauagccggugcuugggagaauggcgugugugggauccggucaacuacccgaauggaaaaccugcuuuggaaacagauugccaaugaguugaacuacauccugugggaaaauaacauuaagcucacaaucgucguuggagacgugauaggcgugcuggagcaggggaaacgcacguuaacaccccaaccaauggagcugaaguauaguuggaagacuuggggaaaagcgaagauuguaacagccgaaacccaaaauuccagcuuuaucauugauggcccuaacacacccgagugcccaucugcuucaagagcauggaacgucugggaaguggaggacuacgguuucgggguuuuuacuaccaauaucuggcuuaaauugagggaaauguauacgcagcucugugaccaccggcugaugagugccgcugugaaggaugagcgcgccguccacgcagacaugggauacuggauagagagccagaaaaacggcuccuggaagcuagaaaaggcgucucugaucgaggugaaaacaugcaccuggcccaagucgcauacucucuggagcaaugguguucuggaauccgauaugauuaucccuaaaucacuugccggcccaauuagucagcacaacuacagaccgggguaucauacccaaacagcuggacccuggcacuugggcaagcuggaguuagacuucaauuacugcgaggggacuaccgugguaaucacagaaaacuguggaacgaggggcccuucucuccguaccacuacagucagcgguaaacugauacacgaguggugcugucgguccugcacccuuccaccccugcgauauaugggggaagauggauguugguacggcauggagauuagaccuaucaaugaaaaggaggagaacauggugaagucauuggugagcgccgguucuggcaaagcagacaauuuuacuauggggguccucugccuggcuauccuauucgaagagguuaugaggggaaaguucggcaaaaagcauaugauugccggggcacuguuuacauucgugcuccugcuuuccggacagaucaccuggcgcgauauggcccacacguugauuaugauaggcaguaacgcuagcgaccggauggguauggggguaacuuaucuggcguuaaucgccaccuuuaaaauucagccauuccucgcacugggauuuuuccuuagaaagcugacaucuagggaaaaucuacuccugggcgugggcuuggcuauggccaccacucugcaauuacccgaggauaucgaacagauggccaacgggauugcucucggacugauggcacuuaagcugaucacacaguuugagaccuaccaguuguggacagcccucgucucccugauguguucaaauacuauauucacccuaacgguggcguggcgcacagcuacccugauccuugccguuauuagucuccugccggugugccaaagcucguccaugcgaaaaacugacugguugccuaugaccgucgcagccaugggugugccaccccugccuuuauuuaucuucucucucaaggauacacugaaacggcguagcuggccccuuaacgagggcguuauggcuguggggcuggucucaauuuuggcaaguuccuuucucagaaaugacguaccaauggccggaccucugguggcgggcggucuacugaucgcuuguuauguuauaacugggaccucugccgaucuuacgguggaaaaggcagccgacgucacaugggaggaagaggcugaacagaccggagugagccauaaccucaugauuacuguagacgaugacggcacaaugaggaucaaagaugacgagaccgagaacauccugacuguguuguuaaagacagcccugcucauugucuccggcauauuccccuacucaaucccagcaacccugcuuguuuggcacacguggcagaaacagacucaacgcagcggggugcugugggaugugccgaguccucccgaaacccagaaggcugaguuggaagagggagucuaccggauuaagcagcaggguaucuuuggcaaaacacaaguggggguuggaguacauaaggagggcguguuccacaccauguggcacgucacaagaggugccgugcuaacucauaaugggaaaaggcuggaaccaaacugggcgaauguuaagaaagaccucauuucuuauggaggcggcuggaagcuguccgcccaguggcagaagggggaggaagugcaagucaucgcaguggagcccggcaagaacccuaagaauuuccagaccaugccagguauauuucagacgacaacuggcgaaaucggggcuauugcccuugauuucaaacccggaaccagcggcucgccuaucauuaaccgagaggguaagguagucggguuauacggaaauggcgugguuaccaagaacggcggguaugugucaggaaucgcucagaccaaugcagagccggacgguccaacucccgaacuggaggaagagauguuuaagaagcgcaaccucaccauaauggauuugcacccuggcucugggaaaacacggaaguaccugccagccauugucagagaagccaucaaaaggcgucuccgcacgcugauccuugcucccacucgggugguugcggcagagauggaggaagcccugaagggauugccuauuagauaucaaaccacagcuaccaaaagugagcauacuggcagggaaaucguggaccuaaugugccacgccacauucaccaugcgacugcucuccccgguccgggugcccaauuacaacuuaauaguaauggaugaggcacauuuuacggacccagccagcauugcugcgcgcgguuauaucucuacuagaguggggaugggagaagccgcagcuauuuucaugacagccaccccucccggcaccgcagaugccuuuccacagagcaaugcuccuauccaggacgaggagagggacauacccgaacgguccuggaacucaggcaaugaguggauuacugauuucgccgggaagacaguuugguuugucccaaguaucaaggcgggaaacgacaucgcaaacugucugagaaagaaugguaagaaagugauucagcuuagcagaaagaccuucgauacagaauaccagaagacuaagcugaacgacugggauuuuguggucacgaccgacaucucugagaugggcgccaauuucaaggcugaucgcguaauugacccgaggcguugccucaaaccugugauauugacagaugggcccgagcggguuauccuggccggaccaaugcccgugacugucgcuuccgcagcccagagaaggggccgcgugggucgaaacccucagaaggaaaaugaccaguacauuuucaccgggcaaccacucaacaaugaugaggaccacgcucacuggacagaagccaaaaugcugcuugacaacaucaauacccccgagggcaucauuccugcacuauuugaaccggagagagagaagucagcggccauagauggagaauaucggcugaaaggcgagaguaggaagacuuucguugaauugaugcgccguggggacuuaccaguguggcuggcucauaaagucgccagcgagggaaucaaguacacggauagaaaguggugcuuugacggugaacggaacaaucagauucucgaggagaacauggauguggaaaucuggaccaaagagggcgaaaggaagaaacugcgcccccgauggcuugacgcaagaacauauuccgauccucuggcucucaaggaguucaaagacuuugccgcagggcggaagucuauugccuuggaucugguaacugaaaucggaagggugcccucgcaccuagcucaucgcaccagaaaugcgcuggacaaccucguuaugcuucacacaagcgagcacggcgguagggccuaccggcaugcagucgaggaacugccagagaccauggaaacuuuauugcugcucgggcugaugauacuucugacaggcggagcuaugcuauucuugaucucaggcaaggggauuggaaaaacguccaucggucugauuugugugguggccaguucuggcauguuauggauggccgaugucccucuacaguggaucgcaagcgcuauaguucuggaguuuuucaugauggugcuccuuauucccgagccagaaaagcagcguaccccucaagacaaucagcuggccuauguagugaucgggauuuugacucuggcggcuaucgucgccgcaaacgagaugggacuccuggaaacaaccaaacgcgaucuuggcauguccaaggagccgggugugguuucacccaccucuuaccucgacguggaccugcacccagccagcgcuuggacauuguaugcagucgccacuacgguaauaaccccuaugcugcgacauacaaucgaaaauaguacugcgaacguguccuuagcugccauugcaaaccaggccguugugcuaauggggcuggauaaaggcuggcccaucagcaagauggaccucggagucccacuucuggcuuugggcugcuacucucaagugaauccucugacccucacagccgcaguccugcuuuuagugacccacuacgcuauuaucgggcccggacugcaggccaaggcgacuagagaggcccagaaaaggacggcagcuggcauaaugaagaacccgacaguugaugguauuaugaccaucgaccucgauccagugaucuaugacucaaaauuugagaagcaguuggggcaaguaaugcugcuagugcugugugccguccagcuccuucugaugcggacuuccugggcauucugcgaggcuuugacccuggccacaggaccuauuacuacccucugggaaggcagucccgguaaauuuuggaauacaacgaucgccguuagcauggcgaacauauuccgcggcucguaccuggcuggggcaggauuagccuuuucuauuaugaaguccgugggcaccgggaagagaggaacuggcagccagggugaaacacuuggggagaaauggaagaaaaagcugaaucagcucucaaggaaagaguucgaucuauauaagaaaaguggaaucaccgaggucgaccggacugaggcuaaggaaggccugaagcgaggugagauuacacaucacgccgugucuagaggcuccgcaaaauugcaaugguucguagaacgcaacauggugaucccagaggggaggguuauagaucugggauguggcagagggggauggagcuacuauugcgccggccucaagaaagugaccgaaguccgugguuacacgaaagggggacccggccacgaggagccugugccgaugucaaccuauggcuggaauaucgucaaacuuaugagugggaaggacguguuuuaccugcccccagaaaagugugauacauugcugugcgacauuggagagagcuccccuucucccacuguugaagagagcagaaccaucaggguacucaaaaugguggagccuugguuaaagaacaaucaguucuguauuaaaguccugaacccauacaugcccacagugaucgaacaucuugagcgccugcagcggaagcacgguggcaugcuaguucgaaauccucucuccagaaacucaacucaugaaauguauuggauuucuaaugggaccggaaacaucgugaguucggucaauauggugagcaggcuguugcugaaccgcuuuacaaugacccaccggagaccaacuauagagaaagauguagaccucggcgcugguacgcgucacgugaacgcggaacccgagacaccgaauauggacguuauuggggagaggauccggcgcaucaaggaagaacauuccucuaccuggcacuacgaugacgaaaacccuuauaagacuugggccuaccauggaucauaugaggucaaagcaaccggcagcgcuuccaguaugauuaauggcguggugaaacuucugacaaaaccaugggaugucguucccauggugacgcagauggccaugaccgacacuacaccuuucgggcaacagcgaguauuuaaggaaaaaguggauaccagaacuccaaggcccaugccgggaacacggaaggucauggagauaaccgcagagugguuauggcgcacacuggguagaaacaagaggccucgauugugcacucgggaagaguucaucaaaaaggugcguaccaaugccgcuaugggcgccguuuuuacggaagagaaccagugggacucugcgagagcagccguggaagaugaggaguucuggaaacucgucgaccgcgaaagggagcugcacaagcuagggaaauguggaagcugcguguacaauaugaugggcaagcgggagaagaaacuuggugaguuugggaaagcuaaaggaucaagagccauuugguauauguggcugggcgcacgcuaccucgaguucgaagcucugggcuuuuugaacgaggaucauugguucuccagggaaaauaguuacagcgggguagagggagaaggucugcacaagcucggcuauauccuucgagacauuucuaaaauccccgggggagccauguacgcugaugacaccgccggcugggacacacggauaacugaggaugaccugcacaacgaggaaaagaucacccaacagauggauccagagcauagacaguuagcaaaugcgauuuuuaaacugacauaucagaacaagguugugaagguccaaaggccuacucccaaagguaccgugauggacaucauuucccgcaaggaucagcgugggucaggacaggugggcacguacggcuugaauacauucaccaacauggaagcccagcucauccggcaaauggagggggaaggaguccugagcaaagcugaccuagagaauccacaccuucuggagaagaaaguuacucaguggcucgaaacaaaggguguggagagacugaagaggauggccauaucgggcgaugacugcguagugaaacccauugaugaccgcuucgcaaacgcuuuguuagcccugaacgauauggggaagguccgaaaagacaucccucaguggcagccaucuaagggauggcaugauuggcaacaggugccguuuuguagucaccacuuccaugaacucaucaugaaagacggccggaaacuuguugugcccugcagaccucaggacgagcugauugguagggcacgcauaucccagggggccggauggagccuaagagaaaccgcgugucugggcaaggcuuaugcccaaaugugggcacucauguacuuucaccggagggauuugcgucuggccucaaaugcuaucugcuccgccgucccagugcauuggguacccacuucucgaaccacauggagcauucacgcacaucaccaguggaugacgaccgaggacaugcuuacuguuuggaaccgcguguggaucgaggauaauccuuggauggaagacaaaacaccagucaccacuugggaggaugugcccuaucugggcaagagagaagaccaguggugugggagucucauuggauuaacaucccgggcuaccugggcccaaaacauccugacggcgauacagcagguuaggagcuugaucgguaaugaggaguuccuggauuacaugccuucuaugaaacgcuuuagaaaggaagaggaaucagagggcgcuauuugguga

SEQ ID NO: 15175 - RNA, 9873 nt, Artificial Sequence
  derived and/or modified CDS sequence (opt3) from DENV-3__GQ199891__SS-prME
accagccugugccucaugaugauccuucccgcagcucuggcauuccacuugacauccagagacggcgagccuaggaugauuguggggaagaacgaacggggaaaaucuuuacuguuuaagacugcaucagguauaaauauguguacgcuaaucgcgauggaucucggcgaaaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccagacguggauguccgccgagggggcuuggaggcaggucgaaaaaguggagacuugggcauugcggcacccuggauucaccauucucgcccuguuucuggcucauuacaucggcacaucucucacucagaaggccguuauauucaucuuacugaugcuugugaccccaucgaugacaaugcgcugugucggcguggggaacagagacuuuguagaaggauugucaggugcgaccuggguugaugugguccuggagcacggcgggugcgugacgacuauggcaaagaauaaacccacacuagacauugagcuccagaagaccgaagccacucagcuggcuacacuuaggaaacuguguaucgagggaaagauuaccaacaucacgaccgauagccggugcccuacacagggcgaagccguguugccagaggaacaggaccagaauuaugucuguaaacacacuuacguugaucgcgguugggggaacggaugcggccucuucggcaaggggagucuggugaccugcgcaaaguuucaauguuuagagcccauagagggaaaaguagugcaguaugaaaaucugaaguacacagucauuaucacugugcauaccggugaccagcaccagguuggcaacgagacacaaggggugaccgcugaaauuacuccucaggccuccacgacagaggcgauccucccagaauauggaacccuuggccuggagugcucuccgcgaacugguuuggacuucaaugagaugauccuacugaccaugaaaaacaaggccuggaugguccauagacagugguuuuucgaucucccccugccuuggacaagcggggcaaccacugaaacaccaacguggaauaggaaagagcuucuggugaccuuuaagaacgcucacgccaaaaagcaagaaguaguuguguugggcucccaggagggagcuaugcacacugcccucacaggcgcaaccgaaauucaaaauucagggggaacaaguauauucgccggucaucugaagugucgguuaaaaauggacaagcuggagcuaaaaggcaugagcuacgcuaugugcacuaacaccuuuguccucaagaaagaggugucugaaacgcagcacgggaccauccugauuaaggucgaguacaagggagaagaugugcccuguaaaaucccuuucuccacagaggacggccaagguaaggcgcauaacgggcgucuuauaacugcaaauccaguugugaccaaaaaggaggaacccguaaacauugaggccgaaccgccuuucggcgagucaaauaucgucaucggaauuggcgauaacgcuuugaaaaucaauugguauaagaaggggagcaguauuggaaaaauguuugaagccacagcacgcggugccagaaggauggcuauacugggcgacacugccugggauuucgggucugugggaggcguucucaacucccuggguaagauggugcaccagaucuuugggagcgcauacaccgcgcuuuucucgggcgucucuugggugaugaaaauuggaaucggcguacuguugacguggaucgggcucaauuccaagaacacaucaaugaguuuuagcugcauugcuauaggaaucauuacccuguauuuaggcgccgugguucaggcagacauggguugugucaucaauuggaaagggaaggagcugaagugcggauccggcauuuucgugacuaacgaggugcauacauggaccgaacaguacaaauuucaagccgauucucccaagcggcuagcuacugccaucgccggugcuugggagaauggcgucugugggauacgaagcaccacacgcauggaaaaccuccuguggaaacagaucgccaaugagcuuaacuauauuuugugggaaaauaacaucaagcugacgguuguggugggagacauuaucggcguacucgagcaggggaaaagaacccugacuccacagccuauggaguuaaaguacucauggaaaacauggggaaaggcgaagauagucaccgccgaaacacaaaacaguuccuucauuaucgauggccccaauacuccagagugccccagcgcuucuagggcauggaacgugugggaaguugaggacuaugguuuugggguguucaccacgaauauuuggcugaaacuucgggaagucuacacacaguugugugaccaccgccucaugucagccgcugugaaggaugagagagccguucacgcagacaugggauacuggaucgagagucagaaaaacggcagcuggaagcuggaaaaagcgucccuaauagaggugaagaccugcacuuggccuaagucucauacccuguggucgaaugguguacucgaaagcgauaugaucauuccaaaaucccuggccggcccgaucucacagcacaacuauaggcccggguaccauacacaaacugcuggaccuuggcaccuuggcaaguuggagcuggacuuuaauuauugcgaggggaccacagucgugauuacggaaaacuguggaacccguggcccaaguuuacggacuacaaccgugucugguaaacucauccacgaguggugcugucgaagcugcacucugcccccucuuagauacaugggggaagauggauguugguauggcauggagauaaggccaauuuccgaaaaggaggagaauauggucaaaucacugguuagcgccgguucuggcgaaguggacaacuucacaauggggguauugugccucgcaauccuguuugaggaagugaugcgcggaaaguucggcaagaaacauaugaucgcuggggucuucuuuaccuucgugcuacugcucuccggacagauuacguggcgggauauggcccacacucugaucaugauuggcaguaaugcaagcgacagaauggguauggggguuaccuaccuugccuugauagcuacauuuaagauccagcccuuccuggcguuaggauuuuuccucaggaaacugaccucucgcgagaaccuucugcuaggcgugggccucgccauggcaacuacacugcaauugccggaagauauugagcagauggcuaaugggaucgcccugggauuaauggcccucaagcugauuacccaguuugagacauaucagcuuuggacugcucugaucuccuugaccuguucaaacacgauauucacacucaccgucgcauggcgaacugccacccugauccuagcgggugugagucugcuuccuguuugccaaagcucguccaugcggaaaacagacuggcucccaaugacuguggcugccaugggcgucccaccucugcccuuguuuauuuucucucugaaggauaccuuaaagcguagaagcuggccacucaaugaagggguaauggcagugggacugguuucaauccuugccaguucccuguugaggaacgacgugccuauggcuggcccccucgucgccggugggcugcuaauugccuguuacgugaucacgggaacaucugcggaucugaccguagagaaagcugccgacgugacuugggaagaggaagcagagcagacaggcgucagccauaaccuuaugauaaccguugacgaugacggcacuaugcgcauuaaggaugacgagacagaaaauauccucaccgugcuguugaaaacggccuuacugaucguguccgggauuuuuccauacucaauaccggcuacucuccuggucuggcacaccuggcagaagcagacacaacggagcggagugcuuugggauguuccuagucccccagagacccagaaagccgaacuggaggaggguguauauagaaucaagcagcagggcauuuucgggaaaacacaagugggagucggcgugcagaaggaagguguuuuucauacuauguggcacgugaccagaggggcagucuugacguacaacggaaagcgacuagagcccaauugggcuucugugaaaaaggaccugaucuccuauggcggcggguggcgccucagcgcccaguggcaaaaaggagaagagguacaggucauugcgguggaaccugguaagaaccccaagaauuuccagacaaugcccggcacuuuccagaccacaaccggggagaucggagccauagcacuggauuuuaagccuggcacuucggguucaccgaucauuaaccgggaggggaagguugugggacuuuacggcaauggcgucgugaccaaaaacgggggauauguuucugguaucgcucaaacaaaugccgaaccagacggccccacgccugaguuagaagaggaaauguucaagaaaagaaaccugacuauuauggaucuccacccagggaguggaaagaccaggaaauacuugcccgcuaucgugcgugaggcaauaaagcgccggcugagaacacucauucuggccccuaccagggucguggccgcugagauggaagaggcgcuuaagggccugccgauccgauaucagacuacagcaaccaaauccgaacauacgggucgggagaucguagacuugaugugccacgccacuuuuacaaugcgccuacugagccccgugagaguuccaaauuacaaccucauuaucauggaugaagcucauuucaccgacccugccucuauagcagccaggggguacauuagcacccgggucggaaugggcgaggcugcggccaucuuuaugacugcaacacccccaggcaccgcugaugccuucccucaguccaaugcacccauucaggacgaggaacgagacaucccagagagaucauggaacagugggaaugaauggauaacagauuuugccggaaagacugugugguucgugccgagcauuaaagcugguaacgacaucgccaacuguuuacgcaagaauggcaaaaaggucauccaacugucuaggaagacguuugauaccgaguaucagaaaacaaaacuuaacgacugggauuucguagugacuaccgacauuuccgagaugggggcgaauuuuaaagcagaucguguuaucgacccucggagaugccugaagcccgugauucucacagauggaccagaaagggucauauuggccggccccaugccugugaccgcugccucagcugcacagcgccgagguagaguugggcggaacccacagaaagagaaugaccaauacaucuucacuggccagccccugaacaaugaugaagaccacgcccauuggacggaggcuaagaugcuccuggacaacauuaauaccccugaaggaaucaucccggcccuuuucgagccagagagggaaaagagugcagcgauugauggcgaguaucgccuaaaaggggaaagccguaagacauuuguggagcugaugagacggggagacuugcccgucugguuagcccacaaaguggcuuccgaagguauaaaguacacugauaggaaauggugcuucgacggccagcgcaacaaucagauccuggaggagaacauggauguagaaauuuggaccaaggagggggagaagaagaagcuccgaccuagauggcuggacgcccggacauauucugauccccuugcacugaaagaguuuaaggacuucgcugccggaaggaaaucgaucgcacucgauuuggugaccgaaauuggccgcguuccaacucaccuggcccauagaacaaggaaugcucuagacaaccuggucaugcuccacacgagcgagcauggugggaaggcguaccggcacgccguggaggaacuuccugagaccauggaaacucuguuauugcugggccucaugauccugcuuacaggaggcgcaaugcuguuucucauaucagggaaaggaaucgguaagaccuccauuggcuugaucugugugauugcuaguucugggaugcuguggauggccgagauccccuuacaauggauagccagcgcaauuguccuagaguucuuuaugaugguucugcucaucccagaaccugagaagcagcguaccccgcaggauaaucaacuugcuuaugugguaauuggaauccugacauuggccgcgauaaucgcugccaacgaaaugggccugcucgagacuacgaaacgcgaccuggguauguccaaggaacccgggguggucucaccaaccucuuaccuugauguggaccuccacccugcaagcgccuggacacuguacgcuguugcaacuaccgugauuacacccauguugcgacauaccaucgagaauaguacugccaacgucucccuggcggcuauugccaaccaggcaguaguguuaaugggccuagacaaaggauggccaaucagcaagauggaucugggcguuccucuccuugcccuggggugcuauucucaggugaaucccuugacgcugacagcugccguccuccugcuuauaacccacuacgcaauuaucggaccgggcuuacaggcuaaagccacuagagaggcgcaaaagaggaccgccgcagguaucaugaagaacccaacaguggacgggauuaugacuaucgaucuggacccugucauauaugauucaaaauucgaaaagcagcucggacaggugauguugcugguucuaugugcugugcagcugcuccuuaugcggaccuccugggcccugugcgaggcauugacacuggcuacgggccccauuaccacucucugggaagguaguccaggcaaauuuuggaauacaaccaucgccguaagcauggccaacauuuuccgcgggucguaccuggcgggagcuggcuuagcauuuucuaucaugaaguccguggggacuggaaaaagaggcacagguagccaaggggagacccuuggagaaaaguggaagaaaaagcugaaucagcucucaaggaaagaguucgaccuauauaagaaaaguggcauaacggaggucgaucggaccgaagccaaggagggucugaaacgaggcgaaaucacacaucacgcuguuucuagaggguccgccaaguugcagugguuuguggagcgcaacauggucauucccgaaggaagggugaucgaccugggcugugggcggggaggcuggagcuacuauugcgcaggucucaagaaaguaacugaggugcguggguacaccaagggaggcccuggccaugaggaaccgguucccaugucaacauacggguggaauauugugaaacuuaugaguggaaaggaugucuucuaucugccaccugagaaaugugacacuuugcugugcgauaucggugaaagcucccccucuccuaccguggaggagagcagaacaauuaggguccucaagaugguggaaccaugguuaaagaacaaucaguucuguaucaaaguucugaaccccuacaugccuaccguaauagagcaccuugaacgccugcaacggaagcacggcgggaugcuagugcgaaauccacucuccagaaacucaacucaugagauguauuggauuucuaauggaacgggcaacaucgucgccagugugaauaugguuucgaggcuguugcugaaccgcuuuacaaugacccaccggagacccacuaucgaaaaagacguggaucucggugcugggacccgucaugucaacgcggagccggagacaccuaauauggacgugauuggagaaaggauaaagcggaucaaagaggaacacaacagcacguggcacuacgacgaugagaauccauauaagaccugggccuaccauggcuccuaugaaguaaaggcaacuggcucugcuucaagcaugauuaacggggugguuaaacuucugacaaagcccugggacgucgugccuauggugacccagauggccaugacugauacaaccccauucggacagcaacgcgucuuuaaagagaagguugacacacgaacucccagauccaugccggguaccaggcgggugaugggcaucacggcagagugguuauggcgcacccuggggagaaauaaaaagccuagguugugcacacgagaagaguucacuaagaaaguacggaccaacgccgcuaugggagccguguuuacagaagagaaucagugggauagugcgaaggcagccgucgaagacgaggauuucuggaaacucguggaccgugagagagaacugcacaagcuaggcaaaugugguucuugcguuuacaacaugauggggaagcgcgagaagaaacuuggagaauuuggcaaagcuaaaggcagcagggccauuugguacauguggcugggggcacgguaucucgaguucgaggcucugggauuuuugaaugaagaucauugguucucaagagagaacuccuacagugguguggaaggcgaggggcugcacaagcucggauauauccuucgcgacauaagcaaaauccccggcggugccauguacgcugaugacacugccgggugggacaccaggauuacggaagaugaccugcauaaugaggagaagaucacacagcagauggauccagaacaccgacaauuagcaaacgcgauuuuuaaacugaccuaucagaauaaggucgugaagguacagcggccuacucccacaggaaccguuauggacaucauaucuagaaaagaucagaggggcuccggccaaguggggacuuacggauugaacaccuucacaaauauggaggcccagcucauucgccagauggaaggugagggcguccugucaaaggcugaccuagaaaacccacaccuucccgagaaaaagaucacgcaguggcuggagaccaaagggguggaacgucucaagcggauggccaucagcggagaugacugcguggucaagccuauugaugacagauuugcaaacgcucuguuggccuuaaaugauaugggcaaaguuaggaaggacauaccacaauggcagccgucgaaagguuggcaugauuggcaacaggugcccuucuguucucaccauuuccacgagcugaucaugaaggacgggcgcaaacucguagugccuugccgaccacaagacgaacuuauuggacgggcaagaaucagucagggcgccggcuggucccugagggagacugcgugucuagggaaggcuuaugcccagauguggagccugauguacuuucaccgcagagaucuccgguuggcaucaaacgccauuugcuccgcuguccccgugcauuggguuccuacaucuaggaccacuuggagcauccacgcccaucaccaauggaugacaaccgaagacaugcugacgguguggaaucgugucuggauagaggauaacccauggauggaggacaagacacccgugaccacuugggaaaauguaccuuaccuuggaaaacgagaggaucaguggugugguagucugaucggccucaccucccgcgcaacaugggcucagaacauuccgacugccauccagcaaguuaggagcuuaauugggaaugaagaguuccuggacuauaugccaucuaugaagcgguuuaggaaagaggaagagucagaaggagcgaucugguga

SEQ ID NO: 15176 - RNA, 9873 nt, Artificial Sequence
  derived and/or modified CDS sequence (opt3) from DENV-3__FJ898443__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaaggccguuauauucaucuuacugaugcuugugaccccaucgaugacaaugcgcugugucggcguggggaacagagacuuuguagaaggauugucaggugcgaccuggguugaugugguccuggagcacggcgggugcgugacgacuauggcaaagaauaaacccacacuagacauugagcuccagaagaccgaagccacucaacuggcuacacuuaggaaacuguguaucgagggaaagauuaccaacaucacgaccgauagccggugcccuacacagggcgaagccguguugccagaggaacaggaccagaauuaugucuguaaacacacuuacguugaucgcgguugggggaacggaugcggccucuucggcaaggggagucuggugaccugcgcaaaguuucaauguuuagagcccauagagggaaaaguagugcaguaugaaaaucugaaguacacagucauuaucacugugcauaccggugaccagcaccagguuggcaacgagacacaaggggugaccgcugaaauuacuccucaggccuccacgacagaggcgauccucccagaauauggaacccuuggccuggagugcucuccgcgaacugguuuggacuucaaugagaugauccuacugaccaugaaaaacaaggccuggaugguccauagacagugguuuuucgaucucccccugccuuggacaagcggggcaaccacugaaacaccaacguggaauaggaaagagcuucuggugaccuuuaagaacgcucacgccaaaaagcaagaaguaguuguguugggcucccaggagggagcuaugcacacugcccucacaggcgcaaccgaaauucagaauucagggggaacaaguauauucgccggucaucugaagugucgguuaaaaauggacaagcuggagcuaaaaggcaugagcuacgcuaugugcacuaacaccuuuguccucaagaaagaggugucugaaacgcagcacgggaccauccugauuaaggucgaguacaagggagaagaugugcccuguaaaaucccuuucuccacagaggacggccaagguaaggcgcauaacgggcgucuuauaacugcaaauccaguugugaccaaaaaggaggaacccguaaacauugaggccgaaccgccuuucggcgagucaaauaucgucaucggaacaggcgauaacgcuuugaaaauuaauugguauaagaaggggagcaguaucggaaaaauguuugaagccacugcacgcggugccagaaggauggcuauucugggcgacaccgccugggauuucgggucugugggaggcguucucaacucccuggguaagauggugcaccagauauuugggagcgcauacacggcgcuuuucucgggcgucucuugggugaugaaaaucggaauuggcguacuguugacauggaucgggcucaauuccaagaacaccucaaugaguuuuagcugcaucgcuauuggaauaaucacucuguauuuaggcgccgugguucaggcagacauggguugugucauuaauuggaaagggaaggagcugaagugcggauccggcaucuucgugacaaacgaggugcauaccuggacugaacaguacaaauuucaagccgauucucccaagcggcuagcuaccgccauugcaggugcuugggagaauggcgucugugggauccgaagcacaacgcgcauggaaaaccuccuguggaaacagauagccaaugagcuuaacuauaucuugugggaaaauaacauuaagcugaccguuguggugggagacaucauuggcguacucgagcaggggaaaagaacucugacaccacagccuauggaguuaaaguacucauggaaaaccuggggaaaggcgaagaucgucacagccgaaacucaaaacaguuccuucauaauugauggccccaauaccccagagugccccagcgcuucuagggcauggaacgugugggaaguugaggacuaugguuuugggguguucacgacaaauaucuggcugaaacuucgggaagucuacacccaguugugugaccaccgccucaugucagccgcugugaaggaugagagagccguucacgcagacaugggauacuggauugagagucagaaaaacggcagcuggaagcuggaaaaagcgucccuaaucgaggugaagacuugcaccuggccuaagucucauacacuguggucgaaugguguacucgaaagcgauaugauaaucccaaaaucccuggccggcccgauuucacagcacaacuauaggcccggguaccauacucaaaccgcuggaccuuggcaccuuggcaaguuggagcuggacuuuaauuauugcgaggggacaacggucgugaucaccgaaaacuguggaacucguggcccaaguuuacggacaaccacugugucugguaaacucauucacgaguggugcugucgaagcugcacacugcccccucuuagauacaugggggaagauggauguugguauggcauggagaucaggccaauauccgaaaaggaggagaauauggucaaaucacugguuagcgccgguucuggcaagguggacaacuucaccauggggguauugugccucgcaauucuguuugaagaggugaugcgcggaaaguucggcaaaaagcauaugaucgcuggggucuucuuuacguucgugcuacugcucuccggacagaucacuuggcgggauauggcccacacccugauuaugaucggcaguaaugcaagcgacagaauggguauggggguuacauaccuugccuugauugcuaccuuuaaaauacagcccuuccuggcguuaggauuuuuccucaggaagcugacuucucgcgaaaaccuucugcuaggcgugggccucgccauggcaacaacccugcaauugccggaggauaucgaacagauggcuaaugggauugcccugggauuaauggcccucaaacugaucacacaguuugagacuuaucagcuuuggaccgcucugauuuccuugacguguucaaacacaaucuucacccucacugucgcauggcgaaccgccacacugauacuagcgggugugagucugcuuccuguuugccaaagcucguccaugcggaagacugacuggcucccaaugaccguggcugccaugggcguccccccucugcccuuguuuaucuucucucugaaggauacguuaaaacguagaagcuggccacucaaugaggggguaauggcagugggacugguuucaauucuugccaguucccuguugaggaacgacgugccuauggcuggcccccucgucgcaggugggcugcuaaucgccuguuacgugauuacaggaaccucugcggaucugacuguagaaaaggcugccgacgugacaugggaggaagaggcagaacagaccggcgucagccauaaccuuaugaucacuguugacgaugacggcacaaugcgcauaaaagaugacgagaccgagaauauucucacggugcuguugaagacugccuuacugaucguguccgggaucuuuccauacucaauuccggcuacccuccuggucuggcacacauggcagaaacagacccaacggagcggagugcuuugggauguuccuagucccccagaaacacagaaggccgagcuggaagaggguguauauagaauaaaacagcagggcaucuucgggaagacucaagugggagucggcgugcagaaggaggguguuuuucauaccauguggcacgugacgaggggggcagucuugacauacaacggaaaacgacuagaacccaauugggcuucugugaagaaagaccugauuuccuauggcggcggguggcgccucagcgcccaguggcaaaagggagaggaaguacaggucaucgcgguggagccugguaaaaacccaaagaauuuccagacuaugcccggcaccuuccagacaaccacuggggaaauuggagccaucgcacuggauuuuaagccuggcaccucggguucaccgauaaucaaccgggaggggaaaguugugggacuuuacggcaauggcgucgugacaaagaacgggggauauguuucugguauugcucaaacgaaugccgagccagacggccccacuccugaauuagaggaagagauguucaaaaagagaaaccugaccaucauggaucuccacccagggaguggaaaaacaaggaaguacuugcccgcuauugugcgugaagcaaucaagcgccggcugagaacccucauacuggccccuacuagggucguggccgcugagauggaggaagcgcuuaaaggccugccgauucgauaucagacaaccgcaacgaaguccgagcauacuggucgggaaaucguagacuugaugugccacgccacauuuaccaugcgccuacugagccccgugagaguuccaaauuacaaccucaucauuauggaugaggcucauuucaccgacccugccucuaucgcagccaggggguacauaagcacucgggucggaaugggcgaagcugcggccauuuuuaugacagcaacccccccaggcacagcugaugccuucccucaguccaaugcacccauccaggacgaggagcgagacauuccagaaagaucauggaacagugggaaugaguggaucacugauuuugccggaaaaacggugugguucgugccgagcauaaaggcugguaacgacauugccaacuguuuacgcaaaaauggcaagaaggucauccaacugucuaggaaaaccuuugauacagaauaucagaagacuaaacuuaacgacugggauuucguagugaccacagacaucuccgagaugggggcgaauuuuaaggcagaucguguuauugacccucggagaugccugaaacccgugauccucaccgauggaccagagagggucauuuuggccggccccaugccugugacugcugccucagcugcacagcgccgagguagaguugggcggaacccacagaaggaaaaugaccaauacauauucacgggccagccccugaacaaugaugaggaccacgcccauuggaccgaagcuaagaugcuccuggacaacaucaauacaccugagggaauuaucccggcccuuuucgaaccagagagggagaaaagugcagcgaucgauggcgaauaucgccuaaagggggagagccguaaaacuuuuguggaacugaugagacggggagacuugcccgucugguuagcccacaagguggcuuccgaggguauuaaauacaccgauaggaaguggugcuucgacggccagcgcaacaaucagauacuggaagagaacauggauguagagaucuggacaaaagaaggggagaagaagaaacuccgaccuagauggcuggacgcccggaccuauucugauccccuugcacugaaggaauuuaaagacuucgcugccggaaggaagucgauugcacucgauuuggugacugagaucggccgcguuccaacacaccuggcccauagaacgaggaaugcucuagacaaccuggucaugcuccacaccagcgaacauggugggaaagcguaccggcacgccguggaggagcuuccugaaacuauggagacacuguuauugcugggccucaugauucugcuuaccggaggcgcaaugcuguuucucaucucagggaagggaauagguaagaccuccaucggcuugauuugugugaucgcuaguucugggaugcuguggauggccgaaauucccuuacaauggaucgccagcgcaauaguccuagaguucuuuaugaugguucugcucauuccagagccugaaaaacagcguacaccgcaggauaaucaacuugcuuaugugguaaucggaauucugacuuuggccgcgaucauagcugccaacgagaugggccugcucgaaacgaccaagcgcgaccuggguauguccaaagagcccgggguggucucaccaacaucuuaccuugauguggaccuccacccugcaagcgccuggacucuguacgcuguugcaaccacagugaucacccccauguugcgacauacuauugaaaauaguacggccaacgucucccuggcggcuaucgccaaccaggcaguaguguuaaugggccuagacaagggauggccaauuagcaaaauggaucugggcguuccucuccuugcccuggggugcuauucucaggugaaucccuugacacugaccgcugccguccuccugcuuaucacucacuacgcaauaauuggaccgggcuuacaggcuaaggccaccagagaggcgcaaaagaggacagccgcagguaucaugaaaaacccaacuguggacgggaucaugaccauugaucuggacccugucaucuaugauucaaaguucgagaaacagcucggacaggugauguugcugguucuaugugcugugcagcugcuccuuaugcggacauccugggcccugugcgaagcauugacgcuggcuaccggccccauaacuacacucugggaggguaguccaggcaaguuuuggaauaccacuauugccguaagcauggccaacaucuuccgcgggucguaccuggcgggagcuggcuuagcauuuucuauuaugaaauccguggggacaggaaagagaggcaccgguagccaaggggaaacgcuuggagagaaguggaaaaugaagcugaaucagcucucaaggaaagaauucgaccuauauaagaaaaguggcaucaccgaggucgaucggacagaggccaaggaaggucugaaacgaggcgagauaacucaucacgcuguuucuagaggguccgccaaguugcagugguuuguggaacgcaacauggucauccccgagggaagggugauugaccugggcugugggcggggaggcuggagcuacuauugcgcaggucucaagaaaguaaccgaagugcguggguacacaaagggaggcccuggccaugaggagccgguucccaugucaacuuacggguggaauaucgugaaacuuaugaguggaaaggaugucuucuaucugccaccugaaaaaugugacaccuugcugugcgauauuggugagagcucccccucuccuacaguggaagagagcagaaccaucaggguccucaagaugguggagccaugguuaaagaacaaucaguucuguauuaaaguucugaaccccuacaugccuacuguaaucgaacaccuugagcgccugcaacggaagcacggcgggaugcuagugcgaaauccacucuccagaaacucaacgcaugaaauguauuggauaucuaauggaacaggcaacauugucgccagugugaauaugguuucgaggcuguugcugaaccgcuuuaccaugacucaccggagacccaccaucgagaaagacguggaucucggugcugggacacgucaugucaacgcggaaccggagacgccuaauauggacgugaucggagagaggauuaagcggauaaaagaagagcacaacagcaccuggcacuacgacgaugaaaauccauauaagacuugggccuaccauggcuccuaugagguaaaggcaacaggcucugcuucaagcaugaucaacggggugguuaaacuucugaccaagcccugggacgucgugccuauggugacucagauggccaugacagauaccacaccauucggacagcaacgcgucuuuaaagaaaagguugacacucgaacccccagauccaugccggguacgaggcgggugaugggcauuaccgcagagugguuauggcgcacacuggggagaaauaaaaagccuagguugugcacucgagaggaauucaccaagaaaguacggacaaacgccgcuaugggagccguguuuacugaggaaaaucagugggauagugcgaaggcagccgucgaggacgaagauuucuggaaacucguggaccgugagagagagcugcacaagcuaggcaaaugugguucuugcguuuacaacaugauggggaagcgcgaaaaaaagcuuggagaguuuggcaaggcuaaaggcagcagggccaucugguacauguggcugggggcacgguaucucgaauucgaggcucugggauuuuugaaugaggaucauugguucucaagagaaaacuccuacagugguguggagggcgaagggcugcacaagcucggauauauucuucgcgacaucagcaaaauacccggcggugccauguacgcugaugacaccgccgggugggacacgaggaucacagaggaugaccugcauaaugaagagaagauuacccagcagauggauccagagcaccgacaauuagcaaacgcgaucuuuaaacugacuuaucagaauaaggucgugaagguacagcggccuacacccaccggaacuguuauggacauuaucucuagaaaagaucagaggggcuccggccaaguggggaccuacggauugaacacauucacgaauauggaagcccagcucauacgccagauggagggugaaggcguccugucaaaggcugaccuagagaacccacaccuucccgaaaaaaagauuacccaguggcuggagacuaaagggguggagcgucucaagcggauggccaucagcggagaugacugcguggucaagccuaucgaugacagauuugcaaacgcucuguuggccuuaaaugauaugggcaaaguuaggaaggacauuccacaauggcagccgucgaaagguuggcaugauuggcagcaggugcccuucuguucucaccauuuccacgaacugauaaugaaggacgggcgcaaacucguagugccuugccgaccacaagacgagcuuaucggacgggcaagaauuagucagggcgccggcuggucccugagggaaacagcgugucuagggaaggcuuaugcccagauguggagccugauguacuuucaccgcagagaucuccgguuggcaucaaacgccaucugcuccgcuguccccgugcauuggguuccuaccucuaggacuacauggagcauucacgcccaucaccaauggaugaccacggaggacaugcugacaguguggaaucgugucuggaucgaagauaacccauggauggaggacaagacccccgugacuaccugggagaauguaccuuaccuuggaaaacgagaagaucaguggugugguagucugauaggccucacaucccgcgcaacuugggcucagaacaucccgaccgccauucagcaaguuagaagcuuaaucgggaaugaggaauuccuggacuauaugccaucuaugaagcgguuuaggaaagaggaggaauuggagggagcgauuugguga

SEQ ID NO: 15177 - RNA, 9873 nt, Artificial Sequence
  derived and/or modified CDS sequence (opt3) from DENV-3__FJ898444__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucagaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagaugcucccuguaaaaucccuuucuccacagaggacgagcaaggcaaggcgcauaacggucgucuuauaacugcaaauccaguugugaccaaaaaggaagagcccguaaacauugaagccgagccgccuuucggggaaucaaauaucgucaucggcauuggagauaacgcuuugaaaaucaauugguauaagaagggcagcaguauugggaaaauguuugaggccacagcacgcggagccagaaggauggcuauacugggugacacugccugggauuucggcucuguggggggaguucucaacucccugggcaagauggugcaccagaucuuugguagcgcauacaccgcgcuuuucucgggggucucuugggugaugaaaauuggcaucggaguacuguugacguggaucggccucaauuccaagaacacaucaaugaguuuuagcugcauugcuauagggaucauuacccuguauuuaggagccgugguucaggcagacaugggcugugucgugaauuggaaagguaaggagcugaagugcggguccggaaucuucgugacuaacgaaguccauacauggaccgagcaguacaaauuucaagccgauucucccaagcggcuagcuacugccauugcaggcgcuugggaaaaugguguuuguggcauccgaagcaccacacgcauggagaaccuccuguggaaacagauagccaaugaacuuaacuauaucuugugggagaauaacauuaagcugacgguggugguaggggacaucauuggaguccucgagcagggcaaaagaacccugacuccacagccuauggaauuaaaguacucauggaaaacaugggggaaggcgaagaucgugaccgccgagacacaaaacaguuccuucauaauugauggacccaauacuccagaaugccccagcgcuucuagggcauggaacguuugggagguggaagacuauggcuuuggugucuucaccacgaauaucuggcugaaacuucgggagguguacacacaguugugugaccaccgccucaugucagccgcuguuaaggaugagagagccgugcacgcagacaugggguacuggauugaaagucagaaaaacggaagcuggaagcuggagaaagcgucccuaaucgaaguaaagaccugcacuuggccuaagucucauacccuguggucgaauggcguccucgagagcgauaugauaaucccaaaaucccuggccgguccgauuucacagcacaacuauaggcccggcuaccauacacaaacugcugggccuuggcaccuuggaaaguuggagcuggacuuuaauuauugcgaaggcaccacaguggugaucacggagaacugugggacccguggaccaaguuuacggacuacaaccgucucuggcaaacucauucacgaauggugcugucgaagcugcacucugcccccucuuagauacaugggugaggauggguguugguauggaauggaaaucaggccaauauccgagaaggaggaaaauaugguuaaaucacuggugagcgccggcucuggugagguagacaacuucacaaugggcguguugugccucgcaauucuguuugaagaggucaugcgcgggaaguucggaaagaaacauaugaucgcuggcguguucuuuaccuucguucuacugcucuccgggcagaucacguggcgggauauggcccacacucugauuaugaucggaaguaaugcaagcgacagaaugggcaugggugugaccuaccuugccuugauugcuacauuuaagauacagcccuuccuggcguuaggguuuuuccucaggaaacugaccucucgcgaaaaccuucugcuaggagucggccucgccauggcaacuacacugcaauugccggaggauaucgagcagauggcuaauggcauugcccugggguuaauggcccucaagcugaucacccaguuugaaacauaucagcuuuggacugcucugauuuccuugaccuguucaaacacgaucuucacacucaccguggcauggcgaacugccacccugauacuagcgggaguuagucugcuuccugugugccaaagcucguccaugcggaaaacagacuggcucccaaugacugucgcugccauggguguacccccucugcccuuguuuaucuucucucugaaggauaccuuaaagcguagaagcuggccacucaaugagggcgugauggcaguugggcuggugucaauucuugccaguucccuguugaggaacgacgucccuauggcuggaccccucguggcaggcggucugcuaaucgccuguuacguaauuacggggacaucugcggaucugaccguggaaaaagcugccgacgucacuugggaggaagaggcagagcagacaggaguuagccauaaccuuaugaucaccguggacgaugacggcacuaugcgcauaaaggaugacgaaacagagaauauucucaccgugcuguugaaaacggccuuacugaucgucuccggcaucuuuccauacucaauuccggcuacucuccugguguggcacaccuggcagaagcagacacaacggagcgggguucuuugggauguaccuagucccccagaaacccagaaagccgagcuggaggaaggaguguauagaauaaagcagcaggguaucuucggcaaaacacaagucggggugggaguucagaaggagggcguguuucauacuauguggcacgucaccaggggugcaguguugacguacaacgggaagcgacuagaacccaauugggcuucuguaaaaaaggaccugauuuccuauggaggcggcuggcgccucagcgcccaguggcaaaaaggggaggaaguccaggugaucgcgguugagccuggaaagaacccaaaaaauuuccagacaaugcccgguacuuuccagaccacaaccggcgagauuggggccaucgcacuggauuuuaagccuggaacuucgggcucaccgauaaucaaccgggaagguaagguggucgggcuuuacggaaauggcgugguuaccaaaaacggcggguaugugucuggaauugcucaaacaaaugccgagccagacggucccacgccugaauuagaggaagagauguucaagaaaagaaaccugacuaucauggaucuccacccaggcagugggaagaccaggaaauacuugcccgcuauuguccgugaggcaaucaagcgccggcugagaacacucauacuggccccuaccagggugguagccgcugaaauggaggaagcgcuuaagggacugccgauucgauaucagacuacagcaaccaaauccgagcauacgggccgggaaaucguggacuugaugugccacgccacuuuuacaaugcgccuacugagccccguuagagucccaaauuacaaccucaucauuauggaugaggcucauuucaccgacccugccucuaucgcagccagggguuacauaagcacccggguggggaugggagaggcugcggccauuuuuaugacugcaacacccccaggcaccgcugaugccuucccucaguccaaugcacccauccaggacgaagagcgagacauuccagaaagaucauggaacaguggcaaugaguggaucacagauuuugccgggaagacugugugguucgucccgagcauaaaagcuggaaacgacauugccaacuguuuacgcaagaaugguaaaaagguaauccaacugucuaggaagacguuugauaccgaguaucagaaaacaaagcuuaacgacugggauuucgugguuacuaccgacaucuccgaaaugggcgcgaauuuuaaagcagaucgugugauugacccucggagaugccugaagcccgucauccucacagaugggccagagagggugauuuuggccggacccaugccuguuaccgcugccucagcugcacagcgccgaggcagagugggucggaacccacagaaagaaaaugaccaauacauauucacugggcagccccugaacaaugaugaggaccacgcccauuggacggaagcuaagaugcuccuggacaacaucaauaccccugagggcauuaucccggcccuuuucgagccagaaagggagaagagugcagcgaucgauggagaauaucgccuaaaaggcgagagccguaagacauuugucgaacugaugagacggggggacuugcccgugugguuagccuacaaaguagcuuccgagggaauuaaguauacugauaggaaauggugcuucgacggucagcgcaacaaucagauacuggaggaaaacauggauguggagaucuggaccaaggaaggcgagaaaaagaagcuccgaccuagauggcuggacgcccggacauacucugauccccuugcacugaaagaauuuaaggacuucgcugccgggaggaaaucgauugcacucgauuugguuaccgagaucggacgcgucccaacucaccuggcccacagaacaaggaaugcucuagacaaccuggugaugcuccauacgagcgagcacggcgguaaggcguaucggcaugccguggaagagcuuccugaaaccauggagacucuguuauugcuggggcucaugauucugcuuacaggcggagcaaugcuguuucucaucucaggcaaagggauaggaaagaccuccaucgguuugauuugugucaucgcuaguucuggcaugcuguggauggccgagauucccuuacaauggaucgccagcgcaauaguucuagaauucuuuaugauggugcugcucauuccagagccugaaaagcagcguaccccgcaggauaaucaacuugcuuacguagugaucgggauucugacauuggccgcgaucauagcugccaacgagaugggacugcucgaaacuacgaaacgcgaccugggcaugucccgagagcccggugucgugucaccaaccucuuaccuugauguugaccuccacccugcaagcgccuggacacuguaugcuguggcaacuaccgucaucacacccauguugagacacaccauugagaauaguacugccaacguaucccuggcggcuaucgccaaccaggcagugguuuuaauggggcuagacaagggcuggccaauuagcaaaauggaucugggagugccucuccuugcccugggcugcuacucucaggucaaucccuugacgcugacagcugccgugcuccugcuuaucacccauuaugcaauaauugggccgggauuacaggcuaaggccacuagggaagcgcaaaaacggaccgccgcaggcaucaugaagaacccaacagucgacgguaucaugacuauugaucuggacccugugaucuacgauucaaaguucgagaaacagcucgggcagguuauguugcuggugcuaugugcuguacagcugcuccuuaugcgcaccuccugggcccugugcgaagcauugacacuggcuacgggacccauaaccacucucugggagggcaguccagguaaguuuuggaauacaaccauugccgugagcauggccaacaucuucagaggcucguaucuggcgggggcuggauuagcauuuucuauuaugaaauccgucggcacugggaagaggggaacaggcagccaaggugaaacccuuggggagaaauggaagaagaaacugaaucagcucucacggaaggaguucgaccuauacaaaaagaguggaaucacggaaguugaucgaaccgaggccaaagaaggccugaagaaaggugagauaacacaccaugcugugucuagaggcuccgccaaguugcagugguuugucgaacgcaacauggugauccccgaggggaggguaauugaccugggauguggccgggggggauggagcuauuacugcgcaggccucaagaaagugacugagguucgugguuacaccaaggggggaccuggccacgaagagccggugcccaugucaacauauggcuggaauaucgucaaacuuaugagugggaaggauguguucuaccugccaccugaaaaaugugacacuuugcugugcgauauuggagagagcucccccucuccuaccgucgaggaaagcagaacaaucagggugcucaagaugguugagccaugguuaaagaacaaucaguucuguauuaaaguacugaaccccuauaugccuaccgugaucgaacaucuugagcgccugcaacggaagcacgguggcaugcuaguccgaaauccacucuccagaaacucaacucacgaaauguacuggauaucuaaugggacgggaaacauuguggccaguguuaauauggugucgaggcuguugcugaaccgcuuuacaaugacccaucggagacccacuaucgagaaagacgucgaucucggcgcugguacccgucacgugaacgcggagccggaaacaccuaauauggacguaaucggggagaggauuaagcggauaaaagaagagcauaacagcacguggcacuaugacgaugaaaauccauacaagaccugggccuaucacggauccuacgaggugaaggcaacuggcucugcuucaagcaugaucaacggcguugucaaacuucugacaaagcccugggacguggugccuauggucacccagauggccaugacugauacaaccccauucgggcagcaacgcguuuuuaaagagaagguggacacacgaacucccagaccgaugccuggaaccaggcggguaauggguauuacggcagaaugguuauggcgcacccugggcagaaauaaaaagcccagguugugcacacgagaggaauucacuaagaaagugcggaccaacgccgcuaugggggccgucuuuacagaggaaaaucagugggauuccgcgaaggcagccguggaggacgaggauuucuggaaacucguugaccgugaaagagagcugcauaagcuaggaaaauguggcaguugcguguacaacaugauggguaagcgcgaaaaaaagcuuggggaguuuggaaaggcuaaaggcucuagggccaucugguauauguggcugggcgcacgguaccucgaguucgaagcucugggguuuuugaaugaggaucacugguucagcagagaaaacucauauuccggagucgagggugaaggccugcauaagcucggguacauucuucgcgacaucaguaaaauaccaggaggcgccauguaugcugaugacacugccgguugggacaccaggaucacggaggaugaccugcacaaugaggaaaagauuacacagcagauggauccugagcaucgacaauuagcaaacgcgaucuuuaaacugaccuaccagaauaaggugguaaagguucagcggcccacuccaacagggaccgugauggacauuaucagcagaaaagaucagaggggaucuggccaagucggcacuuauggguugaacaccuucacaaauauggaagcccagcucauacgccagauggagggagaaggugugcuguccaaggcugaccuagagaacccccaccuuccugagaaaaagauuacgcaguggcuggaaaccaaaggcguggagcgucucaagcggauggccaucucaggggaugacugcgucguuaagccaaucgaugacagauuugcaaacgcucuguuggccuuaaaugauaugggaaaagugaggaaggacauuccgcaauggcagcccagcaaaggcuggcacgauuggcagcagguaccuuucuguucgcaucacuuccaugaacugauaaugaaggacggucgcaaacucguggucccaugccgaccccaagacgagcuuaucgggcgggcaagaauuucucagggagccggcuggagucugagggaaacugcgugucuaggcaaggcuuacgcccagauguggucccugauguacuuucaccgcagagaucuccgguuggcaagcaacgccaucugcucagcugugccuguucacugggugccaacauccaggaccacuuggucuauucaugcccaccaucaauggaugacaaccgaggacaugcugacggucuggaaucguguguggaucgaggauaaccccuggauggaagacaagacaccuguaaccacuugggagaauguuccguaucuugggaaacgagaagaucagugguguggaagccugauaggucucaccagucgcgcaacaugggcucagaacaucccaacugccauucagcaagugagauccuuaaucggcaaugaggaguuccuggacuacaugcccagcaugaagcgguuuaggaaagaagaggaaucugagggggcgauuugguga

SEQ ID NO: 15178 - RNA, 9873 nt, Artificial Sequence
  derived and/or modified CDS sequence (opt3) from DENV-3__FJ898445__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaaggccguuauauucaccuuacugaugcuugugacaccaucgaugaccaugcgcugugucggcguggggaacagagacuuuguagaaggauugucaggugcgacguggguugaugugguccuggagcacggcgggugcgugacuacaauggcaaagaauaaacccacccuagacaucgagcuccagaagacugaagccacacaacuggcuacccuuaggaaacuguguauugagggaaagaucacgaacauuaccacagauagccggugcccuacucagggcgaagccguguugccagaggaacaggaccagaauuaugucuguaaacacaccuacguugaucgcgguugggggaacggaugcggccucuucggcaaggggagucuggugacaugcgcaaaguuucaauguuuagagcccaucgagggaaaaguagugcaguaugaaaaucugaaguacacugucauaauuaccgugcauacaggugaccagcaccagguuggcaacgagacccaaggggugacugcugaaaucacgccucaggccuccacaaccgaggcgauucucccagaauauggaacucuuggccuggagugcucuccgcgaaccgguuuggacuucaaugagaugauccuacugacaaugaaaaacaaggccuggaugguccauagacagugguuuuucgaucucccccugccuuggaccagcggggcaacuacagaaacgccaaccuggaauaggaaagagcuucuggugacuuuuaagaacgcucacgccaaaaagcaagaaguaguuguguugggcucccaggagggagcuaugcacacagcccucaccggcgcaacagaaauccagaauucagggggaacuaguauuuucgccggucaucugaagugucgguuaaaaauggacaagcuggagcuaaaaggcaugagcuacgcuaugugcaccaacacguuuguccucaagaaagaggugucugaaacccagcacgggacaauacugaucaaggucgaguacaagggagaagaugugcccuguaaaauuccuuucuccacugaggacggccaagguaaggcgcauaacgggcgucuuaucaccgcaaauccaguugugacaaaacgcgaggaacccguaaacauagaggccgaaccgccuuucggcgagucaaauauugucaucggaaucggcgauaacgcuuugaagauuaauugguauaaaaaggggagcaguaucggaaagauguuugaagccacugcaagaggugccaggcggauggcuauucugggcgacaccgccugggauuucgggucugugggaggcguucucaacucccuggguaaaauggugcaccagauauuugggagcgcauacacggcgcuuuucucgggcgucucuugggugaugaagaucggaauuggcguacuguugacauggaucgggcucaauuccaaaaacaccucaaugaguuuuagcugcaucgcuauuggaauaaucacucuguauuuaggcgccgugguucaggcagacauggguugugucauuaauuggaaggggaaagagcugaagugcggauccggcaucuucgugacaaacgaggugcauaccuggacugaacaguacaaguuucaagccgauucucccaaacgacuagcuaccgccauugcaggugcuugggagaauggcgucugugggauccgcagcacaacgagaauggaaaaccuccuguggaagcagauagccaaugagcuuaacuauaucuugugggaaaauaacauuaaacugaccguuguggugggagacaucauuggcguacucgagcaggggaagaggacucugacaccacagccuauggaguuaaaauacucauggaagaccuggggaaaagcgaagaucgucacagccgaaacucaaaacaguuccuucauaauugauggccccaauaccccagagugccccagcgcuucucgggcauggaacgugugggaaguugaggacuaugguuuugggguguucacgacaaauaucuggcugaagcuucgcgaagucuacacccaguugugugaccacagacucaugucagccgcugugaaagaugagagggccguucacgcagacaugggauacuggauggagagucagaagaacggcagcuggaaacuggaaaaggcgucccuaauugaggugaaaacuugcaccuggccuaagucucauacacuguggucgaaugguguacucgaaagcgauaugaucauaccaaagucccuggccggcccgaucucacagcacaacuaucgucccggguaccauacucaaaccgcuggaccuuggcaccuuggcaaauuggagcuggacuuuaauuauugcgaggggacaacggucgugauuaccgaaaacuguggaacucggggcccaaguuuacgaacaaccacugugucugguaagcucauccacgaguggugcuguagaagcugcacacugcccccucuuagguacaugggggaagauggauguugguauggcauggagauucgcccaaucuccgaaaaagaggagaauauggucaagucacugguuagcgccgguucuggcgaaguggacaacuucaccauggggguauugugccucgcaauacuguuugaggaagugaugcggggaaaauucggcaagaagcauaugauugcuggggucuucuuuacguucgugcuacugcucuccggacagaucacuuggagagauauggcccacacccugaucaugauuggcaguaaugcaagcgacaggauggguauggggguuacauaccuugccuugaucgcuaccuuuaaaauucagcccuuccuggcguuaggauuuuuccuccgcaagcugacuucucgagagaaccuucugcuaggcgugggccucgccauggcaacaacccugcaauugccggaagauauagagcagauggcuaaugggaucgcccugggauuaauggcccucaaacugauuacacaguuugagacuuaucagcuuuggaccgcucugaucuccuugacguguucaaacacaauuuucacccucacugucgcauggcggaccgccacacugauccuagcgggugugagucugcuuccuguuugccaaagcucguccaugcguaagacugacuggcucccaaugaccguggcugccaugggcguccccccucugcccuuguuuauauucucucugaaagauacguuaaagagaaggagcuggccacucaaugaagggguaauggcagugggacugguuucaauccuugccaguucccuguugcgcaacgacgugccuauggcuggcccccucgucgcaggugggcugcuaauugccuguuacgugaucacaggaaccucugcggaucugacuguagagaaggcugccgacgugacaugggaagaggaagcagagcagaccggcgucagccauaaccuuaugauuacuguugacgaugacggcacaaugcggaucaaagaugacgagaccgaaaauauacucacggugcuguugaagacugccuuacugauuguguccgggaucuuuccauacucaaucccggcuacccuccuggucuggcacacauggcagaaacagacccaaagaagcggagugcuuugggauguuccuagucccccagagacacagaaggccgaacuggaggaggguguauauaggauuaaacagcagggcauauucgggaagacucaagugggagucggcgugcagaaagaagguguuuuucauaccauguggcacgugacgcgaggggcagucuugacauacaacggaaagcgccuagagcccaauugggcuucugugaagaaagaccugaucuccuauggcggcggguggcggcucagcgcccaguggcaaaagggagaagagguacaggucauugcgguggaaccugguaaaaacccaaagaauuuccagacuaugcccggcaccuuccagacaaccacuggggagaucggagccauugcacuggauuuuaaaccuggcaccucggguucaccgaucauaaacagagaggggaagguugugggacuuuacggcaauggcgucgugacaaagaacgggggauauguuucugguaucgcucaaacgaaugccgaaccagacggccccacuccugaguuagaagaggaaauguucaaaaagaggaaccugaccauuauggaucuccacccagggaguggaaaaacacguaaguacuugcccgcuaucgugcgcgaggcaauuaaacggagacugaggacccucauccuggccccuacucgagucguggccgcugagauggaagaggcgcuuaagggccugccgauacgguaucagacaaccgcaacgaaguccgaacauacuggucgcgagauuguagacuugaugugccacgccacauuuaccaugagacuacugagccccgugaggguuccaaauuacaaccucaucaucauggaugaagcucauuucaccgacccugccucuauugcagcccggggguacaucagcacucgagucggaaugggcgaggcugcggccauauuuaugacagcaacccccccaggcacagcugaugccuucccucaguccaaugcacccauucaggacgaggaaagagacaucccagagcgcucauggaacagugggaaugaauggauuacugauuuugccggaaaaacggugugguucgugccgagcaucaaggcugguaacgacauagccaacuguuuaaggaaaaauggcaagaaagucauucaacugucucguaagaccuuugauacagaguaucagaagacuaaacuuaacgacugggauuucguagugaccacagacaucuccgagaugggggcgaauuuuaaggcagaucggguuaucgacccuagaaggugccugaaacccgugauucucaccgauggaccagaacgcgucaucuuggccggccccaugccugugacugcugccucagcugcacagcgaagaggucggguugggaggaacccacagaaggagaaugaccaauacauuuucacgggccagccccugaacaaugaugaagaccacgcccauuggaccgaggcuaaaaugcuccuggacaacauaaauacaccugaaggaaucauuccggcccuuuucgagccagagcgcgaaaagagugcagcgaucgauggcgaguaucgucuaaagggggaaagcagaaaaacuuuuguggagcugaugcggaggggagacuugcccgucugguuagccuacaagguggcuuccgaagguaucaaauauaccgaucgcaaguggugcuucgacggccagcgaaacaaucagauucuggaggagaacauggauguagaaauauggacaaaagagggggaaaagaaaaagcucagaccucgguggcuggacgccaggaccuacucugauccccuugcacugaaggaguuuaaagacuucgcugccggacgcaagucgaucgcacucgauuuggugacugaaauuggcagaguuccaacacaccuggcccacaggacgcggaaugcucuagacaaccuggucaugcuccauaccagcgagcacggugggaaagcguaucgucaugccguggaggaacuuccugagacuauggaaacacuguuauugcugggccucaugauccugcuuaccggaggcgcaaugcuguuucucauuucagggaagggaaucgguaaaaccuccauaggcuugaucugugugauugcuaguucugggaugcuguggauggccgagauccccuuacaauggauugccagcgcaaucguccuagaguucuuuaugaugguucugcucauaccagaaccugagaagcagcgcacaccgcaggauaaucaacuugcuuacgugguaauuggaauccugacuuuggccgcgauuaucgcugccaacgaaaugggcaugcuggagacgaccaagcgagaccucgguauguccaaagaacccgggguggcaucaccaacaucuuaccuggaugucgaccuucacccugccagcgcuuggacucucuaugcaguggccaccacaguuauaacccccaugcugagacacacuaucgagaauaguacggcgaacguguccuuggcugccauugcaaaccaggccgucguacugaugggcuuagacaagggauggccaaucagcaaaauggaucuaggcgugccucugcucgcucuugggugcuacucucagguuaauccccugacauugaccgccgcagugcugcuccugauuacucauuaugcuaucauaggaccgggccuucaggccaaggcgaccagggaggcccaaaaacggacagcagcugguauuaugaagaacccaacugucgacgggaucaugaccaucgauuuagacccugugauuuacgauucaaaguucgaaaaacagcugggacaggucaugcucuuggugcugugugccguucagcuacugcucaugcgcacauccugggcacuuugcgaggcucugacguuggccaccggccccaucacuacacugugggaagguaguccaggcaaguuuuggaauaccacuauagccgugagcauggcgaacauuuucagagggucguaucucgcuggagcaggccuggccuuuucuaucaugaaauccguagggacaggaaagaggggcaccgguagccaaggggagacguuaggagaaaaauggaagaagaaacuuaaucagcugucacggaaggaguucgaccucuacaaaaagaguggcauuaccgagguggaucgaacagaagcuaaagagggucuaaagagaggcgaaaucacucaccaugccgucucucgcggguccgcaaaacugcagugguuuguugagaggaacauggugauacccgaaggacgggucaucgacuugggcugugggcguggaggcuggagcuauuacugcgccggucugaagaaggugaccgagguaagaggguacacaaaaggaggcccuggccacgaggaaccggugcccaugucaacuuauggguggaauauuguuaagcucaugaguggaaaagauguguucuaccuuccaccugagaagugugacacccuguugugcgauaucggugaaagcucccccucuccuacagucgaggagagcaggaccauucgcgugcugaaaauggucgaaccauggcucaagaacaaucaguucuguaucaagguguuaaaccccuauaugccuacuguuauugagcaucuggaacggcuucaacgaaaacacggcgggaugcugguaagaaauccacuauccaggaacucaacgcacgagauguacuggaucucuaauggaacaggcaacauaguggcuagugucaauauggugucgcgccuccuguugaaccgguuuaccaugacucauagacgucccaccauugaaaaggacguugaucugggugcggggacaaggcacgugaacgccgagccggagacgccuaauauggacgucaucggagaacggaucaaacgcauuaaggaggaacauaacagcaccuggcacuaugacgaugagaauccauacaaaacuugggcauaucacggcuccuacgaagugaaggcuacaggcucugccucaagcaugauaaacgggguagugaagcuccuuaccaaacccugggacguugucccuauggugauccagauggcaaugacugauacaaccccauucggacagcaacgaguguuuaaggagaaagucgacacaagaacucccagguccaugccggguacccggcgcguuaugggcauuacggccgaguggcuguggagaaccuuagggaggaauaagaaaccucgacugugcacacgggaagaguucacucguaaggugagaaccaacgcugccaugggagcgguauuuacagaagagaaucagugggauagugcaaaggccgcuguggaagacgaggauuucuggaaauuggucgaccgcgagagggaacuccauaagcugggcaaaugugguucuugcguguacaacaugauggggaagcgggagaaaaagcuaggagaauuuggcaaagccaagggcagcagagcaaucugguauauguggcuuggggcucgcuaccuggaguucgaggcccucggauuucugaaugaagaucacugguucucaagggagaacuccuauagugguguugaaggcgagggguugcauaagcugggauacauucuccgagacaucagcaaaauacccggcggugcuauguaugccgaugacacugcagggugggacacccggaucacggaagaugaccuucacaaugaggagaagauuacacagcagauggauccagaacauagacaacuggcgaacgccaucuuuaaauuaaccuaccagaauaagguggucaaagugcagaggccuacucccacaggaaccguaauggacauuaucucucgcaaggaucagcguggcuccggccaaguugggacuuauggacugaacaccuucacaaauauggaggcucaguugauacggcagauggaaggugagggcgugcucucaaaggccgaccuggaaaacccacaccuacccgagaaaaagauuacgcaguggcuugagaccaaaggggucgaaagacugaagaggauggcaaucagcggagaugacugcguggugaaaccuaucgaugaccgcuuugcuaacgcccuccuggcauugaaugauaugggcaagguccgaaaggacauuccacaauggcagccgucgaaagguuggcacgauuggcagcagguucccuucuguucucaucacuuccaugaguuaauaaugaaggacgggcggaaacuggugguaccuugcagaccacaagacgaacucaucggaagggcccgcauuagucagggcgcgggcuggucccuuagagagacugcuugucuggggaaggccuacgcacagauguggagccuaauguacuuucaccggagggaucugcgucucgccucaaacgcuaucugcuccgccgugcccguccacugggugccuacaucucgaaccacuuggagcauucaugcacaccaucaauggaugacaaccgaagacauguugacgguuuggaaucgcguguggaucgaggauaacccauggauggaggacaaaacacccgucaccacuugggaaaaugugccuuaucugggaaagagagaggaucaguggugugguagucuuauaggccugaccucccgggcuacaugggcccagaacaucccgacugcgauucagcaaguaaggagccucaucgggaaugaagaguucuuagacuacaugccaucuaugaagcgcuuuagaaaagaggaagagucagaaggagcuauuugguga

SEQ ID NO: 15179 - RNA, 9873 nt, Artificial Sequence
  derived and/or modified CDS sequence (opt3) from DENV-3__GQ868571__SS-prME
accagccugugccucaugaugauccuucccgcagcucuggcauuccacuugacauccagggacggcgagccuaggaugauuguggggaagaacgaacggggaaaaucuuuacuguuuaagacugcaucagguauaaauauguguacgcuaaucgcgauggaucucggcgaaaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccagacguggauguccgccgagggggcuuggaggcaggucgaaaaaguggagacuugggcauugcggcacccuggauucaccauucucgcccuguuucuggcucauuacaucggcacaucucucacucagaaggccguuauauucaucuuacugaugcuugugaccccaucgaugacaaugcgcugugucggcguggggaacagagacuuuguagaaggauugucaggugcgaccuggguugaugugguccuggagcacggcgggugcgugacgacuauggcaaagaauaaacccacacuagacauugagcuccagaagaccgaagccacucagcuggcuacacuuaggaaacuguguaucgagggaaagauuaccaacaucacgaccgauagccggugcccuacacagggcgaagccguguugccagaggaacaggaccagaauuaugucuguaaacacacuuacguugaucgcgguugggggaacggaugcggccucuucggcaaggggagucuggugaccugcgcaaaguuucaauguuuagagcccauagagggaaaaguagugcaguaugaaaaucugaaguacacagucauuaucacugugcauaccggugaccagcaccagguuggcaacgagacacaaggggugaccgcugaaauuacuccucaggccuccacgacagaggcgauccucccagaauauggaacccuuggccuggagugcucuccgcgaacugguuuggacuucaaugagaugauccuacugaccaugaaaaacaaggccuggaugguccauagacagugguuuuucgaucucccccugccuuggacaagcggggcaaccacugaaacaccaacguggaauaggaaagagcuucuggugaccuuuaagaacgcucacgccaaaaagcaagaaguaguuguguugggcucccaggagggagcuaugcacacugcccucacaggcgcaaccgaaauucaaaauucagggggaacaaguauauucgccggucaucugaagugucgguuaaaaauggacaagcuggagcuaaaaggcaugagcuacgcuaugugcacuaacaccuuuguccucaagaaagaggugucugaaacgcagcacgggaccauccugauuaaggucgaguacaagggagaagaugugcccuguaaaaucccuuucuccacagaggacggccaagguaaggcgcauaacgggcgucuuauaacugcaaauccaguugugaccaaaaaggaggaacccguaaacauugaggccgaaccgccuuucggcgagucaaauaucgucaucggaauuggcgauaacgcuuugaaaaucaauugguauaagaaggggagcaguauuggaaaaauguuugaagccacagcacgcggugccagaaggauggcuauacugggcgacacugccugggauuucgggucugugggaggcguucucaacucccuggguaagauggugcaccagaucuuugggagcgcauacaccgcgcuuuucucgggcgucucuugggugaugaaaauuggaaucggcguacuguugacguggaucgggcucaauuccaagaacacaucaaugaguuuuagcugcauugcuauaggaaucauuacccuguauuuaggcgccgugguucaggcagacauggguugugucaucaauuggaaagggaaggagcugaagugcggauccggcauuuucgugacuaacgaggugcauacauggaccgaacaguacaaauuucaagccgauucucccaagcggcuagcuacugccaucgccggugcuugggagaauggcgucugugggauacgaagcaccacacgcauggaaaaccuccuguggaaacagaucgccaaugagcuuaacuauauuuugugggaaaauaacaucaagcugacgguuguggugggagacauuaucggcguacucgagcaggggaaaagaacccugacuccacagccuauggaguuaaaguacucauggaaaacauggggaaaggcgaagauagucaccgccgaaacacaaaacaguuccuucauuaucgauggccccaauacuccagagugccccagcgcuucuagggcauggaacgugugggaaguugaggacuaugguuuugggguguucaccacgaauauuuggcugaaacuucgggaagucuacacacaguugugugaccaccgccucaugucagccgcugugaaggaugagagagccguucacgcagacaugggauacuggaucgagagucagaaaaacggcagcuggaagcuggaaaaagcgucccuaauagaggugaagaccugcacuuggccuaagucucauacccuguggucgaaugguguacucgaaagcgauaugaucauuccaaaaucccuggccggcccgaucucacagcacaacuauaggcccggguaccauacacaaacugcuggaccuuggcaccuuggcaaguuggagcuggacuuuaauuauugcgaggggaccacagucgugauuacggaaaacuguggaacccguggcccaaguuuacggacuacaaccgugucugguaaacucauccacgaguggugcugucgaagcugcacucugcccccucuuagauacaugggggaagauggauguugguauggcauggagauaaggccaauuuccgaaaaggaggagaauauggucaaaucacugguuagcgccgguucuggcgaaguggacaacuucacaauggggguauugugccucgcaauccuguuugaggaagugaugcgcggaaaguucggcaagaaacauaugaucgcuggggucuucuuuaccuucgugcuacugcucuccggacagauuacguggcgggauauggcccacacucugaucaugauuggcaguaaugcaagcgacagaauggguauggggguuaccuaccuugccuugauagcuacauuuaagauccagcccuuccuggcguuaggauuuuuccucaggaaacugaccucucgcgagaaccuucugcuaggcgugggccucgccauggcaacuacacugcaauugccggaagauauugagcagauggcuaaugggaucgcccugggauuaauggcccucaagcugauuacccaguuugagacauaucagcuuuggacugcucugaucuccuugaccuguucaaacacgauauucacacucaccgucgcauggcgaacugccacccugauccuagcgggugugagucugcuuccuguuugccaaagcucguccaugcggaaaacagacuggcucccaaugacuguggcugccaugggcgucccaccucugcccuuguuuauuuucucucugaaggauaccuuaaagcguagaagcuggccacucaaugaagggguaauggcagugggacugguuucaauccuugccaguucccuguugaggaacgacgugccuauggcuggcccccucgucgccggugggcugcuaauugccuguuacgugaucacgggaacaucugcggaucugaccguagagaaagcugccgacgugacuugggaagaggaagcagagcagacaggcgucagccauaaccuuaugauaaccguugacgaugacggcacuaugcgcauuaaggaugacgagacagaaaauauccucaccgugcuguugaaaacggccuuacugaucguguccgggauuuuuccauacucaauaccggcuacucuccuggucuggcacaccuggcagaagcagacacaacggagcggagugcuuugggauguuccuagucccccagagacccagaaagccgaacuggaggaggguguauauagaaucaagcagcagggcauuuucgggaaaacacaagugggagucggcgugcagaaggaagguguuuuucauacuauguggcacgugaccagaggggcagucuugacguacaacggaaagcgacuagagcccaauugggcuucugugaaaaaggaccugaucuccuauggcggcggguggcgccucagcgcccaguggcaaaaaggagaagagguacaggucauugcgguggaaccugguaagaaccccaagaauuuccagacaaugcccggcacuuuccagaccacaaccggggagaucggagccauagcacuggauuuuaagccuggcacuucggguucaccgaucauuaaccgggaggggaagguugugggacuuuacggcaauggcgucgugaccaaaaacgggggauauguuucugguaucgcucaaacaaaugccgaaccagacggccccacgccugaguuagaagaggaaauguucaagaaaagaaaccugacuauuauggaucuccacccagggaguggaaagaccaggaaauacuugcccgcuaucgugcgugaggcaauaaagcgccggcugagaacacucauucuggccccuaccagggucguggccgcugagauggaagaggcgcuuaagggccugccgauccgauaucagacuacagcaaccaaauccgaacauacgggucgggagaucguagacuugaugugccacgccacuuuuacaaugcgccuacugagccccgugagaguuccaaauuacaaccucauuaucauggaugaagcucauuucaccgacccugccucuauagcagccaggggguacauuagcacccgggucggaaugggcgaggcugcggccaucuuuaugacugcaacacccccaggcaccgcugaugccuucccucaguccaaugcacccauucaggacgaggaacgagacaucccagagagaucauggaacagugggaaugaauggauaacagauuuugccggaaagacugugugguucgugccgagcauuaaagcugguaacgacaucgccaacuguuuacgcaagaauggcaaaaaggucauccaacugucuaggaagacguuugauaccgaguaucagaaaacaaaacuuaacgacugggauuucguagugacuaccgacauuuccgagaugggggcgaauuuuaaagcagaucguguuaucgacccucggagaugccugaagcccgugauucucacagauggaccagaaagggucauauuggccggccccaugccugugaccgcugccucagcugcacagcgccgagguagaguugggcggaacccacagaaagagaaugaccaauacaucuucacuggccagccccugaacaaugaugaagaccacgcccauuggacggaggcuaagaugcuccuggacaacauuaauaccccugaaggaaucaucccggcccuuuucgagccagagagggaaaagagugcagcgauugauggcgaguaucgccuaaaaggggaaagccguaagacauuuguggagcugaugagacggggagacuugcccgucugguuagcccacaaaguggcuuccgaagguauaaaguacacugauaggaaauggugcuucgacggccagcgcaacaaucagauccuggaggagaacauggauguagaaauuuggaccaaggagggggagaagaagaagcuccgaccuagauggcuggacgcccggacauauucugauccccuugcacugaaagaguuuaaggacuucgcugccggaaggaaaucgaucgcacucgauuuggugaccgaaauuggccgcguuccaacucaccuggcccauagaacaaggaaugcucuagacaaccuggucaugcuccacacgagcgagcauggugggaaggcguaccggcacgccguggaggaacuuccugagaccauggaaacucuguuauugcugggccucaugauccugcuuacaggaggcgcaaugcuguuucucauaucagggaaaggaaucgguaagaccuccauuggcuugaucugugugauugcuaguucugggaugcuguggauggccgagauccccuuacaauggauagccagcgcaauuguccuagaguucuuuaugaugguucugcucaucccagaaccugagaagcagcguaccccgcaggauaaucaacuugcuuaugugguaauuggaauccugacauuggccgcgauaaucgcugccaacgaaaugggcaugcuggagacuacgaaacgcgaccucgguauguccaaggaacccgggguggucucaccaaccucuuaccuggauguggaccuucacccugcaagcgccuggacacucuacgcuguugcaacuaccgugauuacacccaugcugcgacauaccaucgagaauaguacugccaacgucuccuuggcggcuauugccaaccaggcaguagugcugaugggcuuagacaaaggauggccaaucagcaagauggaucuaggcguuccucugcucgcccuugggugcuauucucaggugaauccccugacguugacagcugccguccugcuccugauaacccacuacgcaauuaucggaccgggccuucaggcuaaagccacuagagaggcgcaaaagaggaccgccgcagguaucaugaagaacccaacaguggacgggauuaugacuaucgauuuagacccugucauauaugauucaaaauucgaaaagcagcugggacaggugaugcucuugguucugugugcugugcagcuacugcucaugcggaccuccugggcccuuugcgaggcacugacauuggcuacgggccccauuaccacucugugggaagguaguccaggcaaauuuuggaauacaaccaucgccguaagcauggccaacauuuuccgcgggucguaccucgcgggagcuggccuggcauuuucuaucaugaaguccguggggacuggaaaaagaggcacagguagccaaggggagaccuuaggagaaaaguggaagaagaaacuuaaucagcugucaaggaaagaguucgaccucuauaagaaaaguggcauaacggaggucgaucggaccgaagccaaagagggucuaaaacgaggcgaaaucacacaucacgcuguuucuagaggguccgccaagcugcagugguuuguggagcgcaacauggucauucccgaaggaagggugaucgacuugggcugugggcggggaggcuggagcuacuauugcgcaggucugaagaaaguaacugaggugcguggguacaccaagggaggcccuggccaugaggaaccgguucccaugucaacauacggguggaauauugugaaacucaugaguggaaaggaugucuucuaucuuccaccugagaaaugugacacucuguugugcgauaucggugaaagcucccccucuccuaccguggaggagagcagaacaauuaggguccugaagaugguggaaccauggcucaagaacaaucaguucuguaucaaaguuuuaaaccccuacaugccuaccguaauagagcaccuggaacgccuucaacggaagcacggcgggaugcuggugcgaaauccacuauccagaaacucaacucaugagauguauuggauuucuaauggaacgggcaacaucgucgccagugugaauaugguuucgaggcuccuguugaaccgcuuuacaaugacccaccggagacccacuaucgaaaaagacguggaucugggugcugggacccgucaugucaacgcggagccggagacaccuaauauggacgugauuggagaaaggauaaagcggaucaaagaggaacacaacagcacguggcacuacgacgaugagaauccauauaagaccugggccuaccauggcuccuaugaaguaaaggcaacuggcucugcuucaagcaugauuaacggggugguuaaacuccuuacaaagcccugggacgucgugccuauggugacccagauggccaugacugauacaaccccauucggacagcaacgcgucuuuaaagagaagguugacacacgaacucccagauccaugccggguaccaggcgggugaugggcaucacggcagaguggcuguggcgcaccuuagggagaaauaaaaagccuaggcugugcacacgagaagaguucacuaagaaaguacggaccaacgccgcuaugggagccguguuuacagaagagaaucagugggauagugcgaaggcagccgucgaagacgaggauuucuggaaauugguggaccgugagagagaacuccacaagcugggcaaaugugguucuugcguuuacaacaugauggggaagcgcgagaaaaagcuaggagaauuuggcaaggcuaaaggcagcagggccauuugguacauguggcuuggggcacgguaucuggaguucgaggcucucggauuucugaaugaagaucauugguucucaagagagaacuccuacagugguguggaaggcgagggguugcacaagcugggauauauccuccgcgacauaagcaaaauccccggcggugccauguacgcugaugacacugccgggugggacaccaggauuacggaagaugaccuucauaaugaggagaagaucacacagcagauggauccagaacaccgacaacuggcaaacgcgauuuuuaaauuaaccuaucagaauaaggucgugaagguacagcggccuacucccacaggaaccguuauggacaucauaucuagaaaagaucagaggggcuccggccaaguggggacuuacggacugaacaccuucacaaauauggaggcccaguugauucgccagauggaaggugagggcguccucucaaaggcugaccuggaaaacccacaccuacccgagaaaaagaucacgcaguggcuugagaccaaagggguggaacgucugaagcggauggccaucagcggagaugacugcguggucaagccuauugaugacagauuugcaaacgcucuccuggccuugaaugauaugggcaaaguuaggaaggacauaccacaauggcagccgucgaaagguuggcaugauuggcaacaggugcccuucuguucucaccauuuccacgaguuaaucaugaaggacgggcgcaaacugguagugccuugccgaccacaagacgaacucauuggacgggcaagaaucagucagggcgccggcuggucccuuagggagacugcgugucuggggaaggcuuaugcccagauguggagccuaauguacuuucaccgcagagaucugcggcucgcaucaaacgccauuugcuccgcuguccccgugcauuggguuccuacaucuaggaccacuuggagcauccacgcccaucaccaauggaugacaaccgaagacauguugacgguguggaaucgugucuggauagaggauaacccauggauggaggacaagacacccgugaccacuugggaaaauguaccuuaccugggaaaacgagaggaucaguggugugguagucuuaucggccugaccucccgcgcaacaugggcucagaacauuccgacugccauccagcaaguuagaagccucauugggaaugaagaguucuuagacuauaugccaucuaugaagcgguuuaggaaagaggaagagucagaaggagcgaucugguga

SEQ ID NO: 15180 - RNA, 9873 nt, Artificial Sequence
  derived and/or modified CDS sequence (opt3) from DENV-3__GU131951__SS-prME
accagccugugccucaugaugauccuuccagcagcucuggcauuccacuugacuuccagagacggcgagccuaggaugauuguggggaagaacgaacggggaaaaucuuuacuguuuaagacugccucagguauaaauauguguacgcuaaucgcgauggaucucggcgaaaugugcgacgauaccguaacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuaugagcaagaauaaacccacacuagacauugagcuccagaagaccgaagcgacucaacuggcaacacuuaggaaacuguguaucgagggaaagauuaccaacaucacgaccgauagucggugcccuacacagggcgaagccgucuugccagaggaacaggaccagaauuauguuuguaaacacacuuacguggaucgcgguugggggaacggaugcggccucuucggcaaggggucccugguaaccugcgcuaaguuucaauguuuagagcccauagagggaaaagugguccaguaugaaaaucugaaguacacagugauuaucacuguucauaccggugaccagcaccaggugggcaacgagacacaaggggucaccgccgaaauuacuccucaggcaucuacgacagaggcuauccucccagaauauggaacccuuggccuggagugcagcccgcgaacugguuuggacuucaaugagaugauccuacugaccaugaaaaacaaggccuggauggugcauagacagugguuuuucgaucucccccugccuuggacauccggggcgaccacugaaacaccaacguggaauaggaaagagcuucugguaaccuuuaagaacgcccacgccaagaagcaagaaguuguggucuugggcucacaggagggagcuaugcacacugcccucacaggcgcuaccgaaauucagaauagugggggaacaagcauauucgccggucaucugaagugucgguuaaaaauggacaagcuggagcuaaaaggcaugucuuacgcaaugugcacuaacaccuuugugcucaagaaagaggucuccgaaacgcagcacgggaccauccugauuaagguggaguacaagggagaagauguucccuguaaaaucccuuucucaacagaggacggccaagguaaggcccauaacgggcgucuuauaacugcuaauccagugguaaccaaaaaggaggaacccgucaacauugaggcggaaccgccuuucggcgagagcaauaucgugaucggaauuggcgauaacgcauugaaaaucaauugguauaagaaggggaguucuauuggaaaaauguuugaagccacagcucgcggugccagaaggauggcaauacugggcgacacugccugggauuucggguccguuggaggcgugcucaacagccuggguaagaugguccaccagaucuuugggucggcuuacaccgcccuuuucucuggcguguccuggguaaugaaaauuggaaucggcgugcuguugacguggaucgggcucaauucaaagaacacaaguaugagcuuuuccugcauugcaauaggaaucauuacccuguauuuaggcgcgguuguccaggcugacauggguugugugaucaauuggaaagggaaggagcugaagugcggaucuggcauuuucgugacuaacgagguccauacauggaccgaacaguacaaauuucaagccgauagccccaagcggcuagcaacugccaucgcuggugccugggagaauggcguuugugggauacgaucaaccacacgcauggaaaaccuccuguggaaacagaucgcaaaugagcuuaacuauauuuugugggaaaauaacaucaagcugacgguggugguaggagacauuaucggcguccucgagcaggggaaaagaacccugacuccacagccuauggaguuaaaguacaguuggaaaacauggggaaaggcuaagauagugaccgccgaaacacaaaacuccagcuucauuaucgauggccccaauacuccagagugccccucugcgucaagggccuggaacguuugggaaguggaggacuaugguuuuggggucuucaccacgaauauuuggcugaaacuucgggaaguguacacacaguugugugaccaccgccucaugagugcugcaguuaaggaugagagagccgugcacgcugacaugggauacuggaucgagagccagaaaaacggcuccuggaagcuggaaaaagccucucuaauagagguaaagaccugcacuuggccuaagucgcauacccuguggagcaaugguguccucgaauccgauaugaucauuccaaaaucacuggcaggcccgaucagucagcacaacuauaggcccggguaccauacacaaacugcgggaccuuggcaccuuggcaaguuggagcuggacuuuaauuauugcgaggggaccacaguggugauuacggaaaacuguggaacccguggcccaucuuuacggacuacaaccgucagcgguaaacucauccacgaguggugcugucgauccugcacucugcccccucuuagauacaugggggaagauggauguugguauggcauggagauaaggccaauuucagaaaaggaggagaauaugguuaaaagccuggugucugccgguuccggcgaaguagacaacuucacaauggggguguugugccucgcuauccuguuugaggaagucaugcgcggaaaguucggcaagaaacauaugaucgccgggguguucuuuaccuucguucuacugcucaguggacagauuacguggcgggauauggcacacacucugaucaugauuggcagcaaugcuucugacagaauggguaugggggugaccuaccuugccuugauagcaacauuuaagauccagcccuuccuggccuuaggauuuuuccucaggaaacugaccucccgcgagaaccuucugcuaggcgucggccucgcuauggcgacuacacugcaauugccggaagauauugagcagauggccaaugggaucgcacugggauuaauggcucucaagcugauuacccaguuugagacauaucagcuuuggacugcccugaucucauugaccuguaguaacacgauauucacacucaccguggccuggcgaacugcuacccugauccuagccgguguuagccugcuuccugugugccaaucguccucuaugcggaaaacagacuggcucccaaugacugucgccgcgaugggcguacccccucugcccuuguuuauuuucagccugaaggauaccuuaaagcguagaucauggccacucaaugaaggggugauggcuguuggacuggugaguauccuugccuccucucuguugaggaacgacgucccuauggcaggcccccucguggccggugggcugcuaauugcuuguuacguaaucacgggaacaagcgcagaucugaccguggagaaagccgcggacgucacuugggaagaggaagcugagcagacaggcguuucccauaaccuuaugauaaccguggacgaugacggcacuaugcgcauuaaggaugacgagacagaaaauauccucaccgugcuguugaaaacggccuuacugaucgucucagggauuuuuccauacagcauaccggcaacucuccugguguggcacaccuggcagaagcagacacaacggaguggaguucuuugggauguaccuucucccccagaggcccagaaagcugaacuggaggaggguguguauagaaucaagcagcagggcauuuucgggaaaacccaagucggagugggcguucagaaggaagguguguuucauacaauguggcacgucacucgaggggcaguguugaccuacaacggaaagaggcuagagcccaauugggcauccgucaagaaggaccugaucagcuauggcggcggguggcgccucucggcucaguggcaaaaaggagaagagguccaggugauugccguugaaccugguaagaaccccaaaaauuuccagacgaugcccggcacauuccagacuaccacaggggagaucggagcgauagcccuggauuuuaagccuggcaccucagguucuccgaucauuaaccgggaggggaagguggucggacuuuacggcaauggcgugguuacuaaaaacgggggauaugugagugguaucgcacaaaccaaugcugaaccagacggccccacaccugaguuagaagaggaaauguucaagaaaagaaaccugacgauuauggaucuccacccaggguccggaaagacuaggaaauacuugcccgccaucguccgugaggcuauaaagcgccggcugagaacccucauucuggcaccuacaagggugguagccgccgagauggaagaggcucuuaagggccugccgauccgauaucagaccacugcgacaaaaagcgaacauaccggucgggagaucguggacuugaugugccacgcaacguuuacuaugcgccuacugucucccguuagagucccaaauuacaaccucauuaucauggaugaagcccauuucacagacccugcuagcauagccgcaaggggguacauuuccacccgggugggaaugggcgaggccgcugcgaucuuuaugaccgccacucccccaggcacagcagaugcuuucccucagucaaaugcccccauucaggacgaggaacgagacaucccagagagaaguuggaacagcgggaaugaauggauaaccgauuuugcaggaaagacagugugguucgucccgucuauuaaagccgguaacgacaucgcuaacuguuuacgcaagaauggcaaaaagguaauccaacuguccaggaagacuuuugauacggaguaucagaaaaccaaacuuaacgacugggauuucgugguuacaacugacauuucagagaugggggccaauuuuaaagcggaucgugugaucgacccucggagaugccugaagcccgucauucucaccgauggaccagaaagggugauauuggcaggccccaugccuguuacagccgcuagugccgcucagcgccgagguagaguggggcggaacccacagaaagagaaugaccaauacaucuucaccggccagccccugaacaaugaugaagaccacgcacauuggacugaggccaagaugcuccuggacaacauuaauacgccugaaggaaucaucccggcucuuuucgagccagagagggaaaagagcgccgcaauugauggcgaguaucgccuaaaaggggaaucccguaagaccuuugucgagcugaugagacggggagacuugcccgugugguuagcgcacaaaguagccucugaagguauaaaguacacagauaggaaauggugcuucgacggccagcgcaacaaucagauccuggaggagaacauggauguggaaauuuggacuaaggagggggagaaaaagaagcuccgaccuagauggcuggacgcucggaccuauucggauccccuugcccugaaagaguuuaaggacuucgcagcuggaaggaaaagcaucgcccucgauuugguuacagaaauuggccgcgucccaucacaccuggcacauagaaccaggaaugcccuagacaaccuggugaugcuccacacuuccgagcauggugggaaggcuuaccggcacgcgguggaggaacuuccugagacaauggaaacgcuguuauugcugggccucaugauccugcuuaccggaggcgccaugcuguuucucauaagugggaaaggaaucgguaagacuucuauuggcuugaucugugucauugcaagcuccgggaugcuguggauggcugagauccccuuacaauggauagccucagccauuguucuagaguucuuuaugauggugcugcucaucccagaaccugagaagcagcguacaccgcaggauaaucaacuugcauauguagugauuggaauccugaccuuggcugccauaaucgcggcuaacgaaaugggccugcucgagaccacaaaacgcgaccuggguaugucuaaggaacccggggucgugagcccaacaaguuaccuugauguugaccuccacccugccuccgcauggacgcuguacgccguggcuaccacagucauuacucccauguugcgacauaccaucgagaauagcacagcaaacguaucucuggccgcgauugcuaaccaggccgugguuuuaaugggccuagacaaaggauggccaaucucaaagauggaucugggcgugccucuccuugcacuggggugcuauucccaggucaaucccuugacccugacugccgcugugcuccugcuuauaacgcacuacgccauuaucggaccgggcuuacaggcaaaagcuacaagagaggcccaaaagaggaccgcggccgguaucaugaagaacccaacugucgacgggauuaugaccaucgaucuggacccugugauauaugauaguaaauucgaaaagcagcucggacagguuauguugcuggugcuaugugcaguacagcugcuccuuaugcggacaagcugggcucugugcgaggccuugacucuggcaaccggccccauuacaacgcucugggaagguucgccaggcaaauuuuggaauaccacuaucgcugugucuauggccaacauuuuccgcggguccuaccuggccggagcgggcuuagcuuuuagcaucaugaagucagucgggacaggaaaaagaggcaccgguagucaaggggagacucuuggagaaaaguggaagaaaaagcugaaucagcucucuaggaaagaguucgaccuauauaagaaauccggcauaacagagguugaucggaccgaagcaaaggagggucugaaacgaggcgaaaucacgcaucacgccgugagcagagggucagcuaaguugcagugguuugucgagcgcaacauggugacccccgaaggaaggguaauugaccugggcugugggcggggaggcuggaguuacuauugcgccggucucaagaaagugacagagguucguggguacacuaagggaggcccuggccaugaggaaccggugcccaugagcaccuacggguggaauaucgucaaacuuauguccggaaaggauguguucuaucugccaccugagaaaugugacacauugcugugcgauauuggugaaucuagccccuccccuaucgucgaggagucaagaacuauuagggugcucaagaugguugaaccaugguuaaagaacaaucaguucuguaucaaaguacugaaccccuacaugccuaccgugauagagcaccuugaacgccugcaacggaagcacggcgggaugcuaguccgaaauccacucucuagaaacaguacacaugagauguauuggauuucgaauggaaccggcaacaucguggcaagcguuaauaugguguccaggcuguugcugaaccgcuuuacuaugacgcaccggagacccacaaucgaaaaagacgucgaucucggugccgggacccgucaugugaacgcugagccggagacuccuaauauggacguaauuggagaaaggauaaagcggaucaaagaggaacacaacucuaccuggcacuacgacgaugagaauccauauaagacaugggcguaccauggcucauaugaagugaaggccacgggcagcgcauccaguaugauuaacgggguugucaaacuucugaccaagcccugggacguggugccuauggucacucagauggcuaugacagauaccacuccauucggacagcaacgcguuuuuaaagagaagguggacacacgaacccccagaucuaugccggguacaaggcggguaaugggcaucacugccgagugguuauggcgcacccuggggagaaauaaaaagccuagguugugcacgcgagaagaguucaccaagaaagugcggacaaacgcagccaugggagcugucuuuacugaagagaaucagugggauagcgccaaggcggcaguggaagacgaggauuucuggaaacucguugaccgugagagagaacugcacaagcuaggcaaaugugguucaugcguguacaacaugauggggaagcgcgagaagaaacuuggagaauuuggcaaagccaaaggcuccagggcuauuugguacauguggcugggggcccgguaucucgaguucgaggcacugggauuuuugaaugaagaucauugguucaguagagagaacagcuacucuggugucgaaggcgaggggcugcacaagcucggauauauccuucgcgacauauccaaaauccccggcggugcuauguacgccgaugacaccgcugggugggacacaaggauuacugaagaugaccugcauaaugaggagaagaucacccagcagauggauccagaacaccgacaauuagccaacgcaauuuuuaaacugacguaucagaauaaggugguaaagguucagcggccuacacccaccggaacugugauggacaucauaucaagaaaagaucagaggggcagcggccaagucgggacauacggauugaacaccuucacuaauauggaggcgcagcucauucgccagauggaaggugagggcgugcugucgaaggccgaccuagaaaacccacaccuucccgagaaaaagaucacccaguggcuggagacaaaagggguggaacgucucaagcggauggcuaucucuggagaugacugcgucguuaagccuauugaugacagauuugccaacgcacuguuggcuuuaaaugauaugggcaaagugaggaaggacauaccacaauggcagccgaguaaagguuggcaugauuggcagcagguacccuucuguucccaccauuuccacgagcugaucaugaaggacgggcgcaaacucguggucccuugccgaccacaagacgaacuuauuggacgggccagaaucagccagggcgcaggcuggucacugagggagacggccugucuagggaaggcguaugcucagauguggucccugauguacuuucaccgcagagaucuccgguuggccucuaacgcaauuugcagcgccgugcccguucauugggugccuaccaguaggacuacaugguccauccacgcucaucaccaauggaugaccacugaagacaugcugacagucuggaaucguguguggauagaggauaacccauggauggaggacaagacccccguaacgacaugggaaaauguuccuuaccuuggaaaacgagaggaucaguggugugguagccugaucggccucaccucucgcgccacuugggcacagaacauuccgaccgcuauccagcaagugagaucauuaauugggaaugaagaguuccuggacuauaugccaaguaugaagcgguuuaggaaagaggaagaguccgaaggagccaucugguga

SEQ ID NO: 15181 - RNA, 9873 nt, Artificial Sequence
  derived and/or modified CDS sequence (opt3) from DENV-3__GQ868572__SS-prME
accagccugugccucaugaugauccuuccagccgcucuggcauuccacuugacauccagagacggcgagccuaggaugauuguggggaagaacgaacggggaaaaucuuuacuguuuaagacugccucagguauaaauauguguacgcuaaucgcgauggaucucggcgaaaugugcgacgauaccguaacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccagacguggauguccgccgagggggcuuggaggcaggucgaaaaaguggagacuugggcauugcggcacccuggauucaccauucucgcccuguuucuggcucauuacaucggcacaucucucacucagaaggccguuauauucaucuuacugaugcuugugaccccaucgaugacaaugcgcugugucggcguggggaacagagacuuuguagaaggauugucaggugcgaccuggguugaugugguccuggagcacggcgggugcgugacgacuauggcaaagaauaaacccacacuagacauugagcuccagaagaccgaagccacucaacuggcuacacuuaggaaacuguguaucgagggaaagauuaccaacaucacgaccgauagccggugcccuacacagggcgaagccguguugccagaggaacaggaccagaauuaugucuguaaacacacuuacguugaucgcgguugggggaacggaugcggccucuucggcaaggggagucuggugaccugcgcaaaguuucaauguuuagagcccauagagggaaaaguagugcaguaugaaaaucugaaguacacagucauuaucacugugcauaccggugaccagcaccagguuggcaacgagacacaaggggugaccgcugaaauuacuccucaggccuccacgacagaggcgauccucccagaauauggaacccuuggccuggagugcucuccgcgaacugguuuggacuucaaugagaugauccuacugaccaugaaaaacaaggccuggaugguccauagacagugguuuuucgaucucccccugccuuggacaagcggggcaaccacugaaacaccaacguggaauaggaaagagcuucuggugaccuuuaagaacgcucacgccaaaaagcaagaaguaguuguguugggcucccaggagggagcuaugcacacugcccucacaggcgcaaccgaaauucaaaauucagggggaacaaguauauucgccggucaucugaagugucgguuaaaaauggacaagcuggagcuaaaaggcaugagcuacgcuaugugcacuaacaccuuuguccucaagaaagaggugucugaaacgcagcacgggaccauccugauuaaggucgaguacaagggagaagaugugcccuguaaaaucccuuucuccacagaggacggccaagguaagguucauaacgggcgucuuauaacugcgaauccagugguaaccaaaaaggaggaacccgucaacauugaggcagaaccgccuuucggcgagucaaauaucgugaucggaauuggcgauaacgccuugaaaaucaauugguauaagaaggggagcaguauuggaaaaauguuugaagcuacagcccgcggugcaagaaggauggccauacugggcgacacugcuugggauuucgggucuguuggaggcgugcucaacucccuggguaagaugguccaccagaucuuugggagcgccuacaccgcacuuuucucgggcgugucuuggguaaugaaaauuggaaucggcgugcuguugacguggaucgggcucaauuccaagaacacaucaaugaguuuuagcugcauugcgauaggaaucauuacccuguauuuaggcgcuguuguccaggccgacauggguugugugaucaauuggaaagggaaggagcugaagugcggauccggcauuuucgugacuaacgagguccauacauggaccgaacaguacaaauuucaagcagauucucccaagcggcuagccacugcuaucgccggugcaugggagaauggcguuugugggauacgaagcaccacacgcauggaaaaccuccuguggaaacagaucgcuaaugagcuuaacuauauuuugugggaaaauaacaucaagcugacgguggugguaggagacauuaucggcguccucgagcaggggaaaagaacccugacuccacagccuauggaguuaaaguacucauggaaaacauggggaaaggccaagauagugaccgcggaaacacaaaacaguuccuucauuaucgauggccccaauacuccagagugccccagcgccucuagggcuuggaacguuugggaaguggaggacuaugguuuuggggucuucaccacgaauauuuggcugaaacuucgggaaguguacacacaguugugugaccaccgccucaugucagcagccguuaaggaugagagagcugugcacgccgacaugggauacuggaucgagagucagaaaaacggcagcuggaagcuggaaaaagcaucccuaauagagguaaagaccugcacuuggccuaagucucauacccuguggucgaaugguguccucgaaagcgauaugaucauuccaaaaucccuggcgggcccgaucucacagcacaacuauaggcccggguaccauacacaaacugccggaccuuggcaccuuggcaaguuggagcuggacuuuaauuauugcgaggggaccacaguggugauuacggaaaacuguggaacccguggcccaaguuuacggacuacaaccgucucugguaaacucauccacgaguggugcugucgaagcugcacucugcccccucuuagauacaugggggaagauggauguugguauggcauggagauaaggccaauuuccgaaaaggaggagaauaugguuaaaucacuggugagcgcugguucuggcgaaguagacaacuucacaauggggguguugugccucgccauccuguuugaggaagucaugcgcggaaaguucggcaagaaacauaugaucgcagggguguucuuuaccuucguucuacugcucuccggacagauuacguggcgggauauggcucacacucugaucaugauuggcaguaaugccagcgacagaauggguaugggggugaccuaccuugcauugauagccacauuuaagauccagcccuuccuggcuuuaggauuuuuccucaggaaacugaccucucgcgagaaccuucugcuaggcgucggccucgcgauggccacuacacugcaauugccggaagauauugagcagauggcaaaugggaucgcucugggauuaauggcccucaagcugauuacccaguuugagacauaucagcuuuggacugcccugaucuccuugaccuguucaaacacgauauucacacucaccguggcuuggcgaacugcaacccugauccuagccgguguuagucugcuuccugugugccaaagcucguccaugcggaaaacagacuggcucccaaugacugucgcggcuaugggcguacccccucugcccuuguuuauuuucucucugaaggauaccuuaaagcguagaagcuggccacucaaugaaggggugauggccguuggacuggugucaauccuugcaaguucccuguugaggaacgacgucccuauggccggcccccucguggcuggugggcugcuaauugcauguuacguaaucacgggaacaucugccgaucugaccguggagaaagcggcugacgucacuugggaagaggaagccgagcagacaggcguuagccauaaccuuaugauaaccguggacgaugacggcacuaugcgcauuaaggaugacgagacagaaaauauccucaccgugcuguugaaaacggcauuacugaucgucuccgggauuuuuccauacucaauaccggccacucuccugguguggcacaccuggcagaagcagacacaacggagcggaguucuuugggauguaccuagucccccagagacccagaaagcugaacuggaggaggguguguauagaaucaagcagcagggcauuuucgggaaaacacaagucggagugggcguucagaaggaagguguguuucauacuauguggcacgucaccagaggggccguguugacguacaacggaaagcgacuagagcccaauugggcaucugucaagaaggaccugaucuccuauggcggcggguggcgccucagcgcucaguggcaaaaaggagaagagguccaggugauugccguugaaccugguaagaaccccaagaauuuccagacaaugcccggcacuuuccagaccacaaccggggagaucggagcgauagcccuggauuuuaagccuggcacuucggguucaccgaucauuaaccgggaggggaagguggucggacuuuacggcaauggcgugguuaccaaaaacgggggauaugugucugguaucgcacaaacaaaugcugaaccagacggccccacgccugaguuagaagaggaaauguucaagaaaagaaaccugacuauuauggaucuccacccagggaguggaaagaccaggaaauacuugcccgccaucguccgugaggcuauaaagcgccggcugagaacacucauucuggcaccuaccagggugguagccgccgagauggaagaggcucuuaagggccugccgauccgauaucagacuacagcgaccaaauccgaacauacgggucgggagaucguggacuugaugugccacgcaacuuuuacaaugcgccuacugagccccguuagagucccaaauuacaaccucauuaucauggaugaagcccauuucaccgacccugcuucuauagccgcaaggggguacauuagcacccgggugggaaugggcgaggccgcugcgaucuuuaugacugccacacccccaggcaccgcagaugcuuucccucaguccaaugcccccauucaggacgaggaacgagacaucccagagagaucauggaacagugggaaugaauggauaacagauuuugcaggaaagacugugugguucgucccgagcauuaaagccgguaacgacaucgcuaacuguuuacgcaagaauggcaaaaagguaauccaacugucuaggaagacguuugauaccgaguaucagaaaacaaaacuuaacgacugggauuucgugguuacuaccgacauuuccgagaugggggccaauuuuaaagcggaucgugugaucgacccucggagaugccugaagcccgucauucucacagauggaccagaaagggugauauuggcaggccccaugccuguuaccgccgcuucagccgcucagcgccgagguagaguggggcggaacccacagaaagagaaugaccaauacaucuucacuggccagccccugaacaaugaugaagaccacgcacauuggacggaggccaagaugcuccuggacaacauuaauaccccugaaggaaucaucccggcucuuuucgagccagagagggaaaagagugccgcaauugauggcgaguaucgccuaaaaggggaaagccguaagacauuugucgagcugaugagacggggagacuugcccgugugguuagcgcacaaaguagccuccgaagguauaaaguacacugauaggaaauggugcuucgacggccagcgcaacaaucagauccuggaggagaacauggauguggaaauuuggaccaaggagggggagaaaaagaagcuccgaccuagauggcuggacgcucggacauauucugauccccuugcccugaaagaguuuaaggacuucgcagcuggaaggaaaucgaucgcccucgauuugguuaccgaaauuggccgcgucccaacucaccuggcacauagaacaaggaaugcccuagacaaccuggugaugcuccacacgagcgagcauggugggaaggcuuaccggcacgcgguggaggaacuuccugagaccauggaaacucuguuauugcugggccucaugauccugcuuacaggaggcgccaugcuguuucucauaucagggaaaggaaucgguaagaccuccauuggcuugaucugugucauugcaaguucugggaugcuguggauggcugagauccccuuacaauggauagccagcgccauuguucuagaguucuuuaugauggugcugcucaucccagaaccugagaagcagcguaccccgcaggauaaucaacuugcauauguagugauuggaauccugacauuggcugccauaaucgcggcuaacgaaaugggccugcucgagacuacgaaacgcgaccuggguauguccaaggaacccggggucgugucaccaaccucuuaccuugauguugaccuccacccugccagcgcauggacacuguacgccguggcuacuaccgucauuacacccauguugcgacauaccaucgagaauaguacugcaaacguaucccuggccgcgauugcuaaccaggccgugguuuuaaugggccuagacaaaggauggccaaucagcaagauggaucugggcgugccucuccuugcacuggggugcuauucucaggucaaucccuugacgcugacagccgcugugcuccugcuuauaacccacuacgccauuaucggaccgggcuuacaggcaaaagcuacuagagaggcccaaaagaggaccgcggccgguaucaugaagaacccaacagucgacgggauuaugacuaucgaucuggacccugugauauaugauucaaaauucgaaaagcagcucggacagguuauguugcuggugcuaugugcaguacagcugcuccuuaugcggaccuccugggcucugugcgaggccuugacacuggcaacgggccccauuaccacucucugggaagguaguccaggcaaauuuuggaauacaaccaucgcugugagcauggccaacauuuuccgcgggucguaccuggccggagcgggcuuagcuuuuucuaucaugaaguccgucgggacuggaaaaagaggcacagguagccaaggggagacccuuggagaaaaguggaagaaaaagcugaaucagcucucaaggaaagaguucgaccuauauaagaaaaguggcauaacggagguugaucggaccgaagcaaaggagggucugaaacgaggcgaaaucacacaucacgccgugucuagaggguccgcuaaguugcagugguuugucgagcgcaacauggugauucccgaaggaaggguaaucgaccugggcugugggcggggaggcuggagcuacuauugcgccggucucaagaaagugacugagguucguggguacaccaagggaggcccuggccaugaggaaccggugcccaugucaacauacggguggaauauugucaaacuuaugaguggaaaggauguguucuaucugccaccugagaaaugugacacuuugcugugcgauaucggugaaagcucccccucuccuaccgucgaggagagcagaacaauuagggugcucaagaugguugaaccaugguuaaagaacaaucaguucuguaucaaaguacugaaccccuacaugccuaccgugauagagcaccuugaacgccugcaacggaagcacggcgggaugcuaguccgaaauccacucuccagaaacucaacucaugagauguauuggauuucuaauggaacgggcaacaucguggcaaguguuaauauggugucgaggcuguugcugaaccgcuuuacaaugacccaccggagacccacuaucgaaaaagacgucgaucucggugccgggacccgucaugugaacgcugagccggagacaccuaauauggacguaauuggagaaaggauaaagcggaucaaagaggaacacaacagcacguggcacuacgacgaugagaauccauauaagaccugggcguaccauggcuccuaugaagugaaggccacuggcucugcaucaagcaugauuaacgggguugucaaacuucugacaaagcccugggacguggugccuauggucacccagauggcuaugacugauacaaccccauucggacagcaacgcguuuuuaaagagaagguggacacacgaacucccagauccaugccggguaccaggcggguaaugggcaucacggccgagugguuauggcgcacccuggggagaaauaaaaagccuagguugugcacacgagaagaguucacuaagaaagugcggaccaacgcagccaugggagcugucuuuacagaagagaaucagugggauagugccaaggcggcaguggaagacgaggauuucuggaaacucguugaccgugagagagaacugcacaagcuaggcaaaugugguucuugcguguacaacaugauggggaagcgcgagaagaaacuuggagaauuuggcaaagccaaaggcagcagggcuauuugguacauguggcugggggcccgguaucucgaguucgaggcacugggauuuuugaaugaagaucauugguucucaagagagaacuccuacaguggugucgaaggcgaggggcugcacaagcucggauauauccuucgcgacauaagcaaaauccccggcggugcuauguacgccgaugacacugcugggugggacaccaggauuacggaagaugaccugcauaaugaggagaagaucacacagcagauggauccagaacaccgacaauuagccaacgcaauuuuuaaacugaccuaucagaauaaggugguaaagguucagcggccuacucccacaggaaccgugauggacaucauaucuagaaaagaucagaggggcuccggccaagucgggacuuacggauugaacaccuucacaaauauggaggcgcagcucauucgccagauggaaggugagggcgugcugucaaaggccgaccuagaaaacccacaccuucccgagaaaaagaucacgcaguggcuggagaccaaagggguggaacgucucaagcggauggcuaucagcggagaugacugcgucguuaagccuauugaugacagauuugccaacgcacuguuggcuuuaaaugauaugggcaaagugaggaaggacauaccacaauggcagccgucgaaagguuggcaugauuggcagcagguacccuucuguucucaccauuuccacgagcugaucaugaaggacgggcgcaaacucguggucccuugccgaccacaagacgaacuuauuggacgggccagaaucagucagggcgcaggcuggucccugagggagacugccugucuagggaaggcguaugcucagauguggagccugauguacuuucaccgcagagaucuccgguuggccucaaacgcaauuugcuccgccgugcccguucauugggugccuacaucuaggaccacuuggagcauccacgcucaucaccaauggaugacaaccgaagacaugcugacggucuggaaucguguguggauagaggauaacccauggauggaggacaagacacccguaaccacuugggaaaauguuccuuaccuuggaaaacgagaggaucaguggugugguagucugaucggccucaccucccgcgccacaugggcacagaacauuccgacugcuauccagcaagugaggagcuuaauugggaaugaagaguuccuggacuauaugccaucuaugaagcgguuuaggaaagaggaagagucagaaggagccaucugguga

SEQ ID NO: 15182 - RNA, 9873 nt, Artificial Sequence
  derived and/or modified CDS sequence (opt3) from DENV-3__GQ868573__SS-prME
accagcuucugccugaugaugauccuccccgcagcucuugcauuucaccugacauccagagacggcgaaccuaggaugauuguggggaagaacgaacggggaaagucuuuguuauucaagacugcaucagguauuaauauguguacgcugaucgcgauggaucucggcgaaaugugcgacgauaccgucacauacaaauguccacauauuacugaaguugagccggaagacaucgauugcugguguaaccucaccaguacaugggugaccuaugggacuugcaaucaggcuggagagcaccgccgagacaagcguagcguagcccuggcaccccaugugggcaugggucuugauacaagaacccagacguggauguccgccgagggggcuuggaggcaggucgaaaaaguggagacuugggcacugcggcacccuggauuuaccauuuuggcccucuuccuggcucauuacaucggcacaucucugacucagaaggccguuauauuuauccucuuaaugcuggugaccccaucgaugacaaugcgcugugucggcguggggaacagagacuucguagaaggacuuucaggugcgaccuggguugauguggucuuggagcacggcgggugcgugacgacuauggcaaagaauaaacccacacuggacauugaguugcagaagaccgaagccacucaacucgcuacacugaggaaacuuuguaucgagggaaagauuaccaacaucacgaccgauagccggugcccuacacagggcgaagccgugcugccagaggaacaggaccagaauuaugucuguaaacacacuuacguugaucgcgguugggggaacggaugcggcuuguuuggcaaggggagucucgugaccugcgcaaaguuccaaugucuggagcccauagagggaaaaguagugcaguaugaaaauuuaaaguacacagucauuaucacugugcauaccggugaccagcaccagguuggcaacgagacacaaggggugaccgcugaaauuacuccucaggccuccacgacagaggcgauccugccagaauauggaacccucggccuugagugcucuccgcgaacuggucuggacuuuaaugagaugaucuugcuaaccaugaaaaacaaggccuggaugguccauagacagugguucuuugaucugccccucccuuggacaagcggggcaaccacugaaacaccaacguggaauaggaaagagcugcuugugaccuucaagaacgcucacgccaaaaagcaagaaguaguugugcugggcucccaggagggagcuaugcacacugccuugacaggcgcaaccgaaauucaaaauucagggggaacaaguauauuugccggucaucucaagugucggcugaaaauggacaaguuagagcugaaaggcaugagcuacgcuaugugcacuaacaccuucguccuaaagaaagaggugucugaaacgcagcacgggaccauccucauuaaggucgaguacaagggagaagaugugcccuguaaaaucccuuucuccacagaggacggccaagguaaggcgcauaacgggcgucugauaacugcaaauccaguugugaccaaaaaggaggaacccguaaacauugaggccgaaccgccuuuuggcgagucaaauaucgucaucggaauuggcgauaacgcucuuaaaaucaauugguauaagaaggggagcaguauuggaaaaauguucgaagccacagcacgcggugccagaaggauggcuauauugggcgacacugccugggauuuugggucugugggaggcguucugaacucccucgguaagauggugcaccagaucuucgggagcgcauacaccgcgcuguuuucgggcgucucuugggugaugaaaauuggaaucggcguacuucugacguggaucgggcuaaauuccaagaacacaucaaugaguuucagcugcauugcuauaggaaucauuacccucuaucugggcgccgugguucaggcagacauggguugugucaucaauuggaaagggaaggaguuaaagugcggauccggcauuuuugugacuaacgaggugcauacauggaccgaacaguacaaauuccaagccgauucucccaagcggcuggcuacugccaucgccggugcuugggagaauggcgucugugggauacgaagcaccacacgcauggaaaaccuacucuggaaacagaucgccaaugagcugaacuauauucuuugggaaaauaacaucaaguugacgguuguggugggagacauuaucggcguacuggagcaggggaaaagaacccucacuccacagccuauggagcugaaguacucauggaaaacauggggaaaggcgaagauagucaccgccgaaacacaaaacaguuccuuuauuaucgauggccccaauacuccagagugccccagcgcuucuagggcauggaacgugugggaaguugaggacuaugguuucgggguguuuaccacgaauauuugguuaaaacugcgggaagucuacacacagcuuugugaccaccgcuugaugucagccgcugugaaggaugagagagccguucacgcagacaugggauacuggaucgagagucagaaaaacggcagcuggaagcucgaaaaagcgucccugauagaggugaagaccugcacuuggccuaagucucauacccuauggucgaaugguguacuggaaagcgauaugaucauuccaaaaucccucgccggcccgaucucacagcacaacuauaggcccggguaccauacacaaacugcuggaccuuggcaccugggcaaacuugaguuggacuucaauuauugcgaggggaccacagucgugauuacggaaaacuguggaacccguggcccaagucugcggacuacaaccgugucugguaaauuaauccacgaguggugcugucgaagcugcacucucccaccucugagauacaugggggaagauggauguugguauggcauggagauaaggccaauuuccgaaaaggaggagaauauggucaaaucacuuguuagcgccgguucuggcgaaguggacaacuuuacaauggggguacugugcuuggcaauccucuucgaggaagugaugcgcggaaaguucggcaagaaacauaugaucgcuggggucuuuuucaccuuugugcugcuacuguccggacagauuacguggcgggauauggcccacacucucaucaugauuggcaguaaugcaagcgacagaauggguauggggguuaccuaccuggcccuuauagcuacauucaagauccagcccuuuuuggcgcugggauucuuuuuaaggaaacucaccucucgcgagaaccugcuucugggcgugggccuagccauggcaacuacacuccaacugccggaagauauugagcagauggcuaaugggaucgccuugggacugauggccuuaaagcucauuacccaguucgagacauaucagcuguggacugcucuuaucucccugaccuguucaaacacgauauuuacauugaccgucgcauggcgaacugccacccucauccuggcgggugugagucuacugccuguuugccaaagcucguccaugcggaaaacagacuggcuuccaaugacuguggcugccaugggccuacccccucugcccuuguucauauuuucucugaaggauaccuuaaagcguagaagcuggccacucaaugaaggggucauggcaguaggacuggugucaauccuugccaguucccuguugaggaacgacguuccuauggcuggcccccucguggccggugggcugcuaauugccuguuacgucaucacgggaacaucugcggaucugaccguggagaaagcugccgacguaacuugggaagaggaagcagagcagacaggcgugagccauaaccuuaugauaaccgucgacgaugacggcacuaugcgcauuaaggaugacgagacagaaaauauccucaccguucuguugaaaacggccuuacugaucguguccgggauuuucccauacucaauaccggcuacucuccugguguggcacaccuggcagaagcagacacaacggagcggaguccuuugggaugugccuagucccccagagacccagaaagccgaacuggaggaggguguuuauagaaucaagcagcagggcauuuuugggaaaacacaaguaggagugggcguccagaaggaagguguguuccauacuauguggcacguuaccagaggggcaguguugacguacaacggaaagcgacuagagcccaauugggcuucugucaaaaaggaccugaucuccuauggcggcggguggcgccucagcgcccaguggcaaaaaggagaagaggugcagguaauugcggucgaaccugguaagaaccccaagaauuuccagacaaugcccggcacuuuucagaccacaaccggggagaucggagccauagcacuggauuucaagccuggcacuucggguucaccgaucauuaaccgggaggggaaggugguuggacuuuacggcaauggcguggucaccaaaaacgggggauaugugucugguaucgcucaaacaaaugccgaaccagacggccccacgccugaguuagaagaggaaauguuuaagaaaagaaaccugacuauuauggaucuccacccagggaguggaaagaccaggaaauacuugcccgcuaucguucgugaggcaauaaagcgccggcugagaacacucauucuggccccuaccaggguggucgccgcugagauggaagaggcgcuuaagggccugccgauccgauaucagacuacagcaaccaaauccgaacauacgggucgggagaucguggacuugaugugccacgccacuuucacaaugcgccuacugagccccguaagagugccaaauuacaaccucauuaucauggaugaagcucauuuuaccgacccugccucuauagcagccaggggguacauuagcacccggguuggaaugggcgaggcugcggccaucuucaugacugcaacacccccaggcaccgcugaugccuuuccucaguccaaugcacccauucaggacgaggaacgagacaucccagagagaucauggaacagugggaaugaauggauaacagauuucgccggaaagacugucugguuugugccgagcauuaaagcugguaacgacaucgccaacuguuuacgcaagaauggcaaaaaggugauccaacugucuaggaagacguucgauaccgaguaucagaaaacaaaacuuaacgacugggauuuugucguaacuaccgacauuuccgagaugggggcgaauuucaaagcagaucgugugaucgacccucggagaugccugaagcccguuauucucacagauggaccagaaagggugauauuggccggccccaugccugucaccgcugccucagcugcacagcgccgagguagaguggggcggaacccacagaaagagaaugaccaauacaucuucacuggccagccccugaacaaugaugaagaccacgcccauuggacggaggcuaagaugcuccuggacaacauuaauaccccugaaggaaucaucccggcccuuuuugagccagagagggaaaagagugcagcgauugauggcgaguaucgccuaaaaggggaaagccguaagacauucguugagcugaugagacggggagacuugcccgugugguuagcccacaaagucgcuuccgaagguauaaaguacacugauaggaaauggugcuuugacggccagcgcaacaaucagauccuggaggagaacauggauguggaaauuuggaccaaggagggggagaagaagaagcuccgaccuagauggcuggacgcccggacauauucugauccccuugcacugaaagaguucaaggacuuugcugccggaaggaaaucgaucgcacucgauuugguaaccgaaauuggccgcgugccaacucaccuggcccauagaacaaggaaugcucuagacaaccugguuaugcuccacacgagcgagcauggugggaaggcguaccggcacgccgucgaggaacuuccugagaccauggaaacucuguuauugcugggccucaugauccugcuuacaggaggcgcaaugcuguuccucauaucagggaaaggaaucgguaagaccuccauuggcuugaucugugugauugcuaguucugggaugcuguggauggccgagauccccuuacaauggauagccagcgcaauugugcuagaguuuuucaugaugguccugcucaucccagaaccugagaagcagcguaccccgcaggauaaucaacuugcuuauguugugauuggaauccugacauuggccgcgauaaucgcugccaacgaaaugggccugcucgagacuacgaaacgcgaccuggguauguccaaggaacccgggguagugucaccaaccucuuaccuugaugucgaccuccacccugcaagcgccuggacacuguacgcuguggcaacuaccguuauuacacccauguugcgacauaccaucgagaauaguacugccaacgugucccuggcggcuauugccaaccaggcagucguauuaaugggccuagacaaaggauggccaaucagcaagauggaucugggcgugccucuccuugcccuggggugcuauucucagguuaaucccuugacgcugacagcugccgugcuccugcuuauaacccacuacgcaauuaucggaccgggcuuacaggcuaaagccacuagagaggcgcaaaagaggaccgccgcagguaucaugaagaacccaacagucgacgggauuaugacuaucgaucuggacccugugauauaugauucaaaauuugaaaagcagcucggacaggucauguugcuggugcuaugugcuguucagcugcuccuuaugcggaccuccugggcccugugcgaggcauugacacuggcuacgggccccauuaccacucucugggaagguaguccaggcaaauucuggaauacaaccaucgccgugagcauggccaacauuuuucgcgggucguaccuggcgggagcuggcuuagcauucucuaucaugaaguccguagggacuggaaaaagaggcacagguagccaaggggagacccuuggagaaaaguggaagaaaaagcugaaucagcucucaaggaaagaguuugaccuauauaagaaaaguggcauaacggagguggaucggaccgaagccaaggagggucugaaacgaggcgaaaucacacaucacgcugucucuagaggguccgccaaguugcagugguucguugagcgcaacauggugauucccgaaggaagggucaucgaccugggcugugggcggggaggcuggagcuacuauugcgcaggucucaagaaagugacugagguacguggguacaccaagggaggcccuggccaugaggaaccggugcccaugucaacauacggguggaauauuguuaaacuuaugaguggaaaggauguguucuaucugccaccugagaaaugugacacuuugcugugcgauaucggugaaagcucccccucuccuaccgucgaggagagcagaacaauuagggugcucaagauggucgaaccaugguuaaagaacaaucaguuuuguaucaaagugcugaaccccuacaugccuaccguuauagagcaccuugaacgccugcaacggaagcacggcgggaugcuaguacgaaauccacucuccagaaacucaacucaugagauguauuggauuucuaauggaacgggcaacaucguggccagugucaauauggugucgaggcuguugcugaaccgcuucacaaugacccaccggagacccacuaucgaaaaagacguugaucucggugcugggacccgucaugugaacgcggagccggagacaccuaauauggacgucauuggagaaaggauaaagcggaucaaagaggaacacaacagcacguggcacuacgacgaugagaauccauauaagaccugggccuaccauggcuccuaugaagugaaggcaacuggcucugcuucaagcaugauuaacgggguagugaaacuucugacaaagcccugggacguugucccuauggugacccagauggccaugacugauacaaccccauuuggacagcaacgcguguucaaagagaaggucgacacacgaacucccagauccaugccggguaccaggcggguuaugggcaucacggcagagugguuauggcgcacccuggggagaaauaaaaagccuagguugugcacacgagaagaguuuacuaagaaagugcggaccaacgccgcuaugggagccguauucacagaagagaaucagugggauagugcgaaggcagccguggaagacgaggauuuuuggaaacucgucgaccgugagagagaacugcacaagcuaggcaaaugugguucuugcguguacaacaugauggggaagcgcgagaagaaacuuggagaguucggcaaagcuaaaggcagcagggccauuugguacauguggcugggggcacgguaucucgaguuugaggcucugggauucuugaaugaagaucauugguuuucaagagagaacuccuacagugguguugaaggcgaggggcugcacaagcucggauauauccuucgcgacauaagcaaaauccccggcggugccauguacgcugaugacacugccgggugggacaccaggauuacggaagaugaccugcauaaugaggagaagaucacacagcagauggauccagaacaccgacaauuagcaaacgcgauuuucaaacugaccuaucagaauaagguggucaaggugcagcggccuacucccacaggaaccguaauggacaucauaucuagaaaagaucagaggggcuccggccaaguugggacuuacggauugaacaccuuuacaaauauggaggcccagcucauucgccagauggaaggugagggcgugcugucaaaggcugaccuagaaaacccacaccuucccgagaaaaagaucacgcaguggcuggagaccaaaggggucgaacgucucaagcggauggccaucagcggagaugacugcguggugaagccuauugaugacagauucgcaaacgcucuguuggccuuaaaugauaugggcaaagucaggaaggacauaccacaauggcagccgucgaaagguuggcaugauuggcagcagguucccuucuguucucaccauuuucacgagcugaucaugaaggacgggcgcaaacucgugguaccuugccgaccacaagacgaacuuauuggacgggcaagaaucagucagggcgccggcuggucccugagggagacugcgugucuagggaaggcuuaugcccagauguggagccugauguacuuccaccgcagagaucuccgguuggcaucaaacgccauuugcuccgcugugcccguccauugggugccuacaucuaggaccacuuggagcauccacgcccaucaccaauggaugacaaccgaagacaugcugacgguuuggaaucguguguggauagaggauaacccauggauggaggacaagacacccgucaccacuugggaaaaugugccuuaccuuggaaaacgagaggaucaguggugugguagucugaucggccucaccucccgcgcaacaugggcucagaacauuccgacugccauccagcaaguaaggagcuuaauugggaaugaagaguuucuggacuauaugccaucuaugaagcgguucaggaaagaggaagagucagaaggagcgaucugguga

SEQ ID NO: 15183 - RNA, 9873 nt, Artificial Sequence
  derived and/or modified CDS sequence (opt3) from DENV-3__GQ868574__SS-prME
accagccugugccucaugaugauccuucccgcagcucuggcauuccacuugacauccagggacggcgagccuaggaugauuguggggaagaacgaacggggaaagucuuuacuguuuaagacugcaucagguauaaauauguguacgcuaaucgcgauggaucucggcgaaaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccagacguggauguccgccgagggggcuuggaggcaggucgaaaaaguggagacuugggcauugcggcacccuggauucaccauucucgcccuguuucuggcucauuacaucggcacaucucucacucagaaggccguuauauucaucuuacugaugcuugugaccccaucgaugacaaugcgcugugucggcguggggaacagagacuuuguagaaggauugucaggugcgaccuggguugaugugguccuggagcacggcgggugcgugacgacuauggcaaagaauaaacccacacuagacauugagcuccagaagaccgaagccacucaacuggcuacacuuaggaaacuguguaucgagggaaagauuaccaacaucacgaccgauagccggugcccuacacagggcgaagccguguugccagaggaacaggaccagaauuaugucuguaaacacacuuacguugaucgcgguugggggaacggaugcggccucuucggcaaggggagucuggugaccugcgcaaaguuucaauguuuagagcccauagagggaaaaguagugcaguaugaaaaucugaaguacacagucauuaucacugugcauaccggugaccagcaccagguuggcaacgagacacaaggggugaccgcugaaauuacuccucaggccuccacgacagaggcgauccucccagaauauggaacccuuggccuggagugcucuccgcgaacugguuuggacuucaaugagaugauccuacugaccaugaaaaacaaggccuggaugguccauagacagugguuuuucgaucucccccugccuuggacaagcggggcaaccacugaaacaccaacguggaauaggaaagagcuucuggugaccuuuaagaacgcucacgccaaaaagcaagaaguaguuguguugggcucccaggagggagcuaugcacacugcccucacaggcgcaaccgaaauucaaaauucagggggaacaaguauauucgccggucaucugaagugucgguuaaaaauggacaagcuggagcuaaaaggcaugagcuacgcuaugugcacuaacaccuuuguccucaagaaagaggugucugaaacgcagcacgggaccauccugauuaaggucgaguacaagggagaagaugugcccuguaaaaucccuuucuccacagaggacggccaagguaaggcgcauaacgggcgucuuauaacugcaaauccaguugugaccaaaaaggaggaacccguaaacauugaggccgaaccgccuuucggcgagucaaauaucgucaucggaauuggcgauaacgcuuugaaaaucaauugguauaagaaggggagcaguauuggaaaaauguuugaagccacagcacgcggugccagaaggauggcuauacugggcgacacugccugggauuucgggucugugggaggcguucucaacucccuggguaagauggugcaccagaucuuugggagcgcauacaccgcgcuuuucucgggcgucucuugggugaugaaaauuggaaucggcguacuguugacguggaucgggcucaauuccaagaacacaucaaugaguuuuagcugcauugcuauaggaaucauuacccuguauuuaggcgccgugguucaggcagacauggguugugucaucaauuggaaagggaaggagcugaagugcggauccggcauuuucgugacuaacgaggugcauacauggaccgaacaguacaaauuucaagccgauucucccaagcggcuagcuacugccaucgccggugcuugggagaauggcgucugugggauacgaagcaccacacgcauggaaaaccuccuguggaaacagaucgccaaugagcuuaacuauauuuugugggaaaauaacaucaagcugacgguuguggugggagacauuaucggcguacucgagcaggggaaaagaacccugacuccacagccuauggaguuaaaguacucauggaaaacauggggaaaggcgaagauagucaccgccgaaacacaaaacaguuccuucauuaucgauggccccaauacuccagagugccccagcgcuucuagggcauggaacgugugggaaguugaggacuaugguuuugggguguucaccacgaauauuuggcugaaacuucgggaagucuacacacaguugugugaccaccgccucaugucagccgcugugaaggaugagagagccguucacgcagacaugggauacuggaucgagagucagaaaaacggcagcuggaagcuggaaaaagcgucccuaauagaggugaagaccugcacuuggccuaagucucauacccuguggucgaaugguguacucgaaagcgauaugaucauuccaaaaucccuggccggcccgaucucacagcacaacuauaggcccggguaccauacacaaacugcuggaccuuggcaccuuggcaaguuggagcuggacuuuaguuauugcgaggggaccacagucgugauuacggaaaauuguggaacccguggcccaucuuuacggacuacaaccgugagcgguaaacucauccacgaguggugcugucgauccugcacucugcccccucuuagauacaugggggaagauggauguugguauggcauggagauaaggccaauuucagaaaaggaggagaacauggucaaaagccugguuucugccgguuccggcgaaguggacaauuucacaauggggguauugugccucgcaauccuguuugaggaagugaugcgcggaaaguucggcaagaaacauaugaucgcuggggucuucuuuaccuucgugcuacugcucaguggacagauuacguggcgggauauggcccacacucugaucaugauuggcagcaacgcaucugacagaauggguauggggguuaccuaccuugccuugauagcuacauuuaagauccagcccuuccuggcguuaggauuuuuccucaggaaacugaccucccgcgagaaucuucugcuaggcgugggccucgccauggcaacuacacugcaauugccggaagauauugagcagauggcuaacgggaucgcccugggauuaauggcccucaagcugauuacccaguuugagacauaucagcuuuggacugcucugaucucauugaccuguaguaauacgauauucacacucaccgucgcauggcgaacugccacccugauccuagcgggugugagccugcuuccuguuugccaaucguccucuaugcggaaaacagacuggcucccaaugacuguggcugccaugggcgucccaccucugcccuuguuuauuuucagccugaaggauaccuuaaagcguagaucauggccacucaacgaagggguaauggcagugggacugguuaguauccuugccuccucucuguugaggaaugacgugccuauggcuggcccccucgucgccggugggcugcuaauugccuguuacgugaucacgggaacaagcgcggaucugaccguagagaaagcugccgacgugacuugggaagaggaagcagagcagacaggcgucucccauaaccuuaugauaaccguugacgaugacggcacuaugcgcauuaaggaugacgagacagaaaacauccucaccgugcuguugaaaacggccuuacugaucgugucagggauuuuuccauacagcauaccggcuacucuccuggucuggcacaccuggcagaagcagacacaacggaguggagugcuuugggauguuccuucucccccagagacccagaaagccgaacuggaggaggguguauauagaaucaagcagcagggcauuuucgggaaaacacaagugggagucggcgugcagaaggaagguguuuuucauacuauguggcacgugaccagaggggcagucuugacguacaauggaaagcgacuagagcccaacugggcuuccgugaaaaaggaccugaucagcuauggcggcggguggcgccucucggcccaguggcaaaaaggagaagagguacaggucauugcgguggaaccugguaagaaucccaagaacuuccagacaaugcccggcacuuuccagaccacaaccggggagaucggagccauagcacuggauuuuaagccuggcacuucagguucuccgaucauuaaucgggaggggaagguugugggacuuuacggcaacggcgucgugaccaaaaaugggggauauguuagugguaucgcucaaacaaacgccgaaccagacggccccacgccugaguuagaagaggaaauguucaagaaaagaaaucugacuauuauggaucuccacccaggguccggaaagaccaggaaauacuugcccgcuaucgugcgugaggcaauaaagcgccggcugagaacacucauucuggccccuaccagggucguggccgcugagauggaagaggcgcuuaagggccugccgauccgauaucagacuacagcaaccaaaagcgaacauacgggucgggagaucguagacuugaugugccacgccacuuuuacaaugcgccuacugucucccgugagaguuccaaacuacaaucucauuaucauggaugaagcucauuucaccgacccugccagcauagcagccaggggguacauuuccacccgggucggaaugggcgaggcugcggccaucuuuaugacugcaacacccccaggcaccgcugaugccuucccucagucaaacgcacccauucaggacgaggaacgagacaucccagagagaaguuggaauagcgggaacgaauggauaacagauuuugccggaaagacugugugguucgugccgucuauuaaagcugguaaugacaucgccaacuguuuacgcaagaacggcaaaaaggucauccaacuguccaggaagacguuugauaccgaguaucagaaaacaaaacuuaaugacugggauuucguagugacuaccgacauuucagagaugggggcgaacuuuaaagcagaucguguuaucgacccucggagaugccugaagcccgugauucucacagauggaccagaaagggucauauuggccggccccaugccugugaccgcugccagugcugcacagcgccgagguagaguugggcggaauccacagaaagagaacgaccaauacaucuucacuggccagccccugaauaacgaugaagaccacgcccauuggacggaggcuaagaugcuccuggacaauauuaacaccccugaaggaaucaucccggcccuuuucgagccagagagggaaaagagcgcagcgauugauggcgaguaucgccuaaaaggggaaucccguaagacauuuguggagcugaugagacggggagacuugcccgucugguuagcccacaaaguggcuucugaagguauaaaguacacugauaggaaauggugcuucgacggccagcgcaauaaccagauccuggaggagaauauggauguagaaauuuggaccaaggagggggagaagaagaagcuccgaccuagauggcuggacgcccggacauauucggauccccuugcacugaaagaguuuaaggacuucgcugccggaaggaaaagcaucgcacucgauuuggugaccgaaauuggccgcguuccaacucaccuggcccauagaacaaggaacgcucuagacaaucuggucaugcuccacacgucagagcauggugggaaggcguaccggcacgccguggaggaacuuccugagaccauggaaacucuguuauugcugggccucaugauccugcuuacaggaggcgcaaugcuguuucucauauccgggaaaggaaucgguaagaccaguauuggcuugaucugugugauugcuucuagcgggaugcuguggauggccgagauccccuuacaauggauagccuccgcaauuguccuagaguucuuuaugaugguucugcucaucccagaaccugagaagcagcguaccccgcaggauaaccaacuugcuuaugugguaauuggaauccugacauuggccgcgauaaucgcugccaaugaaaugggcaugcuggagacuacgaaacgcgaccucgguaugucaaaggaacccgggguggcaucuccaaccagcuaccuggaugucgaccuucacccugccagugcuuggacacucuacgcaguggccacuaccguuauuacacccaugcugcgacauaccaucgagaacuccacugcgaaugugagcuuggcugccauugcaaaccaggccgucguacugaugggcuuagacaaaggauggccaaucucuaagauggaucuaggcgugccucugcucgcucuugggugcuauucacagguuaacccccugacguugacagccgcagugcugcuccugauaacccacuacgcuauuaucggaccgggccuucaggccaaagcgacuagagaggcccaaaagaggaccgcagcugguaucaugaagaauccaacagucgacgggauuaugacuaucgauuuagacccugugauauaugauuccaaauucgaaaagcagcugggacaggucaugcucuuggugcugugugccguucagcuacugcucaugcggaccaguugggcacuuugcgaggcucugacauuggccacgggccccauuaccacucugugggaagguagcccaggcaaauuuuggaacacaaccaucgccgugucgauggcgaauauuuuccgcgggucuuaccucgcuggagcaggccuggccuuuuccaucaugaaaagcguagggacuggaaaaagaggcacagguucacaaggggagaccuuaggagaaaaguggaagaagaaacuuaaccagcugaguaggaaagaguucgaccucuauaagaaaucuggcauaacggagguggaucggaccgaagcuaaagagggucuaaaacgaggcgaaaucacacaucacgccgucuccagagggagcgcaaagcugcagugguuuguugagcgcaauauggugauucccgaaggaagggucaucgacuugggcugugggcggggaggcuggucauacuauugcgccggucugaagaaagugacugagguacguggguacaccaagggaggcccuggccaugaggaaccggugcccaugaguacauacggguggaacauuguuaaacucaugagcggaaaggauguguucuaucuuccaccugagaaaugugacacucuguugugcgauaucggugaauccucucccagcccuaccgucgaggaguccagaacaauuagggugcugaagauggucgaaccauggcucaagaauaaccaguucuguaucaaaguguuaaaucccuacaugccuaccguuauagagcaccuggaacgccuucaacggaagcacggcgggaugcugguacgaaacccacuaucaagaaauucuacucaugagauguauuggauuaguaacggaacgggcaauaucguggcuucggucaacauggugagcaggcuccuguugaaucgcuuuacaaugacccaccggagacccacuaucgaaaaagacguugaucugggugcggggacccgucaugugaacgccgagccggagacaccuaacauggacgucauuggagaaaggauaaagcggaucaaagaggaacacaauuccacguggcacuacgacgaugagaacccauauaagaccugggcauaccauggcucuuaugaagugaaggcuacuggcucagccagcuccaugauuaaugggguagugaaacuccuuacaaagcccugggacguugucccuauggugacccagauggcaaugacugauacaaccccauucggacagcaacgcguguuuaaagagaaggucgacacacgaacucccagaaguaugccggguaccaggcggguuaugggcaucacggccgaguggcuguggcgcaccuuagggagaaacaaaaagccuaggcugugcacacgagaagaguucacuaagaaagugcggaccaaugcugccaugggagcgguauuuacagaagagaaccagugggauucugcaaaggccgcuguggaagacgaggauuucuggaaauuggucgaccgugagagagaacuccacaagcugggcaaaugugguagcugcguguacaauaugauggggaagcgcgagaaaaagcuaggagaauuuggcaaggccaaaggcucaagggcaauuugguacauguggcuuggggcucgguaucuggaguucgaggcccucggauuucugaacgaagaucauugguucuccagagagaauaguuacagcgguguugaaggcgagggguugcacaagcugggauauauccuccgcgacauaucuaaaauccccggcggugcuauguacgccgaugacacugcagggugggacaccaggauuacggaagaugaccuucauaacgaggagaagaucacacagcagauggauccagaacaccgacaacuggcgaaugccauuuuuaaauuaaccuaucagaacaagguggucaaggugcagcggccuacucccacaggaaccguaauggacaucauauccagaaaagaucagaggggcucaggccaaguugggacuuacggacugaauaccuucacaaacauggaggcucaguugauucgccagauggaaggugagggcgugcucagcaaggccgaccuggaaaauccacaccuacccgagaaaaagaucacgcaguggcuugagaccaaaggggucgaacgucugaagcggauggcaaucucgggagaugacugcguggugaagccuauugaugacagauuugcuaacgcccuccuggcauugaacgauaugggcaaagucaggaaggacauaccacaauggcagccgucuaaagguuggcaugauuggcagcagguucccuucuguagucaccauuuccacgaguuaaucaugaaggacgggcgcaaacuggugguaccuugccgaccacaagacgaacucauuggacgggccagaaucucccagggcgcgggcuggagccuuagggagacugcuugucuggggaaggccuaugcacagauguggucacuaauguacuuucaccgcagagaucugcggcucgccuccaaugcuauuugcucugccgugcccguccauugggugccuacaagcaggaccacuuggaguauccacgcacaucaccaauggaugacaaccgaagacauguugacgguuuggaaccguguguggauagaggauaauccauggauggaggacaagacacccgucaccacuugggaaaacgugccuuaccugggaaaacgagaggaucaguggugugguucccuuaucggccugaccagccgcgcuacaugggcccagaauauuccgacugcgauccagcaaguaagaucucucauugggaacgaagaguucuuagacuauaugccaucaaugaagcgguuuaggaaagaggaagagagugaaggagcuaucugguga

SEQ ID NO: 15184 - RNA, 9873 nt, Artificial Sequence
  derived and/or modified CDS sequence (opt3) from DENV-3__GQ868575__SS-prME
accagccugugccucaugaugauccuucccgcagcucuggcauuccacuugacauccagagacggcgagccuagaaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcgucgcccuugcaccccaugugggcaugggucuggauacaagaacccagacguggauguccgccgagggggcuuggaggcaggucgaaaaaguggagacuugggcauugcggcacccuggauucaccauucucgcccuguuucuggcucauuacaucggcacaucucucacucagaaggccguuauauucaucuuacugaugcuugugaccccaucgaugacaaugcgcugugucggcguggggaacagagacuuuguagaaggauugucaggugcgaccuggguugaugugguccuggagcacggcgggugcgugacgacuauggcaaagaauaaacccacacuagacauugagcuccagaagaccgaagccacucagcuggcuacacuuaggaaacuguguaucgagggaaagauuaccaacaucacgaccgauagccggugcccuacacagggcgaagccguguugccagaggaacaggaccagaauuaugucuguaaacacacuuacguugaucgcgguugggggaacggaugcggccucuucggcaaggggagucuggugaccugcgcaaaguuucaauguuuagagcccauagagggaaaaguagugcaguaugaaaaucugaaguacacagucauuaucacugugcauaccggugaccagcaccagguuggcaacgagacacaaggggugaccgcugaaauuacuccucaggccuccacgacagaggcgauccucccagaauauggaacccuuggccuggagugcucuccgcgaacugguuuggacuucaaugagaugauccuacugaccaugaaaaacaaggccuggaugguccauagacagugguuuuucgaucucccccugccuuggacaagcggggcaaccacugaaacaccaacguggaauaggaaagagcuucuggugaccuuuaagaacgcucacgccaaaaagcaagaaguaguuguguugggcucccaggagggagcuaugcacacugcccucacaggcgcaaccgaaauucaaaauucagggggaacaaguauauucgccggucaucugaagugucgguuaaaaauggacaagcuggagcuaaaaggcaugagcuacgcuaugugcacuaacaccuuuguccucaagaaagaggugucugaaacgcagcacgggaccauccugauuaaggucgaguacaagggagaagaugugcccuguaaaaucccuuucuccacagaggacggccaagguaaggcgcauaacgggcgucuuauaacugcaaauccaguugugaccaaaaaggaggaacccguaaacauugaggccgaaccgccuuucggcgagucaaauaucgucaucggaauuggcgauaacgcuuugaaaaucaauugguauaagaaggggagcaguauuggaaaaauguuugaagccacagcacgcggugccagaaggauggcuauacugggcgacacugccugggauuucgggucugugggaggcguucucaacucccuggguaagauggugcaccagaucuuugggagcgcauacaccgcgcuuuucucgggcgucucuugggugaugaaaauuggaaucggcguacuguugacguggaucgggcucaauuccaagaacacaucaaugaguuuuagcugcauugcuauaggaaucauuacccuguauuuaggcgccgugguucaggcagacauggguugugucaucaauuggaaagggaaggagcugaagugcggauccggcauuuucgugacuaacgaggugcauacauggaccgaacaguacaaauuucaagccgauucucccaagcggcuagcuacugccaucgccggugcuugggagaauggcgucugugggauacgaagcaccacacgcauggaaaaccuccuguggaaacagaucgccaaugagcuuaacuauauuuugugggaaaauaacaucaagcugacgguuguggugggagacauuaucggcguacucgagcaggggaaaagaacccugacuccacagccuauggaguuaaaguacucauggaaaacauggggaaaggcgaagauagucaccgccgaaacacaaaacuucaguuuuauuaucgauggccccaauacuccagagugccccuccgcuagcagggcauggaacgugugggaaguugaggacuaugguuucgggguguuuaccacgaauauuuggcugaaacuucgggaagucuacacacaguugugugaccaccgccucaugucugccgcugugaaggaugagagagccguucacgcagacaugggauacuggaucgagucacagaaaaacggcaguuggaagcuggaaaaagcgagccuaauagaggugaagaccugcacuuggccuaagucccauacccuguggucuaaugguguacucgaaucggauaugaucauuccaaaaagccuggccggcccgaucucccagcacaacuauaggcccggguaccauacacaaacugcuggaccuuggcaccuuggcaaguuggagcuggacuucaauuauugcgaggggaccacagucgugauuacggaaaacuguggaacccguggcccaucauuacggacuacaaccgugagugguaaacucauccacgaguggugcugucgaucuugcacucugcccccucuuagauacaugggggaagauggauguugguauggcauggagauaaggccaauuagcgaaaaggaggagaauauggucaaaucccugguuucagccgguagcggcgaaguggacaacuuuacaauggggguauugugccucgcaauccuguucgaggaagugaugcgcggaaaguucggcaagaaacauaugaucgcuggggucuuuuucaccuuugugcuacugcucucuggacagauuacguggcgggauauggcccacacucugaucaugauuggcuccaaugcaagugacaagauggguauggggguuaccuaccuugccuugauagcuacauucaaaauccagcccuuucuggcguuaggauucuuucucagaaagcugaccagcagggagaaccuucugcuaggcgugggccucgccauggcaacuacacugcaauugccggaagauauugagcagauggcuaaugggaucgcccugggauuaauggcccucaaacugauuacccaguucgagacauaucagcuuuggacugcucugaucucuuugaccuguuccaacacgauauuuacacucaccgucgcauggcgcacugccacccugauccuagcgggugugucacugcuuccuguuugccaaaguagcucgaugcgaaagacagacuggcucccaaugacuguggcugccaugggcguacccccucugcccuuguucauuuuugggcugaaggauaccuuaaaacggcguuccuggccacucaaugaaggaguaauggcagugggccugguuucuauccuugccagcucacuguugagaaacgacgugccuauggcugguccccucgucgcagggggacugcuaauugccuguuacgugaucacgggcacaagugcggaucugaccguagagaaggcugccgacgugacuugggaagaggaagcagagcagacaggcgucucccauaaccuuaugauaaccguugacgaugacgggacuaugaggauuaaagaugacgagacagaaaauauccucaccgugcuguugaagacggccuuacugaucgugucuggaauuuucccauacagcauaccggcuacucuccuggucuggcacaccuggcagaaacagacacaacgcuccggugugcuuugggauguuccuucacccccagagacccagaaggccgaacuggaggagggcguauaucggaucaaacagcaggggauuuuuggaaagacacaagugggcgucggugugcagaaggaagggguuuuccauacuauguggcacgugaccagaggagcagucuugacguacaacggcaaaaggcuagagcccaauugggcuagcgugaagaaagaccugaucaguuauggcgggggauggcgacucucugcccaguggcaaaagggugaagagguacaggucauugcgguggaaccuggcaaaaacccaaagaauuuccagacaaugcccgggacuuuucagaccacaaccggagagaucggcgccauagcacuggauuucaagccugguacuuccgggagcccgaucauuaaccgcgagggaaaaguugugggccuuuacggcaauggggucgugaccaagaacggagguuauguuucgggcaucgcucaaacaaaugccgaaccagacgggcccacgccugaguuagaagaggaaauguuuaaaaagcggaaccugacuauuauggaucuccacccaggaucaggcaaaaccagaaaguacuugcccgcuaucgugagggaggcaauaaagcgucgccugcggacacucauucuggccccuaccagagucguggccgcugagauggaagaggcgcuuaaaggucugccgaucagguaucagacuacagcaaccaagucugaacauacggggcgagagaucguagacuugaugugccacgccacuuucacaaugcggcuacugagucccgugcgcguuccaaauuacaaccucauuaucauggaugaagcucauuuuaccgacccugccuccauagcagccagaggauacauuagcaccagggucggcaugggcgaggcugcggccaucuucaugacugcaacacccccagggaccgcugaugccuuuccucagucuaaugcacccauucaggacgaggaacgggacaucccagagcgaagcuggaacuccggaaaugaauggauaacagauuucgccgguaaaacugugugguuugugccgucaauuaaggcuggcaacgacaucgccaacuguuuaaggaagaaugggaagaaggucauccaacugagucgcaaaacguucgauaccgaguaucagaagacaaaacuuaacgacugggauuuuguagugacuaccgacauuagcgagaugggagcgaauuucaaggcagauaggguuaucgacccucgucggugccugaaacccgugauucucacagauggcccagaaagagucauauuggccggucccaugccugugaccgcugccucugcugcacagaggcgcgggcgaguuggcagaaacccacagaaggagaaugaccaauacaucuucacuggacagccccugaacaaugaugaagaccacgcccauuggacggaggcuaagaugcuccuggacaacauuaauaccccugaaggcaucaucccggcccuuuuugagccagagcgggaaaaauccgcagcgauugauggggaguauaggcuaaagggagaaucacgcaaaacauucguggagcugaugcguagaggugacuugcccgucugguuagcccacaagguggcuagugaaggcauaaaauacacugaucggaaguggugcuuugacgggcagaggaacaaucagauccuggaggagaacauggauguagaaauuuggaccaaagagggagaaaagaagaaacuccgcccucgauggcuggacgccagaacauauagcgauccccuugcacugaaggaguucaaagacuuugcugccggccggaaguccaucgcacucgauuuggugaccgaaauugguaggguuccaacucaccuggcccaucgcacaagaaaugcucuagacaaccuggucaugcuccacacgucugagcaugggggcaaagcguacaggcacgccguggaggaacuuccugagaccauggaaacucuguuauugcugggacucaugauccugcuuacaggcggggcaaugcuguuccucauaucgggaaaggguaucggcaagaccagcauuggguugaucugugugauugcuucauccggaaugcuguggauggccgagauccccuuacaauggauagccagugcaauuguccuagaguuuuucaugaugguucugcucaucccagaaccugagaaacagcggaccccgcaggauaaucaacuugcuuaugugguaauuggcauccugacauuggccgcgauaaucgcugccaacgaaaugggucugcucgagacuacgaagcgugaccuggggaugucucgcgaacccggcguggucagcccaaccuccuaccuugauguggaccuccacccugcaucagccuggacacuguacgcuguugcaacuaccgugauuacacccauguugcgacauaccaucgaaaauucuacugccaacgucagccuggcggcuauugccaaccaggcaguaguguuaaugggacuagacaaaggcuggccaaucaguaagauggaucuggggguuccucuccuugcccugggaugcuauucccaggugaaucccuugacgcugacagcugccguccuccugcuuauaacccacuacgcaauuaucggcccggguuuacaggcuaaagccacuagagaggcgcaaaagaggaccgccgcagggaucaugaagaacccaacaguggacggaauuaugacuaucgaucuggacccugucauauaugauagcaaauuugaaaagcagcucggccaggugauguugcugguucuaugugcugugcagcugcuccuuaugcggaccucuugggcccugugcgaggcauugacacuggcuacgggucccauuaccacucucugggaaggcucaccagggaaauucuggaauacaaccaucgccguauccauggccaacauuuuucgcggaaguuaccuggcgggcgcuggguuagcauucagcaucaugaagucggugggaacuggcaaaagagguacagggucucaaggagagacccuuggcgaaaaguggaagaaaaagcugaaucagcucuccaggaaagaguuugaccuauauaagaaaagcgguauaacggaggucgaucggaccgaagccaaggagggccugaaacgaggggaaaucacacaucacgcuguuucaagaggaagugccaaguugcagugguucguggagcgcaacauggucauucccgaaggcagggugaucgaccugggguguggacggggcgguuggucuuacuauugcgcagggcucaagaaaguaacugaggugcguggauacaccaagggcggcccugggcaugaggaaccgguucccauguccacauacggauggaauauugugaaacuuaugagcgguaaggaugucuucuaucugccaccugagaaaugugacacuuugcugugcgauaucggcgaaucaagucccagcccuaccguggaggaguccagaacaauuaggguccucaagaugguggaaccaugguuaaagaacaaucaguuuuguaucaaaguucugaaccccuacaugccuaccguaauagagcaccuugaacgccugcaacggaagcacgggggaaugcuagugcgaaauccacucucuagaaacagcacucaugagauguauuggauuuccaauggcacggguaacaucgucgccucagugaauaugguuucuaggcuguugcugaaccgcuucacaaugacccaccggagacccacuaucgaaaaagacguggaucucggggcuggaacccgucaugucaacgcggagccggagauuccuaauauggacgugauaggcgaaaggaucaagcggauuaaagaggaacacaacaguacauggcacuacgacgaugagaauccauauaagacgugggccuaccauggcucguaugaaguaaaggcaaccgggagcgcuuccucuaugaucaacggagugguuaaacuucugacuaagcccugggacgucgugccuauggugacacagauggccaugaccgauacuacaccauuuggucagcaacgcgucuucaaagagaagguugacacccgaacacccagaucaaugccgggcacuaggcgggugauggggauuaccgcagagugguuauggcgcacgcugggaagaaauaaaaagccuagguugugcacccgagaagaguuuacaaagaaaguacggacuaacgccgcuaugggcgccguguucaccgaagagaaucagugggauagcgcgaaggcagccgucgaagacgaggauuuuuggaaacucguggaccgugagagagaacugcacaagcuagguaaauguggguccugcguuuacaacaugaugggaaagcgcgagaagaaacuuggcgaguucggcaaagcuaaagggaguagggccaucugguacauguggcugggagcacgguaucucgaguuugaggcucuggguuucuugaaugaagaucauugguuuucuagagagaacagcuacucaggcguggaaggggagggacugcacaagcucggcuauauacuucgcgacaucuccaaaauucccgguggggccauguacgcugaugacacagccggaugggacacuaggaucaccgaagaugaccugcauaaugaggagaagauuacgcagcagauggauccagaacaccgacaauuagcaaacgcgaucuucaaacugacauaucagaauaaggucgugaagguacagcggccuacccccacuggcacaguuauggacauaauuaguagaaaagaucagaggggcagcgggcaagugggaaccuacgguuugaacacuuuuaccaauauggaggcccagcucauccgccagauggaaggcgaggggguccugucuaaggcugaccuagaaaacccacaccuucccgagaaaaagaucacacaguggcuggagacgaaaggaguggaacgucucaagcggauggccauuuccggcgaugacugcguggucaagccuauagaugacagauucgcaaacgcucuguuggccuuaaaugauauggguaaaguuaggaaggacaucccacaauggcagccgucaaaaggguggcaugauuggcaacaggugcccuucuguagccaccauuuucacgagcugauuaugaaggacggacgcaaacucguagugccuugccgaccacaagacgaacuuaucggccgggcaagaauuucgcagggcgccggguggucucugagggagaccgcgugucuaggaaaggcuuaugcccagauguggagucugauguacuuccaccgcagagaucuccgguuggcauccaacgccaucugcagcgcuguccccgugcauuggguuccuacuucaaggacaaccugguccauacacgcccaucaccaauggaugacuacagaagacaugcugaccguguggaaucgugucuggaucgaggauaacccauggauggaggacaagacgcccgugacaaccugggaaaauguaccuuaccuugguaaacgagaggaucagugguguggcucucugauugggcucacuagccgcgcaaccugggcucagaacaucccgacagccauucagcaaguuagaaguuuaaucggaaaugaagaguuucuggacuauaugccauccaugaagcgguucaggaaagaggaagagagcgaaggcgcgauuugguga

SEQ ID NO: 15185 - RNA, 9873 nt, Artificial Sequence
  derived and/or modified CDS sequence (opt3) from DENV-3__GU131953__SS-prME
accagccugugccucaugaugauccuucccgcagcucuggcauuccacuugacaucccgggacggcgaaccuaggaugauuguggggaagaacgaacggggaaaaucuuuacuguuuaagacugccucagguauaaauauguguacgcuaaucgcgauggaucucggcgaaaugugcgacgauaccgucacauacaaauguccacauauuacugaaguugaaccggaagacaucgauugcugguguaaccugaccaguacaugggugaccuaugggacuugcaaucaggcuggagagcaccgccgagacaagcguagcguagcccuugcaccccaugugggcaugggucuggauacaagaacccagacguggauguccgccgagggggcuuggaggcaggucgaaaaaguggagacuugggcauugcggcacccuggauucaccauucucgcccuguuucuggcucauuacaucggcacaucucucacucagaaggccguuauauucaucuuacugaugcuugugaccccaucgaugacaaugcgcugugucggcguggggaaccgggacuuuguagaaggauugucaggugcgaccuggguugaugugguccuggagcacggcgggugcgugacgacuauggcaaagaauaaacccacacuagacauugagcuccagaagaccgaagccacucagcuggcuacacuuaggaaacuguguaucgagggaaagauuaccaacaucacgaccgauagccggugcccuacacagggcgaagccguguugccagaggaacaggaccagaauuaugucuguaaacacacuuacguugaucgcgguugggggaacggaugcggccucuucggcaaggggagucuggugaccugcgcaaaguuucaauguuuagagcccauagagggaaaaguagugcaguaugaaaaucugaaguacacagucauuaucacugugcauaccggugaccagcaccagguuggcaacgagacacaaggggugaccgcugaaauuacuccucaggccuccacgacagaggcgauccucccagaauauggaacccuuggccuggagugcucuccgcgaacugguuuggacuucaaugagaugauccuacugaccaugaaaaacaaggccuggaugguccauagacagugguuuuucgaucucccccugccuuggacaagcggggcaaccacugaaacaccaacguggaauaggaaagagcuucuggugaccuuuaagaacgcucacgccaaaaagcaagaaguaguuguguugggcucccaggagggagcuaugcacacugcccucacaggcgcaaccgaaauucaaaauucagggggaacaaguauauucgccggucaucugaagugucgguuaaaaauggacaagcuggagcuaaaaggcaugagcuacgcuaugugcacuaacaccuuuguccucaagaaagaggugucugaaacgcagcacgggaccauccugauuaaggucgaguacaagggagaagaugugcccuguaaaaucccuuucuccacagaggacggccaagguaaggcgcauaacgggcgucuuauaacugcaaauccaguugugaccaaaaaggaggaacccguaaacauugaggccgaaccgccuuucggcgagucaaauaucgucaucggaauuggcgauaacgcuuugaaaaucaauugguauaagaaggggagcaguauuggaaaaauguuugaagccacagcacgcggugccagaaggauggcuauacugggcgacacugccugggauuucgggucugugggaggcguucucaacucccuggguaagauggugcaccagaucuuugggagcgcauacaccgcgcuuuucucgggcgucucuugggugaugaaaauuggaaucggcguacuguugacguggaucgggcucaauuccaagaacacaucaaugaguuuuagcugcauugcuauaggaaucauuacccuguauuuaggcgccgugguucaggcagacauggguugugucaucaauuggaaagggaaggagcugaagugcggauccggcauuuucgugacuaacgaggugcauacauggaccgaacaguacaaauuucaagccgauucucccaagcggcuagcuacugccaucgccggugcuugggagaauggcgucugugggauacgaagcaccacacgcauggaaaaccuccuguggaaacagaucgccaaugagcuuaacuauauuuugugggaaaauaacaucaagcugacgguuguggugggagacauuaucggcguacucgagcaggggaaaagaacccugacuccacagccuauggaguuaaaguacucauggaaaacauggggaaaggcgaagauagucaccgccgaaacacaaaacaguuccuucauuaucgauggccccaauacuccagagugccccagcgcuucuagggcauggaacgugugggaaguugaggacuaugguuuugggguguucaccacgaauauuuggcugaaacuucgggaagucuacacacaguugugugaccaccgccucaugucagccgcugugaaggaugagagagccguucacgcagacaugggauacuggaucgagagucagaaaaacggcagcuggaagcuggaaaaagcgucccuaauagaggugaagaccugcacuuggccuaagucucauacccuguggucgaaugccguacucgaaagcgauaugaucauuccaaaaucccuggcugguccgaucucacagcacaacuauaggcccggcuaccauacacaaacugccgggccuuggcaccuuggaaaguuggagcuggacuuuaauuauugcgagggcaccacagucgugauuacggaaaacugugggacccguggaccaaguuuacggacuacaaccgugucuggcaaacucauccacgaguggugcugucgaagcugcacucugcccccucuuagauacaugggugaagauggguguugguauggaauggagauaaggccaauuuccgaaaaggaggagaauauggucaaaucacugguuagcgcaggcucuggugaaguggacaacuucacaaugggcguauugugccucgcuauccuguuugaggaagugaugcgcgggaaguucggaaagaaacauaugaucgccggcgucuucuuuaccuucgugcuacugcucuccgggcagauuacguggcgggauauggcacacacucugaucaugauuggaaguaaugccagcgacagaaugggcauggguguuaccuaccuugcuuugauagcgacauuuaagauccagcccuuccuggccuuaggguuuuuccucaggaaacugaccucucgcgagaaccuucugcuaggagugggccucgcaauggcuacuacacugcaauugccggaagauauugagcagauggccaauggcaucgcccugggguuaauggcucucaagcugauuacccaguuugagacauaucagcuuuggacugcacugaucuccuugaccuguucaaacacgauauucacacucaccgucgccuggcgaacugcgacccugauccuagcuggagugagucugcuuccuguuugccaaagcucguccaugcggaaaacagacuggcucccaaugacuguggccgcaaugggugucccaccucugcccuuguuuauuuucucucugaaggauaccuuaaagcguagaagcuggccacucaaugaaggcguaauggccguggggcugguuucaauccuugcuaguucccuguugaggaacgacgugccuauggcaggaccccucgucgccggcggucugcuaauugcguguuacgugaucacggggacaucugcugaucugaccguagagaaagccgcagacgugacuugggaagaggaagccgagcagacaggagucagccauaaccuuaugauaaccguugacgaugacggcacuaugcgcauuaaggaugacgagacagaaaauauccucaccgugcuguugaaaacggcuuuacugaucguguccggcauuuuuccauacucaauaccggccacucuccuggucuggcacaccuggcagaagcagacacaacggagcggggugcuuugggauguuccuagucccccagagacccagaaagcagaacuggaggagggaguauauagaaucaagcagcaggguauuuucggcaaaacacaagugggggucggagugcagaaggaaggcguuuuucauacuauguggcacgugaccaggggugcugucuugacguacaacgggaagcgacuagagcccaauugggccucugugaaaaaggaccugaucuccuauggaggcggcuggcgccucagcgcgcaguggcaaaaaggggaagagguacaggucauugccguggaaccuggaaagaaccccaagaauuuccagacaaugcccgguacuuuccagaccacaaccggcgagaucggggcaauagcucuggauuuuaagccuggaacuucgggcucaccgaucauuaaccgggaggguaagguuguggggcuuuacggaaauggcgucgugaccaaaaacggcggguauguuucuggaaucgcccaaacaaaugcugaaccagacggucccacgccugaguuagaagaggaaauguucaagaaaagaaaccugacuauuauggaucuccacccaggcagugggaagaccaggaaauacuugcccgcaaucgugcgugaggccauaaagcgccggcugagaacacucauucuggccccuaccagggucguggcugcggagauggaagaggcacuuaagggacugccgauccgauaucagacuacagccaccaaauccgaacauacgggccgggagaucguagacuugaugugccacgcuacuuuuacaaugcgccuacugagccccgugagaguuccaaauuacaaccucauuaucauggaugaagcccauuucaccgacccugcaucuauagccgcuagggguuacauuagcacccgggucgggaugggagaggcggccgcaaucuuuaugacugcuacacccccaggcaccgccgaugcauucccucaguccaaugcccccauucaggacgaggaacgagacaucccagagagaucauggaacaguggcaaugaauggauaacagauuuugcugggaagacugugugguucgugccgagcauuaaagccggaaacgacaucgcgaacuguuuacgcaagaaugguaaaaaggucauccaacugucuaggaagacguuugauaccgaguaucagaaaacaaaacuuaacgacugggauuucguagugacuaccgacauuuccgagaugggcgcaaauuuuaaagccgaucguguuaucgacccucggagaugccugaagcccgugauucucacagaugggccagaaagggucauauuggcuggacccaugccugugaccgccgcuucagcagcccagcgccgaggcagaguuggucggaacccacagaaagagaaugaccaauacaucuucacugggcagccccugaacaaugaugaagaccacgcucauuggacggaggccaagaugcuccuggacaacauuaauaccccugaaggcaucaucccggcacuuuucgagccagagagggaaaagagugcggccauugauggagaguaucgccuaaaaggcgaaagccguaagacauuuguggagcugaugagaagaggggacuugcccgucugguuagcucacaaaguggccuccgaaggaauaaaguacacugauaggaaauggugcuucgacggucagcgcaacaaucagauccuggaggagaacauggauguagaaauuuggaccaaggagggcgagaagaagaagcuccgaccuagauggcuggacgcacggacauauucugauccccuugcucugaaagaguuuaaggacuucgccgcagggaggaaaucgaucgcccucgauuuggugaccgaaauuggacgcguuccaacucaccuggcucauagaacaaggaaugcgcuagacaaccuggucaugcuccacacgagcgagcauggcgguaaggccuaccggcacgcaguggaggaacuuccugagaccauggaaacucuguuauugcuggggcucaugauccugcuuacaggcggagcuaugcuguuucucauaucaggcaaagggaucggaaagaccuccauugguuugaucugugugauugccaguucuggcaugcuguggauggccgagauccccuuacaauggauagcaagcgcuauuguccuagaguucuuuaugaugguucugcucaucccagaaccugagaagcagcguaccccgcaggauaaucaacuugccuaugugguaauugggauccugacauuggcggcuauaaucgccgcaaacgaaaugggacugcucgagacuacgaaacgcgaccugggcauguccaaggaacccgguguggucucaccaaccucuuaccuugauguggaccuccacccugccagcgcuuggacacuguacgcaguugccacuaccgugauuacacccauguugcgacauaccaucgagaauaguacugcgaacgucucccuggcugccauugcaaaccaggccguaguguuaauggggcuagacaaaggcuggccaaucagcaagauggaucugggaguuccucuccuugcucugggcugcuauucucaggugaaucccuugacgcugacagccgcaguccuccugcuuauaacccacuacgcuauuaucgggccgggauuacaggccaaagcgacuagagaggcccaaaagaggaccgcagcuggcaucaugaagaacccaacaguggacgguauuaugacuaucgaucuggacccugucauauaugauucaaaauucgaaaagcagcucggacaggugauguugcugguucuaugugccgugcagcugcuccuuaugcggaccuccugggcacugugcgaggcuuugacacuggccacgggacccauuaccacucucugggaaggcaguccagguaaauuuuggaauacaaccaucgccguaagcauggcgaacauuuuccgcggcucguaccuggcuggggcaggauuagccuuuucuaucaugaaguccgugggcacugggaaaagaggaacaggcagccaaggugagacccuuggggaaaaguggaagaaaaagcugaaucagcucucaaggaaagaguucgaccuauauaagaaaaguggaauaacggaggucgaucggaccgaagcuaaggagggccugaaacgaggugaaaucacacaucacgccguuucuagaggcuccgcaaaguugcagugguuuguggagcgcaacauggucauucccgaagggagggugaucgaccugggauguggcagaggcggguggagcuacuauugcgccgggcucaagaaaguaacugaggugcgugguuacaccaaagggggaccuggccaugaggaaccgguucccaugucaacauacggcuggaauauugugaaacuuaugagugggaaggaugucuucuaucugccaccugagaaaugugacacuuugcugugcgauaucggagaaagcucccccucuccuaccguggaggagagcagaacaauuaggguccucaagaugguggaaccaugguuaaagaacaaucaguucuguaucaaaguucugaaccccuacaugccuaccguaauagagcaccuugaacgccugcaacggaagcacgguggcaugcuagugcgaaauccacucuccagaaacucaacucaugagauguauuggauuucuaaugggacgggaaacaucgucgcuagugugaauaugguuucgaggcuguugcugaaccgcuuuacaaugacccaccggagacccacuaucgaaaaagacguggaucucggcgcggguacccgucaugucaacgccgagccggagacaccuaauauggacgugauuggggaaaggauaaagcggaucaaagaggaacacaacagcacguggcacuacgacgaugagaauccauauaagaccugggcauaccauggauccuaugaaguaaaggcuacuggcucugccucaagcaugauuaacggcgugguuaaacuucugacaaagcccugggacgucgugccuauggugacccagauggcaaugacugauacaaccccauucgggcagcaacgcgucuuuaaagagaagguugacacacgaacucccagauccaugccgggaaccaggcgggugauggagaucacggccgaaugguuauggcgcacccuggguagaaauaaaaagccuagguugugcacacgagaggaguucacuaagaaaguacggaccaacgcugccaugggcgcgguguuuacagaggaaaaucagugggauagugcaaaggccgcugucgaggacgaggauuucuggaaacucguggaccgugaaagagagcugcacaagcuagggaaauguggaucuugcguuuacaacaugaugggcaagcgcgagaagaaacuuggugaguuugggaaggccaaaggaagcagggcaauuugguacauguggcugggcgcucgguaucucgaguucgaagcccugggcuuuuugaaugaggaucauugguucucaagagaaaacuccuacagugggguggagggagaaggucugcacaagcucggcuauauccuucgcgacauaagcaaaauccccgggggagcuauguacgccgaugacacugcaggcugggacaccaggauuacggaggaugaccugcauaaugaggaaaagaucacacagcagauggauccagagcaccgauuacuggcgaacgccauuuuuaaauugaccuaucaaaauaaggucgugaagguacagcggccuacucccacagguaccguuauggacaucauaucuagaaaagaucagaggggguccggacaggugggcacuuacggccucaacaccuucacaaauauggaagcucaacugauucgccagauggagggggaaggaguccuaucaaaggccgaccuugagaacccacaccugagcgagaaaaaggugacgcaguggcucgaaaccaaagguguggagcgucugaagcggauggcaaucucgggcgaugacugcgucguuaagcccaucgaugacagauuugcuaacgccuuguuagcacugaaugauauggggaaagugaggaaggacauuccucaguggcaaccaucuaaaggauggcaugauuggcagcagguaccguucuguagucaccauuuccacgaacucauaaugaaggacggccgcaaacuugugguccccugccgaccucaggacgagcugaucggucgggccagaauuucccaaggggcgggauggagccuaagggaaacugcuugucugggcaaggccuaugcacagauguggucacucauguacuuucaccgcagagauuugcggcuggccuccaacgcuaucugcucugccgugccaguucauugggugcccacaagcaggaccacuuggaguauucacgcacaucaccaguggaugacaaccgaggacaugcuuacggucuggaaucguguguggaucgaggauaacccuuggauggaagacaagacaccaguaaccacuugggagaauguucccuaccugggcaaacgagaagaucaauggugugggucccucauaggauuaaccagccgcgcuacaugggcccagaacaucccuacugcgauucaacaggugagaucucugaucgguaaugaggaguucuuggacuauaugccgucaaugaagcgguuuaggaaagaagaggaaagugagggcgcuauuugguga

SEQ ID NO: 15186 - RNA, 9873 nt, Artificial Sequence
  derived and/or modified CDS sequence (opt3) from DENV-3__GQ868577__SS-prME
accagccugugccucaugaugauccuuccagccgcucuggcauuccacuugacauccagagacggcgagccuaggaugauuguggggaagaacgaacggggaaaaucuuuacuguuuaagacugccucagguauaaauauguguacgcuaaucgcgauggaucucggcgaaaugugcgacgauaccguaacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccagacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucagcuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucaaaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagauguucccuguaaaaucccuuucuccacagaggacggccaagguaaggcucauaacgggcgucuuauaacugcgaauccagugguaaccaaaaaggaggaacccgucaacauugaggcagaaccgccuuucggcgagucaaauaucgugaucggaauuggcgauaacgccuugaaaaucaauugguauaagaaggggagcaguauuggaaaaauguuugaagcuacagcccgcggugcaagaaggauggccauacugggcgacacugcuugggauuucgggucuguuggaggcgugcucaacucccuggguaagaugguccaccagaucuuugggagcgccuacaccgcacuuuucucgggcgugucuuggguaaugaaaauuggaaucggcgugcuguugacguggaucgggcucaauuccaagaacacaucaaugaguuuuagcugcauugcgauaggaaucauuacccuguauuuaggcgcuguuguccaggccgacauggguugugugaucaauuggaaagggaaggagcugaagugcggauccggcauuuucgugacuaacgagguccauacauggaccgaacaguacaaauuucaagcagauucucccaagcggcuagccacugcuaucgccggugcaugggagaauggcguuugugggauacgaagcaccacacgcauggaaaaccuccuguggaaacagaucgcuaaugagcuuaacuauauuuugugggaaaauaacaucaagcugacgguggugguaggagacauuaucggcguccucgagcaggggaaaagaacccugacuccacagccuauggaguuaaaguacucauggaaaacauggggaaaggccaagauagugaccgcggaaacacaaaacaguuccuucauuaucgauggccccaauacuccagagugccccagcgccucuagggcuuggaacguuugggaaguggaggacuaugguuuuggggucuucaccacgaauauuuggcugaaacuucgggaaguguacacacaguugugugaccaccgccucaugucagcagccguuaaggaugagagagcugugcacgccgacaugggauacuggaucgagagucagaaaaacggcagcuggaagcuggaaaaagcaucccuaauagagguaaagaccugcacuuggccuaagucucauacccuguggucgaaugguguccucgaaagcgauaugaucauuccaaaaucccuggcgggcccgaucucacagcacaacuauaggcccggguaccauacacaaacugccggaccuuggcaccuuggcaaguuggagcuggacuuuaauuauugcgaggggaccacaguggugauuacggaaaacuguggaacccguggcccaaguuuacggacuacaaccgucucugguaaacucauccacgaguggugcugucgaagcugcacucugcccccucuuagauacaugggggaagauggauguugguauggcauggagauaaggccaauuuccgaaaaggaggagaauaugguuaaaucacuggugagcgcugguucuggcgaaguagacaacuucacaauggggguguugugccucgccauccuguuugaggaagucaugcgcggaaaguucggcaagaaacauaugaucgcagggguguucuuuaccuucguucuacugcucuccggacagauuacguggcgggauauggcucacacucugaucaugauuggcaguaaugccagcgacagaauggguaugggggugaccuaccuugcauugauagccacauuuaagauccagcccuuccuggcuuuaggauuuuuccucaggaaacugaccucucgcgagaaccuucugcuaggcgucggccucgcgauggccacuacacugcaauugccggaagauauugagcagauggcaaaugggaucgcucugggauuaauggcccucaagcugauuacccaguuugagacauaucagcuuuggacugcccugaucuccuugaccuguucaaacacgauauucacacucaccguggcuuggcgaacugcaacccugauccuagccgguguuagucugcuuccugugugccaaagcucguccaugcggaaaacagacuggcucccaaugacugucgcggcuaugggcguacccccucugcccuuguuuauuuucucucugaaggauaccuuaaagcguagaagcuggccacucaaugaaggggugauggccguuggacuggugucaauccuugcaaguucccuguugaggaacgacgucccuauggccggcccccucguggcuggugggcugcuaauugcauguuacguaaucacgggaacaucugccgaucugaccguggagaaagcggcugacgucacuugggaagaggaagccgagcagacaggcguuagccauaaccuuaugauaaccguggacgaugacggcacuaugcgcauuaaggaugacgagacagaaaauauccucaccgugcuguugaaaacggcauuacugaucgucuccgggauuuuuccauacucaauaccggccacucuccugguguggcacaccuggcagaagcagacacaacggagcggaguucuuugggauguaccuagucccccagagacccagaaagcugaacuggaggaggguguguauagaaucaagcagcagggcauuuucgggaaaacacaagucggagugggcguucagaaggaagguguguuucauacuauguggcacgucaccagaggggccguguugacguacaacggaaagcgacuagagcccaauugggcaucugucaagaaggaccugaucuccuauggcggcggguggcgccucagcgcucaguggcaaaaaggagaagagguccaggugauugccguugaaccugguaagaaccccaagaauuuccagacaaugcccggcacuuuccagaccacaaccggggagaucggagcgauagcccuggauuuuaagccuggcacuucggguucaccgaucauuaaccgggaggggaagaucgugggacuuuacggcaauggcgucgugaccaaaaacgggggauauguuucugguauugcacaaacaaaugcugaaccagacggccccacgccugaguuagaagaggaaauguucaagaaaagaaaccugacuaucauggaucuccacccagggaguggaaagaccaggaaauacuugcccgccauagugcgugaggcuauuaagcgccggcugagaacacucauccuggcaccuaccagggucguggccgccgagauggaagaggcucuuaagggccugccgauccgauaucagacuacagcgaccaaauccgaacauacgggucgggagauuguagacuugaugugccacgcaacuuuuacaaugcgccuacugagccccgugagaguuccaaauuacaaccucaucauaauggaugaagcccauuucaccgacccugcuucuauugccgcaaggggguacaucagcacccgggucggaaugggcgaggccgcugcgauuuuuaugacugccacacccccaggcaccgcagaugcuuucccucaguccaaugcccccauccaggacgaggaacgagacauaccagagagaucauggaacagugggaaugaauggauuacagauuuugcaggaaagacugugugguucgugccgagcaucaaagccgguaacgacaucgcuaacuguuuacgcaagaauggcaaaaaggucauucaacugucuaggaagacguuugauaccgaguaucagaaaacaaaacuuaacgacugggauuucguagugacuaccgacaucuccgagaugggggccaauuuuaaagcggaucguguuauugacccucggagaugccugaagcccgugauacucacagauggaccagaaagggucaucuuggcaggccccaugccugugaccgccgcuucagccgcucagcgccgagguagaguugggcggaacccacagaaagagaaugaccaauacauuuucacuggccagccccugaacaaugaugaagaccacgcacauuggacggaggccaagaugcuccuggacaacaucaauaccccugaaggaaucauuccggcucuuuucgagccagagagggaaaagagugccgcaauagauggcgaguaucgccuaaaaggggaaagccguaagacauuuguggagcugaugagacggggagacuugcccgucugguuagcguacaaaguggccuccgaagguaucaaguauacugauaggaaauggugcuucgacggccagcgcaacaaucagauucuggaggagaacauggauguagaaaucuggaccaaggagggggagaaaaagaagcuccgaccuagauggcuggacgcucggacauacucugauccccuugcccugaaagaguuuaaggacuucgcagcuggaaggaaaucgauugcccucgauuuggugaccgaaaucggccgcguuccaacucaccuggcacacagaacaaggaaugcccuagacaaccuggucaugcuccauacgagcgagcacggugggaaggcuuaucggcaugcgguggaggaacuuccugagaccauggaaacucuguuauugcugggccucaugauacugcuuacaggaggcgccaugcuguuucucaucucagggaaaggaauugguaagaccuccaucggcuugauuugugugaucgcaaguucugggaugcuguggauggcugagauacccuuacaauggauugccagcgccaucguccuagaguucuuuaugaugguucugcucauuccagaaccugagaagcagcguaccccgcaggauaaucaacuugcauacgugguaaucggaauacugacauuggcugccaucauugcggcuaacgaaaugggccugcucgagacuacgaaacgcgaccuggguauguccaaggaacccgggguggucucaccaaccucuuaccuugauguggaccuccacccugccagcgcauggacacuguaugccguugcuacuaccgugaucacacccauguugcgacacaccauugagaauaguacugcaaacgucucccuggccgcgaucgcuaaccaggccguaguguuaaugggccuagacaaaggauggccaauaagcaagauggaucugggcguuccucuccuugcacuggggugcuacucucaggugaaucccuugacgcugacagccgcuguccuccugcuuauuacccauuaugccaucaucggaccgggcuuacaggcaaaagcuacuagagaggcccaaaagaggaccgcggccgguauuaugaagaacccaacaguggacgggaucaugacuauagaucuggacccugucauuuacgauucaaaauucgaaaagcagcucggacaggugauguugcugguucuaugugcagugcagcugcuccuuaugcggaccuccugggcucugugcgaggccuugacacuggcaacgggccccaucaccacucucugggaagguaguccaggcaaauuuuggaauacaaccauugcuguaagcauggccaacaucuuccgcgggucguaucuggccggagcgggcuuagcuuuuucuauaaugaaguccguggggacuggaaaaagaggcacagguagccaaggggagacccuuggagaaaaguggaagaaaaagcugaaucagcucucaaggaaagaguucgaccuauacaagaaaaguggcaucacggaggucgaucggaccgaagcaaaggagggucugaaacgaggcgaaauuacacaccaugccguuucuagaggguccgcuaaguugcagugguuuguggagcgcaacauggucauccccgaaggaagggugauugaccugggcugugggcggggaggcuggagcuauuacugcgccggucucaagaaaguaacugaggugcguggguacaccaagggaggcccuggccacgaggaaccgguucccaugucaacauauggguggaauaucgugaaacuuaugaguggaaaggaugucuucuaccugccaccugagaaaugugacacuuugcugugcgauauuggugaaagcucccccucuccuaccguggaggagagcagaacaaucaggguccucaagaugguggaaccaugguuaaagaacaaucaguucuguauaaaaguucugaaccccuauaugccuaccguaauugagcaucuugaacgccugcaacggaagcacggcgggaugcuagugcgaaauccacucuccagaaacucaacucacgagauguacuggaucucuaauggaacgggcaacaucgucgcaagugugaauaugguuucgaggcuguugcugaaccgcuuuacaaugacccaucggagacccacuauugaaaaagacguggaucucggugccgggacccgucacgucaacgcugagccggagacaccuaauauggacgugauaggagaaaggaucaagcggauuaaagaggaacauaacagcacguggcacuaugacgaugagaauccauacaagaccugggcguaucacggcuccuacgaaguaaaggccacuggcucugcaucaagcaugaucaacggggugguuaaacuucugacaaagcccugggacgucgugccuauggugacccagauggcuaugacugauacaaccccauucggacagcaacgcgucuuuaaagagaagguugacacacgaacucccagauccaugccggguaccaggcgggugaugggcauuacggccgagugguuauggcgcacccuggggagaaauaaaaagccuagguugugcacacgagaagaguucacuaagaaaguacggaccaacgcagccaugggagcuguguuuacagaagagaaucagugggauagugccaaggcggcagucgaagacgaggauuucuggaaacucguggaccgugagagagaacugcauaagcuaggcaaaugugguucuugcguuuacaacaugauggggaagcgcgagaagaaacuuggagaauuuggcaaagccaaaggcagcagggcuaucugguauauguggcugggggcccgguaccucgaguucgaggcacugggauuuuugaaugaagaucacugguucucaagagagaacuccuauagugguguggaaggcgaggggcugcauaagcucggauacauacuucgcgacaucagcaaaauucccggcggugcuauguaugccgaugacacugcugggugggacaccaggaucacggaagaugaccugcacaaugaggagaagauuacacagcagauggauccagaacaucgacaauuagccaacgcaaucuuuaaacugaccuaccagaauaaggucgugaagguacagcggccuacucccacaggaaccguuauggacauaauuucuagaaaagaucagaggggcuccggccaaguggggacuuauggauugaacaccuucacaaauauggaggcgcagcucauccgccagauggaaggugagggcguccugucaaaggccgaccuagaaaacccacaccuucccgagaaaaagaucgcucaguggcuggagacgaaagggguggaacgucucaagcggauggccauuagcggagaugacugcguggucaagccuauagaugacagauuugcaaacgcucuguuggccuuaaaugauaugggcaaaguuaggaaggacaucccacaauggcagccgucgaaagguuggcacgauuggcaacaggugcccuucuguucucaucacuuccaugagcugauuaugaaggacgggcgcaaacucguagugccuugccgaccacaagacgaacuuaucggacgggcaagaauuagucagggcgccggcuggucccugagggagaccgcgugucuagggaaggcuuacgcccagauguggagccugauguacuuucaccgcagagaucuccgguuggcaucaaacgccaucugcuccgcuguccccgugcacuggguuccuacuucuaggacaaccuggagcauacaugcccaccaucaauggaugacuacagaagacaugcugaccguguggaaucgugucuggaucgaggauaacccauggauggagaauaagacgcccgugacaaccugggaaaacguaccuuaucuuggaaaacgagaggaccaguggugugguagucugauuggccucacuucccgcgcaaccugggcucagaauaucccgacagccauucagcaaguuaggagcuuaaucgggaacgaagaguuccuggauuacaugccaucuaugaagcgguuuaggaaagaggaagagucagaaggagcgauuugguga

SEQ ID NO: 15187 - RNA, 9873 nt, Artificial Sequence
  derived and/or modified CDS sequence (opt3) from DENV-3__GU131954__SS-prME
accagccugugccucaugaugauccuuccagccgcucuggcauuccacuugacauccagggacggcgagccuaggaugauuguggggaagaacgaacggggaaaaucuuuacuguuuaagacugccucagguauaaauauguguacgcuaaucgcgauggaucucggcgaaaugugcgacgauaccguaacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccagacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucagcuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucaaaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagauguucccuguaaaaucccuuucuccacagaggacggccaagguaaggcucauaacgggcgucuuauaacugcgaauccagugguaaccaaaaaggaggaacccgucaacauugaggcagaaccgccuuucggcgagucaaauaucgugaucggaauuggcgauaacgccuugaaaaucaauugguauaagaaggggagcaguauuggaaaaauguuugaagcuacagcccgcggugcaagaaggauggccauacugggcgacacugcuugggauuucgggucuguuggaggcgugcucaacucccuggguaagaugguccaccagaucuuugggagcgccuacaccgcacuuuucucgggcgugucuuggguaaugaaaauuggaaucggcgugcuguugacguggaucgggcucaauuccaagaacacaucaaugaguuuuagcugcauugcgauaggaaucauuacccuguauuuaggcgcuguuguccaggccgacauggguugugugaucaauuggaaagggaaggagcugaagugcggauccggcauuuucgugacuaacgagguccauacauggaccgaacaguacaaauuucaagcagauucucccaagcggcuagccacugcuaucgccggugcaugggagaauggcguuugugggauacgaagcaccacacgcauggaaaaccuccuguggaaacagaucgcuaaugagcuuaacuauauuuugugggaaaauaacaucaagcugacgguggugguaggagacauuaucggcguccucgagcaggggaaaagaacccugacuccacagccuauggaguuaaaguacucauggaaaacauggggaaaggccaagauagugaccgcggaaacacaaaacaguuccuucauuaucgauggccccaauacuccagagugccccagcgccucuagggcuuggaacguuugggaaguggaggacuaugguuuuggggucuucaccacgaauauuuggcugaaacuucgggaaguguacacacaguugugugaccaccgccucaugucagcagccguuaaggaugagagagcugugcacgccgacaugggauacuggaucgagagucagaaaaacggcagcuggaagcuggaaaaagcaucccuaauagagguaaagaccugcacuuggccuaagucucauacccuguggucgaaugguguccucgaaagcgauaugaucauuccaaaaucccuggcgggcccgaucucacagcacaacuauaggcccggguaccauacacaaacugccggaccuuggcaccuuggcaaguuggagcuggacuuuaauuauugcgaggggaccacaguggugauuacggaaaacuguggaacccguggcccaaguuuacggacuacaaccgucucugguaaacucauccacgaguggugcugucgaagcugcacucugcccccucuuagauacaugggggaagauggauguugguauggcauggagauaaggccaauuuccgaaaaggaggagaauaugguuaaaucacuggugagcgcugguucuggcgaaguagacaacuucacaauggggguguugugccucgccauccuguuugaggaagucaugcgcggaaaguucggcaagaaacauaugaucgcagggguguucuuuaccuucguucuacugcucuccggacagauuacguggcgggauauggcucacacucugaucaugauuggcaguaaugccagcgacagaauggguaugggggugaccuaccuugcauugauagccacauuuaagauccagcccuuccuggcuuuaggauuuuuccucaggaaacugaccucucgcgagaaccuucugcuaggcgucggccucgcgauggccacuacacugcaauugccggaagauauugagcagauggcaaaugggaucgcucugggauuaauggcccucaagcugauuacccaguuugagacauaucagcuuuggacugcccugaucuccuugaccuguucaaacacgauauucacacucaccguggcuuggcgaacugcaacccugauccuagccgguguuagucugcuuccugugugccaaagcucguccaugcggaaaacagacuggcucccaaugacugucgcggcuaugggcguacccccucugcccuuguuuauuuucucucugaaggauaccuuaaagcguagaagcuggccacucaaugaaggggugauggccguuggacuggugucaauccuugcaaguucccuguugaggaacgacgucccuauggccggcccccucguggcuggugggcugcuaauugcauguuacguaaucacgggaacaucugccgaucugaccguggagaaagcggcugacgucacuugggaagaggaagccgagcagacaggcguuagccauaaccuuaugauaaccguggacgaugacggcacuaugcgcauuaaggaugacgagacagaaaauauccucaccgugcuguugaaaacggcauuacugaucgucuccgggauuuuuccauacucaauaccggccacucuccugguguggcacaccuggcagaagcagacacaacggagcggaguucuuugggauguaccuagucccccagagacccagaaagcugaacuggaggaggguguguauagaaucaagcagcagggcauuuucgggaaaacacaagucggagugggcguucagaaggaagguguguuucauacuauguggcacgucaccagaggggccguguugacguacaacggaaagcgacuagagcccaauugggcaucugucaagaaggaccugaucuccuauggcggcggguggcgccucagcgcucaguggcaaaaaggagaagagguccaggugauugccguugaaccugguaagaaccccaagaauuuccagacaaugcccggcacuuuccagaccacaaccggggagaucggagcgauagcccuggauuuuaagccuggcacuucggguucaccgaucauuaaccgggaggggaagguggucggacuuuacggcaauggcgugguuaccaaaaacgggggauaugugucugguaucgcacaaacaaaugcugaaccagacggccccacgccugaguuagaagaggaaauguucaagaaaagaaaccugacuauuauggaucuccacccagggaguggaaagaccaggaaauacuugcccgccaucguccgugaggcuauaaagcgccggcugagaacacucauucuggcaccuaccagggugguagccgccgagauggaagaggcucuuaagggccugccgauccgauaucagacuacagcgaccaaauccgaacauacgggucgggagaucguggacuugaugugccacgcaacuuuuacaaugcgccuacugagccccguuagagucccaaauuacaaccucauuaucauggaugaagcccauuucaccgacccugcuucuauagccgcaaggggguacauuagcacccgggugggaaugggcgaggccgcugcgaucuuuaugacugccacacccccaggcaccgcagaugcuuucccucaguccaaugcccccauucaggacgaggaacgagacaucccagagagaucauggaacagugggaaugaauggauaacagauuuugcaggaaagacugugugguucgucccgagcauuaaagccgguaacgacaucgcuaacuguuuacgcaagaauggcaaaaagguaauccaacugucuaggaagacguuugauaccgaguaucagaaaacaaaacuuaacgacugggauuucgugguuacuaccgacauuuccgagaugggggccaauuuuaaagcggaucgugugaucgacccucggagaugccugaagcccgucauucucacagauggaccagaaagggugauauuggcaggccccaugccuguuaccgccgcuucagccgcucagcgccgagguagaguggggcggaacccacagaaagagaaugaccaauacaucuucacuggccagccccugaacaaugaugaagaccacgcacauuggacggaggccaagaugcuccuggacaacauuaauaccccugaaggaaucaucccggcucuuuucgagccagagagggaaaagagugccgcaauugauggcgaguaucgccuaaaaggggaaagccguaagacauuugucgagcugaugagacggggagacuugcccgugugguuagcguacaaaguagccuccgaagguauaaaguauacugauaggaaauggugcuucgacggccagcgcaacaaucagauccuggaggagaacauggauguggaaauuuggaccaaggagggggagaaaaagaagcuccgaccuagauggcuggacgcucggacauacucugauccccuugcccugaaagaguuuaaggacuucgcagcuggaaggaaaucgaucgcccucgauuugguuaccgaaauuggccgcgucccaacucaccuggcacacagaacaaggaaugcccuagacaaccuggugaugcuccauacgagcgagcacggugggaaggcuuaucggcaugcgguggaggaacuuccugagaccauggaaacucuguuauugcugggccucaugauccugcuuacaggaggcgucaugcuguuucucauaucagggaaaggaaucgguaagaccuccauuggcuugaucuguguuauugccaguucugggaugcuguggauggcagagauccccuuacaauggauagcuagcgccauugugcuagaguucuuuaugaugguacugcucaucccagaaccugagaagcagcguaccccgcaggauaaucaacuugccuacguggucauuggaauccugacauuggcagcuauaaucgccgcgaacgaaaugggccugcucgagacuacgaaacgcgaccuggguaugaccaaggaacccggggcuguguccccaacaucauaccuugauguugaccuccacccugccucugcauggacucuguaugccguggcuaccacagucauuacccccauguugcgacacacuaucgagaauagcacggcaaacguaagucuggccgcgauugcuaaccaggccgugguuuuaaugggccuagacaaaggauggccaaucuccaagauggaucugggcgugccucuccuugcacuggggugcuacagccaggucaaucccuugacacugaccgccgcugugcuccugcuuauaacucauuaugccauuaucggaccgggcuuacaggcaaaagcuaccagagaggcccaaaagaggacagcggccgguaucaugaagaacccaacugucgacgggauuaugaccaucgaucuggacccugugauauacgauucuaaauucgaaaagcagcucggacagguuauguugcuggugcuaugugcaguacagcugcuccuuaugcggacaucaugggcucugugcgaggccuugacgcuggcaaccggccccauuacuacacucugggaagguuccccaggcaaauuuuggaauaccacuaucgcugugaguauggccaacauuuuccgcgggagcuaucuggccggagcgggcuuagcuuuuucgaucaugaagucugucgggacaggaaaaagaggcaccgguucccaaggggagacgcuuggagaaaaguggaagaaaaagcugaaucagcucagcaggaaagaguucgaccuauacaagaaaucaggcauaaccgagguugaucggacagaagcaaaggagggucugaaacgaggcgaaaucacucaccaugccgugaguagagggucugcuaaguugcagugguuugucgagcgcaacauggugauucccgaaggaaggguaaucgaccugggcugugggcggggaggcugguccuauuacugcgccggucucaagaaagugaccgagguucguggguacacaaagggaggcccuggccacgaggaaccggugcccaugagcacuuauggguggaauauugucaaacuuaugucaggaaaggauguguucuaccugccaccugagaaaugugacaccuugcugugcgauaucggugaaaguagccccuccccuacagucgaggagucuagaaccauuagggugcucaagaugguugaaccaugguuaaagaacaaucaguucuguaucaaaguacugaaccccuauaugccuacugugauagagcaucuugaacgccugcaacggaagcacggcgggaugcuaguccgaaauccacucagcagaaacuccacgcacgagauguacuggauuucaaauggaacaggcaacaucguggcaucuguuaauauggugaguaggcuguugcugaaccgcuuuaccaugacucaucggagacccaccaucgaaaaagacgucgaucucggugccgggacacgucacgugaacgcugagccggagacgccuaauauggacguaauuggagaaaggauaaagcggaucaaagaggaacauaacucgaccuggcacuaugacgaugagaauccauacaagacuugggcguaucacggcagcuacgaagugaaggccacaggcuccgcaucuucaaugauuaacgggguugucaaacuucugaccaagcccugggacguggugccuauggucacucagauggcuaugacagauaccacaccauucggacagcaacgcguuuuuaaagagaagguggacacucgaacccccagaagcaugccggguacgaggcggguaaugggcaucaccgccgagugguuauggcgcacacuggggagaaauaaaaagccuagguugugcacucgagaagaguucaccaagaaagugcggacaaacgcagccaugggagcugucuuuacugaagagaaucagugggauuccgccaaggcggcaguggaagacgaggauuucuggaaacucguugaccgugagagagaacugcauaagcuaggcaaaugugguaguugcguguacaacaugauggggaagcgcgagaagaaacuuggagaauuuggcaaagccaaaggcucuagggcuauuugguauauguggcugggggcccgguaccucgaguucgaggcacugggauuuuugaaugaagaucacugguucagcagagagaacucauauuccggugucgaaggcgaggggcugcauaagcucggauacauccuucgcgacauaaguaaaauccccggcggugcuauguaugccgaugacaccgcugggugggacacgaggauuacagaagaugaccugcacaaugaggagaagaucacccagcagauggauccagaacaucgacaauuagccaacgcaauuuuuaaacugacuuaccagaauaaggugguaaagguucagcggccuacacccaccggaacugugauggacaucauaagcagaaaagaucagaggggcucuggccaagucgggaccuauggauugaacacauucacgaauauggaggcgcagcucauucgccagauggaaggugagggcgugcuguccaaggccgaccuagaaaacccacaccuucccgagaaaaaggugacccaguggcuggagacuaaaggggucgaacgucucaagcggauggcuaucucaggagaugacugcguugugaagccuaucgaugacagauuugccaacgcacuguuggcuuuaaaugauaugggcaaaguaaggaaggacauuccacaauggcagccgagcaaagguuggcacgauuggcaacaggugcccuucuguucgcaucacuuccaugagcugauaaugaaggacgggcgcaaacucgucgugccuugccgaccacaagacgaacuuaucggacgggccagaauuucucagggcgcaggcuggagucugagggagacagccugucuagggaaggcguacgcucagauguggucccugauguacuuucaccgcagagaucuccgguuggccagcaacgcaaucugcucagccguucccgugcacugggucccuaccuccaggacuacauggucuauucaugcucaccaucaauggaugaccacggaagacaugcugacaguguggaaucguguauggaucgaggauaacccauggauggaggacaagacccccguuacuaccugggaaaaugugccuuaucuuggaaaacgagaggaucaguggugugguagccugauaggccucacaagucgcgccacuugggcacagaacaucccgaccgcuauucagcaagucagauccuuaaucgggaaugaagaguuccuggacuacaugccaagcaugaagcgguuuaggaaagaggaagagucugaaggagccauuugguga

SEQ ID NO: 15188 - RNA, 9873 nt, Artificial Sequence
  derived and/or modified CDS sequence (opt3) from DENV-3__GQ868578__SS-prME
accagccugugccucaugaugauccuucccgccgcucuggcauuccacuugacauccagggacggcgaaccuaggaugauuguggggaagaacgaacggggaaagucuuuacuguuuaagacugccucagguauaaauauguguacgcucaucgcgauggaucucggcgagaugugcgacgauaccgucacauacaaauguccacacauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccagacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagaguccauagagggaaaagugguccaguaugaaaaucugaaguacacagugauuaucacuguucauaccggugaccagcaccaggugggcaacgagacacaaggggucaccgcagaaauuacuccccaggcuucuacgacagaggccauccucccugaauauggaacccuuggccuggagugcagcccacgaacugguuuggacuucaaugagaugauccuacugaccaugaaaaacaaggcguggauggugcauagacagugguuuuucgaucucccgcugcccuggacauccggggccaccacugaaacaccuacguggaauaggaaagagcuucugguaaccuuuaagaacgcacacgcuaaaaagcaagaaguuguggucuugggcucacaggagggagccaugcacacugcucucacaggcgccaccgaaauucagaauagugggggaacaagcauauucgcaggucaucugaagugucgguuaaaaauggacaagcuggagcuaaaaggcaugucuuacgccaugugcacuaacaccuuugugcucaagaaagaggucuccgaaacgcagcacgggaccauccugauuaagguggaguacaagggagaagauguuccauguaaaauccccuucucaacagaggacggccaagguaaggcucauaacgggcgucuuauaacugcgaauccugugguaaccaaaaaggaggaaccagucaacauugaggcagaacccccguucggcgagagcaauaucgugaucggaauuggcgauaacgccuugaaaaucaauugguauaagaaggggaguucuauuggaaaaauguuugaagcuacagcccgcggugcaagaaggauggccauacugggcgacacugcuugggauuucggguccguuggaggcgugcucaacagccuggguaagaugguccaccagaucuuugggucggccuacaccgcacuuuucucuggcguguccuggguaaugaaaauuggaaucggcgugcuguugacguggaucgggcucaauucaaagaacacaaguaugagcuuuuccugcauugcgauaggaaucauuacccuguauuuaggcgcuguuguccaggccgacauggguugugugaucaauuggaaagggaaggagcugaagugcggaucuggcauuuucgugacuaacgagguccauacauggaccgaacaguacaaauuucaagcagauagcccuaagcggcuagccacugcuaucgccggugcaugggagaauggcguuugugggauacgaucaaccacacgcauggaaaaccuccuguggaaacagaucgcuaaugagcuuaacuauauuuugugggaaaauaacaucaagcugacgguggugguaggagacauuaucggcguccucgagcaggggaaaagaacccugacuccccagccaauggaguuaaaguacaguuggaaaacauggggaaaggccaagauagugaccgcggaaacacaaaacuccagcuucauuaucgauggcccuaauacucccgagugcccaucugccucaagggcuuggaacguuugggaaguggaggacuaugguuuuggggucuucaccacgaauauuuggcugaaacuucgggaaguguacacacaguugugugaccaccgccucaugagugcagccguuaaggaugagagagcugugcacgccgacaugggauacuggaucgagagccagaaaaacggcuccuggaagcuggaaaaagcaucucuaauagagguaaagaccugcaaguggcccaaaucgcauacucuguggagcaaugguguccucgaauccgauaugaucauuccuaagucacuggcgggcccaaucagucagcacaacuauaggccgggguaccauacccaaacagccggacccuggcaccuuggcaaauuggagcuggacuuuaauuauugcgaggggacuaccguggugauuacagaaaacuguggaacgcguggcccuucuuuacggaccacuacagucagcgguaagcucauccacgaguggugcugucgauccugcacccugccaccccuuagauacaugggggaagauggauguugguauggcauggagauaaggccuacuucagaaaaagaggagaauaugguuaagagccuggugucugcugguuccggcgaaguagacaacuucacaauggggguguugugccucgccauucuguuugaggaagucaugcgcggaaaguucggcaaaaagcauaugaucgcaggggugcuauucaccuuuguucugcuccugaguggacagaucacguggcgggauauggcucacacucuuauuaugaucggcagcaaugccucugacagaauggguaugggggugaccuacuuggcacugauugccacauucaaaauacagccauuuuuagcucucggauucuuucugaggaaacuuaccucccgcgagaaccugcuacucggcgucggccuggcgauggccacuacauugcaacugcccgaagauaucgagcagauggcaaaugggauugcuuuaggacucauggcccugaaacuuaucacccaguucgagacauaucagcuguggacugccuugauuucacucaccuguaguaacacgaucuuuacacugaccguggcuuggcgaacugcaacccuaauacuggccgguguuagccuucucccggugugccaaucguccucuaugcggaagacagacuggcugccuaugacugucgcggcuaugggcguaccacccuugccucuguucaucuuuagcuuaaaggauacccucaaacguagaucauggccccugaaugaaggggugauggccguuggacuugugaguauucuggcauccucuuugcucaggaacgacgucccaauggccggcccucugguggcuggugggcuacugaucgcauguuacguaauuacgggaacaagcgccgaucuuaccguggagaaggcggcugacgucacuugggaagaggaagccgagcagacaggcguuucccauaaccucaugaucaccguggacgaugacggcacuaugcgcauaaaagaugacgagacagaaaauauucugaccguguuguuaaagacggcacugcucaucgucucagggaucuuccccuacagcauuccagccacucugcuuguguggcacaccuggcagaaacagacacaacggaguggaguucugugggauguaccgucuccucccgagacccagaaggcugaauuggaggaggguguguauagaauaaaacagcagggcaucuuugggaagacacaagucggagugggcguucagaaggaagguguguuccauacuauguggcacgucaccagaggggccgugcuaacguacaacggaaaacgacuggagccaaauugggcauccguaaagaaagaccucauuagcuauggcggcggguggcgccugucggcucaguggcaaaagggagaagagguccaggugaucgccguugaacccgguaaaaacccuaagaauuuucagacaaugccaggcacuuuccagaccacaaccggggagauuggagcgaucgcccuugauuucaagcccggcacuucagguucuccuauaaucaaccgggaggggaaaauugugggauuauacggcaauggcgucgugaccaagaacgggggauauguuagugguaucgcacaaacaaaugcugaaccggacggcccaacgcccgagcuggaagaggaaauguuuaaaaagagaaaccucacuauuauggauuugcacccuggguccggaaaaaccaggaaguaccugccagccaucgugcgugaggcuauaaagcgccggcucagaacacugauucuugcacccaccagggucguggccgccgagauggaagaggcucugaaaggcuugccuauccgauaucagacuacagcgaccaagagcgaacauacgggucgggagaucguagaccuaaugugccacgcaacuuucacaaugcgccugcucucuccggugagaguucccaauuacaacuuaauuaucauggaugaagcccauuuuaccgacccagcuagcauagccgcaaggggguacauuuccacccgggucggaaugggcgaggccgcugcgaucuucaugacugccacaccucccggcaccgcagaugcuuuuccacagucaaaugccccuauucaggacgaggaacgagacauccccgagagaaguuggaacagcgggaaugaauggauaacagauuucgcaggaaaaacugugugguuugugccaucuauuaaggccgguaacgacaucgcuaacugucugcgcaaaaauggcaagaaggucauccaacuuuccaggaaaacguucgauaccgaguaucagaagacaaaacugaacgacugggauuuuguagugacuaccgacauuucagagaugggggccaauuucaaggcggaucguguuaucgacccgcggagaugccucaaaccugugauuuugacagauggacccgaaagggucauacuggcaggcccaaugcccgugaccgccgcuagugccgcucagcgccgagguagaguugggcggaacccucagaaggagaaugaccaauacaucuuuacuggccagccacucaacaaugaugaagaccacgcacauuggacggaggccaagaugcugcuugacaacauuaauacccccgaaggaaucaucccugcucuauucgagccggagagggaaaagagcgccgcaauugauggcgaguaucgccugaagggggagucccguaaaacauucguggaguugaugagacggggagacuuaccagucuggcuggcguacaagguggccucugaagguauaaaauauacugauaggaaguggugcuuugacggccagcgcaacaaucagauccucgaggagaacauggauguagaaauuuggaccaaagagggggaaaagaagaaacugcgacccagauggcuugacgcucggacauacucggauccucuggcccucaaggaguucaaagacuuugcagcuggaaggaaaagcaucgccuuggaucuggugaccgaaauuggccgcguucccacucaccuagcacacagaacaaggaaugcccuggacaaccucgucaugcuucauacgucagagcacggugggaaggcuuaucggcaugcgguggaggaacugccagagaccauggaaacuuuauugcugcucggccugaugauccuucugacaggaggcgccaugcuauucuugauauccgggaagggaaucgguaagaccaguauuggccugaucugugugauugcaucuagcgggauguuauggauggcugagaucccucuacaauggauagccuccgccauuguccuggaguuuuucaugaugguucuccuuauccccgaaccagagaaacagcguaccccucaggauaaucaacuggcauacgugguaauuggaaucuugacacuggcugccauaaucgcggcuaacgaaaugggccuccuggagacuacgaagcgcgaccuugguaugucaaaagaaccggggguggucucucccaccagcuaccucgauguggaccugcacccagccagugcauggacauuguaugccguugcuacuaccgugauuacaccuaugcugcgacacaccaucgaaaauuccacugcaaacgucagcuuagccgcgauugcuaaccaggccguagugcuaaugggccuggacaagggauggcccaucucuaaaauggaucucggcguuccacuucuggcauuggggugcuacucacaggugaauccucugacgcucacagccgcuguccugcuuuuaauaacccauuaugccauuaucggacccggccugcaggcaaaggcuacuagagaggcccaaaagaggaccgcggccgguaucaugaaaaacccgacaguggacgggauuaugacuaucgaucucgacccagucauauacgauuccaaguuugaaaaacaguugggacaggugaugcugcuaguucugugugcagugcagcuccuucugaugcggaccaguugggcuuugugcgaggcccugacacucgcaacgggcccuauuaccacucugugggaagguagccccggcaaguucuggaauacaaccaucgcuguaucgauggccaacauuuuucgcgggucuuauuuagccggagcgggccuugcuuucuccaucaugaaaagcguggggacuggaaagagaggcacagguucacaaggggagacccugggagaaaaguggaaaaagaaacucaaucagcuaaguaggaaggaguuugaccuguacaaaaagucuggcauaacggaggucgaucggaccgaagcaaaagaggguuugaagcgaggcgaaaucacacaccaugccguuuccagagggagcgcuaagcugcagugguucguggagcgcaacauggucauuccagaaggaagggugaucgaccucggcugugggcggggaggcuggucauauuacugcgccggucuuaaaaagguaacugaggugcguggguacaccaaaggaggccccggccacgaggaaccuguuccgaugaguacauauggguggaauauugugaagcugaugagcggaaaagaugucuuuuacuugcccccagagaagugugacacucugcucugcgauaucggugaauccucuccuagccccaccguggaggaguccagaacaauuagggucuuaaagaugguggaaccuuggcugaaaaacaaucaguucuguaucaagguucuuaacccauauaugcccaccguaauagagcaucuggaacgccuacaacggaaacacggcgggaugcucgugcgaaauccucugucaagaaacucuacucacgagauguacuggauuaguaauggaacgggcaacaucgucgcaucggugaauaugguuagcagguugcugcucaaccgcuucacaaugacccaucggagaccaacuaucgaaaaggacguggaucuuggugccgggacccgucacgucaacgcugagcccgagacaccgaauauggacgugauuggagaaaggauaaaacggaucaaggaggaacauaacuccacguggcacuaugacgaugagaauccuuacaagaccugggcguaucacggcucuuacgaaguaaaagccacuggcucagcaagcuccaugauuaacggggugguuaagcuguuaacaaaaccaugggacgucgugcccauggugacccagauggcuaugacugauacaaccccuuuuggacagcaacgcgucuucaaggagaaaguugacacacgaacuccaagaaguaugcccgguaccaggcgggugaugggcaucacggccgaguggcuguggcgcaccuuggggagaaauaagaagccgaggcucugcacacgagaagaguuuacuaaaaagguacggaccaacgcagccaugggagcuguguucacagaagagaaucagugggauucugccaaagcggcagucgaagacgaggauuuuuggaagcugguggaccgugagagagaacuacauaaacuuggcaagugugguagcugcguuuacaacaugauggggaaacgcgagaagaagcugggagaguucggcaaagccaagggcucaagggcuauuugguauauguggcucggggcccgguaccuggaguuugaggcauugggauuccugaaugaagaucacugguuuuccagagagaacaguuauagcgguguggaaggcgaggggcuccauaaacuuggauacauccugcgcgacauaucuaagaucccuggcggugcuauguaugccgaugacacugcugggugggacaccaggauuacggaagaugacuuacacaaugaggagaaaaucacacagcagauggaucccgaacaucgacaacuggccaacgcaauuuucaaguugaccuaccagaauaaggucgugaaaguacagcggccaacuccuacaggaaccguuauggacaucauauccagaaaggaucagaggggcucaggccaaguggggacuuauggacucaacaccuuuacaaauauggaggcgcagcugauucgccagauggaaggugagggcguccuaagcaaagccgaccuugaaaacccccaucugccagagaagaaaaucgcucaguggcucgagacgaaggggguggaacgucugaagcggauggccaucucgggagaugacugcguggucaaacccauugaugacagauucgcaaacgcuuuguuagcccugaaugauaugggcaagguuaggaaagacauaccucaauggcagccaucuaaggguuggcacgauuggcaacaggugccguuuuguagucaucacuuccaugagcucaucaugaaagacgggcgcaaacuuguagugcccugccgaccucaagacgaacugauuggacgggcaagaaucucccagggcgccggcuggagccuaagggagaccgcgugucuggggaaggcuuacgcccagauguggucacucauguacuuccaccgcagagauuugcggcuggcauccaacgccauuugcucugcugucccagugcacuggguucccacuagcaggacaaccuggaguauccaugcccaccaucaauggaugacuacagaagacaugcuuaccguguggaaucgugucuggauagaggauaacccuuggauggaggacaaaacgccagugacaaccugggaaaauguacccuaucugggaaagcgagaggaucaguggugugguucccucaucggcuuaacuagccgcgcaaccugggcucagaacauuccuacagccauccagcaaguuagaucucugauggggaaugaagaguuuuuggacuacaugccgucaaugaaacgguucaggaaggaggaagagagugaaggagcgauuugguga

SEQ ID NO: 15189 - RNA, 9873 nt, Artificial Sequence
  derived and/or modified CDS sequence (opt3) from DENV-3__FJ898457__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccagcaugaaaaucugaaguauacagugauuaucacuguucacaccggugaccagcaucaggugggcaacgagacacaaggggucaccgcagaaauuacuccucaggcuuccacgacagaggccauccucccagaauacggaacccuuggccuggagugcucuccgcgaacugguuuggacuucaaugagaugauccuacugaccaugaaaaacaaggcguggauggugcacagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcauacugcucucacaggcgccaccgaaauucagaauucagggggaacaaguauauucgcaggucaccugaagugucgguuaaaaauggacaagcuggagcuaaaaggcaugagcuaugccaugugcacuaacaccuuugugcucaagaaagaggucucugaaacgcagcaugggaccauccugauuaagguggaguacaagggagaagaugcucccuguaaaaucccuuucuccacagaggacggccaagguaaggcgcacaacgggcgucuuauaacugcaaauccaguugugaccaaaaaggaggaacccguaaacauugaggccgaaccgccuuucggcgagucaaauaucgucaucggaauuggcgauaacgcuuugaaaaucaauugguacaagaaggggagcaguauuggaaaaauguuugaagccacagcacgcggugccagaaggauggcuauacugggcgacacugccugggauuucgggucugugggaggcguucucaacucccuggguaagauggugcaucagaucuuugggagcgcauauaccgcgcuuuucucgggcgucucuuggauuaugaaaaucggaaucggcgugcuguugacguggauugggcucaauuccaagaacacaucaaugaguuuuagcugcauagcuaucggaauuaucacccuguacuuaggcgccguagugcaggcagacauggguuguguuauuaauuggaaagggaaggagcugaagugcggauccggcaucuucgucacuaacgaggugcacacauggaccgaacaguauaaauuucaagccgauucucccaagcggcuagcuacugccauagcaggugcuugggagaauggcgugugugggauccgaagcaccacacgcauggaaaaccuccuguggaaacagauugccaaugagcuuaacuacaucuugugggaaaauaacauuaagcugacggucguugugggagacaucauaggcgugcucgagcaggggaaaagaacccugacuccacagccuauggaguuaaaguauucauggaaaacauggggaaaggcgaagauuguaaccgccgaaacacaaaacaguuccuucaucauugauggccccaauacuccagagugccccagcgcuucuagggcauggaacgucugggaaguggaggacuacgguuuugggguuuucaccacgaauaucuggcugaaacuucgggaaguguauacacaguugugugaccaccgccucaugucagccgcugucaaggaugagagagccgugcaugcagacaugggauacuggauagagagucagaaaaacggcagcuggaagcuggaaaaagcgucccuaaucgagguuaagaccugcacuuggccuaagucucacacccuguggucgaauggugugcucgaaagcgauaugauuaucccaaaaucccuggccggcccgauuucacagcauaaccacaggcccggguaccacacacaaacugcuggaccuuggcaucuuggcaaguuggagcuggacuuuaauuauugcgaggggaccacaguagucaucacggaaaacuguggaacccguggcccaaguuuacggacuacaaccgugucugguaaacucauacacgaguggugcugucgaagcugcacucugcccccucuuagauacaugggggaagauggauguugguauggcauggagauuaggccaaucuccgaaaaggaggagaauauggugaaaucacuggucagcgccgguucuggcaagguugacaacuucacaauggggguguugugccucgcaauccuguuugaagagguaaugcgcggaaaguucggcaaaaagcauaugauugcugggguguucuuuaccuucguccuacugcucuccggacagaucacguggcgggauauggcccacacucugauuaugauaggcaguaaugcaagcgacagaauggguaugggggugaccuaccuugccuugaucgcuacauuuaaaauucagcccuuccuggcguuaggauuuuuccucaggaagcugaccucucgcgaaaaccuucugcuaggcguuggccucgccauggcaacuacacugcaauugccggaggauaucgaacagauggcuaaugggauugcccugggauuaauggcccucaaacugaucacccaguuugagacauaucagcuuuggacugcucugauauccuugaccuguucaaacacgaucuucacacucaccguggcauggcgaacugccacccugauucuagcgggugucagucugcuuccugugugccaaagcucguccaugcggaagacagacuggcucccaauggcuguugccgcaaugggcgugcccccucugcccuuguuuaucuucucucugaaggauacuuuaaaacguagaagcuggccacucaaugagggggucauggccguaggacuggugucaauucuugcuaguucccuguugaggaacgacguuccuauggcaggcccccucguggccggugggcugcuaaucgcguguuacgucauaaccggaacgucugcugaucugacaguggaaaaggccgcagacauuaccugggaggaagaggccgaacagacuggcguaagccauaaccuuaugaucacaguggacgaugacggcaccaugcgcaucaaagaugacgagacugagaauauucucacaguccuguugaagaccgcuuuacugauaguuuccgggaucuuuccauauucaauuccggccacgcuccugguguggcacacuuggcagaaacagacccaacggagcggagugcuuugggaugucccuagucccccagaaacacagaaggcagagcuggaagaggguguguacagaaucaaacagcagggcauuuucgggaagacccaaguuggaguaggcgugcagaaggagggugucuuucacacaauguggcaugugacuaggggggcuguuuugaccuacaacggaaaacgacuagaacccaauugggccucugugaagaaagaccugaucuccuauggcggcggguggcgccucagcgcgcaguggcaaaagggagaggaaguccaggugauagccguagagccugguaaaaacccaaagaauuuccagacgaugcccggcacauuccagacuaccacaggggaaaucggagcaauugcucuggauuuuaagccuggcaccucggguucaccgaucauuaaccgggaggggaaagucgugggacuuuacggcaauggcguugugacuaagaacgggggauaugucucugguaucgcccaaaccaaugcugagccagacggccccacaccugaauuagaggaagagauguucaaaaagagaaaccugacgauaauggaucuccacccagggaguggaaaaacuaggaaguacuugcccgcaauugugcgugaagccaucaagcgccggcugagaacccucauccuggccccuacaaggguuguggcugcggagauggaggaagcacuuaaaggccugccgauucgauaucagaccacugccacaaaguccgagcauaccggucgggaaaucgucgacuugaugugccacgcuacguuuacuaugcgccuacugagccccgugagaguaccaaauuacaaccucauaauuauggaugaggcccauuucacagacccugcaucuaucgccgcuaggggguauauuagcacccgggugggaaugggcgaagcggccgcaaucuuuaugaccgcuacucccccaggcacagccgaugcauucccucaguccaaugcccccauacaggacgaggagcgagacauuccagaaagaucauggaacagugggaaugaguggaucaccgauuuugcuggaaaaacaguuugguucgucccgagcaucaaggccgguaacgacauugcgaacuguuuacgcaaaaauggcaagaaggugauccaacugucuaggaaaacuuuugauacggaauaccagaagaccaaacuuaacgacugggauuucguggucacaacugacauuuccgagaugggggcaaauuuuaaggccgaucguguaauagacccucggagaugccugaaacccgugauccucaccgauggaccagagaggguuauuuuggcuggccccaugccugugacagccgcuucagcagcccagcgccgagguagagucgggcggaacccacagaaggaaaaugaccaauacaucuucaccggccagccccugaacaaugaugaggaccacgcucacuggacugaagccaagaugcuccuggacaacaucaauacgccugagggaauuauaccggcacuuuucgaaccagagagggagaaaagugcggccaucgauggcgaauaucgccuaaagggggagagccguaaaaccuuuguggaacugaugagacggggagacuugcccguuugguuagcucauaagguggccuccgaggguauuaaauacacagauaggaaguggugcuucgacggccagcgcaacaaucagauccuggaagagaacauggaugucgagauuuggacuaaagaaggggagaagaagaaacuccgaccuagauggcuggacgcacggaccuauucugauccccuugcucugaaggaauuuaaagacuucgccgcaggaaggaagucgaucgcccucgauuuggugacagagauaggccgcguaccaagccaccuggcucauagaaccaggaaugcgcuagacaaccuggugaugcuccacacuucagaacacggugggcgggccuaccgucaugcaguugaggagcuuccugaaacaauggagacgcuguuauugcugggccucaugauccugcuuaccggaggcgcuaugcuguuucucauuuccgggaaaggaaucgguaagacuaguauuggcuugaucugugucauagccucuagcgggaugcuguggauggccgaaauucccuuacaauggaucgcauccgcuauugugcuagaguucuuuaugauggugcugcucaucccagagccugaaaagcagcgcacaccgcaggauaaucaacuugccuaugucguuauaggaauccugaccuuggcggcuauuaucgccgcaaacgagaugggccugcucgaaaccacaaaacgagaccuggguaugucaaaggagcccggggugguaucuccaacuagcuaccuugauguggaccuccacccugccagugcuuggacgcuguaugcagucgccaccacagugauuacucccauguugagacauaccaucgaaaauuccacagcgaacguuagccuggcugccauagcaaaccaggccguggucuuaaugggccuagacaaaggauggccaauuucuaagauggaucugggcguaccucuccuugcucuggggugcuacucacaggugaaucccuugacccugacugccgcaguucuccugcuuaucacgcacuacgcuaucauuggaccgggcuuacaggccaaagcgacaagggaggcccaaaagcggaccgcagcugguaucaugaagaacccaacuguggacgggauaaugaccauugaucuggacccugucaucuaugauuccaaauucgagaagcagcucggacaggugauguugcugguccuaugugccgugcagcugcuccuuaugcgcacaaguugggcacugugcgaagcuuugacucuggccaccggccccauuacaacgcucugggaggguagcccaggcaaauuuuggaauaccacuaucgccguuucgauggcgaacauauucagagggucuuaccuggcuggagcaggcuuagccuuuuccaucaugaagacaguggggaccggaaaaaggggcacugguagccaaggggaaacacuuggagagaaguggaagaaaaagcugaaucagcucucacggaaagaauucgaccuauauaagaaaaguggcauuaccgagguagaucgaacggaggcuaaggaaggucugaaaagaggcgagaucacccaucacgccgugucucgcggguccgcaaaguugcagugguuugucgaaaggaacaugguuauucccgagggacgggugaucgaccugggcugugggcguggaggcuggagcuacuauugcgccggucucaagaaagucacagaagugagaggguacacuaagggaggcccuggccacgaggagccgguacccaugucaaccuauggguggaauauugugaaacuuaugaguggaaaggauguuuucuaccugccaccugaaaaaugugacacauugcugugcgauaucggugagagcucccccucuccuacuguggaagagagcaggaccauacgcguccucaagaugguggagccaugguuaaagaacaaucaguucuguauuaaaguccugaaccccuacaugccuacagugaucgaacaucuugagcggcugcaacgaaagcacggcgggaugcuaguuagaaauccacucuccaggaacucaacccaugaaauguauuggaucucuaauggaacuggcaacauuguagcuagugugaauauggucucgcgccuguugcugaaccgguuuacgaugacacacagacgucccaccauagagaaagacguggaucucggugcggggacuaggcacguuaacgccgaaccggagaccccuaauauggacgugaucggagagcggauuaagcgcaucaaagaagagcauaacagcacauggcacuacgacgaugaaaauccauauaagacgugggcauaccauggcuccuaugaggucaaggcuaccggcucugccucaagcaugauuaacggggugguaaaacuucugacuaagcccugggacgugguuccuauggucacacagauggcaaugaccgauacuacaccauucggacagcaacgaguguuuaaagaaaagguggacaccagaacacccagguccaugccggguacucggcgcgucaugggcaucaccgccgagugguuauggagaacgcuggggaggaauaaaaagccucgauugugcacccgggaggaauucacaaagaaaguucguacuaacgcugccaugggagcgguguuuaccgaggaaaaucagugggauagugcaaaggccgcuguagaggacgaagauuucuggaaacucguggacagagagcgcgagcugcacaagcuaggcaaaugugguucuugcgucuacaacaugauggggaagagggaaaaaaagcuuggagaguuuggcaaggccaaaggcagccgggcaauaugguauauguggcugggggcuagauaccucgaauucgaggcccugggauuuuugaaugaggaucauugguucucacgcgaaaacuccuacagugguguggagggcgaagggcugcacaagcucggauauauccuuagggacauuagcaaaauccccggcggugcuauguacgccgaugacacagcagggugggacacucgaauuaccgaggaugaccugcacaaugaagagaagaucacgcagcagauggauccagagcaucggcaauuagcgaacgccauauuuaaacugacauaucagaauaagguugugaagguccagagaccuacccccacuggaacagugauggacauuaucucuaggaaagaucagcgcggcuccggccaaguagggaccuacggauugaacacuuucaccaauauggaagcucagcucauccgucagauggagggugaaggcguucugucaaaggccgaccuagagaacccacaccuucccgaaaaaaagauuacacaguggcuggagacgaaagggguggagcggcucaagagaauggcaauaagcggagaugacugcgucgugaagccuaucgaugacagguuugcuaacgcccuguuggcauuaaaugauaugggcaaagugcgcaaggacauuccacaauggcagccgucgaaagguuggcaugauuggcagcagguccccuucuguucucaccacuuccaugaacugaucaugaaggacgggcgaaaacucguugugccuugccggccacaagacgagcuuauuggaagagccaggaucagucagggcgcgggcuggucccugcgcgaaaccgcuugucuagggaaggccuaugcacagauguggagccugauguacuuucacagacgggaucucagguuggccucaaacgcuauaugcuccgccguacccgugcauugggucccuacuucucguacaaccuggagcauccacgcacaucaccaauggaugacuacagaggacaugcugaccguguggaaucgaguuuggauugaagauaacccauggauggaggacaagacgcccgugacaaccugggagaaugucccuuaucuuggaaaacgcgaagaucaguggugugguagucugaucggccucacuuccagagcuaccugggcccagaacauuccgacagcgauccagcaagugcggagcuuaauugggaaugaggaauuccuggacuacaugccaucuaugaagagguuucgcaaagaggaggaaucagagggagcuauaugguga

SEQ ID NO: 15190 - RNA, 9873 nt, Artificial Sequence
  derived and/or modified CDS sequence (opt3) from DENV-3__KF955505__SS-prME
accagccugugccucaugaugauccuucccgccgcucuggcauuccacuugacauccagaaacggcgagccuaggaugauuguggggaagaaugaacggggaaaaucuuuacuguuuaagacugccucagguauaaacauguguacgcuaaucgcgauggaccucggcgagaugugcgaugacaccgucacauacaaauguccacauauuacugaaguugagccggaagauaucgacugcugguguaaucugaccaguacaugggugaccuaugggacuugcaaccaggcuggagagcaccgccgagauaagcguagcguagcccuugcaccccaugugggcaugggucuggacacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaauagagauuuuguugaaggauugucaggugccaccuggguggacgucgugcuggagcacggcgggugcgugacgacuauggcgaagaacaaacccacacuagauauugagcuccagaagaccgaagcaacucaacuggccacacuuaggaaacuguguaucgagggaaagauuaccaauaucacgaccgacagccggugcccuacacagggcgaagcugucuugccagaggaacaggaucagaacuauguuuguaaacacacuuacguggaccgcgguugggggaauggaugcggccucuucggcaaggggagucugguaaccugcgccaaguuucaauguuuagagcccauagagggaaaagugguccaguaugaaaaccugaaguacacagugauuaucacuguucauaccggugaucagcaccaggugggcaaugagacacaaggggucaccgcagaaauuacuccucaggcuuccacgacagaggccauccucccagaauauggaacccuuggccuggagugcucuccgcgaacugguuuggacuucaacgagaugauccuacugaccaugaaaaauaaggcguggauggugcauagacagugguuuuucgaccucccccugccuuggacaagcggggccaccacugaaacaccaacguggaacaggaaagagcuucugguaaccuuuaagaaugcacacgcuaaaaagcaagaaguuguggucuugggcucccaggagggagccaugcacacugcucucacaggcgccaccgaaauucagaacucagggggaacaaguauauucgcaggucaucugaagugucgguuaaaaauggauaagcuggagcuaaaaggcaugagcuacgccaugugcacuaacaccuuugugcucaagaaagaggucucugaaacgcagcacgggaccauccugauuaagguggaguacaagggagaagacgcucccuguaaaaucccuuucuccacagaggauggccaagguaaggcgcauaaugggcgucuuauaacugcaaacccaguugugaccaaaaaggaggaacccguaaauauugaggccgaaccgccuuucggcgagucaaacaucgucaucggaauuggcgacaaugcuuugaaaaucaacugguauaagaaggggagcaguauuggaaaaauguuugaagccacagcacgcggugccagaaggauggcuauacugggcgauacugccugggacuucgggucugugggaggcguucucaauucccuggguaagauggugcaccagaucuuugggagcgcauacaccgcgcuuuucucgggcgucucuugggugaugaaaauuggaaucggcguacuguugacguggaucgggcucaacuccaagaauacaucaaugaguuuuagcugcauugcuauaggaaucauuacccuguauuuaggcgccgugguucaggcagauauggguugugucaucaacuggaaagggaaggagcugaagugcggauccggcauuuucgugacuaaugaggugcauacauggaccgaacaguacaaauuucaagccgacucucccaagcggcuagcuacugccaucgcaggugcuugggagaacggcgucugugggauacgaagcaccacacgcauggaaaaucuccuguggaaacagaucgccaacgagcuuaauuauauuuugugggaaaacaacaucaagcugacgguuguggugggagauauuaucggcguacucgagcaggggaaaagaacccugacuccacagccuauggaguuaaaguacucauggaaaacauggggaaaggcgaagauagucaccgccgaaacacaaaauaguuccuucauuaucgacggccccaacacuccagagugccccagcgcuucuagggcauggaaugugugggaaguugaggauuaugguuuugggguguucaccacgaacauuuggcugaaacuucgggaagucuacacacaguugugugaccaccgccucaugucagccgcugugaaggacgagagagccguucacgcagauaugggauacuggaucgagagucagaaaaauggcagcuggaagcuggaaaaagcgucccuaauagaggugaagaccugcacuuggccuaagucucauacccuguggucgaacgguguacucgaaagcgacaugaucauuccaaaaucccuggccggcccgaucucacagcacaaucauaggcccggguaucacacacaaacugcuggaccuuggcaccuuggcaaguuggagcuggauuuuaacuacugcgaggggaccacagucgugauuacggaaaauuguggaacccguggcccaaguuuacggacuacaaccgugucugguaaacucauccaugaguggugcugucgaagcugcacucugcccccucuuagauauaugggggaagacggauguugguacggcauggagauaaggccaauuuccgaaaaggaggagaacauggucaaaucacugguuagcgccgguucuggcaagguggauaauuucacaauggggguauugugccucgcaauccuguuugaagaggugaugcgcggaaaguucggcaaaaagcacaugaucgcuggggucuucuuuaccuucgugcuacugcucuccggacagauuacguggcgggacauggcccauacucugaucaugauuggcaguaacgcaagcgauagaauggguauggggguuaccuaucuugccuugauagcuacauuuaaaauccagcccuuccuggcguuaggauuuuuccucaggaagcugaccucucgcgaaaaucuucugcuaggcgugggccucgccauggcaacuacacugcaauugccggaggacauugaacagauggcuaacgggaucgcccugggauuaauggcccucaaacugauuacccaguuugagacauaccagcuuuggacugcucugaucuccuugaccuguucaaauacgauguucacacucaccgucgcauggcgaacugccacccugauacuagcgggugugagucugcuuccuguuugccaaagcucguccaugcggaagacagauuggcucccaauggcuguggccgcaaugggcguccccccucugcccuuguuuaucuucucucugaaggacacuuuaaaacguagaagcuggccacucaacgaggggguaauggccgugggacugguuucaauucuugcuaguucccuguugaggaacgaugugccuauggcaggcccccucgucgccggugggcugcuaaucgcguguuaugugauuaccggaacgucugcugaccugacaguagaaaaggccgcagauaucaccugggaggaagaggccgaacagacuggcgugagccacaaucuuaugauaacagucgacgacgauggcaccaugcgcauuaaagacgaugagacugagaacauccucacaguucuguugaagaccgcuuuacugaucguguccgggguguuuccauacucaauuccggccacgcuccuggucuggcauacuuggcagaaacagacccaacggagcggagugcuuugggacguuccuagucccccagaaacacagaaggcagagcuggaagaggguguauacagaauaaaacagcagggcaucuucgggaagacccaagugggagucggcgugcagaaggaggguguuuuucacacaauguggcacgugacuaggggggcugucuugaccuauaauggaaaacgacuagaacccaacugggccucugugaagaaagaucugauuuccuacggcggcggguggcgccucagcgcgcaguggcaaaagggagaggaaguacaggucaucgccguggagccugguaaaaauccaaagaacuuccagacgaugcccggcacauuccagacuaccacaggggaaauuggagcaaucgcucuggacuuuaagccuggcaccucggguucaccgauaaucaaucgggaggggaaaguugugggacuuuauggcaacggcgucgugacuaagaaugggggauacguuucugguauugcccaaaccaacgcugagccagauggccccacaccugaauuagaggaagagauguucaaaaagagaaaucugacgaucauggaccuccauccagggaguggaaaaacuaggaaguauuugcccgcaauugugcgugaagccaucaagcgccggcugagaacccucauacuggccccuacaagggucguggcugcggagauggaggaagcacuuaaaggccugccgauucgauaccagaccacugccacaaaguccgagcacaccggucgggaaaucguagauuugaugugccaugcuacguuuacuaugcgccuacugagccccgugagaguuccaaacuauaaucucaucauuauggacgaggcccacuucacagauccugcaucuaucgccgcuaggggguacauaagcacccgggucggaaugggcgaagcggccgcaauuuuuaugaccgcuacucccccaggcacagccgacgcauucccucaguccaacgcccccauccaggaugaggagcgagacauuccagaaagaucauggaauagugggaacgaguggaucaccgacuuugcuggaaaaacagugugguucgugccgagcauaaaggccgguaacgauauugcgaauuguuuacgcaaaaacggcaagaaggucauccaacugucuaggaaaacuuuugacacggaauaccagaagaccaaacuuaaugauugggacuucguagugacaacugauaucuccgagaugggggcaaacuuuaaggccgaccguguuauugauccucggagaugccugaaacccgugauccucaccgacggaccagagagggucauuuuggcuggccccaugccugugacagccgcuucagcagcccagcgccgagguagaguugggcggaauccacagaaggaaaacgaucaauauauauucaccggccagccccugaauaacgacgaggaucaugcucacuggacugaagccaagaugcuccuggacaauaucaacacgccugagggaauuaucccggcacuuuucgaaccagagagggagaaaagugcggccaucgacggcgaauaccgccuaaagggggagagccguaaaaccuuuguggaacugaugagacggggagauuugcccgucugguuagcucacaagguggccuccgaggguauuaaauauacagacaggaaguggugcuucgauggccagcgcaauaaccagauacuggaagagaauauggacguagagaucuggacuaaagaaggggagaagaagaaacuccgaccuagauggcuggaugcacggaccuacucugacccccuugcucugaaggaauuuaaagauuucgccgcaggaaggaagucgauugcccucgacuuggugacagagaucggccgcguuccaagccaucuggcucacagaaccaggaacgcgcuagauaaucuggucaugcuccauacuucagaacacggugggcgggccuaucgucacgcaguggaggagcuuccugaaacaauggagacgcuguuauugcugggccucaugauucugcuuaccggaggcgcuaugcuguuucucaucuccgggaaaggaauagguaagacuaguaucggcuugauuugugugaucgccucuagcgggaugcuguggauggccgaaauucccuuacaauggaucgcauccgcuauaguccuagaguucuuuaugaugguucugcucauuccagagccugaaaagcagcgcacaccgcaggacaaccaacuugccuacgugguaaucggaauucugaccuuggcggcuaucauagccgcaaaugagaugggccugcucgaaaccacaaaacgagaucuggguaugucaaaggagcccgggguggucucuccaacuagcuaucuugacguggaucuccauccugccagugcuuggacgcuguacgcaguugccaccacagugaucacucccauguugagacacaccauugaaaacuccacagcgaacgucagccuggcugccaucgcaaaucaggccguaguguuaaugggccuagacaaaggauggccaauuucuaagauggaccugggcguuccucuccuugcucuggggugcuacucacaggugaaccccuugacccugacugccgcaguccuccugcuuaucacgcauuaugcuauaauuggaccgggcuuacaggccaaagcgacaagggaggcccaaaagcggaccgcagcugguaucaugaagaauccaacuguggaugggaucaugaccauugaccuggauccugucaucuacgacuccaaauucgagaagcagcucggacaggugauguugcugguucuaugugccgugcagcugcuccuuaugcgcacaaguugggcacugugcgaagcuuugacucuggccaccggccccauaacaacgcucugggaggguagcccaggcaaauuuuggaacaccacuauugccguaucgauggcgaauaucuucagagggucuuaucuggcuggagcaggcuuagccuuuuccauuaugaagagcguggggacaggaaaaaggggcaccgguucacaaggggaaacucuuggagagaaguggaagaaaaagcugaaccagcucagucggaaagaauucgaucuauacaagaaaucuggcaucacagaggucgaccgaaccgaggcuaaggaaggucugaaaagaggcgagacgacccaccaugccguuucccgcgggagcgcaaaguugcagugguuuguggaaaggaauauggucauacccgagggacgggugaucgaucugggcugugggcguggaggcuggucauauuacugcgccggucucaagaaaguaacagaagugagaggguauacuaagggaggcccuggccacgaggagccgguucccaugaguaccuacggguggaacauugugaaacuuaugagcggaaaggacgucuucuaccugccaccugaaaaaugugauacauugcugugcgacaucggugaguccucucccagcccuacuguggaagaguccaggaccauucgcguccucaagaugguggagccaugguuaaagaauaaccaguucuguaucaaaguucugaaucccuauaugccuacaguaauugaacaccuugagcggcugcaacgaaagcauggcgggaugcuagugagaaacccacucucaaggaauucuacccacgaaauguacuggaucaguaacggaacuggcaauauagucgcuucggugaacaugguuagccgccuguugcugaaccgguuuacgaugacacauagacgucccaccauugagaaagauguggaccucggugcggggacuaggcacgucaaugccgaaccggagaccccuaacauggaugugaucggagagcggaucaagcgcauuaaagaagagcacaauuccacauggcauuaugacgacgaaaacccauacaagacgugggcauaucacggcucuuacgagguaaaggcuaccggcucagccagcuccaugauaaauggggugguuaaacuucugacuaagcccugggaugucgugccuauggugacacagauggcaaugaccgacacuacaccauucggacagcaacgagucuuuaaagaaaagguugauaccagaacacccaggaguaugccggguacucggcgcgugaugggcaucaccgccgagugguuauggagaacgcuggggaggaacaaaaagccucgauugugcccccgggaggaauucaccaagaaaguacguacaaaugcugccaugggagcgguguuuacugaggaaaaccagugggacucugcaaaggccgcugucgaggaugaagacuucuggaaacucguggauagagagcgcgagcugcauaagcuaggcaaaugugguagcugcguuuauaauaugauggggaagagggaaaaaaagcuuggagaguuuggcaaggccaaaggcucacgggcaauuugguacauguggcugggggcuagauaccucgaauucgaggcccugggauuuuugaacgaggaccacugguucucccgcgaaaauaguuauagcgguguggagggcgaagggcugccaaagcucggauacauccuuagggauauuucuaaaaucccuggcggugcuauguaugccgacgauaccgcagggugggacacacgaauaacugaggacgaucugcauaacgaagagaagaucccccaccagauggacccagagcacucccgguuagcgaaugccauuuuuaaacugaccuaccagaacaaggucgugaagguacaaagacccacgccuacaggaaccguuauggauaucauuucaaggaaagcucagcgcggcagcggccagguggggacuuauggauugaauacauucaccaacauggaagcccagcucauccgucaaauggagggugaaggcguccugucgaaggcagaccuagagaacccacaucuuccggaaaaaaagauaacucaguggcuggagaccaaagggguggagcggcucaagagaauggcuauuacaggagaugacugcguggucaagcccaucgaugacagguuugccaaugcacuguuggccuuaaacgauaugggcaaaguucgcaaggacaucccucaguggcagccaucuaaagguuggcacgauuggcaacaggugcccuucuguagucaucacuuccacgaacugauuaugaaggacgggcgaaaacucguagugccuugccggccacaggaugagcuuauaggaagagcgaggaucucccagggcgcuggcuggagccugcgcgaaacggccugucuagggaaggcauacgcccaaauguggucacugauguauuuucauagacgggaccucagguuggcuuccaaugccauuugcucugcaguccccgugcacuggguuccuaccagccguacuacauggaguauccaugcucaccaucaguggaugaccacugaggacaugcugacaguguggaaccgagucuggauugaagauaauccguggauggaggacaagaccccagugacgacaugggagaacguacccuaccuuggaaaacgcgaagaucaguggugugguucccugaucggccucaccagcagagccacuugggcgcaaaauauaccuaccgcuauccagcagguucggucuuuaauugggaacgaggaauuccuggacuacaugcccucaaugaagagguuucgcaaagaggaggaaagugagggagccaucugguga

SEQ ID NO: 15191 - RNA, 9873 nt, Artificial Sequence
  derived and/or modified CDS sequence (opt3) from DENV-3__FJ898464__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucagaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagaugcucccuguaaaaucccuuucuccacagaggacggccaagguaaggcgcauaacgggcgucuuauaacugcaaauccaguugugaccaaaaaggaggaacccguaaacauugaggccgaaccgccuuucggcgagucaaauaucgucaucggaauuggcgauaacgcuuugaaaaucaauugguauaagaaggggagcaguauuggaaaaauguuugaagccacagcacgcggugccagaaggauggcuauacugggcgacacugccugggauuucgggucugugggaggcguucucaacucccuggguaagauggugcaccagaucuuugggagcgcauacaccgcgcuuuucucgggcgucucuugggugaugaaaauuggaaucggcguacuguugacguggaucgggcucaauuccaagaacacaucaaugaguuuuagcugcauugcuauaggaaucauuacccuguauuuaggcgccgugguucaggcagacauggguugugucaucaauuggaaagggaaggagcugaagugcggauccggcauuuucgugacuaacgaggugcauacauggaccgaacaguacaaauuucaagccgauucucccaagcggcuagcuacugccaucgcaggugcuugggagaauggcgucugugggauacgaagcaccacacgcauggaaaaccuccuguggaaacagaucgccaaugagcuuaacuauauuuugugggaaaauaacaucaagcugacgguuguggugggagacauuaucggcguacucgagcaggggaaaagaacccugacuccacagccuauggaguuaaaguacucauggaaaacauggggaaaggcgaagauagucaccgccgaaacacaaaacaguuccuucauuaucgauggccccaauacuccagagugccccagcgcuucuagggcauggaacgugugggaaguugaggacuaugguuuugggguguucaccacgaauauuuggcugaaacuucgggaagucuacacacaguugugugaccaccgccucaugucagccgcugugaaggaugagagagccguucacgcagacaugggauacuggaucgagagucagaaaaacggcagcuggaagcuggaaaaagcgucccuaauagaggugaagaccugcacuuggccuaagucucauacccuguggucgaaugguguacucgaaagcgauaugaucauuccaaaaucccuggccggcccgaucucacagcacaaccauaggcccggguaucacacacaaacugcuggaccuuggcaccuuggcaaguuggagcuggacuuuaauuacugcgaggggaccacagucgugauuacggaaaacuguggaacccguggcccaaguuuacggacuacaaccgugucugguaaacucauccaugaguggugcugucgaagcugcacucugcccccucuuagauauaugggggaagauggauguugguacggcauggagauaaggccaauuuccgaaaaggaggagaauauggucaaaucacugguuagcgccgguucuggcaagguggacaacuucacaauggggguauugugccucgcaauccuguuugaagaggugaugcgcggaaaguucggcaaaaagcacaugaucgcuggggucuucuuuaccuucgugcuacugcucuccggacagauuacguggcgggauauggcccauacucugaucaugauuggcaguaaugcaagcgacagaauggguauggggguuaccuaucuugccuugauagcuacauuuaaaauccagcccuuccuggcguuaggauuuuuccucaggaagcugaccucucgcgaaaaccuucugcuaggcgugggccucgccauggcaacuacacugcaauugccggaggauauugaacagauggcuaaugggaucgcccugggauuaauggcccucaaacugauuacccaguuugagacauaccagcuuuggacugcucugaucuccuugaccuguucaaacacgauguucacacucaccgucgcauggcgaacugccacccugauacuagcgggugugagucugcuuccuguuugccaaagcucguccaugcggaagacagacuggcucccaauggcuguggccgcaaugggcguccccccucugcccuuguuuaucuucucucugaaggauacuuuaaaacguagaagcuggccacucaaugaggggguaauggccgugggacugguuucaauucuugcuaguucccuguugaggaacgacgugccuauggcaggcccccucgucgccggugggcugcuaaucgcguguuaugugauuaccggaacgucugcugaucugacaguagaaaaggccgcagacaucaccugggaggaagaggccgaacagacuggcgugagccacaaccuuaugauaacagucgacgaugacggcaccaugcgcauuaaagaugacgagacugagaauauccucacaguucuguugaagaccgcuuuacugaucguguccgggguguuuccauacucaauuccggccacgcuccuggucuggcauacuuggcagaaacagacccaacggagcggagugcuuugggauguuccuagucccccagaaacacagaaggcagagcuggaagaggguguauacagaauaaaacagcagggcaucuucgggaagacccaagugggagucggcgugcagaaggaggguguuuuucacacaauguggcacgugacuaggggggcugucuugaccuauaacggaaaacgacuagaacccaauugggccucugugaagaaagaccugauuuccuacggcggcggguggcgccucagcgcgcaguggcaaaagggagaggaaguacaggucaucgccguggagccugguaaaaacccaaagaauuuccagacgaugcccggcacauuccagacuaccacaggggaaauuggagcaaucgcucuggauuuuaagccuggcaccucggguucaccgauaaucaaccgggaggggaaaguugugggacuuuauggcaauggcgucgugacuaagaacgggggauacguuucugguauugcccaaaccaaugcugagccagacggccccacaccugaauuagaggaagagauguucaaaaagagaaaccugacgaucauggaucuccauccagggaguggaaaaacuaggaaguauuugcccgcaauugugcgugaagccaucaagcgccggcugagaacccucauacuggccccuacaagggucguggcugcggagauggaggaagcacuuaaaggccugccgauucgauaccagaccacugccacaaaguccgagcacaccggucgggaaaucguagacuugaugugccaugcuacguuuacuaugcgccuacugagccccgugagaguuccaaauuauaaccucaucauuauggaugaggcccacuucacagacccugcaucuaucgccgcuaggggguacauaagcacccgggucggaaugggcgaagcggccgcaauuuuuaugaccgcuacucccccaggcacagccgaugcauucccucaguccaaugcccccauccaggacgaggagcgagacauuccagaaagaucauggaacagugggaaugaguggaucaccgauuuugcuggaaaaacagugugguucgugccgagcauaaaggccgguaacgacauugcgaacuguuuacgcaaaaauggcaagaaggucauccaacugucuaggaaaacuuuugauacggaauaccagaagaccaaacuuaacgacugggauuucguagugacaacugacaucuccgagaugggggcaaauuuuaaggccgaucguguuauugacccucggagaugccugaaacccgugauccucaccgauggaccagagagggucauuuuggcuggccccaugccugugacagccgcuucagcagcccagcgccgagguagaguugggcggaacccacagaaggaaaaugaccaauauauauucaccggccagccccugaacaaugaugaggaccaugcucacuggacugaagccaagaugcuccuggacaacaucaauacgccugagggaauuaucccggcacuuuucgaaccagagagggagaaaagugcggccaucgauggcgaauaccgccuaaagggggagagccguaaaaccuuuguggaacugaugagacggggagacuugcccgucugguuagcucacaagguggccuccgaggguauuaaauauacagauaggaaguggugcuucgacggccagcgcaacaaucagauacuggaagagaacauggauguagagaucuggacuaaagaaggggagaagaagaaacuccgaccuagauggcuggacgcacggaccuacucugauccccuugcucugaaggaauuuaaagacuucgccgcaggaaggaagucgauugcccucgauuuggugacagagaucggccgcguuccaagccaucuggcucacagaaccaggaaugcgcuagacaaccuggucaugcuccauacuucagaacacggugggcgggccuaucgucacgcaguggaggagcuuccugaaacaauggagacgcuguuauugcugggccucaugauucugcuuaccggaggcgcuaugcuguuucucaucuccgggaaaggaauagguaagacuaguaucggcuugauuugugugaucgccucuagcgggaugcuguggauggccgaaauucccuuacaauggaucgcauccgcuauaguccuagaguucuuuaugaugguucugcucauuccagagccugaaaagcagcgcacaccgcaggauaaucaacuugccuacgugguaaucggaauucugaccuuggcggcuaucauagccgcaaacgagaugggccugcucgaaaccacaaaacgagaccuggguaugucaaaggagcccgggguggucucuccaacuagcuaucuugauguggaccuccauccugccagugcuuggacgcuguacgcaguugccaccacagugaucacucccauguugagacacaccauugaaaauuccacagcgaacgucagccuggcugccaucgcaaaccaggccguaguguuaaugggccuagacaaaggauggccaauuucuaagauggaucugggcguuccucuccuugcucuggggugcuacucacaggugaaucccuugacccugacugccgcaguccuccugcuuaucacgcauuaugcuauaauuggaccgggcuuacaggccaaagcgacaagggaggcccaaaagcggaccgcagcugguaucaugaagaacccaacuguggacgggaucaugaccauugaucuggacccugucaucuacgauuccaaauucgagaagcagcucggacaggugauguugcugguucuaugugccgugcagcugcuccuuaugcgcacaaguugggcacugugcgaagcuuugacucuggccaccggccccauaacaacgcucugggaggguagcccaggcaaauuuuggaauaccacuauugccguaucgauggcgaacaucuucagagggucuuaucuggcuggagcaggcuuagccuuuuccauuaugaagagcguggggacaggaaaaaggggcaccgguucacaaggggaaacucuuggagagaaguggaagaaaaagcugaaucagcucagucggaaagaauucgaccuauacaagaaaucuggcaucacagaggucgaucgaaccgaggcuaaggaaggucugaaaagaggcgagacgacccaccaugccguuucccgcgggagcgcaaaguugcagugguuuguggaaaggaacauggucauacccgagggacgggugaucgaccugggcugugggcguggaggcuggucauauuacugcgccggucucaagaaaguaacagaagugagaggguauacuaagggaggcccuggccacgaggagccgguucccaugaguaccuacggguggaauauugugaaacuuaugagcggaaaggaugucuucuaccugccaccugaaaaaugugacacauugcugugcgauaucggugaguccucucccagcccuacuguggaagaguccaggaccauucgcguccucaagaugguggagccaugguuaaagaacaaucaguucuguaucaaaguucugaaccccuauaugccuacaguaauugaacaccuugagcggcugcaacgaaagcauggcgggaugcuagugagaaauccacucucaaggaacucuacccacgaaauguacuggaucaguaauggaacuggcaacauagucgcuucggugaauaugguuagccgccuguugcugaaccgguuuacgaugacacauagacgucccaccauugagaaagacguggaucucggugcggggacuaggcacgucaacgccgaaccggagaccccuaauauggacgugaucggagagcggaucaagcgcauuaaagaagagcacaacuccacauggcauuaugacgaugaaaauccauacaagacgugggcauaucacggcucuuacgagguaaaggcuaccggcucagccagcuccaugauaaacggggugguuaaacuucugacuaagcccugggacgucgugccuauggugacacagauggcaaugaccgauacuacaccauucggacagcaacgagucuuuaaagaaaagguugacaccagaacacccaggaguaugccggguacucggcgcgugaugggcaucaccgccgagugguuauggagaacgcuggggaggaauaaaaagccucgauugugcacccgggaggaauucacaaagaaaguacguacuaacgcugccaugggagcgguguuuaccgaggaaaaucagugggauucugcaaaggccgcugucgaggacgaagauuucuggaaacucguggacagagagcgcgagcugcauaagcuaggcaaaugugguagcugcguuuauaacaugauggggaagagggaaaaaaagcuuggagaguuuggcaaggccaaaggcucacgggcaauuugguacauguggcugggggcuagauaccucgaauucgaggcccugggauuuuugaaugaggaucacugguucucccgcgaaaacaguuauagcgguguggagggcgaagggcugcauaagcucggauacauccuuagggacauuucuaaaauccccggcggugcuauguaugccgaugacacagcagggugggacacucgaauaaccgaggaugaccugcacaaugaagagaagaucacgcagcagauggauccagagcaccggcaauuagcgaacgccauuuuuaaacugacauaccagaauaaggucgugaagguacagagaccuacccccacuggaacaguuauggacaucauuuccaggaaagaucagcgcggcucaggccaaguggggaccuauggauugaacacuuucaccaauauggaagcucagcucauccgucagauggagggugaaggcguccugagcaaggccgaccuagagaacccacaucuucccgaaaaaaagauaacacaguggcuggagacgaaagggguggagcggcucaagagaauggcaauuucgggagaugacugcguggucaagccuaucgaugacagguuugcuaacgcccuguuggcauuaaaugauaugggcaaaguucgcaaggacaucccacaauggcagccgucuaaagguuggcacgauuggcagcaggugcccuucuguagucaucacuuccacgaacugauuaugaaggacgggcgaaaacucguagugccuugccggccacaagacgagcuuauaggaagagccaggaucucccagggcgcgggcuggagccugcgcgaaaccgcuugucuagggaaggccuacgcacagauguggucacugauguauuuucauagacgggaucucagguuggccuccaacgcuauuugcucugccguccccgugcacuggguuccuacuagccguacaaccuggaguauccaugcacaccaucaauggaugacuacagaggacaugcugaccguguggaaucgagucuggauugaagauaacccauggauggaggacaagacgcccgugacaaccugggagaauguaccuuaccuuggaaaacgcgaagaucaguggugugguucccugaucggccucacuagcagagcuaccugggcccagaacauaccgacagcgauccagcaaguucggucuuuaauugggaaugaggaauuccuggacuacaugccaucaaugaagagguuucgcaaagaggaggaaagugagggagcuaucugguga

SEQ ID NO: 15192 - RNA, 9873 nt, Artificial Sequence
  derived and/or modified CDS sequence (opt3) from DENV-3__JQ922556__SS-prME
accagccugugccucaugaugauccuucccgcagcucuggcauuccacuugaccuccagagacggcgaaccuaggaugauuguggggaagaacgaacgggggaagucuuuacuguuuaagacugccucagguauaaauauguguacgcuaaucgcgauggaucucggcgaaaugugcgacgauaccguaacguacaaguguccacauauuacugaaguugaaccggaagacaucgauugcugguguaaccugaccaguacaugggugaccuaugggacuugcaaucaggcuggagaacaccgccgagacaagcguagcguagcccuugcaccccaugugggcaugggucuggauacaagaacccagacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucaaaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagaugcucccuguaaaaucccuuucuccacagaggacggccaagguaaggcgcauaacgggcgucuuauaacugcaaauccaguugugaccaaaaaggaggaacccguaaacauugaggccgaaccgccuuucggcgagucaaauaucgucaucggaauuggcgauaacgcuuugaaaaucaauugguauaagaaggggagcaguauuggaaaaauguuugaagcccccgcacgcggugccagaaggauggcuauacugggcgacacagccuggguguucgggucuguuggaggcgugcucaacucccuggguaagaugguccaccagaucuuugggagcgcauacacugcgcuuuucucgggcgugucuuggguaaugaaaauuggaaucggcgugcuguugaccuggaucgggcucaauuccaagaacacgucaaugaguuuuagcugcauugcuauaggaaucauuacacuguauuuaggcgccguuguccaggcagauauggguugugugaucaauuggaaagggaaggagcugaagugcggauccggcauuuucgugaccaacgagguccauacuuggacagaacaguacaaauuucaagccgacucuccaaagcggcuagcuaccgccaucgccggugcuugggagaauggcguuugugggauacgaagcacuacccgcauggaaaaccuccuguggaaacagaucgccaaugagcuuaacuauauuuugugggaaaauaacaucaagcugacaguggugguaggagauacgauuggcguccucgagcaggggaaaagaacccugacuccucagcccauggaguuaaaguacucauggaaaacauggggaaaggcgaagaucgugaccgccgaaacacaaaacaguuccuucauaauugacggcccaagcacucccgagugcccuucugcuucaagggcauggaauguuugggaaguggaggauuaugguuuuggggucuucaccacgaacaucuggcugaaacuucgggaaguguacacacagaugugugaccaccgcuugaugaguccagccguuaaggacgagagagcugugcacgccgauaugggauacuggauugagagccagaaaaauggcuccuggaagcucgaaaaagcaucucugaucgagguaaagaccugcacuuggccgaagucgcauacccuauggagcaacgguguccuggaauccgacaugauaauccccaaaucacucgcgggcccuauuagucagcacaauuauaggccaggguaccauacacaaacugccggacccuggcaccugggcaaacuugaguuggauuuuaacuauugcgaggggaccacaguggugaucacggaaaauuguggaacccguggcccuucucugcggacuacaaccgucagcgguaaauuaauucacgaguggugcugucgauccugcacucucccaccccugagauacaugggggaagacggauguugguauggcauggagaucaggccgauaucagaaaaggaggagaacaugguuaaaagccuugugucugcugguuccggcaagguagauaauuucacaaugggggugcugugcuuggccauucucuuugaagaggucaugcgcggaaaguucggcaaaaagcauaugaucgcagggguguucuuuaccuucguucugcuacugaguggacagaucacguggcgggacauggcucacacucucauuaugaucggcagcaacgccucugauagaauggguaugggggugaccuaccuggcacuuauugccacauuuaaaauacagccuuucuuggcucugggauuuuucuuaaggaagcucaccucccgcgaaaaucugcuucugggcgucggccuagcgauggccacuacacuccaacugccagaggacaucgaacagauggcaaacgggauugcuuugggacugauggccuuuaaauuaaucacccaguucgagacauaucagcucuggacugcccugauuucacuuaccuguaguaauacgaucuuuacacugaccguggcuuggcgaacugcaaccuugauacucgccgguguuagccugcuacccgugugccaaucguccucuaugcggaagacagauuggcugccuaugacugucgcggcuaugggcguacccccacuuccucucuucaucuuuagccugaaggacaccuugaaacguagaucauggccccugaacgagggggugauggccguuggauuagugaguauucucgcauccucucugcuuaggaaugaugucccaauggccggcccgcugguggcugguggguugcucaucgcauguuacguaggaacgggcacaagcgccgaccugaccguggaacaggcggcugaugucacuugggaggaagaggccgaacagacaggcguuucccauaaccuaaugauuaccguggacgacgaugggacuaugcgcaucaaggacgaugagacagagaacauacugaccgugcuucucaaaacggcacuguugauugucucaggaaucuucccuuacagcauccccgccacuuuacugguguggcacaccuggcagaagcaaacacagcggagugguguucucugggacguaccaucucccccugaaacccagaaagcugagcuggaagagggcguguauagaauuaagcagcaagggauacuuggaaaaacacaggucggcguggguguucagaaggaggggguguuucauacuauguggcacgucaccaggggagccgugcugacgcacaauggcaagcgauuggaaccaaacugggcauccgucaagaaggaucuaaucagcuacggcgggggauggcgccugucgccccaauggcagaaaggugaggaaguccaggugauuacaguugagccuggcaagaauccgaaaaacuuccagacuaugccagggaccuuccaaacaaccacuggagaaaucggcgcuauugcccucgacuuuaagcccgguaccucagggucuccuaucauaaaucgggagggaaagguggucggccuguauggcaacggggugguuaccaagaauggagguuacgugaguggcaucgcgcagacgaacgccgagccagaugggcccacuccugaacuugaggaagagauguucaagaaaagaaauuuaaccauuauggaccugcauccgggauccggcaagacaaggaaauaucuccccgcaaucguccgugaagcuauuaaccgccgguugagaacccugauccucgccccaacuagggugguagcugcagagauggaggaagcccugaagggucuuccuauacgauaccagacaaccgccacaaagagcgagcacacugggcgggaaauuguggaucugaugugccaugcuacauuuaccaugcgcuugcuaucucccguuagagucccaaauuauaaccugaucaucauggacgaggcgcacuucaccgauccugcaagcauugccgcuaggggauacaucuccacucgggugggcaugggcgaagccgcagccauauuuaugacagcuacacccccagggacagcggacgccuucccgcagucaaaugcaccuauucaagaugaggagcgagacauccccgaaagaaguuggaacagcggaaaugaguggauuacugacuuugcugguaaaacggugugguucgucccaucuaucaaggccggcaacgauauagcaaacugucuccgcaaaaaugggaagaaaguaauucaguuauccaggaagaccuuugaaacagaguaccagaagacuaaacugaacgacugggauuucgugggaaccacagacaucucagagaugggcgccaauuuuaaggcugaucguguuaucgacccccggagaugccuuaaaccugguauucugaccgaugggccagaaggcgugauccucgccggacccaugccugucacugcggcaagugccgcucagaggcgcggccgaguggggagaaacccgcaaaaggagaaugaccaguauauuuucacgggacagccauugaacaaugaugaagaccaugcccacuggaccgaggcuaaaaugcugcucgauaacauaaauacacccgaagguaucauuccugcacuguucgagcccgagcgggaaaagagcgccgcuaucgacggcgaguacaggcuuaagggggaaucccgcaaaacuuuuguugagcuaaugcguagaggagaccugccagugugguuggcccacaaggucgcaucugaaggcaucaaauauaccgaucggaaguggugcuucgacggucagaggaacaaucaaauuuuagaggagaacauggauguggaaauauggacaaaagagggggaaaagaucaaacugcgcccucgauggcucgacgcgagaaccuacucggauccccuggcccuuaaggaguuuaaggacuucgcugccggccggaaaagcauugcacuggaucucguaacugaaaucggaagggugccaucacauuuggcucaccgcacaagaaaugcccuggacaaccuaguuaugcugcauacguccgagcacggcgggagggcauaucggcacgccgucgaggaacucccugagaccauggaaacucuucuguuauugggacugaugauucuccugacagguggcgcuaugcuuuuucugaucagugggaagggaauaggcaaaaccucuaucggucucauuugugugaucgcgagcuccgggauguuguggauggccgagauuccgcugcaguggaucgcaucagcuauaguguuagaguucuuuaugaugguccuacugauucccgaaccagagaagcagcguaccccucaagauaaucagcucgccuacguugugaucggcauucuuacacuggccgcaaucauagcugccaacgaaaugggauugcuggagacuacgaaacgcgaccucggcguaucuaaggaacccgggguggucagcccaaccaguuaucuggauguggaccuucauccugcguccgcuuggacacucuacgccguugcaacuaccgugaucacacccaugcugcgacacaccauugagaauagcacugccaacgucucuuuggcugcaaucgccaaccaggcgguagugcugaugggauuagauaagggcuggccgauuucaaaaauggaccuagguguuccacugcucgcucuugggugcuacucccaggugaauccucugacguugacagccgcaguccugcuccugaucacccauuaugccauaauuggacccggccuucaagcuaaggccacuagagaggcacagaaaaggaccgcugccgguaucaugaagaacccaacaguggacggcaucauuacuaucgauuuagaccccgucauauacgauaguaaauucgaaaagcagcugggacaggugaugcucuugguucugugugcggugcaacuacugcucaugcggaccagcugggcccuuugcgaggcacugacauuggcuacgggaccuauuaccacucugugggaaggcucgccggggaaguuuuggaauacaaccaucgccguaucuauggcaaacauuuuccgcggauccuaucucgcuggcgccggucuggccuuuagcaucaugaaaucaguggggacuggaaagagaggcacagguagucagggcgagaccuuaggggaaaaauggaagaagaaacuuaaucagcugucuaggaaagaguucgaccucuacaaaaaguccggaauaacggaggucgaucggaccgaagcgaaagagggccuaaagcgaggggaacugacacaccaugcuguuagcagaggaucagcaaaauugcagugguuuguggagcgcaacauggucauccccgaaggcagggugauugaccuggguugugggcggggaggcuggaguuauuacugcgccggccucaagaaaguaacugaggugcguggguauaccaagggagguccaggccacgaggaaccuguucccaugagcacauacggguggaauaucgugaaacuuauguccggaaaagaugucuucuaccugccuccagagaagugugacacuuugcugugcgauauuggcgaaucuagccccuccccuaccguggaggagucaagaacaaucaggguccucaaaaugguggaaccaugguuaaagaacaaucaauucuguauuaaaguucugaaccccuauaugccggcuguaaucgagcaccuugaacgccugcagcggaagcauggugggaugcuagugcgaaauccucucucuagaaacaguacccacgagauguacuggauaucgaauggaacuggcaacauugucagcuccgugaauaugguuucuaggcuguugcugaaccgcuuuacgaugacacaucggagaccaaccaucgaaaaggacguggaucucggcgccgggacucgucacgucaacgcagagcccgagaccccuaauauggacgugaucggagaaaggauuaaacggauaaaggaggaacacaacucaacauggcauuaugaugacgagaauccauacaaaacgugggccuaucacgguagcuacgaaguaaaggcuaccggcuccgggaguucuaugaucaacggagugguuaaacuucugacuaagcccugggacgucgugccgauggugacacagauggcgaugaccgauacuacaccuuucggccaacagcgcgucuuuaaggagaaaguugacacccgaacacccagaccaaugccugguacuaggaaggugauggagauuaccgccgaaugguuauggcggacgcuggggcgcaauaaaagacccagguugugcacccgagaggaguucacaaagaaaguacggacuaacgcagcuaugggagccguguuuaccgaggaaaaucagugggauagcgcaaaggccgcugucgaggacgaggaguucuggaagcucguggaucgugagagagaacugcauaaacuaggcaaguguggcucaugcguuuauaacaugaugggagggcgcgagaagaaacuuggugaguuuggcaaagccaaaggguccagggcgaucugguacauguggcugggagcacgguaccucgaguucgaggcccugggcuuuuugaaugaagaccacugguucaguagagagaacagcuauucugguguggaaggggagggacugcauaaacucggcuacauucuucgcgauaucuccaagauaccaggcggggcuauguaugccgacgauacagcaggaugggacacuaggaucaccgaggaugaccugcacaaugaagagaagauuacgcagcaaauggaccccgaacaccgauuacuggcuaacgccaucuuuaaauugacauaccagaauaaggucgugaaaguacagcggccuaccccaacugguacaguuauggauauuaucucaagaaaggaccagaggggcagcgggcaagugggaaccuauggccucaacacuuucaccaauauggaggcucagcugguccgccagauggaaggugagggggugcuaucgaaagccgaucuugagaacccgcaucugcccgaaaagaagauaacacaguggcucgagacgaaaggaguggaacgucugaagcggauggcaauuucuggcgacgauugcgucguuaaaccuaucgacgauagauuugcgaacgccuuguuagcucugaaugacaugggcaaggugaggaaagauaucccacaauggcagcccaguaagggguggcacgacuggcagcagguaccuuucuguucccaucacuuccacgagcucauuaugaaggauggacgcaaacuuguggucccaugccgaccccaagacgaacugauaggucgggccagaaucagccagggcgcaggguggucacuaagggagaccgcuugucugggaaaggccuacgcacagauguggucccucauguauuuucaucgcagagauuugcggcuggccucuaacgcgauuugcagcgcugugccuguucacugggugacuacaaguaggaccacuugguccauccaugcccaccaucaauggaugacaaccgaggacaugcuuacggucuggaaucguguguggauugaagacaacccguggauggaggauaaaacaccaguaaccacuugggaaaauguucccuaccugggcaagcgagaggaccaguggugugguagccucaucggguuaaccucucgcgcaacaugggcccagaacauaccuacugcuauccagcaagugagaucacugauuggaaaugaggaguucuuggauuacaugcccaguaugaaacgguuuaggaaggaggaagaguccgaaggcgccaucugguga

SEQ ID NO: 15193 - RNA, 9873 nt, Artificial Sequence
  derived and/or modified CDS sequence (opt3) from DENV-3__JQ922557__SS-prME
acaagccugugccucaugaugauccuucccgccgcucuggcauuccacuugacauccagggacggagagccuaggaugauuguggggaagaacgagcggggaaaaucuuuacuguuuaagacugccucagguauaaauauguguacgcucaucgcgauggaucucggcgagaugugcgacgauacagucacauacaaauguccacauauuacugaaguugagccggaagacaucgauugcugguguaaccugaccaguacaugggugaccuaugggacuugcaaucaggcuggagagcaccgccgagacaagcguagcguggcccuugcaccccaugugggcaugggucuggauacaagaacccagacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaagguugucaggagccaccuggguggaugucgugcuggagcacgguggcugcgugacgacuauggcgaagaauaaacccacacuagacauugagcuccagaagaccgaagcaacucaacuggccacacuucggaaacuguguaucgaggggaagauuaccaacaucacgaccgauagccgcugcccuacacagggagaagcugucuugccagaggaacaggaccagaauuauguuuguaaacacacuuacguggaucgaggcugggguaacgggugcggacucuucggcaagggcagucugguaaccugcgccaaguuucaauguuuagagcccauagaggggaaagugguccaguaugaaaaucugaaguacacagugauuaucacuguucauaccggagaccagcaccagguggguaacgagacacaaggcgucaccgcagaaauuacuccucaggcuuccacgacagaggccauccucccagaauaugggacccuuggacuggagugcucuccgagaacuggcuuggacuucaaugagaugauccuacugaccaugaaaaacaaggcguggauggugcauaggcagugguuuuucgaucucccccugccuuggacaagcggugccaccacugaaacaccaacguggaaucggaaagagcuucugguaaccuuuaagaacgcacacgcuaaaaagcaagaaguuguggucuuggggucccaggagggcgccaugcacacugcucucacaggagccaccgaaauucaaaauucaggcgggacaaguauauucgcaggacaucugaagugucguuuaaaaauggacaagcuggagcuaaaagguaugagcuacgccaugugcacuaacaccuuugugcucaagaaagaggucucugaaacgcagcacggcaccauccugauuaagguggaguacaagggggaagaugcucccuguaaaaucccuuucuccacagaggacggacaaggcaaggcgcauaacggucgccuuauaacugcaaauccaguugugaccaaaaaggaggaacccguaaacauugaggccgaaccgccuuucggggagucaaauaucgucaucggcauuggagauaacgcuuugaaaaucaauugguauaagaagggcagcaguauugggaaaauguuugaagccacagcaagaggagccaggcggauggcuauacugggugacacugccugggauuucggcucuguaggcgggguucucaacucccuggggaagauggugcaccagaucuuugguagcgcauacaccgcgcuuuucucgggggucucuugggugaugaaaauuggcaucggaguacuguugacguggaucggccucaauuccaagaacacaucaaugaguuuuagcugcauugcuauagggaucauuacccuguauuuaggagccgugguucaggcagacaugggcugugucaucaauuggaaagguaaggagcugaagugcggguccggaauuuucgugacuaacgaggugcauacauggaccgaacaguacaaauuucaagccgauucucccaagcgacuagcuacugccaucgcaggcgcuugggagaauggugucuguggcauacgcagcaccacaagaauggaaaaccuccuguggaaacagaucgccaaugagcuuaacuauauuuugugggaaaauaacaucaagcugacgguuguggugggggacaccauuggaguacucgagcagggcaaaaggacucugacaccacagccuauggaguuaaaguacucauggaaaaccugggggaaggcgaagaucgucacagccgaaacucaaaacaguuccuucauaauugauggacccaauaccccagagugccccagcgcuucucgggcauggaacgugugggaaguugaggacuauggcuuugguguguucacgacaaauaucuggcugaaacuucgcgaagucuacacccagaugugugaccacagauugaugucagccgcugugaaggaugagagggccguucacgcagacaugggguacuggauugagagucagaaaaacggaagcuggaagcucgaaaaagcgucccugaucgaggugaagacuugcaccuggccuaagucucauacacuauggucgaauggcguacuggaaagcgauaugauaaucccaaaaucccucgccgguccgauuucacagcacaacuaucgucccggcuaccauacucaaaccgcugggccuuggcaccugggaaaacuugaguuggacuuuaauuauugcgagggcacaacggucgugaucaccgaaaacugugggacucggggaccaagucugcgaacaaccacugugucuggcaaauuaauucacgaguggugcuguagaagcugcacacuacccccucugagguacaugggugaagauggguguugguauggaauggagauccgcccaauauccgaaaaggaggagaauauggucaaaucacuuguuagcgccggcaagucuaagcgggacaacuccaccaugggugugcugugcuuggcaauucucuucgaagagguaaugagaggcaaauuugggaagaaacauaugaucgcuggaguguucuucacguuuguccugcuacugaguggccagaucacuuggagggauauggcccacacccucauuaugaucgggagcaaugcaucugaccgcaugggaaugggcgugacauaccuggcccuuauugcuaccuucaagauacagcccuuuuuggcgcuggguuucuuuuuacgaaaacucacuucccgggaaaaccugaugcuugggguuggacuggccauggcaacaacccuacaacucccggaggauaucgaacagauggcuaauggcauugcccugggcuugauggcccugaaguuaaucacacaguucgagacuuaucagcucuggaccgcucugauuucacuuacguguaguaacacaaucuuuacccugacuguggcauggcguaccgccacauugauacucgcgggggucagccugcuaccugugugccaaucguccucuaugagaaagacugacuggcugccaaugaccguugcugccaugggagugcccccucuuccccucuucaucuuuagccugaaagauacguugaagaggcgcucauggccacugaaugagggugucauggcaguaggcuuagugaguauucucgccuccucucugcuucggaacgacguuccuauggcugggccccugguggcaggaggcuugcucaucgccuguuacgucauuacagguaccagcgcggaucugacuguggaaaaagcugccgacguaacaugggaggaagaggcagaacagaccggggugucccauaaccuacugaucacugucgacgauaauggaacaaugagaauaaaggacgaugagaccgagauuauccuuacgguucuccugaaaacugccuugcagaucgugucaggcauuuucccauacagcauaccggcuaccuuacugguguggcacacauggcagaagcaaacccagaggaguggcguccucugggacgugccuucucccccagaaacacagaaagccgagcuggaagaggggguuuaucgaaucaagcagcaaggcauucuugguaagacucagguaggcguggggguccagaaagagggaguguuucauaccauguggcacguuacgcgcggcgcagugcugacacacaacgguaagcgguuggaacccaauugggcuuccgucaaaaaggaucuaaucagcuacgggggaggcuggagacugucggcccaauggcagaaaggcgaggaagugcagguaauugcggucgagccugggaagaacccaaagaauuuccagacuaugcccggaaccuuucaaacaaccacuggugaaaucggcgccauagcacucgacuucaaaccugggaccucaggaucuccgaucauuaacagggagggcaaggugguuggucuguaugggaauggaguggucaccaagaauggcgauuaccuuaguggcaucgcucagacgaaugccgagccauaugggcccuccccugacuuagaagaggaaauguucaagaaacguaagcugacuauuauggaucuccauccaggaagcggucagaccuugaaguaccugcccgcuaucgugcgcgacgcaauaaaacggagacucaggauucugauccuugccccuacacgaguuguggccgcugagauggaagaggcgcugaagggcuugccgauccgguaucagaccacugcaacaaaaucugagcacaccgggcgcgaaauugucgaucuaaugugccaugccacguuuacuaugagacugcucagccccgugaggguaccaaacuacaauuuaaucauaauggacgaggcucacuucacagauccugccuccauugcagcccggggauacaucucaacccgagugggcaugggugaagcugcggccauuuuuaugaccgcaacucccccagggacagcugacgccuucccucaaaguaacgcacccauccaggacgccgagagagauauaccagaacgcagcuggaacucuggaaacgaguggauuaccgacuuugcuggcaagacaguuugguucgucccguccaucaaagccggcaaugauaucgcgaacugucugaggaagaacgggaagaaagugauucagcuuucacguaagacuuuugagacggaauaucagaaaaccaagcugaaugacugggauuucguggucacaacugacaucagugagaugggagcaaacuuuaaagccgaucggguaauugacccuagaaggugccucaagcccgugauauugaccgaugguccaaagcgcguuauccuggcuggccccaugccugacacagccgcuagcgcagcccaacgaagagggcgggugggaaggaauccacagaaagaaaacgaucaguacauuuuccccggccagccucucaauaccgacgaggaccaugcucacuggccggagacuaagcugcuuauggaucuauuuacgaccccagaagguauccugcccucccacuucgacccucauggggagaacuuccccgaaaucucuggcgaguaucgcuugaaaggagaaucgcguaagacauuugucgaguuaaugagacggggcgaucugccaguguggcucgcccacaaaguugcaagcgaggggauuaaguacacugacaggaaauggugcuucgauggacaacgcaauaaccagauacuggaagagaauauggacguggaaaucuggaccaaggagggugaaaagaagaaacuucgaccuagauggcuggaugcgcggacauauucagacccccucgccuugaaagaguuuaaagauuucgcugccggcaggaaauccauugcacuggaccuagucaccgagaucgggcgcgugccaagucaucuggcucacagaacuaggaacgcccucgauaaucuuguaaugcugcacacaucugaacauggaggccgggcauaccgucacgccguggaggaauuaccugagacgauggaaaccuugcugcuccugggucuuaugauucugcucacugggggcgcuauguuguuucugaucagcggaaagggcauagggaagacauccaucggauuaauuuguguuaucgcgucaucugguaugcuauggauggccgagauuccgcugcaguggaucgcaagcgcuauaguccucgaguucuuuaugauggugcuucugauucccgaaccagagaaacaacgcaccccucaggacaaccaguuggccuauguggucaucggcauucugacccucgccgcaaucauagcugccaaugaaauggggcugcuugagacaacuaagcgagaucucggaaugaguaaagagcccggcguuguguccccaacgagcuaccuggacguagacucucauccugcgucagcuuggaccuuguacgccguggcaacaacugucaucacccccaugcugagacacacaauugaaaacuccaccgccaaugugaguuuagcugcaaucgccaaccaggcgguugugcuaaugggucuggauaagggguggccgauuagcaaaauggaccucggcgucccacuucuggcuuugggaugcuauucgcaaguaaauccucugacucucacggccgcagugcugcuuuuaaucacacauuacgccauaauuggccccgggcugcaggcuaaggccaccagggaggcacagaagcggacugcugccggaaucaugaaaaacccaaccguugauggcaucauuacaaucgaccucgaucccgugauauaugacucuaaguucgaaaaacaguugggucaagucaugcugcuagugcugugugcgguccagcuccuucugaugcgcacuuccugggccuugugcgaggcacugacccucgcuacagggccuaugacgacccugugggaaggaagcccgggcaagauuuggaacacuacaaucgccgugucaauggcaaauauuuuuagagguaguuacuuagcuggcgccgggcuugccuucucuaucaugaaauccguuggaaccggcaagagggggacuggaagccagggcgagacacugggugagaaguggaaaaagaaacucaaccagcuaucacggaaggaauuugaucuguauaaaaagagugggauaaccgagguggaccgaacggaagcgaaagagggauugaagagaggcgaaaccacacaccacgcuguaagccgcgguuccgcaaagcugcaaugguucguggagaggaauauggucauccccgagggccggguuauugaucucggguguggacguggcggguggucuuacuauugcgccggacuuaaaaaggugacugaagucagaggcuacaccaaaggugggccaggacaugaggaaccugugcccaugagcacauacggcuggaacaucguaaagcugauguccggcaaagacguguuuuauuugccuccagagaagugugauacucugcucugcgacauuggggaaucaucucccaguccuaccguugaggagucgaggacaauccgcguguuaaagauggucgaaccauggcugaaaaauaaccaguucuguauuaaggugcuuaaucccuacaugccggcugucaucgagcaccuggaacggcuacagcgaaaacauggagguaugcucgugagaaacccucugagcagaaauuccacccacgagaugcacuggauaucuaacggcacugggaauauuguuucaagcguaaacauggugucccgcuugcugcucaaucgguucacgaugacacauagacguccaaccaucgagaaggaugucgaccuuggagccggcacuaggcacgugaacgcagaacccgagaccccuaauauggacguuaucggugaacggauuaaacgcauaaaggaggaacauaacaguacauggcacuaugaugacgagaacccauacaagacgugggccuaucaugggucuuacgaggugaaagcuaccggaagcgcgucauccaugaucaauggcgucgugaagcuguuaacuaaacccugggauguagugccgaugguuacacaaauggccaugaccgacacuacaccuuuuggccagcagcgagucuucaaggaaaaaguggauaccagaacacccaggccaaugccugggacucggaaggugauggagauuaccgcagaauggcuguggcgcacguugggaagaaacaagaggccccgacucugcacccgggaggaauuuaccaagaagguccguacuaaugcugccaugggugcaguuuucaccgaggagaaccagugggacagugccaaagcugccguggaagaugaggaauuuuggaagcugguagacagagagcgcgaacuacacaaacuuggcaagugugggagcugcguguauaauaugaugggaaaaagggagaagaagcugggcgaguucgguaaagcgaaggggucucgggcaaucugguacauguggcucggagccagauaccuggaauuugaggcuuugggcuuccugaacgaagaucacugguuuucccgcgaaaauucauauagcggcgucgagggggaaggacuccauaaacuugguuacauucugagggacaucucgaagauaccaggcggggccauguaugcagaugacacagcuggaugggacacucgaaucaccgaggaugacuuacacaacgaagagaaaauuacgcaacagauggaucccgaacaucggcuguuggccaaugcuaucuucaagcucacauaccagaacaaggugguuaaagugcagagaccuaccccaacuggcacagucauggacauuaucucuaggaaggaucaacgcgguaguggacaggugggaaccuauggccugaauacuuuuaccaacauggaggcccagcuaguacgucagauggagggcgaagggguucuuuccaaagcagaccuggagaauccgcaccuccccgaaaagaaaauaacacaauggcuggagacgaagggaguggaacgguugaagagaauggcgauuagcggugaugacugcgucgugaaaccuaucgaugacagguucgccaacgcuuuacuggcccucaaugauaugggcaaggugcgcaaagacaucccacaguggcagcccucaaagggguggcacgauuggcagcaagucccuuuuuguucccaucacuuccaugagcuuauuaugaaagacggacgaaagcugguugugccaugccggccccaggacgagcuaauaggcagagcaaggaucucucagggugcuggguggagccugcgcgaaaccgccugucucggaaaggcauacgcccaaauguggaguuugauguauuuccacagacgggaucugaggcuugcguccaacgcuauuugcagcgccguaccugugcauugggucccgacuucucguacaaccuggucaauccacgcacaccaucaguggaugacuacagaggacaugcugaccguguggaaccgaguuuggauugaagauaauccauggauggaggacaaaacgcccgugacaaccugggaaaacccucccuaccucggcaagcgcgaggaucagugguguggcaguaucauaggguuauccagcagagccacuugggcucagaauaucccaaccgccauucaacagguccggucucugaucggaaacgaggaauuuuuggacuacaugccuucgaugaaaagguuccgcaaggaggaagagucagagggugcaauuugguga

SEQ ID NO: 15194 - RNA, 9873 nt, Artificial Sequence
  derived and/or modified CDS sequence (opt3) from DENV-3__JQ922555__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagaguccauagagggaaaagugguccaguaugaaaaucugaaguacacagugauuaucacuguucauaccggugaccagcaccaggugggcaacgagacacaaggggucaccgcagaaauuacuccccaggcuucuacggccgaggcgauccucccugaauauggaacacuuggccuggagugcagcccacgaaccgguuuggacuucaaugagaugauccuacugacuaugaaaaacaaggccuggauggggcauagacagaugcucuuugaucugccgacccccuggacauccggcaccacuacagaaacgucagcauggaauaggaaagagccuuucgugaccuuuaagaacgcucacacuaaaaagcaagaaguaguugugcuuggaagucaggagggcgccaugcacacagcucugaccggggccacagaaauucagaauagcggagguacuucuauauucgcaggccauuugaagugucggcucaaaauggacaagcuggaguuaaaagggauguccuacgccaugugcaccaacacguuuguccugaagaaagaggugucagaaacccagcacggaacaauccuagucaagguggaguacaagggcgaagaugcuccauguaaaauucccuucagcacugaggacggucaagggaaggcgcauaacggccgucucaucaccgcaaauccuguugugacaaaaaaggaggaaccaguaaacauagaggccgaacccccguucggagagaguaauauugucaucggcaucggggauaaagcucugaagauuaacugguaucgcaagggaucuuccaucgguaaaauguuugaagccacuagcagaggcgcaaggcggauggccauucuuggggacaccgcuugggauuucggaucggugggcgguguuuugaauucucuggggaagauggugcaccagauauuuggcuccgccuacacggcacucuucucaggagucaguugggugaugaaaaucggcauugggguacugcuuacauggaucggacugaacagcaagaauaccuccaugucuuuuagcugcaucgcgauuggcauaaucacuuuguaucucggugcugugguucaggccgacauggggugugucauuaacuggaaaggaaaggagcugaagugcggcucagguaucuucgugacaaaugaggugcauaccuggacugaacaguacaaauuucaagcagauaguccuaagcgauuagccaccgcuauugccggcgcaugggagaacggggucuguggaauccgcuccacaacgagaauggaaaaucugcuauggaaacagauagcuaacgagcucaauuauauccugugggaaaacaauauuaagcuuaccguuguggugggcgacacuaucgggguauuggagcagggaaaaaggacacugaccccccagccaauggagcucaaguacagcuggaaaacauggggcaaggccaagauugucacugcggaaacccaaaacucuucauucaucauagaugguccuaacacgcccgagugcccaagugccagccgggcuuggaaugugugggaaguugaggacuauggguuuggaguguucacaaccaacauuuggcugaaauuacgcgaagucuacacucagaucugugaccacagacugauguccgcagccgugaaggaugagagggcuguucacgccgacaugggcuacuggauugagucucagaaaaaugguucguggaagcuugaaaaagcaagcuugaucgaggugaagaccuccacauggcccaagucacauacucucuggaguaacggcguacaggaaucugauaugauaaucccuaaaagccuggcggggccaauuucccaacacaauuaucguccgggauaccauacccagacagccggccccuggcaccuagggaagcuggagcucgacuuuaacuauugcgagggaacgaccgucgugaucacugaaaauugcggcacacgggguccuucacugcgaaccacuacagugagcgggaaacuuauucacgagugguguugcagaucuuguaccuugccaccccugagguacaugggagaagauggcugcugguaugguauggagauccgcccuauauccgaaaaggaggagaacauggucaaaaguuuagcuagcgccggcucugggaagguugacaauuucacgaugggagugcucugucuggcaauucuuuuugaagagguaaugcggggcaaguucgggaaaaagcauaugaucgcuggagugcuguucacuuuugucuugcuccuguccggccagaucaccuggagagauauggccaggacacuaauuaugaucgguucaaacgcaagugaccgcauggggaugggagugaccuaccuggcccucauugcuacuuucaaaauacaaccauuucuggcgcuuggcuucuuuuugcgaaagcugacaagccgggaaaauuuacuccugggcguugggcuugccauggcaaccacacugcagcuacccgaggauaucgaacagauggcuaacggaauugcccucggucugauggccuugaaacugaucacucaguucgagaccuaucaauuauggacggcucucgugucgcugacaugcuccaauaccauuuuuacucuuaccgucgcauggcguacagccacucugaucuuggcgggcgugucucuccugccgguuugucagagcucaaguaugagaaagaccgacuggcuaccuaugacgguggcugccaugggggucccaccccugccucuuuucauauuuucccucaaggauacacugaaaaggcgcucuuggcccuugaacgagggaguaauggcagugggccugguuagcaucuuagccuccucacuccugcggaauggugugccaauggcugggccucuugucgcaggaggccuguugauugccugcuacgugaucaccggcacuagcgcggaccucacaguagaaaaggcugccgaugugaccugggaggaagaggcagaacagacuggggucagucacaaccugaugauuacaguugacgacgauggaaccaugagaaucaaagacgaugagacggagaacauacuaacugugcugcuuaagaccgcccuccugauugugucugguaucuuccccuacuccaucccagcuacauuguuagucuggcauaccuggcagaaacaaacacagaggagcggcgugcugugggacguuccgucgccucccgaaacucagaaggccgagcucgaagaggggguauaucgaauuaaacagcaaggaauauuuggcaagacccaggugggugucggggugcagaaggagggaguuuuccacacgauguggcaugugacacgcggcgcaguccugacucacaauggcaaacggcuugaaccaaacugggcuucagugaagaaagaucugaucucuuacgggggagguuggagauugagugcccaauggcagaagggcgaggaaguacaggucauugcgguggagcccgggaaaaauccuaagaacuuucagaccaugccaggaacauuccaaaccacuuccggcgaaaucggugccauugcacuagacuucaagcccgggaccagcggaucuccuaucauaaauagggagggcaaaguugugggccuguaugggaacggagucgugacaaagaaugguggcuacguuagcgggaucgcucagacgaacgccgagccggauggaccaacucccgaacucgaggaagagauguuuaaaaagcguaaucugaccauuauggaccuucacccuggcuccgguaaaacacgcaaguauuuaccagcuaucgugcgggaagcaauuaagagaaggcugcgaacccucaucuuggcccccacucgggucguggccgcugagauggaggaagcgcugaaagggcucccuauacgcuaccagacaaccgcaacgaagucagagcauacuggaagagaaauuguagaucugaugugucacgccacauucaccaugaggcuucugaguccggugcggguucccaacuauaauuugaucaucauggacgaggcucauuuuaccgauccagccagcauugcagcccgaggcuacaucucuacuagagucggcaugggggaagcugcggccauauucaugacagcaaccccucccggaacagcugacgccuuuccacaguccaacgcaccuauucaagaugaggagcgcgacauccccgaaaggucauggaauagugguaacgaguggauuacugacuucgccggcaaaacggugugguuugugccaagcaucaaggcugggaaugauauagccaacugccuacguaaaaacggaaagaaggucauucagcugucccggaaaaccuucgacacagaauaccagaagacuaaacucaaugauugggacuuuguagugaccacagauaucucugagaugggcgcgaacuucaaggcagacagaguuaucgauccgaggcgcuguuuaaaaccugugauucugaccgacggucccgagcgagucauccuugccgggccaaugcccgugacugcugccucggcugcacagagacggggcaggguuggacgcaauccucaaaaggaaaacgaucaguauauuuuuacgggccagccacugaauaacgacgaggaucacgcccauuggaccgacgcuaagaugcucuuggaaaauauaaacacacccgaggggaucauuccugcccuguucgaaccggagcgugagaaaagcgcaggacucgacggugaauacagacugaagggcgagucacggaaaacuuucguggaacuuaugaggcgcggggaucuaccagucuggcuggcgcacaagguggccuccgagggaaucuuguauaccgaccgaaaauggugcuuugauggccagagaaauaaccaaaucuuagaagagaauauggacguagagauuuggacaaaggaaggugagaaaaagaagcugcggcccagguggcucgaugcucgcaccuacagugacccucuggcccuuaaagaauucaaggauuuugcagcugggagaaaaucuauagcccuggaccucgugacugagaucggcaggguuagcucccacuuggcacaucggacacguaacgcccuggauaauaagaugaugcuacacacgucagaauauggaggccgcgcuuaccgacaugcggucgaggagcugcccgaaaccauggagacucuccuucuguuaggguugaugauucugcucacaggaggugccaugcuguuccuuaucucuggcaaagggauuggaaagaccagcaucggccugauaugcgugaucgcaaguuccgguaugcucuggauggcugacgugccauugcaguggauugccagcgccaucguccuggaauuuuucaugaugguuuuacuaauuccugagcccgagaagcagagaaccccacaagauaaccagcuggcauaugugguaaucgggauacucacacuugcugccauuaucgcggcuaaugaaaugggccuguuggagacuacgaaaagggaccugggagugucuaaggaaccuggcgucgugucaccgaccuccuaccucgauguugaccugcaccccgccagugcauggacacuuuacgccguggcuacuaccgucauugcaccaaugcuccggcacacaaucgagaacagcaccgccaauguaucgauggcggcuauagccaaccaggcagugguucugaugggguuggacaaaggauggccuaucucuaagauggaucugggcgugcccuuacuagcccuggguuguuauuuuuacgucaacccacucacucuuacggcugccguguuccuguuggucacacauuaugcaauuaucgggccuggacugcaggcuaaagccacccgcgaagcgcacaagaagacugccgcaggcauuaugaaucccccgccaggugacggcaucaugaccauagaucucgacccugugauuuacgauuccaaauuugagaagcaacuggggcagguuaugcuuuuagugcugugcgcuguacagcucuugcugaugagaacaagcugggcccuaugugaggcacugacucucgcuaccggacccacaacgacccuuugggaaggcucaccagggaaauucuggaacacuacaaucgccgugaguauggccaauaucuuuaggggaucuuaucuggcgggcgcugguuuggcauucuccauuaugaagagcgucgggaccggaaaacggggcacugguucacagggcgagacacugggggaaaaguggaagaaaaagcucaaccaacugagucgaaaagaguuugacuuauacaagaaaagcggaaucaccgaaguugauagaacggaggccaaggagggccuuaaacgcggggaaauaacccaucacgcuguguccaggggaucugccaagcugcagugguucgucgagcggaauauggugauucccgaaggccguguaaucgaccucgguugcgggaagggaggcuggagcuauuacugugcaggccuaaaaaaggugacagagguuagaggguacacuaaaggagguccuggccaugaagagccggugcccauguccaccuauggguggaacauugucaagcugaugucaggaaaagauguguucuacuugccaccugagaagugcgacacacugcucugugauaucggcgaaucuagucccucgccuacugucgaggaaagcaggaccauacgcgugcuuaagaugguugagccauggcugaaaaauaaccaguuuugcaucaagguauugaaucccuauaugccuacagugauugagcaccuggaacggcuccagcgaaaacacggugggauguuagucagaaacccacuguccaggaauucucgcaacgagauguacuggaucucaaauggaaccggcaacauugugagcuccguuaauauggugagucggcuucugcuaaacagauucacuaugacgcaucguaggcccacaaucgaaaaggacgucgaucucggcgccgggacccggcacgugaacgcugagccggaaacuccuaauauggacguaauuggagagcgcaucaaacgaauaaaggaggaacauaacucuaccuggcacuaugacgaugagaauccauacaagacaugggcguaucacgguagcuacgaagugaaagccacgggcucagcauccaguaugauuaacgggguugucaagcuguugaccaaacccugggacguggugccuauggucacucaaauggcuaugacagauaccacuccauuuggacagcagagaguuuucaaggagaaaguggacacaaggaccccccggcugaugccgcgcacaagaaagguaauggaaaucacugccgaguggcucuggaggacccuuggccgaaauaagcggccucgucuguguacgagagaggaauuuaccaaaaaggugcgccccaucgcagccaugggugcugucuucacacaaagggaucagugggacagcgccaaagcggcaguggaggaugaagaguuuuggaagccaguugaccgggaaugcaacucucaucaguuagggaaauguggauccugcguguacaauaugaugggcaagagagagaaaaagcugggcgaguucgggaaggccaaaggaucacgcgcuauuugguauaugugguugggugccagguaccucgaauuugaggcacugggcuuccuaaacgaagaucacugguuuagccgagagaauucguauucuggggucgagggagaaggccuucauaagcuggguuacauacuccgggacaucaguaaaauuccugggggagcuauguaugccgaugacacugcuggcugggacaccagaaacacagaggaugaccugcacaugaaggaaaaaaucacucagcaaaugggccccgggcauuccagguuggccaaugcaauuuucaagcugaccuaccagaacaaggugguaaaaguucagcgcccaacgcccacaggaaccgugauggauaucauaagccguaaggaccagcgggguucaggccaagucgggacuuauggacucaauacauuuaccaacauggaggcgcagcuugugagacagauggaaggcgagggugugcuguccaaagccgauuuagagaauccucaccuguuggaaaagaaaaucacucaguggcucgagaccaagggggucgaaaggcugaagcgcauggcuauuucuggagacgauugcguugugaaaccaaucgacgaucgauucgccaacgcacuacuugcucugaacgacaugggcaagguacggaaagauauuccgcaauggcagcccagcaagggcuggcacgacuggcagcaggugccuuucuguagucaucacuuucaugagcucaucaugaaagaugggagaaagcuggucgugccaugcaggccccaagacgaauugauaggacgcgccagaauuucccagggugcaggcuggagcuuacgggagacagccugucuggggaaggcguacgcucagauguggucucucauguacuuccacaggcgugaccuucgacuggccucaaaugcaaucugcagugccguuccugugcacugggucccaacgucccgcaccacuuggagcauccaugcucaccaucaauggaugacaaccgaggauaugcuaacuguguggaacagaguauggauugaagacaaucccuggauggaggauaaaacaccuguuaccacgugggaaaacgugccguaucugggaaagcgggaggaccagugguguggcucucucauagguuugacaucgagggccaccugggcacagaauaucccaacugcuauucagcaaguccgcucacugaucgggaacgaagaguuucuugauuacaugcccagcaugaaaagauuccggaaggaggaagaguccgaaggagccauuugguga

SEQ ID NO: 15195 - RNA, 9873 nt, Artificial Sequence
  derived and/or modified CDS sequence (opt3) from DENV-3__GU131903__SS-prME
accagccugugccucaugaugaugcuuccagccacacuggcuuuccacuugacuuccagagacggagaaccuaggaugaucguggggaagaacgaacggggaaaaucuuuacuguuuaagacggcaucagguauuaauauguguacccuaauagccauggaucucggcgagaugugcgacgauacaguaacuuacaaauguccacugaucgcggaaguugagccggaagacauugauugcugguguaaccuuaccaguacaugggugaccuaugggacuugcaaucaggcuggagagcaucgccgagacaagcguagcguagcccuggcaccccacgugggcauggguuuggauacaagaacccaaacguggauguccgccgagggggcuuggaggcaggucgaaaaaguggagacuugggcacuccggcauccuggauucaccauccuggcccuguuucucgcucacuacauuggcacaucuuuaacucagaagguugugaucuucauacugcuuauguuggucaccccaucgaugacaaugcgcugugugggcguagggaacagagacuuuguugaaggacugucaggugccaccuggguggaugucgugcuagagcauggcgggugcgugacgacuauggcaaagagcaaacccacacucgacaucgagcugcagaagaccgaagcaacucaacuugccacacugaggaaauuguguauugagggaaagaucaccaauauuacgaccgauagucggugcccuacacagggcgaagcuacucucccagaggaacaggaccagaacuaugucuguaaacacaccuacguugaucgcgguugggggaauggaugcggccuguucggcaagggguccuuagugacaugcgccaaguuucaaugucuggagcccaucgagggaaaaguagugcagcacgaaaaccucaaguauacugucauaauuaccgugcauacaggugaccagcaccagguuggcaaugacacccaaggggugacugucgagaucacgccucaggcaucuacaguggaagcuguacuuccagaguacggaacccugggcuuggaaugcagcccgcgaacuggucuagauuucaacgagaugauucugcucaccaugaaaaauaaggccuggaugguucauagacagugguuuuucgaccugccccuuccuuggacauccggggcgaccacugagacaccaacguggaacaggaaagaacuguuggugaccuuuaagaaugcccacgccaagaagcaagaggucgugguccucggcucacaggaaggagcuaugcacacugcccugacaggcgcuaccgagauccagaacagugggggaacaagcaucuucgccggucauuuaaagugucggcugaaaauggauaagcuagaacucaaaggcaugucuuaugcaaugugccugaauacuuuugugcuuaagaaagagguuuccgagacccagcacgggacgauuuugauaaagguggaauacaagggagaggacgcccccuguaaaaucccuuucucaaccgaagauggccaagguaaggcucauagcgggcgucugauuacagcgaacccaguagucacuaaaaaggaggagcccgugaacaucgaagcagagccgccuuucggcgaaaguaauauaguuauuggaaucggcgacaaagcccucaagaucaacugguacaagaaagggucuuccauuggaaagauguuugaggcuaccgcccgcggugcaagaaggauggccauccugggcgauacagcuugggacuucgggagcgugggaggcguccuuaauucgcuggguaaaauggugcaccagauuuuugggucugccuauacugcauuguucuccggcguaucauggauaaugaagaucggaauuggcgugcuccugaccuggaucggguuaaacaguaaaaauacgagcauguccuuuucuugcaucguuauuggaauaaucacacuguaccuaggcgcggucgugcaggcugauauggguugugugauuaacuggaaggggaaggaacucaaaugcggaagcggcaucuucgucaccaaugagguucauacuuggacagagcaguauaaguuucaagccgacucacccaaacggcuggcaaccgccauugcuggugccugggaaaacggcgugugugggauccgaaguacuacccgcauggagaaucuuuuguggaagcagauagcaaacgaacugaauuacauccucugggagaacaauauuaaacugacagugguagucggagauaucauuggcguguuagaacaggggaagagaacgcugaccccacagccuauggagcuuaaauauuccuggaagacuuggggaaaggcuaaaaucguuacagccgagacccaaaacagcucuuucauaauugacggccccaauacaccagaaugccccaacgcgucaagggccuggaacgugugggaggucgaagacuacgguuuugggguguucacuaccaauaucugguugaagcuccgggagguuuauacgcagaguugugaucaccgccugaugagcgcugcaauuaaagacgaaagagccgugcacgcugauaugggauacuggaucgagucccagaagaacggcucuuggaaacuagagaaggccucguuuauagaaguaaagacaugcaccuggccuaaaagccauacucugugguccaaugguguccucgagucagacaugaucauuccaaagagucuggcaggcccgaucucucagcacaaccauaggcccggguaccacacccaaacagcgggaccuuggcaccuuggcaaauuggaacuggauuucaauuauugcgaggggacuaccguggugauuacagagaacuguggaacgcguggccccagcuuacggaccacuacagucuccgguaagcucauccaugaauggugcugucgaucaugcacccugcccccucuuagauacaugggggaggacggauguugguauggcauggaaauaaggccaauuaaugagaaagaagagaacaugguuaagagccuggugucugccgguuccggcaagguagauaauuuuacuauggggguguugugccucgcuauccuguucgaggaagucaugcgcggaaaauucggcaagaaacacaugaucgccggggugcuauuuacauucguucugcuccugaguggacagauuaccuggcgggacauggcacauacgcuuaucaugauuggcagcaacgcuucugauagaauggguaugggggugacuuacuuggcccugauagcaaccuuuaagauccagcccuucuuagcccucggauuuuuccugaggaaacuuacaucccgcgagaaucugcuacucggcgucggccuggcuauggcgaccacuuugcaacugccggaagacauugagcagauggccaacgggaucgcauuaggacucaugacacugaaacuuauuacccaguuugaaacauaucagcuguggacugcuuuggugucacucaccuguaguaauacgaucuucacacugaccguugccuggcgaacugccacccuaauacuggcuggugugagccuucucccucugugccaaucguccucuaugcggaagacagauugguugccaaugacugucgcagccaugggcguacccccucugcccuuauuuaucuucagccucaaagacaccccaaagcguagaucauggccucugaacgagggggugauggcgguuggacuugugaguauucuggcuuccucuuugcucaggaaugauguccccauggccggcccacugguggcgggugggcuacugaucgccuguuacguaauuacgggaacaagcgcugaccuuaccguggagaaagcagccgacgucacuugggaagaggaagcggagcagacaggcguuucccacaaccucaugaucaccguggaugacgauggcacuaugcgcauaaaggacgaugaaacagagaacauucugaccguguuguuaaaaacggcucugcucaucgucucagggaucuuuccguauagcauuccugccacucugcuuguguggcauaccuggcagaagcagacacaacggaguggaguucugugggacguacccucuccacccgagacccagaaagcagaauuggaggaagguguguacagaauaaagcagcagggcaucuucgggaagacacaagucggagugggcguucagaaagaggguguguuucacacuauguggcacgucacccgaggggcagugcuaacgcauaauggaaagaggcuggagccuaacugggcuuccgucaaaaaggaucucauuagcuacggcggcggguggcgccugaaugcccaguggcaaaaaggagaagagguccaggugaucgcaguugaaccagguaagaaccccaagaauuuccagacaaugccuggcauuuuccagacuaccacaggggagaucggagcuauagcccuugacuuuaaaccgggcaccucggguucaccaaucauuaaccgggaagggaagguggucggauuauauggcaauggcgugguuacuaaaaacgggggauacgugucugguaucgcgcaaaccaaugccgagcccgauggcccuacaccagagcuggaagaggaaauguucaagaaaagaaaccucacgauuauggacuugcaccccgggaguggaaagacuaggaaguaucugccugcaaucguccgugaggcuauaaaacgccggcucagaacccugauucuugccccgacaagggugguagcugcagaaauggaggaggcccugaagggcuugcccauccgauaccagaccacugccacaaaauccgaacauaccggucgggagaucguggaucuaaugugccacgcuacguuuacuaugcgccugcucagcccaguuagagucccuaauuauaacuuagugauuauggacgaagcgcauuucacagaucccgcaucuaucgccgcuaggggguacauaagcacccgggugggaaugggcgaggccgcagccauuuuuaugaccgcuacuccaccuggcacagcggaagccuucccccaguccaaugcaccaauccaggacgaggagcgagacauuccggaaagaucauggaacagugggaaugaguggaucaccgauuuugucggaaagacaguaugguucgugccuagcauaaaagcugguaacgacauugccaacugucugcgcaagaauggcaagaaaguuauccaacuuucuaggaagacuuuugauacggaauaucagaaaacccgucugaacgacugggauuucguggucacaacugacaucuccgagaugggggcaaauuuuaaggccgaucgggugauugaccccagaaggugccucaaaccaguuaucuugaccgauggacccgagcgcgugauucuggcuggcccuaugccagucacagccgcgucagcagcccagcgaagaggucggguggggaggaacccccagaaggaaaaugaccaauacauauucaccggccagccucucaacaaugaugaggaccacgcucacuggacugaagccaagaugcugcuugacaacaucaauacgccggagggaauuaucccagcucuauucgaacccgagcgcgagaaaagugcagccaucgauggcgaauaccgucugaagggggagagcagaaaaaccuuuguagaauugaugcggaggggagacuuaccuguguggcuggcucauaagguugccuccgaggguauuaaauauacagaucgcaaguggugcuucgacggcgaacgaaacaaucagauacucgaggagaacauggaugucgaaaucuggacuaaagagggggaaagaaagaagcugcggcccagguggcuugacgcacgcaccuacucugauccacuggcgcucaaagaguuuaaggacuucgccgcuggaagaaaaucgauugccuuggaucuggugacagaaaucggcagggugccuagccaccuagcacaucggacccguaaugcucuggacaaccucgucaugcuucacacuucagagcacggugggcgcgccuaucgacaugcaguugaggaacugcccgagacaauggaaacguuauugcugcucggccugaugauucuucugaccggaggcgccaugcucuuuuugaucuccgggaagggaauagguaaaacaaguaucggccugauuugugugaucguaucuagcgggauguuauggauggcugaugugccacuacaguggauugcguccgccaucguccuggaguucuuuaugauggugcuccuuauaccugagccggaaaagcaaagaacaccccaggacaaucagcuggcauacguugugauuggaaucuugacccuggcugccauugucgccgcaaacgagaugggccuccuggaaaccacaaagagggaucuugguaugucaaaagagccagggguagugucuccuacuagcuaucucgacguugaccugcaccccgcuagugccuggacguuguacgcgguggcuaccacagucaucacuccaaugcugcggcauaccauagaaaauuccacagccaacgugagcuuagcagccaucgcuaaccaagcagucgugcuaaugggccuggauaagggauggccuauuucuaaaauggaccucggcguuccccuucuggccuuggggugcuauucacaggugaauccgcugacccucacugcggcuguacugcuuuuagugacgcacuacgccaucauuggaccaggccugcaggcaaaggccacacgcgaggcucagaaaagaaccgccgcagguaucaugaagaacccuacugucgaugggauaaugaccauugaccucgaucccguuaucuacgacuccaaguucgagaaacaauugggacaggugaugcugcuaguccugugugcugugcagcuccuucugaugaggacaaguugggccuugugcgaagcgcugacucucgccaccggcccaaucacaacgcugugggaggguagccccggcaaguuuuggaauaccacuauugcaguaucgauggcuaacaucuuccgggggucuuauuuagccggagcaggccuugcuuuuuccauaaugaaaagcguggggacaggacgaagaggcaccgguucacagggggaaacucugggagagaaguggaaaaagaagcucaaucaacuaagucgcaaagaguucgaucuguacaagaaaucuggcauuacagagguugacaggaccgaggccaaggaagguuugaaacggggcgagacgacccaucacgccgugucccgugggagcgcgaagcugcagugguuugucgaaagaaacauggugaucccugagggaagggucauugaucucggcugugggcgcggaggcuggucauauuacugcgcuggucuuaaaaaggugacagaaguucggggguauacuaaggcaggaccgggccacgaggagcccguaccaaugaguaccuacggcuggaauaucgugaaacugaugagcgggaaggacgucuucuauuugccucccgaaaaaugugauacacugcucugcgacauaggagaguccucuccuagcccaacuguggaagagucccgaaccaucagaguuuuaaagaugguggagcccuggcugaggaacaaucaguucuguauuaaaguccuuaacccuuacauggccacagguaucgaacaucuggagcgccuacagcggaaguacggcgggaugcucgugagaaauccacugucacguaacucuacccacgaaauggauuggauuaguaauggaacuggcaacaucguaucgagcgugaauaugguuuccagguugcugcucaaccgguuuacgaugacacaucgccgacccaccauugagaaggacgucgaccuuggugcugggacuagacacgugaacgccgaaccggagaccccuaauauggaugugaucggagagaggauaaaacggauuaaggaagaacacucuucaacauggcauuaugacgaugaaaacccauacaaaacgugggcauaucacggcagcuacgaggucaaggccaccggcuccgcuaguucuaugaucaaugggguugugaaacuguuaacuaagcccugggacguagugccuauggucacacaaauggcgaugaccgauacuacaccauucggacagcagcgcguguuuaaggaaaaaguugacaccagaacacccaggccgaugccugguacucgaaaggugauggagaucaccgccgaguggcuguggcggacguugggccguaacaaaaagcccagacucugcacccgcgaagaguucacuaaaaaggucaggacuaaugcagcuaugggggccguguuuaccgaagagaaccaaugggauagcgcacgggccgcuguagaagacgaggaguucuggaagcugguugauagagaacgcgagcuacauaaacuuggaaaguguggcucaugcguguauaauaugauggguaaaagggaaaagaaacugggggaguuuggaaaggccaaaggcucccgagcgauuugguacauguggcucggcgcacgguaucuggaguucgaagccuugggguuucugaacgaggaccacugguucaguagagaaaauagcuacucuggagucgagggugaaggccuccauaaacuuggguacauacugagggauaucuccaagauuccaggaggcgcuauguaugccgacgacacagcagguugggauacucgcaucaccgaggacgauuuacacaacgaggagaagauuacgcagcagauggacccugagcaccgucagcuggcuaaugccaucuuuaaguugacauaccaaaacaaaguggugaagguccagcggcccaccccaaaagggacuguuauggauauaaucucaagaaaggaccagaggggaagcggccaggugggcacauaugggcucaauaccuucacuaacauggaagcucaacugguacgccagauggagggagaaggugugcuaucgaaggccgaucuugagaauccccaucugcucgagaaaaagauuacccaguggcuggaaacaaaaggcgucgagcgauugaagcggauggcaaucucuggggacgauugcgugguuaaaccuauugacgauagauuugcgaacgccuuacuggcucucaacgacaugggaaaggugaggaaggauaucccacaguggcaaccgaguaaaggcuggcacgacuggcagcagguccccuucuguucccaucacuuccacgaacuuauaaugaaggacggucgcaaacuggugguaccuugcagaccacaggaugagcuaauugggcgggccaggaucagccaaggagcaggcuggucacugaaggaaacggcuugucucggcaaagccuacgcacagaugugguccuugauguauuuucaucgucgagaccugcgccuugccucuaaugcgaucugcagcgcuguucccgugcacuggauuccuaccaguagaacuacaugguccauacaugcccaccaucaguggaugaccacugaggauaugcugacagucuggaaccggguguggaucgaggacaauccauggauggaagauaagacccccguuacgacaugggaggacgugccuuaccucgggaagagggaagaucaaugguguggcagcuuaauuggucugaccucucgcgcaacuugggcccagaacaucuugaccgcuauucagcaggucagaucacugaucggcgacgaggaguuccucgauuauaugccgaguaugaaacgguuuaggaaggaagaggaauccgagggggccauaugguga

SEQ ID NO: 15196 - RNA, 9873 nt, Artificial Sequence
  derived and/or modified CDS sequence (opt3) from DENV-3__GU131904__SS-prME
accagccugugccucaugaugaugcuucccgccacucuggcuuuccacuugacuuccagagacggcgaaccuaggaugaucguggggaagaacgaacggggaaaaucuuuacuguuuaagacggcaucagguauuaauauguguacccuaauagccauggaucucggcgagaugugcgacgauacaguaacuuacaaauguccacugaucgcggaaguugagccggaagacauugauugcugguguaaccuuaccaguacaugggugaccuaugggacuugcaaucaggcuggagagcaccgccgagacaagcguagcguagcccuggcaccccacgugggcauggguuuggauacaagaacccaaacguggauguccgccgagggggcuuggaggcaggucgaaaaaguggagacuugggcacuccggcauccuggauucaccauccuggcccuguuucucgcucacuacauuggcacaucuuuaacucagaagguugugaucuucauacugcuuauguuggucaccccaucgaugacaaugcgcugugugggcguagggaacagagacuuuguugaaggacugucaggugccaccuggguggaugucgugcuagagcauggcgggugcgugacgacuauggcaaagagcaaacccacacucgacaucgagcugcagaagaccgaagcaacucaacuugccacacugaggaaauuguguauugagggaaagaucaccaauauuacgaccgauagucggugcccuacacagggcgaagcuacucucccagaggaacaggaccagaacuaugucuguaaacacaccuacguugaucgcgguugggggaauggaugcggccuguucggcaagggguccuuagugacaugcgccaaguuucaaugucuggagcccaucgagggaaaaguagugcaguaugaaaaccucaaguacacugucauaauuaccgugcacacaggugaccagcaucagguuggcaaugacacccaaggggugacugucgagaucacgccucaggcaucuacaguggaagcuguacuuccagaguauggaacccugggcuuggaaugcagcccgcgaacuggucuagauuucaacgagaugauucugcucaccaugaaaaauaaggccuggaugguucacagacagugguuuuucgaccugccccuuccuuggacauccggggcgaccacugagacaccaacguggaacaggaaagaacuguuggugaccuuuaagaaugcccaugccaagaagcaagaggucgugguccucggcucacaggaaggagcuaugcacacugcccugacaggcgcuaccgagauccagaacagugggggaacaagcaucuucgccggucacuuaaagugucggcugaaaauggauaagcuagaacucaaaggcaugucuuacgcaaugugccugaauacuuuugugcuuaagaaagagguuuccgagacccagcaugggacgauuuugauaaagguggaauacaagggagaggacgcccccuguaaaaucccuuucucaaccgaagauggccaagguaaggcucacaacgggcgucugauuacagcgaacccaguagucacuaaaaaggaggagcccgugaauaucgaagcagagccgccuuucggcgaaagcaacauaguuauuggaaucggcgacaaagcccucaagaucaauugguauaagaaagggaguucuauuggaaagauguuugaggcuaccgcccgcggugcaagaaggauggccauccugggcgauacagcuugggacuucggguccgugggaggcguccuuaacagccuggguaaaauggugcaucagauuuuugggucggccuacacugcauuguucucuggcguauccuggauaaugaagaucggaauuggcgugcuccugaccuggaucggguuaaauaguaaaaacacgucaaugagcuuuuccugcaucguuauuggaauaaucacacuguaucuaggcgcggucgugcaggcugauauggguugugugauuaauuggaaggggaaggaacucaaaugcggaucuggcaucuucgucaccaacgagguucacacuuggacagagcaguacaaguuucaagccgacagccccaaacggcuggcaaccgccauugcuggugccugggaaaauggcgugugugggauccgaucaacuacccgcauggagaaccuuuuguggaagcagauagcaaaugaacugaacuauauccucugggagaauaguauuaaacugacagugguagucggagauaucauuggcguguuagaacaggggaagagaacgcugaccccacagccuauggagcuuaaauacuccuggaagacuuggggaaaggcuaaaaucguuacagccgagacccaaaacagcucuuucauaauugacggccccaauacaccagaaugccccucagcgaguagggccuggaacgugugggaggucgaagacuaugguuuugggguguucacuaccaacaucugguugaagcuccgggagguuuacacgcagagcugugaucaucgccugauguccgcugcaauuaaagacgaaagagccgugcacgcugauaugggauacuggaucgagucucagaagaauggcucguggaaacuagagaaggccagcuuuauagaaguaaagacaugcaccuggccuaaaucccacacucuguggucaaacgguguccucgagagugacaugaucauuccaaagucucuggcaggcccgaucagccagcauaaucacaggcccggguaucauacccaaacagcgggaccuuggcaccuuggcaaauuggaacuggauuucaacuacugcgaggggacuaccguggugauuacagagaauuguggaacgcguggcccauccuuacggaccacuacagucucagguaagcucauccacgaauggugcugucgaagcugcacccugcccccucuuagauauaugggggaggacggauguugguacggcauggaaauaaggccaauuaacgagaaagaagagaauaugguuaagucucugguguccgccgguaguggcaagguagauaacuuuacuauggggguguugugccucgcuauccuguucgaggaagucaugcgcggaaaauucggcaagaaacauaugaucgccggggugcuauuuacauucguucugcuccugagcggacagauuaccuggcgggacauggcacacacgcuuaucaugauuggcucuaaugcuuccgauagaauggguaugggggugacuuauuuggcccugauagcaaccuuuaagauccagcccuucuuagcccucggauuuuuccugaggaaacuuacaucacgcgagaaccugcuacucggcgucggccuggcuauggcgaccacuuugcaacugccggaagacauugagcagauggccaaugggaucgcauuaggacucaugacacugaaacuuauuacccaguuugaaacauaccagcuguggacugcuuuggugagucucaccuguagcaacacgaucuucacacugaccguugccuggcgaacugccacccuaauacuggcuggugugucgcuucucccucugugccaauccucuagcaugcggaagacagauugguugccaaugacugucgcagccaugggcguacccccucugcccuuauuuaucuucucacucaaagacaccccaaagcguagaaguuggccucugaaugagggggugauggcgguuggacuuguguccauucuggcuucuagcuugcucaggaacgauguccccauggccggcccacugguggcgggugggcuacugaucgccuguuauguaauuacgggaacauccgcugaccuuaccguggagaaagcagccgacgucacuugggaagaggaagcggagcagacaggcguuucacauaaucucaugaucaccguggaugacgauggcacuaugcgcauaaaggacgaugaaacagagaacauucugaccguguuguuaaaaacggcucugcucaucgucagcgggaucuuuccguacaguauuccugccacucugcuuguguggcacaccuggcagaagcagacacaacggucuggaguucugugggacguacccuccccacccgagacccagaaagcagaauuggaggaagguguguacagaauaaagcagcagggcaucuucgggaagacacaagucggagugggcguucagaaagaggguguguuucauacuauguggcacgucacccgaggggcagugcuaacgcacaacggaaagaggcuggagccuaauugggcuagcgucaagaaggaucucauuucguauggcggcggguggcgccugucagcccaguggcaaaaaggagaagagguccaggugaucgcaguugaaccagguaagaaccccaagaauuuccagacaaugccuggcauuuuccagacuaccacaggggagaucggagcuauagcccuugacuuuaaaccgggcaccucugguaguccaaucauuaaccgggaagggaagguggucggauuauacggcaauggcgugguuacuaaaaacgggggauauguguccgguaucgcgcaaaccaaugccgagcccgauggcccuacaccagagcuggaagaggaaauguucaagaaaagaaaccucacgauuauggacuugcaucccgggagcggaaagacuaggaaguaccugccugcaaucguccgugaggcuauaaaacgccggcucagaacccugauucuugccccgacaagggugguagcugcagaaauggaggaggcccugaagggcuugcccauccgauaucagaccacugccacaaaaucugaacacaccggucgggagaucguggaucuaaugugccaugcuacguuuacuaugcgccugcucagcccaguuagagucccuaauuacaacuuagugauuauggacgaagcgcacuucacagaucccgcauccaucgccgcuaggggguauauaucaacccgggugggaaugggcgaggccgcagccauuuuuaugaccgcuacuccaccuggcacagcggaagccuucccccagaguaaugcaccaauccaggacgaggagcgagacauuccggaaagaagcuggaacucugggaaugaguggaucaccgauuuugucggaaagacaguaugguucgugccuuccauaaaagcugguaacgacauugccaauugucugcgcaagaacggcaagaaaguuauccaacuuucaaggaagacuuuugauacggaauaccagaaaacccgucugaacgacugggauuucguggucacaacugacaucagugagaugggggcaaauuuuaaggccgaucgggugauugaccccagaaggugccucaaaccaguuaucuugaccgauggacccgagcgcgugauucuggcuggcccuaugccagucacagccgcgagcgcagcccagcgaagaggucggguggggaggaacccccagaaggaaaaugaccaauacauauucaccggccagccucucaacaaugaugaggaccaugcucacuggacugaagccaagaugcugcuugacaacaucaauacgccggagggaauuaucccagcucuauucgaacccgagcgcgagaaauccgcagccaucgauggcgaauaucgucugaagggggagucuagaaaaaccuuuguagaauugaugcggaggggagacuuaccuguguggcuggcucacaagguugccucggaggguauuaaauacacagaucgcaaguggugcuucgacggcgaacgaaacaaucagauacucgaggagaacauggaugucgaaaucuggacuaaagagggggaaagaaagaagcugcggcccagguggcuugacgcacgcaccuauagcgauccacuggcgcucaaagaguuuaaggacuucgccgcuggaagaaaaucaauugccuuggaucuggugacagaaaucggcagggugccuucccaucuagcacaccggacccguaaugcucuggacaaccucgucaugcuucauacaagugagcacggugggcgcgccuaccgacacgcaguugaggaacugcccgagacaauggaaacguuauugcugcucggccugaugauucuucugaccggaggcgccaugcucuuuuugaucucugggaagggaauagguaaaacuagcaucggccugauuugugugaucgcuuccucagggauguuauggauggcggauguaccacuacaguggauugccucugcaaucgugcuggaguucuuuaugaugguccuccuuauaccugagccggaaaagcaaagaacaccccaggacaaucagcuggcuuaugugguuauuggaaucuugacccuggccgccauuguggcagcuaacgagaugggccuccuggaaaccacaaagagggaucuugguaugagcaaagagccaggggucguaaguccuacuuccuaccucgacguggaccugcaucccgccagcgcguggacguuguaugcuguugccaccacagugaucacuccaaugcugcggcacaccauagaaaauucuacagcaaacgucucauuagccgcuaucgcaaaucaagccgugguccuaaugggccuggauaagggauggccuauuuccaaaauggaccucggcgugccccuucuggcguuggggugcuacagucagguuaacccgcugacccucacugcugccgugcugcuuuuaguaacgcauuacgcaaucauuggaccaggccugcaggccaaggcuacacgcgaggcccagaaaagaaccgcagcugguaucaugaagaacccuacuguggaugggauaaugaccauugaccucgaucccgucaucuaugacagcaaguucgagaaacaauugggacagguuaugcugcuagugcugugugccguccagcuccuucugaugaggacaucgugggcguugugcgaagcccugacucucgcaaccggcccaaucacaacgcugugggaggguucucccggcaaguuuuggaauaccacuauugcuguguccauggccaacaucuuccgggggagcuacuuagcaggagcuggccuugccuuuucaauaaugaaaaguguagggacaggacgaagaggcaccgguucucagggggaaacucugggagagaaguggaaaaagaagcucaaucaacuaucccgcaaagaguucgaucuguauaagaaaagcggcauuacagagguggacaggaccgaggccaaggaagguuugaaacggggcgagacgacccaccaugcgguuucacgugggagugcuaagcugcagugguuuguggaaagaaacauggucaucccugagggaagggugauugaucucggcugugggcgcggaggcuggagcuacuauugcgcaggucuucggaaagucacagaagugcgaggguacacuaagggaggcccgggccacgaggagcccguuccaauguccaccuauggguggaauaucguaaagcugaugucuggaaaagacguguucuacuugccucccgaaaagugugauacacugcucugcgacauaggugagagcuccccuucaccaacugucgaagagucuagaaccaucaggguguuaaaaaugguugagcccuggcugcgcaacaaucaguucuguauuaaggugcuuaacccuuacaugccaacagucaucgaacaccuggagcggcuacagagaaaauauggcgggaugcucgugcguaauccccugaguaggaacucgacccaugaaauguacuggauuagcaauggaacuggcaacaucguauccucugugaauaugguuucacgguugcugcucaaccgcuuuacgaugacacaccgaagaccgaccauugagaaggaugucgaccuuggugccgggacuaggcaugugaaugcugaaccugagaccccaaacauggacgugaucggagagcggauaaagcgcauuaaagaagaacacagcuccacauggcacuaugaugacgaaaaccccuacaagacgugggccuaucauggcaguuacgaggucaaagcaaccggcucugccagcucaaugaucaaugggguugugaagcuguuaacuaaaccuugggauguagugccaauggucacacaaauggcuaugaccgacacuacacccuucggacagcagagaguguuuaaggaaaagguugauaccaggacaccgcgaccuauggcggguacucggaaagugauggagaucaccgccgaguggcuguggcguacguugggcagaaacaagaaaccccgccucugcaccagggaagaguucacaaagaaaguccggacuaaugcagcuaugggggccguguuuaccgaagagaaccaaugggacuccgcaagagccgcuguagaagaugaggaguucuggaagcugguugaccgcgaaagggagcuacacaaacuuggaaaauguggcaguugcguguauaauaugauggguaagcgagagaaaaagcugggggaguuuggaaaagccaagggcagccgggcgauuugguacauguggcucggcgcaagauaccuggaguucgaagccuugggguuucugaacgaggaucauugguucucuagggaaaauuccuauucaggagucgagggugaaggccuccacaaacuuggguacauacugcgcgacaucagcaagauuccaggaggcgcuauguaugccgaugacacagcagguugggacacucguaucaccgaggaugacuuacauaacgaggaaaagauuacgcagcagauggauccugagcaccggcagcuggcuaaugccaucuuuaaauugacauaccaaaacaagguggugaaaguccagagacccaccccaaaggggacuguuauggacauaaucucgaggaaagaucagcgcggaucuggccaggugggcacauaugggcucaauaccuucacuaacauggaagcucaacugguacgacagauggagggagaaggugugcuaaguaaggccgaccuugagaauccccaucugcucgagaagaaaauuacccaguggcuggaaacaaagggcgucgagcgguugaaaagaauggcaaucuccggggaugacugcgugguuaagccuauugaugacagguuugcgaacgccuuacuggcucucaaugauaugggaaaagugcgcaaggacaucccacaguggcaaccgagcaagggcuggcaugauuggcagcagguccccuucuguucacaccauuuccacgaacuuauaaugaaagacgguagaaagcuggugguaccuugccggccacaggacgagcuaauugggagggcccguaucucccaaggagcaggcuggucucugaaagaaacggcuugucucggcaaggccuacgcacagauguggagcuugauguauuuucaccgacgcgaucugagacuugccaguaacgcgaucugcuccgcuguucccgugcauuggauuccuaccagccggacuacauggucuauacacgcccaucaccaguggaugaccacugaggacaugcugacagucuggaacaggguguggaucgaggauaauccauggauggaagacaaaacccccguuacgacaugggaggaugugccuuaccucgggaagcgcgaagaccaaugguguggaucauuaauuggucugaccaguagagcaacuugggcccagaacaucuugaccgcuauucagcagguccggucccugaucggcgaugaggaguuccucgacuacaugccgagcaugaagagguuucgaaaagaagaggaaucugagggggccauaugguga

SEQ ID NO: 15197 - RNA, 9873 nt, Artificial Sequence
  derived and/or modified CDS sequence (opt3) from DENV-3__GU131906__SS-prME
accagccugugccucaugaugaugcuuccagcaacucuggcuuuccacuugacuuccagggacggcgagccuaggaugaucguggggaagaacgaacggggaaaaucuuuacuguuuaagacggcaucagguauuaauauguguacccuaauagccauggaucucggcgagaugugcgacgauacagucacuuacaaauguccacugaucgcggaaguugagccggaagacauugauugcugguguaaccuuaccaguacaugggugaccuaugggacuugcaaucaggcuggagagcaccgccgagacaagcguagcguagcccuggcaccccacgugggcauggguuuggauacaagaacccaaacguggauguccgccgagggggcuuggaggcaggucgaaaaaguggagacuugggcacuccggcauccuggauucaccauccuggcccuguuucucgcucacuacauuggcacaucuuuaacucagaagguugugaucuucauacugcuuauguuggucaccccaucgaugacaaugcgcugugugggcguagggaacagagacuuuguugaaggacugucaggugccaccuggguggaugucgugcuagagcauggcgggugcgugacgacuauggcaaagagcaaacccacacucgacaucgagcugcagaagaccgaagcaacucaacuugccacacugaggaaauuguguauugagggaaagaucaccaauauuacgaccgauagucggugcccuacacagggcgaagcuacucucccagaggaacaggaccagaacuaugucuguaaacacaccuacguugaucgcgguugggggaauggaugcggccuguucggcaagggguccuuagugacaugcgccaaguuucaaugucuggagcccaucgagggaaaaguagugcaguaugaaaaccucaaguacacugucauaauuaccgugcacacaggugaccagcaucagguuggcaaugacacccaaggggugacugucgagaucacgccucaggcaucuacaguggaagcuguacuuccagaguauggaacccugggcuuggaaugcagcccgcgaacuggucuagauuucaacgagaugauucugcucaccaugaaaaauaaggccuggaugguucacagacagugguuuuucgaccugccccuuccuuggacauccggggcgaccacugagacaccaacguggaacaggaaagaacuguuggugaccuuuaagaaugcccaugccaagaagcaagaggucgugguccucggcucacaggaaggagcuaugcacacugcccugacaggcgcuaccgagauccagaacagugggggaacaagcaucuucgccggucacuuaaagugucggcugaaaauggauaagcuagaacucaaaggcaugucuuacgcaaugugccugaauacuuuugugcuuaagaaagagguuuccgagacccagcaugggacgauuuugauaaagguggaauacaagggagaggacgcccccuguaaaaucccuuucucaaccgaagauggccaagguaaggcucacaacgggcgucugauuacagcgaacccaguagucacuaaaaaggaggagcccgugaauaucgaagcagagccgccuuucggcgaaagcaacauaguuauuggaaucggcgacaaagcccucaagaucaauugguauaagaaagggaguucuauuggaaagauguuugaggcuaccgcccgcggugcaagaaggauggccauccugggcgauacagcuugggacuucggguccgugggaggcguccuuaacagccuggguaaaauggugcaucagauuuuugggucggccuacacugcauuguucucuggcguauccuggauaaugaagaucggaauuggcgugcuccugaccuggaucggguuaaauaguaaaaacacgucaaugagcuuuuccugcaucguuauuggaauaaucacacuguaucuaggcgcggucgugcaggcugauauggguugugugauuaauuggaaggggaaggaacucaaaugcggaucuggcaucuucgucaccaacgagguucacacuuggacagagcaguacaaguuucaagccgacagccccaaacggcuggcaaccgccauugcuggugccugggaaaauggcgugugugggauccgaucaacuacccgcauggagaaccuuuuguggaagcagauagcaaaugaacugaacuauauccucugggagaauaacauuaaacugacagugguagucggagauaucauuggcguguuagaacaggggaagagaacgcugaccccacagccuauggagcuuaaauacaguuggaagacuuggggaaaggcuaaaaucguuacagccgagacccaaaauuccagcuucauaauugacggccccaacacaccagaaugccccucugcgucaagggccuggaacgugugggaggucgaagacuaugguuuugggguguucacuaccaauaucugguugaagcuccgggagguuuacacgcagaguugugaucaucgccugaugagcgcugcaauuaaagacgaaagagccgugcacgcugauaugggauacuggaucgagucccagaagaacggcucuuggaaacuagagaaggccucguuuauagaaguaaagacaugcaccuggccuaaaagccacacucugugguccaaugguguccucgagucagacaugaucauuccaaagagucuggcaggcccgaucucucagcauaaccacaggcccggguaucauacccaaacagcgggaccuuggcaccuuggcaaauuggaacuggauuucaauuacugcgaggggacuaccguggugauuacagagaacuguggaacgcguggccccagcuuacggaccacuacagucuccgguaagcucauccacgaauggugcugucgaucaugcacccugcccccucuuagauauaugggggaggacggauguugguacggcauggaaauaaggccaauuaaugagaaagaagagaacaugguuaagagccuggugucugccgguuccggcaagguagauaauuuuacuauggggguguugugccucgcuauccuguucgaggaagucaugcgcggaaaauucggcaagaaacauaugaucgccggggugcuauuuacauucguucugcuccugaguggacagauuaccuggcgggacauggcacacacgcuuaucaugauuggcagcaacgcuucugauagaauggguaugggggugacuuauuuggcccugauagcaaccuuuaagauccagcccuucuuagcccucggauuuuuccugaggaaacuuacaucccgcgagaaucugcuacucggcgucggccuggcuauggcgaccacuuugcaacugccggaagacauugagcagauggccaacgggaucgcauuaggacucaugacacugaaacuuauuacccaguuugaaacauaccagcuguggacugcuuuggugucacucaccuguaguaauacgaucuucacacugaccguugccuggcgaacugccacccuaauacuggcuggugugagccuucucccucugugccaaucguccucuaugcggaagacagauugguugccaaugacugucgcagccaugggcguacccccucugcccuuauuuaucuucagccucaaagacaccccacguagaaggucauggccucugaacgagggggugauggcgguuggacuugugaguauucuggcuuccucuuugcuccgcaaugauguccccauggccggcccacugguggcgggugggcuacugaucgccuguuauguaauuacgggaacaagcgcugaccuuaccguggagaaggcagccgacgucacuugggaagaggaagcggagcagacaggcguuucccauaaccucaugaucaccguggaugacgauggcacuaugcggauaaaagacgaugaaacagagaacauucugaccguguuguuaaagacggcucugcucaucgucucagggaucuuuccguacagcauuccugccacucugcuuguguggcacaccuggcagaaacagacacaaagaaguggaguucugugggacguacccucuccacccgagacccagaaggcagaauuggaggaagguguguacaggauaaaacagcagggcaucuucgggaagacacaagucggagugggcguucagaaggaggguguguuucauacuauguggcacgucacccgaggggccgugcuaacgcacaauggaaaacgccuggagccuaacugggcuuccguaaagaaagaucucauuagcuauggcggcggguggcggcugucggcccaguggcaaaagggagaagagguccaggugaucgcaguugaaccagguaaaaaucccaagaacuuccagacaaugccuggcauuuuccagacuaccacaggggagaucggagcuauagcccuugacuuuaagccgggcaccucagguucuccaaucauuaauagagaagggaaaguggucggauuauacggcaacggcgugguuacuaagaaugggggauaugugagugguaucgcgcaaaccaacgccgagcccgauggcccuacaccagagcuggaagaggaaauguucaaaaagaggaaucucacgauuauggacuugcaucccggguccggaaaaacucguaaguaccugccugcaaucguccgcgaggcuauaaagcggagacucaggacccugauucuugccccgacacgagugguagcugcagaaauggaggaggcccugaaaggcuugcccauccgguaucagaccacugccacaaagagcgaacacaccggucgcgagaucguggaucuaaugugccaugcuacguuuacuaugagacugcucucuccaguuagggucccuaacuacaauuuagugauuauggacgaagcgcacuucacagaucccgcaagcaucgccgcucggggguauauauccacccgagugggaaugggcgaggccgcagccauuuuuaugaccgcuacuccaccuggcacagcggaagccuucccccagucaaacgcaccaauccaggacgaggagagagacauuccggaacgcaguuggaauagcgggaacgaguggaucaccgauuuugucggaaaaacaguaugguucgugccuucuauaaaggcugguaaugacauugccaacugucugaggaaaaacggcaagaagguuauccaacuuucccguaaaacuuuugauacggaauaccagaagacccggcugaaugacugggauuucguggucacaacugacaucucagagaugggggcaaacuuuaaagccgauagagugauugaccccaggcgcugccucaagccaguuaucuugaccgauggacccgagcgagugauucuggcuggcccuaugccagucacagccgcgagugcagcccagagacgggguaggguggggcgcaauccccagaaagaaaacgaccaauacauauucaccggccagccucucaauaacgaugaggaccaugcucacuggacugaagccaagaugcugcuugacaauaucaacacgccggagggaauuaucccagcucuauucgaacccgagcgugaaaagagcgcagccaucgauggcgaauauagacugaaaggggagucccggaagaccuuuguagaauugaugaggcgcggagacuuaccuguguggcuggcucacaaaguugccucugaggguauuaaguacacagaucgaaaauggugcuucgacggcgaaagaaauaaccagauacucgaggagaauauggaugucgaaaucuggacuaaggagggggaacggaaaaagcugaggccccgcuggcuugacgcaagaaccuauucggauccacuggcgcucaaggaguuuaaagacuucgccgcuggaagaaagagcauugccuuggaucuggugacagaaaucggccgggugccuucacaucuagcacaccguacccgcaacgcucuggacaaucucgucaugcuucauacuuccgagcacggugggcgagccuacagacacgcaguugaggaacugcccgagacaauggaaacguuauugcugcucggccugaugauucuucugaccggaggcgccaugcucuuuuugaucagugggaaaggaauagguaagacuucuaucggccugauuugugugaucgcuagcuccgggauguuauggauggcggauguaccacuacaguggauugccucagcaaucgugcuggaguucuuuaugaugguccuccuuauaccugagccggaaaaacaaaggacaccccaggacaaccagcuggcuuaugugguuauuggaaucuugacccuggccgccauuguggcagcuaaugagaugggccuccuggaaaccacaaagcgggaucuugguaugucuaaggagccaggggucguaagcccuacaaguuaccucgacguggaccugcaucccgccuccgcguggacguuguaugcuguugccaccacagugaucacuccaaugcugcgccacaccauagaaaacagcacagcaaaugucucuuuagccgcuaucgcaaaccaagccgugguccuaaugggccuggauaaaggauggccuauuucaaagauggaccucggcgugccccuucuggcguuggggugcuacucccagguuaacccgcugacccucacugcugccgugcugcuuuuaguaacgcauuacgcaaucauuggaccaggccugcaggccaaagcuacaagagaggcccagaagaggaccgcagcugguaucaugaaaaauccuacuguggaugggauaaugaccauugaccucgaucccgucaucuaugacaguaaguucgagaagcaauugggacagguuaugcugcuagugcugugugccguccagcuccuucugaugcggacaagcugggcguugugcgaagcccugacucucgcaaccggcccaaucacaacgcugugggaggguucgcccggcaaauuuuggaacaccacuauugcugugucuauggccaauaucuuccgaggguccuacuuagcaggagcuggccuugccuuuagcauaaugaagucaguagggacaggaagacgcggcaccgguagucagggggaaacucugggagagaaauggaagaaaaagcucaaccaacuaucuaggaaggaguucgaucuguauaaaaaguccggcauuacagagguggaccggaccgaggccaaagaagguuugaagcguggcgagacgacccaccaugcgguuagcagagggucagcuaaacugcagugguuuguggaaaggaauauggucaucccugagggacgcgugauugaucucggcugugggcggggaggcuggaguuacuauugcgcaggucuuaagaaagucacagaagugcgaggguacacuaagggaggcccgggccacgaggagcccguuccaaugagcaccuauggguggaacaucguaaagcugauguccggaaaagacguguucuacuugccucccgaaaagugugauacacugcucugcgacauaggugagucuagcccuuccccaacugucgaagagucaagaaccaucaggguguuaaaaaugguugagcccuggcugcgcaauaaccaguucuguauuaaggugcuuaauccuuacaugccaacagucaucgaacaccuggagcggcuacagagaaaauauggcgggaugcucgugcguaacccccugucuaggaauaguacccaugaaauguacuggauuucgaacggaacuggcaauaucguaagcuccgugaacaugguuucucgguugcugcucaaucgcuuuacgaugacacaccgaagaccgaccauugagaaggaugucgaccuuggugccgggacuaggcaugugaacgcugaaccugagaccccaaacauggacgugaucggagagcggauaaagcgcauuaaagaagaacacucaagcacauggcacuaugaugacgaaaaucccuacaagacgugggccuaucauggcuccuacgaggucaaagcaaccggcagugccucuagcaugaucaacgggguugugaagcuguuaacuaaaccuugggauguagugccaauggucacacaaauggcuaugaccgacacuacacccuucggacagcagagaguguuuaaggaaaagguugauaccaggacaccgcgaccuaugcccgguacucggaaagugauggagaucaccgcggaguggcuguggcguacguugggcagaaauaagaaaccacgccucugcaccagggaagaguucacaaagaaaguccggacuaacgccgcaaugggggcuguguuuaccgaagagaaucaaugggacucagccagagcagccguagaagaugaggaguucuggaagcugguugaccgcgaaagggagcuacacaaacuuggaaaauguggcuccugcguguauaacaugauggguaagcgagagaagaagcugggggaguuuggaaaagcuaagggcagucgggccauuugguacauguggcucggcgcgagauaccuggaguucgaagcauugggguuucugaaugaggaucauugguucagcagggaaaacucuuauuccggagucgagggugaaggccuccacaaacuuggguacauacugcgcgacaucucaaagauuccuggaggcgccauguaugcugaugacacagccgguugggacacucguaucaccgaggaugacuuacauaaugaggaaaagauuacgcagcagauggaucccgagcaccggcagcuggcaaacgcuaucuuuaaauugacauaccaaaauaagguggugaaaguccagagaccaacccccaaggggacuguuauggacauaaucagcaggaaagaucagcgcggaucgggccaggugggcacauaugggcucaacaccuucacuaauauggaagcccaacugguacgacagauggagggagaaggugugcuaucuaaggcugaccuugagaacccucaucugcucggcaagaaaauuacccaguggcuggagacaaagggggucgaacgguugaaaagaauggccaucaguggagaugacugcgugguuaagccaauugaugacagguuugcaaaugcguuacuggcccucaacgauaugggcaaagugcgcaaggacaucccgcaguggcaacccuccaaggguuggcaugauuggcagcaggucccuuucuguagccaccauuuccacgagcuuauaaugaaagacgggagaaagcuggugguaccaugccggccccaggacgaacuaauuggaagggcucguaucucacaaggcgccggcuggucccugaaagagacggcaugucucgggaaggcuuacgcccagauguggucuuugauguauuuucaccgacgcgaucugagacuugcaagcaacgccaucugcagugcgguuccugugcauuggauuccaaccucccggacuacauggagcauacacgcucaucaccaguggaugaccacugaagacaugcugacagucuggaauaggguguggaucgaggauaaccccuggauggaggacaaaaccccuguuacgacaugggaagaugugccguaccucggaaagcgcgaggaccaauggugugguucuuuaauuggccugaccucaagagccacuugggcacagaauaucuugaccgccauucagcagguccggagucugaucggggaugaagaguuccucgacuacaugccauccaugaagagguuucgaaaagaggaagagagcgaaggagcuauaugguga

SEQ ID NO: 15198 - RNA, 9873 nt, Artificial Sequence
  derived and/or modified CDS sequence (opt3) from DENV-3__GU131907__SS-prME
accagccugugccucaugaugaugcuucccgcaacacuggcuuuccacuugacuuccagggacggagaaccuaggaugaucguggggaagaacgaacggggaaaaucuuuacuguuuaagacggcaucagguauuaauauguguacccuaauagccauggaucucggcgagaugugcgacgauacaguaacuuacaaauguccacugaucgcggaaguugagccggaagacauugauugcugguguaaccuuaccaguacaugggugaccuaugggacuugcaaucaggcuggagagcaccgccgagacaagcguagcguagcccuggcaccccacgugggcauggguuuggauacaagaacccagacguggauguccgccgagggggcuuggaggcaggucgaaaaaguggagacuugggcacuccggcauccuggauucaccauccuggcccuguuucucgcucacuacauuggcacaucuuuaacucagaagguugugaucuucauacugcuuauguuggucaccccaucgaugacaaugcgcugugugggcguagggaacagagacuuuguugaaggacugucaggugccaccuggguggaugucgugcuagagcauggcgggugcgugacgacuauggcaaagagcaaacccacacucgacaucgagcugcagaagaccgaagcaacucagcuugccacacugaggaaauuguguauugagggaaagaucaccaauauuacgaccgauagucggugcccuacacagggcgaagcuacucucccagaggaacaggaccagaacuaugucuguaaacacaccuacguugaucgcgguugggggaauggaugcggccuguucggcaagggguccuuagugacaugcgccaaguuucaaugucuggagcccaucgagggaaaaguagugcaguaugaaaaccucaaguacacugucauaauuaccgugcacacaggugaccagcaucagguuggcaaugacacccaaggggugacugucgagaucacgccucaggcaucuacaguggaagcuguacuuccagaguauggaacccugggcuuggaaugcagcccgcgaacuggucuagauuucaacgagaugauucugcucaccaugaaaaauaaggccuggaugguucacagacagugguuuuucgaccugccccuuccuuggacauccggggcgaccacugagacaccaacguggaacaggaaagaacuguuggugaccuuuaagaaugcccaugccaagaagcaagaggucgugguccucggcucacaggaaggagcuaugcacacugcccugacaggcgcuaccgagauccagaacagugggggaacaagcaucuucgccggucacuuaaagugucggcugaaaauggauaagcuagaacucaaaggcaugucuuacgcaaugugccugaauacuuuugugcuuaagaaagagguuuccgagacccagcaugggacgauuuugauaaagguggaauacaagggagaggacgcccccuguaaaaucccuuucucaaccgaagauggccaagguaaggcucacaacgggcgucugauuacagcgaacccaguagucacuaaaaaggaggagcccgugaauaucgaagcagagccgccuuucggcgaaagcaacauaguuauuggaaucggcgacaaagcccucaagaucaauugguauaagaaagggaguucuauuggaaagauguuugaggcuaccgcccgcggugcaagaaggauggccauccugggcgauacagcuugggacuucggguccgugggaggcguccuuaacagccuggguaaaauggugcaucagauuuuugggucggccuacacugcauuguucucuggcguauccuggauaaugaagaucggaauuggcgugcuccugaccuggaucggguuaaauaguaaaaacacgucaaugagcuuuuccugcaucguuauuggaauaaucacacuguaucuaggcgcggucgugcaggcugauauggguugugugauuaauuggaaggggaaggaacucaaaugcggaaacggcaucuucgucaccaaugagguucacacuuggacagagcaguacaaguuucaagccgacucucccaaacggcuggcaaccgccauugcuggugccugggaaaacggcgugugugggauccgaagcacuacccgcauggagaaucuuuuguggaagcagauagcaaacgaacugaauuauauccucugggagaacaauauuaaacugacagugguagucggagauaucauuggcguguuagaacaggggaagagaacgcugaccccacagccuauggagcuuaaauacucauggaagacuuggggaaaggcuaaaaucguuacagccgagacccaaaacaguuccuucauaauugacggccccaacacaccagaaugccccagcgcgucuagggccuggaaugugugggaggucgaagacuaugguuuugggguguucacuaccaacaucugguugaagcuccgggagguuuacacgcagucaugugaucaucgccugaugagugcugcaauuaaagacgaaagagccgugcacgcugauaugggauacuggaucgagagccagaagaauggcuccuggaaacuagagaaggccucuuuuauagaaguaaagacaugcaccuggccuaaaucgcacacucuguggagcaacgguguccucgaguccgacaugaucauuccaaagucacuggcaggcccgaucagucagcauaaucacaggcccggguaucauacccaaacagcgggaccuuggcaccuuggcaaauuggaacuggauuucaacuacugcgaggggacuaccguggugauugccgagaauuguggaacacguggcccaucuuuacggacgaccacugucagcgguaagcucauccacgaauggugcugucgauccugcacacugcccccucuuagauauaugggggaggacggauguugguacggcauggaaauaaggccaauuaacgagaaagaagagaauaugguuaagucacuggugagcgcugguucuggcaagguagauaacuuuaccauggggguguugugccucgccauccuguucgaggaagucaugcgcggaaaauucggcaagaaacauaugaucgcaggggugcuauuuacuuucguucugcuccuguccggacagauuacauggcgggacauggcucacacccuuaucaugauuggcaguaaugccagcgauagaauggguaugggggugacguauuuggcacugacugccaccuuuaagauacagcccuucuuagcucucggauuuuuccugaggaaacuuacaucucgcgagaaccugcuacucggcgucggccuggcgauggccaccacuuugcaacugccggaagacaucgagcagauggcaaaugggauugcuuuaggacucaugacacugaaacuuaucacccaguuugaaacauaccagcuguggacugccuuggugucccucaccuguucaaacacgauuuucacacugaccguugccuggcgaacugcuacccuaauccuggcgggugugagucuucucccucugugccaaagcucguccaugcggaagacagauugguugccaaugacugucgccgcgaugggcguacccccucugcccuuauuuauauucucucucaaagacaccccaaagcguagaagcuggccucugaaugagggggugauggcuguuggacuugugucaauccuggccaguuccuugcucaggaacgauguccccauggcaggcccacugguggccggugggcuacugauugcuuguuauguaaucacgggaacaucugcagaccuuaccguggagaaagccgcggacgucacuugggaagaggaagcugagcagacaggcguuagccauaaccucaugauuaccguggaugacgauggcacuaugcgcaucaaggacgaugaaacagagaauauacugaccguguuguuaaaaacggcccugcucauugucuccgggaucuuuccguacucaaucccugcaacucugcuuguguggcacaccuggcagaagcagacacaacggagcggaguucugugggacguacccaguccacccgagacccagaaagccgaauuggaggaagguguguacagaauuaagcagcagggcauauucgggaagacacaagucggagugggcguucagaaagaggguguguuucauacuauguggcacgucaccagaggggcugugcuaacgcacaacggaaagcgacuggagccuaauugggccucugucaagaaggaucucaucuccuauggcggcggguggcgccugagcgcacaguggcaaaaaggagaagagguccaggugauugcuguugaaccagguaagaaccccaagaauuuccagacaaugccuggcaucuuccagacuaccacaggggagauuggagccaucgcgcuugacuuuaaaccgggcaccucggguucaccaauaaucaaccgggaagggaagguggucggauuauacggcaauggcgugguuacuaaaaacgggggauaugugucugguauugcccaaaccaaugcagagcccgauggcccuacaccagagcuggaagaggaaauguucaagaaaagaaaccucacgaucauggacuugcaucccgggaguggaaagacuaggaaguaccugccugcuauuguccgugaggccaucaaacgccggcucagaacccugauacuugcuccgacaagggugguagcagccgaaauggaggaggcccugaagggcuugcccauucgauaucagaccacugcuacaaaauccgaacacaccggucgggagaucguggaucuaaugugccaugcgacguuuacuaugcgccugcucagcccaguuagagucccuaauuacaacuuagugaucauggacgaagcacacuucacagaucccgccucuauugcugccaggggguauaucagcacccgggugggaaugggcgaggcagccgcuauauuuaugaccgcgacuccaccuggcacagccgaagcauucccccaguccaaugcuccaauucaggacgaggagcgagacaucccggaaagaucauggaacagugggaaugaguggauuaccgauuuugucggaaagacaguaugguucgugccuagcaucaaagccgguaacgacauagcaaacugucugcgcaagaauggcaagaaaguuauucaacuuucuaggaagacuuuugauacggaauaccagaaaacccgucugaacgacugggauuucguggucacaacugacaucuccgagaugggggccaauuuuaaggcugaucgggugaucgaccccagaaggugccucaaaccaguuauuuugaccgauggacccgagcgcgugauccuggccggcccuaugccagucacagcggcaucagccgcucagcgaagaggucggguggggaggaacccccagaaggaaaaugaccaauacauuuucaccggccagccucucaacaaugaugaggaccaugcccacuggacugaagcuaagaugcugcuugacaacauaaauacgccggagggaaucauuccagcacuauucgaacccgagcgcgagaaaagugccgcuaucgauggcgaauaucgucugaagggggagagcagaaaaaccuuuguagaauugaugcggaggggagacuuaccuguguggcuggcccacaagguugcauccgaggguaucaaauacacagaucgcaaguggugcuucgacggcgaacgaaacaaucagauucucgaggagaacauggaugucgaaauauggacuaaagagggggaaagaaagaagcugcggcccagguggcuugacgcgcgcaccuauucugauccacuggcccucaaagaguuuaaggacuucgcugccggaagaaaaucgaucgcauuggaucuggugacagaaauuggcagggugccuagccaucuagcucaccggacccguaaugcccuggacaaccucgucaugcuucauacuucagagcacggugggcgcgcauaccgacacgccguugaggaacugcccgagacaauggaaacguuauugcugcucggccugaugauccuucugaccggaggcgcuaugcucuuuuugauuuccgggaagggaaucgguaaaacaaguauaggccugaucugugugauuguaucuagcgggauguuauggauggcggaugugccacuacaguggaucgccuccgcaauuguccuggaguucuuuaugauggugcuccuuaucccugagccggaaaagcaaagaacaccccaggacaaucagcuggcuuauguugugauaggaauuuugacccuggccgccaucgucgcagcuaacgagaugggccuccuggaaaccacaaagagggaucuugguaugucaaaagagccagggguagugucuccuacuagcuaccucgacguugaccugcaucccgccagugcguggacguuguaugcuguggccaccacagucauuacuccaaugcugcggcacaccaucgaaaauuccacagcaaacgugagcuuagccgcuauagcaaaccaagccgucgugcuaaugggccuggauaagggauggccuaucucuaaaauggaccucggcguuccccuucuggcguuggggugcuacucacaggugaauccgcugacccucacugcugccguacugcuuuuagugacgcauuacgcaauuaucggaccaggccugcaggccaaggcuacacgcgaggcccagaaaagaaccgcagcugguauuaugaagaacccuacugucgaugggaucaugaccauagaccucgaucccguuauuuaugacuccaaguucgagaaacaauugggacaggugaugcugcuaguccugugugccgugcagcuccuucugaugaggacaaguugggcguugugcgaagcccugacucucgcaaccggcccaaucacaacgcugugggaggguagccccggcaaguuuuggaauaccacuaucgcuguaucgauggccaacauuuuccgggggucuuacuuagcaggagcuggccuugccuuuuccaucaugaaaagcguggggacaggacgaagaggcaccgguucacagggggaaacucugggagagaaguggaaaaagaagcucaaucaacuaagucgcaaagaguucgaucuguauaagaaaucuggcauaacagagguugacaggaccgaggccaaggaagguuugaaacggggcgagacgacccaccaugcggugucccgugggagcgcuaagcugcagugguuugucgaaagaaacauggugauuccugagggaagggucaucgaucucggcugugggcgcggaggcuggucauacuauugcgcaggucuuaaaaaggugacagaaguucggggguacacuaagggaggcccgggccacgaggagcccguaccaaugaguaccuauggguggaauauugugaaacugaugagcggaaaggacgucuucuacuugccucccgaaaaaugugauacacugcucugcgacaucggugaguccucuccuagcccaacuguggaagagucccgaaccauaagaguuuuaaagaugguggagcccuggcugaggaacaaucaguucuguaucaaaguccuuaacccuuacaugccaacagugauugaacaccuggagcgccuacagcggaaguauggcgggaugcucguaagaaauccccugucacguaacucuacccaugaaauguacuggaucaguaauggaacuggcaacauugugucgagcguuaauauggucuccagguugcugcucaaccgguuuacgaugacacaccgccgaccgaccaucgagaaggauguggaccuuggugccgggacuagacaugugaacgcugaaccugagaccccaaauauggacgucauuggagagaggaucaaacggauaaaggaagaacacucuucaacauggcacuaugaugacgaaaaccccuacaaaacgugggccuaucauggcagcuacgagguuaaggcaaccggcuccgccaguucuaugauuaauggggugguaaaacuguuaacuaagccuugggauguggucccaauggugacacaaauggcuaugaccgacacuacacccuucggacagcagcgcguuuuuaaggaaaaaguggauaccagaacaccgaggccuaugcccgguacucgaaaggucauggagaucaccgcggaguggcuguggcggacguugggccguaacaaaaagccaagacucugcacccgcgaagaguucacuaagaaggugaggacuaaugccgcaaugggggcuguauuuaccgaagagaaccaaugggacagcgcccgggcagccguugaagaugaggaguucuggaagcugguggacaaagaaagagagcuacacaaacuuggaaaauguggcucaugcgucuauaauaugauggguaagcgcgagaaaaagcugggggaguuuggaaaagcuaagggcuccagggccaucugguacauguggcucggcgcgcgauaccuggaguucgaagcauugggguuucugaacgaggaucauugguucagucgggaaaauagcuauucuggaguggagggugaaggccuccacaaacuuggguacauucugagagacauauccaaaaucccuggaggcgccauguaugcugaugacacagccgguugggacacuaggauuaccgaggaugacuuacauaacgaggaaaagaucacgcagcagauggaucccgagcaccgccagcuggcaaaugcuauuuuuaaauugacauaccaaaacaagguggucaaaguucagcguccaacccccaaggggacugugauggacaucauaucacggaaggaucagagaggaagcggccagguaggcacauaugggcucaauaccuucacuaacauggaagcccaacuggugaggcagauggagggagaagguguccuaucgaaagcugaccuugagaauccucaucugcucgagaagaaaaucacccaguggcuggaaacaaagggcguggagcgcuugaaacgaauggccauuucuggggaugacugcguugugaagccaaucgaugaccgguuugcaaacgcguuacuggcccucaacgauaugggaaaggucagaaaagacauuccgcaguggcaacccaguaagggcuggcaugauuggcaacaggugccuuucuguucccaccauuuccacgaacuuaucaugaaagacgguaggaagcugguaguuccaugccgcccccaggacgagcuaauagggagagcucggauuagccaaggagccggcuggucacugaaagaaacggcaugucucggcaaggcuuacgcccagaugugguccuugauguauuuucacaggcgugaucugcgacuugcaucuaaugccaucugcagcgcggugccuguccauuggaucccaaccagucgcacuacaugguccauucacgcucaucaccaguggaugaccacugaggacaugcugacaguguggaacagaguuuggauagaggauaaucccuggauggaagacaagaccccugugacgacaugggaggaugucccguaccucgggaaacgggaagaccaaugguguggcagcuuaaucggucugaccucuagggccacuugggcacagaacauuuugaccgccauccaacaggugcgcucacugauuggcgaugaggaguuccucgacuacaugccaaguaugaagagauuucggaaagaagaggaaacagagggggcuaucugguga

SEQ ID NO: 15199 - RNA, 9873 nt, Artificial Sequence
  derived and/or modified CDS sequence (opt3) from DENV-3__GQ868634__SS-prME
accagccugugccucaugaugaugcuucccgcaacacuggcuuuccacuugacuuccagggacggagaaccuaggaugaucguggggaagaacgaacggggaaaaucuuuacuguuuaagacggcaucagguauuaauauguguacccuaauagcaauggaucucggcgagaugugcgacgauacagucacuuacaaauguccacugaucgcggaaguugagccggaagacauugauugcugguguaaccuuaccaguacaugggugaccuaugggacuugcaaucaggcuggagagcaccgccgagacaagcguagcgucgcccuggcaccccacgugggcauggguuuggauacaagaacccaaacguggauguccgccgagggggcuuggaggcaggucgaaaaaguggagacuugggcacuccggcauccuggauucaccauccuggcccuguuucucgcucacuacauuggcacaucuuuaacucagaagguugugaucuucauacugcuuauguuggucaccccaucgaugacaaugcgcugugugggcguagggaacagagacuuuguugaaggacugucaggugccaccuggguggaugucgugcuagagcauggcgggugcgugacgacuauggcgaaaagcaaacccacacucgacaucgagcugcagaagaccgaagcaacucaacuugccacacugaggaaauuguguauugagggaaagaucaccaauauuacgaccgauagucggugcccuacacagggcgaagcuacucucccagaggaacaggaccagaacuaugucuguaaacacaccuacguugaucgcgguugggggaauggaugcggccuguucggcaagggguccuuagugacaugcgccaaguuucaaugucuggagcccaucgagggaaaaguagugcaguaugaaaaccucaaguacacugucauaauuaccgugcacacaggugaccagcaucagguuggcaaugacacccaaggggugacugucgagaucacgccucaggcaucuacaguggaagcuguacuuccagaguauggaacccugggcuuggaaugcagcccgcgaacuggucuagauuucaacgagaugauucugcucaccaugaaaaauaaggccuggaugguucacagacagugguuuuucgaccugccccuuccuuggacauccggggcgaccacugagacaccaacguggaacaggaaagaacuguuggugaccuuuaagaaugcccaugccaagaagcaagaggucgugguccucggcucacaggaaggagcuaugcacacugcccugacaggcgcuaccgagauccagaacagugggggaacaagcaucuucgccggucacuuaaagugucggcugaaaauggauaagcuagaacucaaaggcaugucuuacgcaaugugccugaauacuuuugugcuuaagaaagagguuuccgagacccagcaugggacgauuuugauaaagguggaauacaagggagaggacgcccccuguaaaaucccuuucucaaccgaagauggccaagguaaggcucacaacgggcgucugauuacagcgaacccaguagucacuaaaaaggaggagcccgugaauaucgaagcagagccgccuuucggcgaaagcaacauaguuauuggaaucggcgacaaagcccucaagaucaauugguauaagaaagggaguucuauuggaaagauguuugaggcuaccgcccgcggugcaagaaggauggccauccugggcgauacagcuugggacuucggguccgugggaggcguccuuaacagccuggguaaaauggugcaucagauuuuugggucggccuacacugcauuguucucuggcguauccuggauaaugaagaucggaauuggcgugcuccugaccuggaucggguuaaauucaaagaacacgaguaugagcuuuuccugcaucguuauuggaauaaucacacuguaucuaggcgcggucgugcaggcugauauggguugugccauuaauuggaaggggaaggaacucaaaugcggaucuggcaucuucgugaccaacgagguccacacuuggacagagcaguacaaguuucaagcagacagccccaaacggcuggccaccgcuauugccggugcaugggaaaauggcguuugugggauccgaucaacuacccgcauggagaaccuuuuguggaagcagauagcuaaugaacugaacuauauccucugggagaauaacauuaaacugacaguggugguaggagauaucauuggcgucuuagaacaggggaagagaacgcugaccccacagccuauggagcuuaaauacaguuggaagacuuggggaaaggccaaaaucgugacagcggagacccaaaauuccagcuucauaauugacggccccaacacaccagaaugccccucugccucaagggcuuggaacguuugggagguggaagacuaugguuuuggggucuucacuaccaauaucugguugaagcuccgggagguguacacgcagaguugugaucaucgccugaugagcgcagccauuaaagacgaaagagcuguucacgccgauaugggauacuggaucgagucccagaagaacggcucuuggaaacuagagaaggcaucguuuauagaagugaagacaugcaccuggccuaaaagccacacucugugguccaaugguguacucgagucagacaugaucauuccaaagagucuggcgggcccgaucucucagcauaaccacaggcccggguaucauacccaaacagccggaccuuggcaccuuggcaaauuggaacuggauuucaauuacugcgaggggacuaccgucgugauuacagagaacuguggaacgcguggccccagcuuacggaccacuacaguguccgguaagcucauccacgaauggugcugucgaucaugcacccugcccccucuuagauauaugggggaggacggauguugguacggcauggaaauaaggccaauuaaugagaaagaagagaacauggucaagagccugguuucugcugguuccggcaagguggauaauuuuacuauggggguauugugccucgccauccuguucgaggaagugaugcgcggaaaauucggcaagaaacauaugaucgcagggguccuauuuacauucgugcugcuccugaguggacagauuaccuggcgggacauggcucacacgcuuaucaugauuggcagcaacgccucugauagaauggguauggggguuacuuauuuggcacugauagccaccuuuaagauccagcccuucuuagcucucggauuuuuccugaggaaacuuacaucccgcgagaaucugcuacucggcgugggccuggcgauggccaccacuuugcaacugccggaagacauugagcagauggcaaacgggaucgcuuuaggacucaugacacugaaacuuauuacccaguuugaaacauaccagcuguggacugccuuggucucacucaccuguaguaauacgaucuucacacugaccguggccuggcgaacugcuacccuaauacuggccgguguuagccuucucccucugugccaaucguccucuaugcggaagacagauugguugccaaugacuguggccgcgaugggcguaccaccucugcccuuauuuaucuucagccucaaagacaccccaaagcguagaucauggccucugaacgaggggguaauggcugugggacuuguuaguauucuggccuccucuuugcucaggaaugaugugcccauggcaggcccacuggucgccggugggcuacugaucgcuuguuaugugauuacgggaacaagcgcagaccuuaccguagagaaagccgcggacgugacuugggaagaggaagcugagcagacaggcgucucccauaaccucaugaucaccguugaugacgauggcacuaugcgcauaaaggacgaugaaacagagaacauucugaccguguuguuaaaaacggcccugcucaucgugucagggaucuuuccguacagcauuccugcaacucugcuugucuggcacaccuggcagaagcagacacaacggaguggagugcugugggacguucccucuccacccgagacccagaaagccgaauuggaggaagguguauacagaauaaagcagcagggcaucuucgggaagacacaagugggagucggcgugcagaaagaggguguuuuucauacuauguggcacgugaccagaggggcuguccuaacgcacaauggaaagcgacuggagccuaacugggccuccgugaaaaaggaucucauuagcuauggcggcggguggcgccugaaugcacaguggcaaaaaggagaagagguacaggucaucgcuguggaaccagguaagaaccccaagaauuuccagacaaugccuggcauuuuccagacuaccacaggggagaucggagccauagcgcuugacuuuaaaccgggcaccucggguucaccaaucauuaaccgggaagggaagguugugggauuauacggcaauggcgucgugacuaaaaacgggggauauguuucugguaucgcccaaaccaaugcagagcccgauggcccuacaccagagcuggaagaggaaauguucaagaaaagaaaccucacgauuauggacuugcaucccgggaguggaaagacuaggaaguaccugccugcuaucgugcgugaggccauaaaacgccggcucagaacccugauucuugcuccgacaagggucguggcagccgaaauggaggaggcccugaagggcuugcccauccgauaucagaccacugcuacaaaauccgaacacaccggucgggagaucguagaucuaaugugccaugcgacguuuacuaugcgccugcucagcccagugagaguuccuaauuacaacuuagucauuauggacgaagcacacuucacagaucccgccucuaucgcugccaggggguauauaagcacccgggugggaaugggcgaggcagccgcuauuuuuaugaccgcgacuccaccuggcacagccgaagcauucccccaguccaaugcuccaauccaggacgaggagcgagacauuccggaaagaucauggaacagugggaaugaguggaucaccgauuuugugggaaagacagucugguucguaccuagcauaaaagccgguaacgacauugcaaacugucugcgcaagaauggcaagaaagugauccaacuuucuaggaagacuuuugauacggaauaccagaaaacccgucugaacgacugggauuucguugugacaacugacaucuccgagaugggggccaauuuuaaggcugaucgggucauugaccccagaaggugccucaaaccagugaucuugaccgauggacccgagcgcguuauucuggccggcccuaugccagugacagcggcaucagccgcucagcgaagaggucgggucgggaggaacccccagaaggaaaaugaccaauacauauucaccggccagccucucaacaaugaugaggaccaugcccacuggacugaagcuaagaugcugcuugacaacaucaauacgccggagggaauuaucccagcacuauucgaacccgagcgcgagaaaagugccgcuaucgauggcgaauaucgucugaagggggagagcagaaaaaccuuuguggaauugaugcggaggggagacuuaccuguauggcuggcccacaagguggcauccgaggguauuaaauacacagaucgcaaguggugcuucgacggcgaacgaaacaaucagauacucgaggagaacauggauguugaaaucuggacuaaagagggggaaagaaagaagcugcggcccagguggcuugacgcgcgcaccuauucugauccacuggcccucaaagaguuuaaggacuucgcugccggaagaaaaucgauugcauuggaucuggucacagaaaucggcagggugccuagccaucuagcucaccggacccguaaugcccuggacaaccucgugaugcuucauacuucagagcacggugggcgcgcauaccgacacgccgucgaggaacugcccgagacaauggaaacguuauugcugcucggccugaugauucuucugaccggaggcgcuaugcucuuuuugaucuccgggaagggaauagguaaaacaaguaucggccugauuuguguuaucgugucuagcgggauguuauggauggcggauguaccacuacaguggauugccuccgcaaucgugcuggaguucuuuaugaugguccuccuuauaccugagccggaaaagcaaagaacaccccaggacaaucagcuggcuuaugugguuauuggaaucuugacccuggccgccauuguggcagcuaacgagaugggccuccuggaaaccacaaagagggaucuugguaugucaaaagagccaggggucguaucuccuacuagcuaccucgacguggaccugcaucccgccagugcguggacguuguaugcuguugccaccacagugaucacuccaaugcugcggcacaccauagaaaauuccacagcaaacgucagcuuagccgcuaucgcaaaccaagccgugguccuaaugggccuggauaagggauggccuauuucuaaaauggaccucggcgugccccuucuggcguuggggugcuacucacagguuaauccgcugacccucacugcugccgugcugcuuuuaguaacgcauuacgcaaucauuggaccaggccugcaggccaaggcuacacgcgaggcccagaaaagaaccgcagcugguaucaugaagaacccuacuguggaugggauaaugaccauugaccucgaucccgucaucuaugacuccaaguucgagaaacaauugggacagguuaugcugcuagugcugugugccguccagcuccuucugaugaggacaaguugggcguugugcgaagcccugacucucgcaaccggcccaaucacaacgcugugggaggguagccccggcaaguuuuggaauaccacuauugcugugucgauggccaacaucuuccgggggucuuacuuagcaggagcuggccuugccuuuuccauaaugaaaagcguagggacaggacgaagaggcaccgguucacagggggaaacucugggagagaaguggaaaaagaagcucaaucaacuaagucgcaaagaguucgaucuguauaagaaaucuggcauuacagagguggacaggaccgaggccaaggaagguuugaaacggggcgagacgacccaccaugcgguuucccgugggagcgcuaagcugcagugguuuguggaaagaaacauggucaucccugagggaagggugauugaucucggcugugggcgcggaggcuggucauacuauugcgcaggucuuaaaaaggucacagaagugcggggguacacuaagggaggcccgggccacgaggagcccguuccaaugaguaccuauggguggaauaucguaaaacugaugagcggaaaggacguguucuacuugccucccgaaaaaugugauacacugcucugcgacauaggugaguccucuccuagcccaacugucgaagagucccgaaccaucagaguguuaaagaugguugagcccuggcugaggaacaaucaguucuguauuaaagugcuuaacccuuacaugccaacagucaucgaacaccuggagcgccuacagcggaaguauggcgggaugcucgugagaaauccccugucacguaacucuacccaugaaauguacuggauuaguaauggaacuggcaacaucguaucgagcgugaauaugguuuccagguugcugcucaaccgguuuacgaugacacaccgccgaccgaccauugagaaggaugucgaccuuggugccgggacuagacaugugaacgcugaaccugagaccccaaauauggacgugaucggagagaggauaaaacggauuaaggaagaacacucuucaacauggcacuaugaugacgaaaaccccuacaaaacgugggccuaucauggcagcuacgaggucaaggcaaccggcuccgccaguucuaugaucaaugggguugugaaacuguuaacuaagccuugggauguagugccaauggucacacaaauggcuaugaccgacacuacacccuucggacagcagcgcguguuuaaggaaaaaguugauaccagaacaccgaggccuaugcccgguacucgaaaggugauggagaucaccgcggaguggcuguggcggacguugggccguaacaaaaagccaagacucugcacccgcgaagaguucacuaaaaaggucaggacuaaugccgcaaugggggcuguguuuaccgaagagaaccaaugggacagcgcccgggcagccguagaagaugaggaguucuggaagcugguugacagagaacgcgagcuacacaaacuuggaaaguguggcucaugcguguauaauaugauggguaaaagggaaaagaaacugggggaguuuggaaaggcuaaaggcucccgagccauuugguacauguggcucggcgcgcgguaccuggaguucgaagcauugggguuucugaacgaggaucauugguucaguagagaaaauagcuauucuggagucgagggugaaggccuccacaaacuuggguacauacugagggacaucuccaagauuccuggaggcgccauguaugcugaugacacagccgguugggacacucgcaucaccgaggaugacuuacauaacgaggagaaaauuacgcagcagauggaucccgagcaccgucagcuggcaaaugcuaucuuuaaguugacauaccaaaacaaaguggugaagguccagcggccaacccccaaagggacuguuauggacauaaucucaagaaaggaucagaggggaagcggccaggugggcacauaugggcucaauaccuucacuaacauggaagcccaacugguacgccagauggagggagaaggugugcuaucgaaggcugaccuugagaauccucaucugcucgagaaaaagauuacccaguggcuggaaacaaaaggcgucgagcgauugaagcggauggccaucucuggggaugacugcgugguuaaaccaauugaugacagauuugcaaacgcguuacuggcccucaacgauaugggaaaggugaggaaggacaucccgcaguggcaacccaguaaaggcuggcaugauuggcagcaggucccuuucuguucccaccauuuccacgaacuuauaaugaaggacggucgcaaacuggugguaccaugcagaccccaggacgagcuaauugggcgggcuaggaucagccaaggagccggcuggucacugaaggaaacggcaugucucggcaaggcuuacgcccagaugugguccuugauguauuuucaccgucgagaucugcgccuugcaucuaaugccaucugcagcgcgguuccugugcauuggauuccaaccaguagaacuacaugguccauacacgcucaucaccaguggaugaccacugaggacaugcugacagucuggaaccggguguggaucgaggauaaucccuggauggaagacaagaccccuguuacgacaugggaggaugugccguaccucgggaagagggaagaccaaugguguggcagcuuaauuggucugaccucucgcgccacuugggcacagaacaucuugaccgccauucagcaggucagaucacugaucggcgaugaggaguuccucgacuacaugccaaguaugaaacgguuuaggaaggaagaggaauccgagggggcuauaugguga

SEQ ID NO: 15200 - RNA, 9873 nt, Artificial Sequence
  derived and/or modified CDS sequence (opt3) from DENV-3__GU131908__SS-prME
accagccugugccucaugaugaugcuucccgcaacucuggcuuuccacuugacuuccagggacggagagccuaggaugaucguggggaagaacgaacggggaaagucuuuacuguuuaagacggcaucagguauuaauauguguacccuaauagccauggaucucggcgagaugugcgacgauacagucacuuacaaguguccacugaucgcggaaguugagccggaagacauugauugcugguguaaccuuaccaguacaugggugaccuaugggacuugcaaucaggcuggagagcaccgccgagacaagcguagcgucgcccuggcaccccacgugggcauggguuuggauacaagaacccaaacguggauguccgccgagggggcuuggaggcaggucgaaaagguggagacuugggcacuccggcauccuggauucaccauccuggcccuguuucucgcucacuacauuggcacaucuuuaacucagaagguugugaucuucauacugcuuauguuggucaccccaucgaugacaaugcgcugugugggcguagggaacagagacuuuguugaaggacugucaggugccaccuggguggaugucgugcuagagcauggcgggugcgugacgacuauggcaaagagcaaacccacacucgacaucgagcugcagaagaccgaagcaacucaacuugccacacugaggaaauuguguauugagggaaagaucaccaauauuacgaccgauagucggugcccuacacagggcgaagcuacucucccagaggaacaggaccagaacuaugucuguaaacacaccuacguugaucgcgguugggggaauggaugcggccuguucggcaagggguccuuagugacaugcgccaaguuucaaugucuggagcccaucgagggaaaaguagugcaguaugaaaaccucaaguacacugucauaauuaccgugcacacaggugaccagcaucagguuggcaaugacacccaaggggugacugucgagaucacgccucaggcaucuacaguggaagcuguacuuccagaguauggaacccugggcuuggaaugcagcccgcgaacuggucuagauuucaacgagaugauucugcucaccaugaaaaauaaggccuggaugguucacagacagugguuuuucgaccugccccuuccuuggacauccggggcgaccacugagacaccaacguggaacaggaaagaacuguuggugaccuuuaagaaugcccaugccaagaagcaagaggucgugguccucggcucacaggaaggagcuaugcacacugcccugacaggcgcuaccgagauccagaacagugggggaacaagcaucuucgccggucacuuaaagugucggcugaaaauggauaagcuagaacucaaaggcaugucuuacgcaaugugccugaauacuuuugugcuuaagaaagagguuuccgagacccagcaugggacgauuuugauaaagguggaauacaagggagaggacgcccccuguaaaaucccuuucucaaccgaagauggccaagguaaggcucacaacgggcgucugauuacagcgaacccaguagucacuaaaaaggaggagcccgugaauaucgaagcagagccgccuuucggcgaaagcaacauaguuauuggaaucggcgacaaagcccucaagaucaauugguauaagaaagggaguucuauuggaaagauguuugaggcuaccgcccgcggugcaagaaggauggccauccugggcgauacagcuugggacuucggguccgugggaggcguccuuaacagccuggguaaaauggugcaucagauuuuugggucggccuacacugcauuguucucuggcguauccuggauaaugaagaucggaauuggcgugcuccugaccuggaucggguuaaauucaaagaacacgaguaugagcuuuuccugcaucguuauuggaauaaucacacuguaucuaggcgcggucgugcaggcugauauggguugugccauuaauuggaaggggaaggaacucaaaugcggaucuggcaucuucgugaccaacgagguccacacuuggacagagcaguacaaguuucaagcagacagccccaaacggcuggccaccgcuauugccggugcauggaagaauggcguuugugggauccgaucaacuacccgcauggaaaaccuuuuguggaaacagauagcuaaugagcugaacuauauccucugggaaaauaacauuaagcugacaguggugguaggagauaucauuggcgucuuagagcaggggaaaagaacgcugaccccacagccuauggaacuuaaguacaguuggaagacuuggggaaaagccaagaucgugacagcggagacccaaaauuccagcuucauaauugacggccccaacacaccagagugccccucugccucaagggcuuggaacguuugggaaguggaggacuaugguuuuggggucuucacuaccaauaucugguugaaacuccgggaaguguacacgcagaguugugaucaucgccugaugagcgcagccauuaaggacgagagagcuguucacgccgauaugggauacuggaucgaaucccagaaaaacggcucuuggaagcuagagaaggcaucguuuauagaggugaaaacaugcaccuggccuaagagccacacucugugguccaaugguguacucgaaucagacaugaucauuccaaaaagucuggcgggcccgaucucucagcauaaccacaggcccggguaucauacccaaacagccggaccuuggcaccuuggcaaguuggagcuggauuucaauuacugcgaagggacuaccgucgugauuacagagaacuguggaacgcguggccccagcuuacggaccacuacaguguccgguaaacucauccacgaguggugcugucgaucaugcacccugcccccucuuagauauaugggggaagacggauguugguacggcauggagauaaggccaauuaaugaaaaggaggaaaacauggucaagagccugguuucugcugguuccggcaaaguggauaauuuuacuauggggguauugugccucgccauccuguucgaggaggugaugcgcggaaaguucggcaaaaagcauaugaucgcagggguccuauuuacauucgugcugcuccugaguggacagauuaccuggcgggacauggcucacacgcuuaucaugauuggcagcaacgccucugauagaauggguauggggguuacuuauuuggcacugauagccaccuuuaaaauccagcccuucuuagcucucggauuuuuccugaggaaacuuacaucccgcgaaaaucugcuacucggcgugggccuggcgauggccaccacuuugcaacugccggaggacauugaacagauggcaaacgggaucgcuuuaggacucaugacacugaaacuuauuacccaguuugagacauaccagcuguggacugccuuggucucacucaccuguaguaauacgaucuucacacugaccguggccuggcgaacugcuacccuaauacuggcggguguuagccuucucccucugugccaaucguccucuaugcggaaaacagauugguugccaaugacuguggccgcgaugggcguaccaccucugcccuuauuuaucuucagccucaaggacaccccaaaacguagaucauggccucugaacgaagggguaauggcugugggacuuguuaguauucuggccuccucuuugcucaggaaugaugugcccauggcaggcccacuggucgccggugggcuacugaucgcuuguuaugugauuacgggaacaagcgcagaccuuaccguagagaaggccgcggacgugacuugggaggaagaggcugaacagacaggcgucucccauaaccucaugaucaccguugaugacgauggcacuaugcgcauaaaagacgaugagacagaaaacauucugaccguguuguuaaagacggcccugcucaucgugucagggaucuuuccguacagcauuccugcaacucugcuugucuggcacaccuggcagaaacagacacaacggaguggagugcugugggacguucccucuccacccgagacccagaaggccgaguuggaagaggguguauacagaauaaagcagcagggcaucuucgggaaaacacaagugggagucggcgugcagaaggaagguguuuuucauacuauguggcacgugaccagaggggcuguccuaacgcacaauggaaaacgacuggagccuaacugggccuccgugaagaaagaucucauuagcuauggcggcggguggcgccugaaugcacaguggcaaaagggagaggaaguacaggucaucgcuguggagccagguaagaaccccaaaaauuuccagacaaugccuggcauuuuccagacuaccacaggggaaaucggagccauagcgcuugacuuuaagccgggcaccucggguucaccaaucauuaaccgggaggggaaaguugugggauuauacggcaauggcgucgugacuaagaacgggggauauguuucugguaucgcccaaaccaaugcagaacccgauggcccuacaccagagcuggaggaagagauguucaaaaagagaaaccucacgauuauggacuugcaucccgggaguggaaagacuaggaaauaccugccugcuaucgugcgugaagccauaaagcgccggcucagaacccugauucuugcuccgacaagggucguggcagccgagauggaagaggcccugaaaggcuugcccauccgauaucagaccacugcuacaaaguccgagcacaccggucgggaaaucguagaucuaaugugccaugcgacguuuacuaugcgccugcucagcccagugagaguuccuaauuacaacuuagucauuauggacgaggcacacuucacagaucccgccucuaucgcugccaggggguauauaagcacccgggugggaaugggcgaagcagccgcuauuuuuaugaccgcgacuccaccuggcacagccgaggcauucccccaguccaaugcuccaauccaggacgaggaacgagacauuccggagagaucauggaacagugggaaugaauggaucaccgauuuugugggaaaaacagucugguucguaccuagcauaaaggccgguaacgacauugcaaacugucugcgcaagaauggcaaaaaggugauccaacuuucuaggaaaacuuuugauacggaguaccagaagacccgucugaacgacugggauuucguugugacaacugacaucuccgaaaugggggccaauuuuaaagcugaucgggucauugaccccagaaggugccucaagccagugaucuugaccgauggacccgagcgcguuauucuggccggcccuaugccagugacagcggcaucagccgcucagcgaagaggucgggucgggaggaacccccagaaggagaaugaccaauacauauucaccggccagccucucaacaaugaugaagaccaugcccacuggacugaggcuaaaaugcugcuugacaacaucaauacgccggaaggaauuaucccagcacuauucgagcccgaacgcgagaagagugccgcuaucgauggcgaguaucgucugaaaggggaaagcagaaagaccuuuguggaguugaugcggaggggagacuuaccuguauggcuggcccacaaaguggcauccgaagguauuaaguacacagaucgcaaauggugcuucgacggcgagcgaaacaaucagauacucgaagagaacauggauguugagaucuggacuaaggaaggggagagaaagaaacugcggcccagguggcuugacgcgcgcaccuauucugauccacuggcccucaaggaauuuaaagacuucgcugccggaagaaagucgauugcauuggaucuggucacagagaucggcagggugccuagccaucuagcucaccggacccguaaugcccuggacaaccucgugaugcuucauacuucagaacacggugggcgcgcauaccgacacgccgucgaggagcugcccgaaacaauggagacguuauugcugcucggccugaugauucuucugaccggaggcgcuaugcucuuuuugaucuccgggaaaggaauagguaagacaaguaucggccugauuuguguuaucgugucuagcgggauguuauggauggcggauguaccacuacaguggauugccuccgcaaucgugcuggaguucuuuaugaugguccuccuuauaccugagccggagaagcaaagaacaccccaggacaaucagcuggcuuaugugguuauuggaaucuugacccuggccgccauuguggcagcuaacgaaaugggccuccuggagaccacaaaaagggaucuugguaugucaaaggaaccaggggucguaucuccuacuagcuaccucgacguggaccugcaucccgccagugcguggacguuguaugcuguugccaccacagugaucacuccaaugcugcggcacaccauagaaaauuccacagcaaacgucagcuuagccgcuaucgcaaaccaagccgugguccuaaugggccuggauaaaggauggccuauuucuaagauggaccucggcgugccccuucuggcguuggggugcuacucacagguuaauccgcugacccucacugcugccgugcugcuuuuaguaacgcauuacgcaaucauuggaccaggccugcaggccaaagcuacacgcgaagcccagaagagaaccgcagcugguaucaugaagaacccuacuguggaugggauaaugaccauugaccucgaucccgucaucuaugacuccaaauucgagaagcaauugggacagguuaugcugcuagugcugugugccguccagcuccuucugaugaggacaaguugggcguugugcgaggcccugacucucgcaaccggcccaaucacaacgcugugggaagguagccccggcaaauuuuggaauaccacuauugcugugucgauggccaacaucuuccgggggucuuacuuagcaggagcuggccuugccuuuuccauaaugaaaagcguagggacaggacgaagaggcaccgguucacagggggagacucugggagaaaaauggaagaagaaacucaaucaacuaagucgcaaggaguucgaucuguauaaaaagucuggcauuacagaaguggacaggaccgaggccaaagaggguuugaagcggggcgaaacgacccaccaugcgguuucccgugggagcgcuaaacugcagugguuuguggagagaaacauggucaucccugaaggaagggugauugaucucggcugugggcgcggaggcuggucauacuauugcgcaggucuuaagaaggucacagaggugcggggguacacuaaaggaggcccgggccacgaagaacccguuccaaugaguaccuauggguggaauaucguaaagcugaugagcggaaaagacguguucuacuugccucccgagaagugugauacacugcucugcgacauaggugaauccucuccuagcccaacugucgaggaaucccgaaccaucagaguguuaaaaaugguugagcccuggcugaggaacaaucaguucuguauuaaggugcuuaacccuuacaugccaacagucaucgagcaccuggaacgccuacagcggaaguauggcgggaugcucgugagaaauccccugucacguaacucuacccaugagauguacuggauuaguaauggaacuggcaacaucguaucgagcgugaauaugguuuccagguugcugcucaaccgguuuacgaugacacaccgccgaccgaccauugaaaaagaugucgaccuuggugccgggacuagacaugugaacgcugagccugaaaccccaaauauggacgugaucggagagaggauaaagcggauuaaagaggaacacucuucaacauggcacuaugaugacgagaaccccuacaagacgugggccuaucauggcagcuacgaagucaaagcaaccggcuccgccaguucuaugaucaaugggguugugaagcuguuaacuaagccuugggauguagugccaauggucacacaaauggcuaugaccgacacuacacccuucggacagcagcgcguguuuaaagagaagguugauaccagaacaccgaggccuaugcccgguacucgaaaagugauggaaaucaccgcggaguggcuguggcggacguugggccguaacaagaaaccaagacucugcacccgcgaggaguucacaaagaaggucaggacuaaugccgcaaugggggcuguguuuaccgaggaaaaccaaugggacagcgcccgggcagccguagaggaugaagaguucuggaaacugguugacagagagcgcgaacuacacaaacuuggaaaauguggcucaugcguguauaauaugauggguaagagggagaaaaagcugggggaauuuggaaaagcuaagggcucccgagccauuugguacauguggcucggcgcgcgguaccuggaguucgaggcauugggguuucugaacgaagaucauugguucaguagagagaauagcuauucuggagucgaaggugagggccuccacaaacuuggguacauacugagggacaucuccaaaauuccuggaggcgccauguaugcugaugacacagccgguugggacacucgcaucaccgaagaugacuuacauaacgaggagaagauuacgcagcagauggaucccgaacaccgucagcuggcaaaugcuaucuuuaaauugacauaccaaaacaagguggugaaaguccagcggccaacccccaaggggacuguuauggacauaaucucaagaaaggaucagaggggaagcggccaggugggcacauaugggcucaauaccuucacuaacauggaggcccaacugguacgccagauggaaggagagggugugcuaucgaaagcugaccuugaaaauccucaucugcucgagaagaaaauuacccaguggcuggagacaaagggcgucgaacgauugaaacggauggccaucucuggggaugacugcgugguuaagccaauugaugacagauuugcaaacgcguuacuggcccucaacgauaugggaaaggugaggaaagacaucccgcaguggcaacccaguaagggcuggcaugauuggcagcaggucccuuucuguucccaccauuuccacgagcuuauaaugaaagacggucgcaagcuggugguaccaugcagaccccaggacgaacuaauugggcgggcuaggaucagccaaggagccggcuggucacugaaagagacggcaugucucggcaaggcuuacgcccagaugugguccuugauguauuuucaccgucgagaucugcgccuugcaucuaaugccaucugcagcgcgguuccugugcauuggauuccaaccaguagaacuacaugguccauacacgcucaucaccaguggaugaccacugaagacaugcugacagucuggaaccggguguggaucgaggauaaucccuggauggaggacaagaccccuguuacgacaugggaagaugugccguaccucgggaaaagggaggaccaaugguguggcagcuuaauuggucugaccucucgcgccacuugggcacagaacaucuugaccgccauucagcaggucagaucacugaucggcgaugaagaguuccucgacuacaugccaaguaugaagcgguuuaggaaagaggaagaguccgaaggggcuauaugguga

SEQ ID NO: 15201 - RNA, 9873 nt, Artificial Sequence
  derived and/or modified CDS sequence (opt3) from DENV-3__GU131909__SS-prME
accagccugugccucaugaugaugcuucccgcaacacuggcuuuccacuugacuuccagggacggcgagccuaggaugaucguggggaagaacgaacggggaaaaucuuuacuguuuaagacggcaucagguauuaauauguguacccucauagcaauggaucucggcgagaugugcgacgauacagucacuuacaaauguccacugaucgcggaaguugagccggaagacauugauugcugguguaaccuuaccaguacaugggugaccuaugggacuugcaaucaggcuggagagcaucgccgagacaagcguagcgucgcccuggcaccccacgugggcauggguuuggauacaagaacccaaacguggauguccgccgagggggcuuggaggcaggucgaaaaaguggagacuugggcauuccggcauccuggauuuaccauccucgcccuguuccuggcucacuacauuggcacaucucucacucagaagguugugaucuuuauauuacugaugcuugucaccccaucgaugacaaugcgcugugugggcguagggaacagagacuucguugaaggauugucaggugccaccuggguggaugucgugcuggagcauggcgggugcgugacgacuauggcgaaaagcaaacccacacuagacaucgagcuccagaagaccgaagcaacucaacuggccacacuuaggaaacuguguauugagggaaagaucaccaauauuacgaccgauagucggugcccuacacagggcgaagcuacuuugccagaggaacaggaccagaacuaugucuguaaacacaccuacguugaucgcgguugggggaauggaugcggccucuuuggcaaggggucccuggugacaugcgccaaguuccaauguuuagagcccaucgagggaaaaguagugcaguaugaaaaccugaaguacacugucauaauuaccgugcacacaggugaccagcaucagguuggcaaugacacccaaggggugacugucgagaucacgccucaggcaucuacaguggaagcuguacucccagaguauggaacccuuggccuggaaugcagcccgcgaacugguuuggauuuuaacgagaugauucuacugaccaugaaaaauaaggccuggaugguucacagacagugguucuuugaccucccccugccuuggacauccggggcgaccacugagacaccaacguggaacaggaaagaacuucuggugaccuucaagaaugcccaugccaaaaagcaagaggucguggucuugggcucacaggaaggagcuaugcacacugcccucacaggcgcuaccgagauccagaacagugggggaacaagcaucuuugccggucaccugaagugucgguuaaaaauggauaagcuggaacuaaaaggcaugucuuacgcaaugugccucaauacuuucgugcugaagaaagagguuuccgagacccagcaugggacgauucuuauaaagguggaauacaagggagaggacgcccccuguaaaaucccuuucucaaccgaagauggccaagguaaggcucacaacgggcguuugauuacagcgaacccaguagucacuaaaaaggaggagcccgugaauaucgaagcagagccgccuuuuggcgaaagcaacauaguuauuggaaucggcgacaaagcccugaagaucaauugguauaagaaagggaguucuauuggaaagauguucgaggcuaccgcccgcggugcaagaaggauggccauccucggcgauacagcuugggacuuuggguccgugggaggcguccugaacagccuugguaaaauggugcaucagauuuucgggucggccuacacugcacuguuuucuggcguauccuggauaaugaagaucggaauuggcguguugcucaccuggaucgggcugaauaguaaaaacacgucaaugagcuucuccugcaucguuauuggaauaaucacauuauaucugggcgcggucgugcaggcugauauggguugugccauuaauuggaaggggaaggaacuaaaaugcggaucuggcaucuuugugaccaacgagguccacacuuggacagagcaguacaaguuccaagcagacagccccaaacggcucgccaccgcuauugccggugcaugggaaaauggcguuugugggauccgaucaacuacccgcauggagaaccugcuuuggaagcagauagcuaaugaauugaacuauauccugugggagaauaacauuaaacucacaguggugguaggagauaucauuggcguccuggaacaggggaagagaacguuaaccccacagccuauggagcugaaauacaguuggaagacuuggggaaaggccaaaaucgugacagcggagacccaaaauuccagcuuuauaauugacggccccaacacaccagaaugccccucugccucaagggcuuggaacguuugggagguggaagacuaugguuucggggucuuuacuaccaauaucuggcuuaaguugcgggagguguacacgcagaguugugaucaucgccucaugagcgcagccauuaaagacgaaagagcuguucacgccgauaugggauacuggaucgagucccagaagaacggcucuuggaaacuggagaaggcaucguucauagaagugaagacaugcaccuggccuaaaagccacacucuaugguccaaugguguacuggagucagacaugaucauuccaaagagucucgcgggcccgaucucucagcauaaccacaggcccggguaucauacccaaacagccggaccuuggcaccugggcaaacuugaauuggauuuuaauuacugcgaggggacuaccgucgugauuacagagaacuguggaacgcguggcccaagccugcggaccacuacaguguccgguaaguuaauccacgaauggugcugucgaucaugcacccuacccccucugagauauaugggggaggacggauguugguacggcauggaaauaaggccaauuaaugagaaagaagagaacauggucaagagccuuguuucugcugguuccggcaagguggauaauuucacuauggggguacugugcuuggccauccucuucgaggaagugaugcgcggaaaauuuggcaagaaacauaugaucgcagggguccuguucacauuugugcuacugcucaguggacagauuaccuggcgggacauggcucacacgcugaucaugauuggcagcaacgccucugauagaauggguauggggguuacuuaucuugcauugauagccaccuucaagauccagcccuuucuggcuuuaggauucuuucucaggaaacugacaucccgcgagaaucuucugcuaggcgugggccucgcgauggccaccacucugcaauugccggaagacauugagcagauggcaaacgggaucgcucugggauuaaugacacucaagcugauuacccaguucgaaacauaccagcuuuggacugcccuggucucauugaccuguaguaauacgaucuuuacacucaccguggccuggcgaacugcuacccugauacuagccgguguuagccugcuuccucucugccaaucguccucuaugcggaagacagauuggcugccaaugacuguggccgcgaugggcguacccccuuugccccuguucaucuuuagcuuaaaagacaccccaaagcguagaucauggccucucaacgaggggguaauggcugugggacugguuaguauucuugccuccucucuguugaggaaugaugugcccauggcaggcccacucgucgccggugggcugcuaaucgcuuguuaugugauuacgggaacaagcgcagaccugaccguagagaaagccgcggacgugacuugggaagaggaagcugagcagacaggcgucucccauaaccuuaugaucaccguugaugacgauggcacuaugcgcauaaaggacgaugaaacagagaacauucucaccgugcuguugaaaacggccuuacugaucgugucagggaucuucccguacagcauuccugcaacucuccuggucuggcacaccuggcagaagcagacacaacggaguggagugcuuugggacguucccucuccacccgagacccagaaagccgaacuggaggaagguguauacagaauaaagcagcagggcaucuuugggaagacacaagugggagucggcgugcagaaagaggguguuuuccauacuauguggcacgugaccagaggggcugucuugacgcacaauggaaagcgacuagagccuaacugggccuccgugaaaaaggaucugauuagcuauggcggcggguggcgccucaaugcacaguggcaaaaaggagaagagguacaggucaucgcuguggaaccagguaagaaccccaagaauuuccagacaaugccuggcauuuuucagacuaccacaggggagaucggagccauagcgcuggacuucaaaccgggcaccucggguucaccaaucauuaaccgggaagggaagguugugggacuuuacggcaauggcgucgugacuaaaaacgggggauauguuucugguaucgcccaaaccaaugcagagcccgauggcccuacaccagaguuagaagaggaaauguuuaagaaaagaaaccugacgauuauggaccuccaucccgggaguggaaagacuaggaaguacuugccugcuaucgugcgugaggccauaaaacgccggcugagaacccucauucuggcuccgacaagggucguggcagccgaaauggaggaggcccuuaagggccugcccauccgauaucagaccacugcuacaaaauccgaacacaccggucgggagaucguagauuugaugugccaugcgacguucacuaugcgccuacugagcccagugagaguuccuaauuacaaccucgucauuauggacgaagcacacuuuacagaucccgccucuaucgcugccaggggguauauaagcacccgggugggaaugggcgaggcagccgcuauuuucaugaccgcgacuccaccuggcacagccgaagcauuuccccaguccaaugcuccaauccaggacgaggagcgagacauuccggaaagaucauggaacagugggaaugaguggaucaccgauuucgugggaaagacagucugguuuguaccuagcauaaaagccgguaacgacauugcaaacuguuuacgcaagaauggcaagaaagugauccaacugucuaggaagacuuucgauacggaauaccagaaaacccgucuuaacgacugggauuuuguugugacaacugacaucuccgagaugggggccaauuucaaggcugaucgggucauugaccccagaaggugccugaaaccagugauccucaccgauggacccgagcgcguuauuuuggccggcccuaugccagugacagcggcaucagccgcucagcgaagaggucgggucgggaggaacccccagaaggaaaaugaccaauacauauucaccggccagccucugaacaaugaugaggaccaugcccacuggacugaagcuaagaugcuccuggacaacaucaauacgccggagggaauuaucccagcacuuuuugaacccgagcgcgagaaaagugccgcuaucgauggcgaauaucgucuaaagggggagagcagaaaaaccuucguggaacugaugcggaggggagacuugccuguaugguuagcccacaagguggcauccgaggguauuaaauacacagaucgcaaguggugcuuugacggcgaacgaaacaaucagauacuggaggagaacauggauguugaaaucuggacuaaagagggggaaagaaagaagcuccggcccagguggcuggacgcgcgcaccuauucugauccacuugcccugaaagaguucaaggacuuugcugccggaagaaaaucgauugcacucgauuuggucacagaaaucggcagggugccuagccaucuggcucaccggacccguaaugcccuagacaaccuggugaugcuccauacuucagagcacggugggcgcgcauaccgacacgccgucgaggaacuucccgagacaauggaaacgcuguuauugcugggccucaugauucugcuuaccggaggcgcuaugcuguuccucaucuccgggaagggaauagguaaaacaaguaucggcuugauuuguguuaucgugucuagcgggaugcuguggauggcggauguaccauuacaguggauugccuccgcaaucgugcuagaguuuuucaugaugguccugcucauaccugagccggaaaagcaaagaacaccccaggacaaucagcuugcuuaugugguuauuggaauccugaccuuggccgccauuguggcagcuaacgagaugggccugcucgaaaccacaaagagggaucuggguaugucaaaagagccaggggucguaucuccuacuagcuaccuugacguggaccuccaucccgccagugcguggacgcuguaugcuguugccaccacagugaucacuccaauguugcggcacaccauagaaaauuccacagcaaacgucagccuggccgcuaucgcaaaccaagccguggucuuaaugggccuagauaagggauggccuauuucuaaaauggaccugggcgugccccuccuugcgcuggggugcuacucacagguuaauccguugacccugacugcugccgugcuccugcuuguaacgcauuacgcaaucauuggaccaggcuuacaggccaaggcuacacgcgaggcccagaaaagaaccgcagcugguaucaugaagaacccuacuguggaugggauaaugaccauugaccuggaucccgucaucuaugacuccaaguuugagaaacaacucggacagguuauguugcuggugcuaugugccguccagcugcuccuuaugaggacaaguugggcgcugugcgaagccuugacucuggcaaccggcccaaucacaacgcucugggaggguagccccggcaaguucuggaauaccacuauugcugugucgauggccaacaucuuucgggggucuuaccuggcaggagcuggcuuagccuucuccauaaugaaaagcguagggacaggacgaagaggcaccgguucacagggggaaacucuuggagagaaguggaaaaagaagcugaaucaacucagucgcaaagaauuugaucuauauaagaaaucuggcauuacagagguggacaggaccgaggccaaggaaggucugaaacggggcgagacgacccaccaugcgguuucccgugggagcgcuaaguugcagugguucguggaaagaaacauggucaucccugagggaagggugauugaucugggcugugggcgcggaggcuggucauacuauugcgcaggucucaaaaaggucacagaagugcggggguacacuaagggaggcccgggccacgaggagcccguuccaaugaguaccuauggguggaauaucguaaaacuuaugagcggaaaggacguguucuaccugccucccgaaaaaugugauacauugcugugcgacauaggugaguccucuccuagcccaacugucgaagagucccgaaccaucagagugcucaagaugguugagcccugguuaaggaacaaucaguuuuguauuaaagugcugaacccuuacaugccaacagucaucgaacaccuugagcgccugcagcggaaguauggcgggaugcuagugagaaauccccucucacguaacucuacccaugaaauguacuggauuaguaauggaacuggcaacaucguaucgagcgugaauaugguuuccaggcuguugcugaaccgguucacgaugacacaccgccgaccgaccauugagaaggaugucgaccucggugccgggacuagacaugugaacgcugaaccugagaccccaaauauggacgugaucggagagaggauaaaacggauuaaggaagaacacucuucaacauggcacuaugaugacgaaaaccccuacaaaacgugggccuaucauggcagcuacgaggucaaggcaaccggcuccgccaguucuaugaucaaugggguugugaaacuucugacuaagccuugggauguagugccaauggucacacaaauggcuaugaccgacacuacacccuuuggacagcagcgcguguucaaggaaaaaguugauaccagaacaccgaggccuaugcccgguacucgaaaggugauggagaucaccgcggagugguuauggcggacgcugggccguaacaaaaagccaagauugugcacccgcgaagaguuuacuaaaaaggucaggacuaaugccgcaaugggggcuguguucaccgaagagaaccaaugggacagcgcccgggcagccguagaagaugaggaguuuuggaagcucguugacagagaacgcgagcugcacaaacuaggaaaguguggcucaugcguguauaauaugauggguaaaagggaaaagaaacuuggggaguucggaaaggcuaaaggcucccgagccauuugguacauguggcugggcgcgcgguaccucgaguuugaagcacugggguucuugaacgaggaucauugguuuaguagagaaaauagcuauucuggagucgagggugaaggccugcacaagcucggguacauacuuagggacaucuccaagauuccuggaggcgccauguaugcugaugacacagccgguugggacacucgcaucaccgaggaugaccugcauaacgaggagaaaauuacgcagcagauggaucccgagcaccgucaguuagcaaaugcuaucuucaagcugacauaccaaaacaaaguggugaagguccagcggccaacccccaaagggacuguuauggacauaaucucaagaaaggaucagaggggaagcggccaggugggcacauauggguugaauaccuuuacuaacauggaagcccaacucguacgccagauggagggagaaggugugcugucgaaggcugaccuagagaauccucaccuucuggagaaaaagauuacccaguggcucgaaacaaaaggcgucgagcgacugaagcggauggccaucucuggggaugacugcgugguuaaaccaauugaugacagauucgcaaacgcguuguuagcccugaacgauaugggaaaggugaggaaggacaucccgcaguggcaacccaguaaaggcuggcaugauuggcagcaggucccuuucuguucccaccauuuucacgaacucauaaugaaggacggucgcaaacuugugguaccaugcagaccccaggacgagcugauugggcgggcuaggaucagccaaggagccggcuggucacuaaaggaaacggcaugucugggcaaggcuuacgcccagauguggucccucauguauuuccaccgucgagauuugcgccuggcaucuaaugccaucugcagcgcgguuccugugcauuggauuccaaccaguagaacuacaugguccauacacgcucaucaccaguggaugaccacugaggacaugcuuacagucuggaaccggguguggaucgaggauaaucccuggauggaagacaagaccccuguuacgacaugggaggaugugccguaccuggggaagagggaagaccaaugguguggaagccucauugguuuaaccucucgcgccacuugggcacagaacauccugaccgccauucagcaggucagaucauugaucggcgaugaggaguuucuggacuacaugccaaguaugaaacgguucaggaaggaagaggaauccgagggggcuauaugguga

SEQ ID NO: 15202 - RNA, 9873 nt, Artificial Sequence
  derived and/or modified CDS sequence (opt3) from DENV-3__GU131912__SS-prME
accagccugugccucaugaugaugcuucccgccacacuggcuuuccacuugacuuccagagacggcgagccuaggaugaucguggggaagaacgaacggggaaaaucuuuacuguuuaagacggcaucagguauuaauauguguacccuaauagccauggaucucggcgagaugugcgacgauacagucacuuacaaauguccacugaucgcggaaguugagccggaagacauugauugcugguguaaccuuaccaguacaugggugaccuaugggacuugcaaucaggcuggagagcaucgccgagacaagcguagcguagcccuggcaccccacgugggcauggguuuggauacaagaacccaaacguggauguccgccgagggggcuuggaggcaggucgaaaaaguggagacuugggcacuccggcauccuggauucaccauccuggcccuguuucucgcucacuacauuggcacaucuuuaacucagaagguugugaucuucauacugcuuauguuggucaccccaucgaugacaaugcgcugugugggcguagggaacagagacuuuguugaaggacugucaggugccaccuggguggaugucgugcuagagcauggcgggugcgugacgacuauggcgaagagcaaacccacacucgacaucgagcugcagaagaccgaagcaacucaacuugccacacugaggaaauuguguauugagggaaagaucaccaauauuacgaccgauagucggugcccuacacagggcgaagcuacucucccagaggaacaggaccagaacuaugucuguaaacacaccuacguugaucgcgguugggggaauggaugcggccuguucggcaagggguccuuagugacaugcgccaaguuucaaugucuggagcccaucgagggaaaaguagugcaguaugaaaaccucaaguacacugucauaauuaccgugcacacaggugaccagcaucagguuggcaaugacacccaaggggugacugucgagaucacgccucaggcaucuacaguggaagcuguacuuccagaguauggaacccugggcuuggaaugcagcccgcgaacuggucuagauuucaacgagaugauucugcucaccaugaaaaauaaggccuggaugguucacagacagugguuuuucgaccugccccuuccuuggacauccggggcgaccacugagacaccaacguggaacaggaaagaacuguuggugaccuuuaagaaugcccaugcaaaaaagcaagaggucgugguccucggcucacaggaaggagcuaugcacacugcccugacaggcgcuaccgagauccagaacagugggggaacaaauaucuucgccggucacuuaaagugucggcugaaaauggauaagcuagaacucaaaggcaugagcuacgcaaugugccugaacacuuuugugcuuaagaaagagguuucugagacccagcaugggacgauuuugauaaagguggaauacaagggagaggacgcccccuguaaaaucccuuucuccaccgaagauggccaagguaaggcucacaacgggcgucugauuacagcgaauccaguagucacuaaaaaggaggagcccaucaacauagaagcagagccgccuuucggcgaaucaaauauugugaucggaaucggcgacaaagcccucaagauuaacugguauaagaaagggagcaguaucggaaagauguuugaggcuaccgcccgcggugcaagaaggauggccauucugggcgauacagcuugggacuucgggucuguuggaggcgugcuuaauucccuggguaaaaugguccaucagauauuugggagcgccuacacugcauuguucucgggcgugucuuggaucaugaagauuggaaucggcguacuccugaccuggaucggguuaaacuccaaaaauacgucaaugaguuuuagcugcauugugauaggaaucauuacacuguaucuaggcgcgguuguccaggcugauauggguugugugaucaacuggaaggggaaggaacucaaaugcggaaauggcauuuucgugaccaacgagguccacacuuggacagagcaguacaaguuucaagccgacucccccaaacggcuggcaaccgccaucgcugguucuugggaaaauggcguuugugggauacgaagcacuacccgcauggagaaccuuuuguggaagcagaucgccaaugaacugaacuauauucucugggagaauaacaucaaacugacaguggugguaggagauauuaucggcgucuuagaacaggggaagagaacgcugaccccacagccuauggagcuuaaauacucauggaagacuuggggaaaggcaaaaauagugacagcugagacccaaaacaguuccuucauuaucgacggccccaauacaccagaaugccccagcgccucuagggcguggaacguuugggagguggaagacuaugguuuuggggucuucacuaccaauauuugguugaagcuccgggagguguacacgcagucaugugaucaucgccugaugagugccgcuaucaaagacgaaagagcaguucacgccgauaugggauacuggauagagagccagaagaacggcuccuggaaacuagagaaggcuucuuuuaucgaagugaagacaugcaccuggccuaaaucgcacacucuguggagcaaugguguacucgaguccgacaugauuaucccaaagucacuggccggcccgauuagucagcauaaccacaggcccggguaucauacccaaacagcaggaccuuggcaccuuggcaaauuggaacuggauuucaauuacugcgaggggacuaccgucgugaucgcggagaacuguggaacacguggcccaucuuuacggacgaccacugugagcgguaagcucauacacgaauggugcugucgauccugcacacugcccccucuuagauauaugggggaggacggauguugguacggcauggaaauuaggccaaucaaugagaaagaagagaacauggucaagucacugguuagcgccgguucuggcaagguggauaauuuuaccauggggguauugugccucgcuauccuguucgaggaagugaugcgcggaaaauucggcaagaaacauaugauugccgggguccuauuuacuuucgugcugcuccuguccggacagaucacauggcgggacauggcacacacccuuauuaugauaggcaguaacgcuagcgauagaauggguauggggguuacguauuuggcccugaucgcaacuuuuaagauucagcccuucuuagcccucggauuuuuccugaggaaacuuaccucucgcgagaaucugcuacucggcgugggccuggcuauggcgacaaccuugcaacugccggaagacaucgagcagauggccaacgggauugcauuaggacucaugacucugaagcuuaucacacaguuugaaaccuaccagcuguggacagcuuuggucucccucacuuguucaaauaccauauucacgcugacaguggccuggcgaaccgccacucuaauccuggcugguguuagucuucucccucugugccaaagcucguccaugcggaagaccgauugguugccaaugacaguggcagccaugggcguccccccucugcccuuauuuauuuucucucucaaagacacuccaaagcguaaaagcuggccucugaacgaggggguaauggcggugggacuuguuucaauccuggcuaguuccuugcucagaaacgaugugcccauggccggcccacuggucgcaggugggcuacugauugccuguuaugugaucaccggaacgucugcugaccuuacaguagagaaggcagccgacgugaccugggaagaggaagcggagcagacuggcgucagccauaaucucaugauaacaguugaugacgauggcaccaugaggauuaaagacgaugaaacugagaacauccugacaguguuguuaaagaccgcucugcucaucguguccgggauuuuuccguacucaauaccugccacgcugcuugucuggcacacuuggcagaaacagacccaacgcagcggagugcugugggacguucccaguccacccgagacacagaaggcagaauuggaggaagguguauaccggaucaagcagcagggcauuuucgggaaaacccaagugggagucggcgugcagaaggaggguguuuuucauacaauguggcacgugacuagaggggccguccuaacccacaauggaaaaaggcuggagccuaacugggcuucugugaagaaagaucucaucuccuauggcggcggguggcgacugagcgcccaguggcaaaagggagaagagguacaggucauugcaguggaaccagguaagaaucccaaaaacuuccagacgaugccuggcaucuuccagacaacuaccggggagauaggagcuaucgcccuugacuuuaagccgggcacaucggguucaccaauuaucaaucgcgaagggaaaguugugggauuauacggcaacggcgucgugaccaagaaugggggauauguuucugguauugcgcaaacuaacgccgagcccgauggcccuaccccagagcuggaagaggaaauguucaaaaagcggaaucucacaaucauggacuugcaucccgggaguggaaagacgagaaaauaccugccugcaauagugagggaggcuauuaagcgucgccuccggacucugauccuugccccgaccagagucguggcugcagaaauggaggaggcccugaaaggcuugcccaucagguaucagacaaccgccuccaagagcgaacacacuggucgagagauuguagaucuaaugugccaugcuacauuuaccaugcggcugcucucuccagugcgcguuccuaacuacaauuuaaucauaauggacgaagcgcacuucacggaucccgcaagcauugccgcuagaggguauaucuccacuagggucggaaugggcgaggccgcagccauuuuuaugacagcuaccccaccuggcaccgcggaagccuucccccagucaaacgcaccaauccaggacgaggagcgggacauaccggaacgaaguuggaauagcgggaacgaguggauuacugauuuugugggaaaaacagugugguucgucccuucuaucaaggcugguaacgacaucgccaauugucugagaaagaacggcaaaaagguaauucaacuuucccgcaaaaccuuugauacagaauaccagaagacuaggcugaaugacugggauuucgugguuacgaccgacaucucagagaugggggcaaacuuuaaagccgaucgugugauugacccccggagaugccucaagccagucauauugacagauggacccgagagggugauccuggcuggcccuaugccaguuacugccgcgagugcagcccagcgccgagguagaguggggcggaauccccagaaggaaaacgaccaauacauuuucaccggccagccucucaauaacgaugaggaccaugcucacuggacagaagccaaaaugcugcuugacaauaucaacaccccggagggaaucauuccagcucuauucgaacccgagagggagaagagcgcagccauagauggcgaauaucgccugaaaggggagucccguaagacuuuugucgaauugaugagacggggagacuuaccuguguggcuggcucacaaaguagccucugaggguaucaaguacacggauaggaaauggugcuucgacggcgaacgcaauaaccagauucucgaggagaauauggauguggaaaucuggaccaaggagggggaacgaaagaaacugagaccccgguggcuugacgcaaggacauauucggauccacuggcgcucaaggaguuuaaagacuucgccgcuggacgcaagagcauugccuuggaucugguuacugaaaucggcagagucccuucacaucuagcacacaggacccggaacgcucuggacaaucucgugaugcuucauacauccgagcacggugggcgugccuaccgccacgcaguggaggaacugcccgagaccauggaaacuuuauugcugcucggccugaugauacuucugacaggaggcgccaugcucuuuuugaucagugggaaaggaauugguaagacgucuaucggccugauuugugucaucguuagcuccgggauguuauggauggcugaugugccacuacaguggauagcgucagccauuguacuggaguucuuuaugauggugcuccuuaucccugagccggaaaagcaacgaaccccccaggacaaccagcuggcauaugucgugauuggaaucuugacucuggcugccauaguugccgcaaaugagaugggccuccuggaaacaaccaaaagagaucuugguaugucuaaggagccagggguggucagcccuaccaguuaccucgacguagaccugcaucccgcuuccgccuggacauuguaugcgguggcuacuacgguuaucaccccaaugcugaggcacacaauugaaaacagcacugccaacgugucuuuagcagccaucgcuaaucaagcagucgugcuaaugggccuggauaaaggauggccuauuucaaagauggaccucggcgucccccuucuggccuuggggugcuacucccaggugaacccgcugacccucacagcggcuguucugcuuuuagugacccauuacgccaucauaggaccaggccugcaggcaaaagccacucgggaggcucagaagcgcacggccgcagguauuaugaagaauccuacaguagaugggaucaugaccaucgaccucgaucccgugauuuaugacaguaaauucgagaagcaauugggacaggucaugcugcuaguucugugugcugugcagcuccuucugaugagaacuagcugggccuugugcgaagcgcugacccucgccacaggcccaaucacuacccugugggaggguucgcccggcaaauuuuggaacacaacgauagcagucucuauggcuaauauuuucaggggguccuacuuagccggagcaggccuugcuuuuagcaucaugaagucaguggggaccggacggcgaggcacugguagucagggggaaacacugggagagaaauggaagaagaaacucaaccaacuaucuagaaaggaauucgaucuguauaaaaaguccggcauuaccgagguagaccgcacugaggccaaagaagguuugaagaggggcgagacaacccaccaugccgugagccgggggucagcgaaacugcagugguuuguugaacguaauauggugaucccugagggaagagucauagaucucggcugugggaggggaggcuggaguuacuauugcgcuggucuuaagaaggugacggaaguccgcggguacaccaaaggaggcccgggccacgaggagcccgugccaaugagcacauauggguggaacaucguuaagcugauguccggaaaagacguauucuacuugccucccgaaaagugugauacucugcucugcgacauuggugagucuagcccuuccccaaccguggaagagucacggacaauccgagucuuaagaaugguggagcccuggcugaggaauaaccaguucuguauuaaaguucuuaauccuuacaugccaaacgugaucgaacaccuggagcgccuacagcggaaguauggcgggaugcucgucagaaauccccugucucguaacaguacucaugaaauguacuggauuucgaauggaaccggcaacaucgugagcuccguaaacauggugucuagguugcugcucaaucgguuuacaaugacccaccgccgaccgacuauagagaaggauguugaccuuggugcagggacgagacaugucaacgccgaaccugagacaccaaauauggacgugauuggagagaggaucaaacggaucaaggaagagcacucaagcaccuggcacuaugaugacgaaaaccccuacaaaacuugggcuuaucauggcuccuacgaggugaaggccaccggcagugcaucuagcaugauuaauggggucguuaaacuguuaacaaagccuugggaugugguaccaauggugacgcaaauggccaugaccgacacuacacccuucggacagcagcgcgucuuuaaggaaaaaguggauaccagaacuccgaggccuaugcccgguacacgaaagguuauggagauaaccgcugaguggcuguggcggacauugggccguaacaaaaagccaagacucugcacucgcgaagaguucaccaaaaaggugaggacgaaugcggccaugggggcagucuuuaccgaagagaaccaaugggacucagcucgggccgcaguggaagaugaggaguucuggaagcugguagacaaagaaagagagcuacacaagcuuggaaaauguggcuccugcguuuauaauaugauggguaagcgcgaaaaaaagcugggggaguuuggaaaagccaagggcaguagggcuaucugguacauguggcucggcgcccgauaccuggaguucgaagcguugggguuucugaacgaggaucauugguucagccgggaaaauucuuauuccggaguggagggugaaggccuccacaagcuuggguacauucugagagacaucucaaaaauuccuggaggcgcaauguaugccgaugacacagcugguugggacacuaggaucaccgaggaugacuuacauaacgaggaaaagauaacacagcagauggaucccgagcaccgccagcuggccaaugcaaucuuuaaauugacuuaccaaaacaaggucgugaaagugcagcguccaacccccaaggggacggucauggacauuaucagccggaaggaucagagaggaucgggccagguuggcacauaugggcucaauaccuucacuaacauggaagcucaacuggugaggcagauggagggagaagguguacuaucugaggccgaccuugagaacccucaccugcucgaaaaaaagauuacacaguggcuggagaccaaaggcguggaacgcuugaagcgaauggcuaucaguggggaugacugcgucgugaaaccaauagaugaccgguuugccaaugcauuacuggcgcucaacgauaugggaaagguuagaaaggacauuccgcaguggcaacccuccaaaggcuggcaugauuggcagcaggugccuuucuguagccaccauuuccacgagcuuaucaugaaggacgguaggaaacuggucgugccaugccgcccccaggacgaacuaaucgggagagcccggauuucacaaggagcuggcuggucccugaaggagacugccugucucggcaaagcauacgcucagauguggucuuugauguauuuucacaggcgugaucugcgacuugccagcaaugcaauaugcagugccguaccuguucauuggaucccaaccucccgcacaacguggagcauucacgcgcaucaccaguggaugaccacugaggacaugcugacaguguggaacagagucuggaucgaagauaaucccuggauggaggacaagaccccugugacuacaugggaagauguuccguaccucgggaagcgggaggaccaaugguguggaucuuuaauuggucugaccucaagggcuacgugggcccagaacaucuugacagcaauacagcaggugcgcagucugaucggcgaugaggaauuccucgacuacaugccauccaugaaaagauuucggaaggaggaagagagcgaaggggccauuugguga

SEQ ID NO: 15203 - RNA, 9873 nt, Artificial Sequence
  derived and/or modified CDS sequence (opt3) from DENV-3__GU131913__SS-prME
accagccugugccucaugaugaugcuucccgcaacacuggcuuuccacuugacuuccagagacggcgaaccuaggaugaucguggggaagaacgaacggggaaaaucuuuacuguuuaagacggcaucagguauuaauauguguacccuaauagccauggaucucggcgagaugugcgacgauacagucacuuacaaauguccacugaucgcggaaguugagccggaagacauugauugcugguguaaccuuaccaguacaugggugaccuaugggacuugcaaucaggcuggagagcaucgccgagacaagcguagcguagcccuggcaccccacgugggcauggguuuggauacaagaacccagacguggauguccgccgagggggcuuggaggcaggucgaaaaaguggagacuugggcacuccggcauccuggauucaccauccuggcccuguuucucgcucacuacauuggcacaucuuuaacucagaagguugugaucuucauacugcuuauguuggucaccccaucgaugacaaugcgcugugugggcguagggaacagagacuuuguugaaggacugucaggugccaccuggguggaugucgugcuagagcauggcgggugcgugacgacuauggcaaagagcaaacccacacucgacaucgagcugcagaagaccgaagcaacucagcuugccacacugaggaaauuguguauugagggaaagaucaccaauauuacgaccgauagucggugcccuacacagggcgaagcuacucucccagaggaacaggaccagaacuaugucuguaaacacaccuacguugaucgcgguugggggaauggaugcggccuguucggcaagggguccuuagugacaugcgccaaguuucaaugucuggagcccaucgagggaaaaguagugcaguaugaaaaccucaaguacacugucauaauuaccgugcacacaggugaccagcaucagguuggcaaugacacccaaggggugacugucgagaucacgccucaggcaucuacaguggaagcuguacuuccagaguauggaacccugggcuuggaaugcagcccgcgaacuggucuagauuucaacgagaugauucugcucaccaugaaaaauaaggccuggaugguucacagacagugguuuuucgaccugccccuuccuuggacauccggggcgaccacugagacaccaacguggaacaggaaagaacuguuggugaccuuuaagaaugcccaugccaagaagcaagaggucgugguccucggcucacaggaaggagcuaugcacacugcccugacaggcgcuaccgagauccagaacagugggggaacaagcaucuucgccggucacuuaaagugucggcugaaaauggauaagcuagaacucaaaggcaugucuuacgcaaugugccugaauacuuuugugcuuaagaaagagguuuccgagacccagcaugggacgauuuugauaaagguggaauacaagggagaggacgcccccuguaaaaucccuuucucaaccgaagauggccaagguaaggcucacaacgggcgucugauuacagcgaacccaguagucacuaaaaaggaggagcccaucaauauagaagcagagccgccuuucggcgaaagcaacauugugaucggaaucggcgacaaagcccucaagauuaauugguauaagaaagggaguucuaucggaaagauguuugaggcuaccgcccgcggugcaagaaggauggccauucugggcgauacagcuugggacuucggguccguuggaggcgugcuuaacagccuggguaaaaugguccaucagauauuugggucggccuacacugcauuguucucuggcguguccuggaucaugaagauuggaaucggcguacuccugaccuggaucggguuaaauaguaaaaacacgucaaugagcuuuuccugcauugugauaggaaucguuacacuguaucuaggcgcggucgugcaggcugauauggguugugugauuaauuggaaggggaaggaacucaaaugcggaaacggcaucuucgucaccaaugagguucacacuuggacagagcaguacaaguuucaagccgacucucccaaacggcuggcaaccgccauugcuggugccugggaaaacggcgugugugggauccgaagcacuacccgcauggagaaucuuuuguggaagcagauagcaaacgaacugaauuauauccucugggagaacaauauuaaacugacagugguagucggagauaucauuggcguguuagaacaggggaagagaacgcugaccccacagccuauggagcuuaaauacucauggaagacuuggggaaaggcuaaaaucguuacagccgagacccaaaacaguuccuucauaauugacggccccaacacaccagaaugccccagcgcgucuagggccuggaaugugugggaggucgaagacuaugguuuugggguguucacuaccaacaucugguugaagcuccgggagguucauacgcagucaugugaucaccgccugaugagugcugcaauuaaagacgaaagagccgugcacgcugauaugggauacuggaucgagagccagaagaauggcuccuggaaacuagagaaggccucuuuuauagaaguaaagacaugcaccuggccuaaaucgcauacucuguggagcaacgguguccucgaguccgacaugaucauuccaaagucacuggcaggcccgaucagucagcacaaucauaggcccggguaccacacccaaacagcgggaccuuggcaccuuggcaaauuggaacuggauuucaacuauugcgaggggacuaccguggugauugccgagaauuguggaacacguggcccaucuuuacggacgaccacugucagcgguaagcucauccaugaauggugcugucgauccugcacacugcccccucuuagauacaugggggaggacggauguugguauggcauggaaauaaggccaauuaacgagaaagaagagaauaugguuaagucacuggugagcgcugguucuggcaagguagauaacuuuaccauggggguguugugccucgccauccuguucgaggaagucaugcgcggaaaauucggcaagaaacacaugaucgcaggggugcuauuuacuuucguucugcuccuguccggacagauuacauggcgggacauggcucauacccuuaucaugauuggcaguaaugccagcgauagaauggguaugggggugacguacuuggcacugauagccacuuuuaagauccagcccuucuuagcucucggauuuuuccugaggaaacuuaccucucgcgagaaccugcuacucggcgucggccuggcgauggccacaaccuugcaacugccggaagacauugagcagauggcaaaugggaucgcuuuaggacucaugacucugaaacuuauuacacaguuugaaaccuaucagcuguggacagccuuggugucccucacuuguucaaacaccaucuucacgcugacaguugccuggcgaaccgcuacucuaauacuggcgggugugagucuucucccucugugccaaagcucguccaugcggaagaccgauugguugccaaugacagucgccgcgaugggcguacccccucugcccuuauuuaucuucucucucaaagacacuccaaagcguaaaagcuggccucugaaugagggggugauggcuguuggacuugugucaauucuggccaguuccuugcucagaaacgauguccccauggcaggcccacugguggccggugggcuacugaucgcuuguuacguaauuaccggaacgucugcagaccuuacaguggagaaggccgcggacgucaccugggaagaggaagcugagcagacuggcguuagccacaaccucaugaucacaguggaugacgauggcaccaugaggauaaaagacgaugaaacugagaauauucugacaguguuguuaaagaccgcccugcucaucgucuccgggaucuuuccguauucaauuccugcaacgcugcuuguguggcauacuuggcagaaacagacccaacgcagcggaguucugugggacguacccaguccacccgagacacagaaggccgaauuggaggaagguguguaccggauaaagcagcagggcaucuucgggaaaacccaagucggagugggcguucagaaggaggguguguuucacacaauguggcacgucacuagaggggcugugcuaacccauaacggaaaaaggcuggagccuaauugggccucuguaaagaaagaucucauuuccuacggcggcggguggcgacugagcgcacaguggcaaaagggagaagagguccaggugaucgcuguugaaccagguaagaaccccaaaaauuuccagacgaugccuggcauuuuccagacaacuaccggggagaucggagccauagcgcuugacuuuaagccgggcacaucggguucaccaaucauuaaccgcgaagggaaaguggucggauuauauggcaauggcgugguuaccaagaacgggggauacgugucugguaucgcccaaacuaaugcagagcccgauggcccuaccccagagcuggaagaggaaauguucaaaaagcggaaccucacaauuauggacuugcaccccgggaguggaaagacgagaaaauaucugccugcuaucgucagggaggccauaaagcgucgccuccggacucugauucuugcuccgaccagagugguagcagccgaaauggaggaggcccugaaaggcuugcccaucagguaccagacaaccgcuacuaaguccgaacauacaggucgagagaucguggaucuaaugugccacgcgaccuuuacgaugcggcugcucagcccaguucgcgucccuaauuauaacuuagugauuauggacgaagcacauuucacugaucccgccucuaucgcugccagaggguacauaagcacaagggugggaaugggcgaggcagccgcuauuuuuaugaccgcgaccccaccuggcacugccgaagcauucccccaguccaaugcuccaauccaggacgaggagcgggacauuccggaacgaucauggaacagugggaaugaguggaucacagauuuugucggaaaaaccguaugguucgugccuagcauaaaggccgguaacgacauugcaaacugucugagaaagaauggcaaaaagguuauccaacuuucucgcaaaacauuugauacugaauaucagaagacgaggcugaacgacugggauuucguggucaccacagacaucuccgagaugggggccaauuuuaaagcugaucgugugauugacccccggagaugccucaagccaguuaucuugacugauggacccgagagggugauucuggccggcccuaugccagucaccgcggcaucagccgcucagcgccgagguagaguggggcggaacccccagaaggaaaaugaccaauacauauucacaggccagccucucaacaaugaugaggaccacgcccacuggaccgaagcuaaaaugcugcuugacaacaucaauacuccggagggaauuaucccagcacuauucgaacccgagagggagaagagugccgcuaucgauggcgaauaccgccugaaaggggagagccguaagacguuuguagaauugaugagacggggagacuuaccuguguggcuggcccauaaaguugcauccgaggguauuaaguauaccgauaggaaauggugcuucgacggcgaacgcaacaaucagauacucgaggagaacauggaugucgaaaucuggacaaaggagggggaacgaaagaaacugagaccccgguggcuugacgcgaggacuuacucugauccacuggcccucaaggaguuuaaagacuucgcugccggacgcaagucgauugcauuggaucuggugaccgaaaucggcagagugccuagccaccuagcucauaggacacggaaugcccuggacaaccucgucaugcuucacaccucagagcacggugggcgugcauaucgccaugccguugaggaacugcccgagacuauggaaacauuauugcugcucggccugaugauucuucugacgggaggcgcuaugcucuuuuugaucuccgggaaaggaauagguaagaccaguaucggccugauuugugugaucguaucuagcgggauguuauggauggcggaugugccacuacaguggauugccuccgcaaucguccuggaguucuuuaugauggugcuccuuauaccugagccggaaaagcaacgaacuccccaggacaaucagcuggcuuacguugugauuggaaucuugacacuggccgccauugucgcagcuaacgagaugggccuccuggaaaccaccaaaagagaucuugguaugucaaaggagccagggguagugucuccuacaagcuaucucgacguugaccugcaccccgccagugcguggacuuuguacgcuguggccacgaccgucaucacaccaaugcugaggcauacuauagaaaauuccaccgcaaacgugagcuuagccgcuaucgcaaaccaagccgucgugcuaaugggccuggauaaaggauggccuauuucuaagauggaccucggcguuccccuucuggcguuggggugcuauucacaggugaauccgcugacacucaccgcugccguacugcuuuuagugacucacuacgcaaucauuggaccaggccugcaggccaaagcuacgcgggaggcccagaagcgcacagcagcugguaucaugaagaacccuaccgucgaugggauaaugacuauugaccucgaucccguuaucuacgacuccaaauucgagaagcaauugggacaggugaugcugcuaguccugugugccgugcagcuccuucugaugagaaccaguugggcguugugcgaagcccugacacucgcaacuggcccaaucaccacacugugggaggguagccccggcaaauuuuggaauacgaccauugcuguaucgauggccaacaucuucagggggucuuauuuagcaggagcuggccuugccuuuuccauaaugaaaagcguggggacuggacggcgaggcacagguucacagggggaaacccugggagagaaauggaagaagaaacucaaucaacuaaguagaaaggaguucgaucuguacaaaaagucuggcauuacugagguugaccgcacagaggccaaagaagguuugaagaggggcgagaccacgcaucacgcggugucccgggggagcgcuaaacugcagugguuugucgaacguaacauggugaucccugagggaagagucauugaucucggcugugggaggggaggcuggucauauuacugcgcaggucuuaagaaggugaccgaaguucgcggguauacaaaaggaggcccgggccacgaggagcccguaccaaugaguacuuacggguggaauaucgugaagcugaugagcggaaaagacgucuucuauuugccucccgaaaagugugauacccugcucugcgacauaggugaguccucuccuagcccaacaguggaagagucccggacuauccgaguuuuaaaaaugguggagcccuggcugagaaacaaucaguucuguauuaagguccuuaacccuuacaugccaaaugugaucgaacaucuggagaggcuacagcgcaaguacggcgggaugcucguacggaacccccugucaagaaauucuacccacgaaauguauuggauuaguaacggaacaggcaauaucgugucgagcguuaacauggucucccguuugcugcucaacagguuuaccaugacucaucggcgcccgacgauugagaaagauguggaccuuggugccgggacacgacacgugaaugcugaaccugagaccccaaacauggacgucaucggagagagaauaaagaggauuaaagaagaacacucuucaacuuggcauuacgaugacgaaaaucccuauaagaccugggccuaccacggcagcuaugagguuaaagcaacaggcuccgccaguucuaugaucaacggggugguaaagcuguuaacgaagccuugggauguggucccaauggugacccaaauggcuaugacugacacaacccccuucggacagcagcggguuuuuaaagaaaagguggauacucgcacaccgagaccuaugcccgguaccaggaaagucauggagaucacagcggaguggcuguggcgaacuuugggccggaauaagaaaccacgucucugcaccagagaagaguucacgaagaaggugcgcaccaacgccgcaaugggggcuguauuuacagaagagaaucaaugggacagcgccagggcagccguugaagaugaggaguucuggaaacugguggacaaggaacgggagcuacauaaacuuggaaaguguggcucaugcgucuacaacaugauggguaaaagagaaaagaaacugggggaguuuggaaaggcuaagggcucccgcgccauuugguauauguggcucggcgcgagguuccuggaguuugaagcauugggguuccugaaugaggaucacugguuuagucgagaaaacagcuacucuggaguggagggugaaggccuccauaaacuuggguacauacugcgggacaucuccaagauuccuggaggcgccauguaugcugaugacacugccgguugggacaccagaaucacagaggaugacuuacacaaugaggagaagauuacucagcagauggaucccgagcacaggcagcuggcaaacgcuaucuucaaguugaccuaccaaaauaaaguggucaagguucagcgcccaacgcccaaggggacagugauggacauaaucucacguaaagaucagcggggaagcggccagguaggcaccuaugggcucaacacuuuuacaaauauggaagcccaacuggugagacagauggagggagaagguguccuaucggaggcugaccuugagaacccucaucugcucgaaaagaaaauuacccaguggcuggagacuaagggcguggaaagguugaaacgcauggccaucucuggggaugacugcguugugaagccaauugaugaccgauucgcaaacgcguuacuggcccucaaugauaugggaaagguccggaaagacaucccgcaguggcaacccaguaagggcuggcacgauuggcaacaggugccuuucuguucccaucacuuucacgagcuuauaaugaaagacgguagaaagcugguaguuccaugcaggccccaggacgaacuaauugggcgcgcuagaaucagccaaggagccggcuggucacugaaagagaccgcaugucucggcaaggcuuacgcccagaugugguccuugauguauuuccaucggagggaucugcgucuugcaucuaacgccaucugcagcgcggugccuguccacuggauuccaacaagucgaacgaccugguccauacaugcucaccaucaguggaugacuacagaggacaugcugaccguguggaaucgcguuuggaucgaagauaaccccuggaugggggacaagacuccugugacaaccugggaggaugucccguaccucggaaaaagagaagaccaauggugugguagcuuaauuggccugacgucucgggccacaugggcacagaauaucuugaccgccauucaacaggugaggucacugaucggggaugaggaguuucucgacuauaugccaaguaugaagcgcuucagaaaagaagaggaauccgagggagcuauaugguga

SEQ ID NO: 15204 - RNA, 9873 nt, Artificial Sequence
  derived and/or modified CDS sequence (opt3) from DENV-3__GU131914__SS-prME
accagccugugccucaugaugaugcuucccgcaacacuggcuuuccacuugacuuccagagacggcgaaccuaggaugaucguggggaagaacgaacggggaaaaucuuuacuguuuaagacggcaucagguauuaauauguguacccuaauagccauggaucucggcgagaugugcgacgauacagucacuuacaaauguccacugaucgcggaaguugagccggaagacauugauugcugguguaaccuuaccaguacaugggugaccuaugggacuugcaaucaggcuggagagcaucgccgagacaagcguagcgucgcccuggcaccccacgugggcauggguuuggauacaagaacccaaacguggauguccgccgagggggcuuggaggcaggucgaaaaaguggagacuugggcacuccggcauccuggauucaccauccuggcccuguuucucgcucacuacauuggcacaucuuuaacucagaagguugugaucuucauacugcuuauguuggucaccccaucgaugacaaugcgcugugugggcguagggaacagagacuuuguugaaggacugucaggugccaccuggguggaugucgugcuagagcauggcgggugcgugacgacuauggcaaagagcaaacccacacucgacaucgagcugcagaagaccgaagcaacucaacuugccacacugaggaaauuguguauugagggaaagaucaccaauauuacgaccgauagucggugcccuacacagggcgaagcuacucucccagaggaacaggaccagaacuaugucuguaaacacaccuacguugaucgcgguugggggaauggaugcggccuguucggcaagggguccuuagugacaugcgccaaguuucaaugucuggagcccaucgagggaaaaguagugcaguaugaaaaccucaaguacacugucauaauuaccgugcacacaggugaccagcaucagguuggcaaugacacccaaggggugacugucgagaucacgccucaggcaucuacaguggaagcuguacuuccagaguauggaacccugggcuuggaaugcagcccgcgaacuggucuagauuucaacgagaugauucugcucaccaugaaaaauaaggccuggaugguucacagacagugguuuuucgaccugccccuuccuuggacauccggggcgaccacugagacaccaacguggaacaggaaagaacuguuggugaccuuuaagaaugcccaugccaagaagcaagaggucgugguccucggcucacaggaaggagcuaugcacacugcccugacaggcgcuaccgagauccagaacagugggggaacaagcaucuucgccggucacuuaaagugucggcugaaaauggauaagcuagaacucaaaggcaugucuuacgcaaugugccugaauacuuuugugcuuaagaaagagguuuccgagacccagcaugggacgauuuugauaaagguggaauacaagggagaggacgcccccuguaaaaucccuuucucaaccgaagauggccaagguaaggcucacaacgggcgucugauuacagcgaacccaguagucacuaaaaaggaggagcccaucaauauagaagcagagccgccuuucggcgaaagcaacauugugaucggaaucggcgacaaagcccucaagauuaauugguauaagaaagggaguucuaucggaaagauguuugaggcuaccgcccgcggugcaagaaggauggccauucugggcgauacagcuugggacuucggguccguuggaggcgugcuuaacagccuggguaaaaugguccaucagauauuugggucggccuacacugcauuguucucuggcguguccuggaucaugaagauuggaaucggcguacuccugaccuggaucggguuaaauaguaaaaacacgucaaugagcuuuuccugcauugugauaggaaucauuacacuguaucuaggcgcgguuguccaggcugauauggguugugugaucaauuggaaggggaaggaacucaaaugcggaaacggcauuuucgugaccaaugagguccacacuuggacagagcaguacaaguuucaagccgacucucccaaacggcuggcaaccgccaucgcuggugccugggaaaacggcguuugugggauacgaagcacuacccgcauggagaaucuuuuguggaagcagaucgcaaacgaacugaauuauauucucugggagaacaauaucaaacugacaguggugguaggagauauuaucggcgucuuagaacaggggaagagaacgcugaccccacagccuauggagcuuaaauacucauggaagacuuggggaaaggcuaaaauagugacagccgagacccaaaacaguuccuucauuaucgacggccccaacacaccagaaugccccagcgcgucuagggccuggaauguuugggagguggaagacuaugguuuuggggucuucacuaccaacauuugguugaagcuccgggaggugcauacgcagucaugugaucaccgccugaugagugcugcaaucaaagacgaaagagccguucacgcugauaugggauacuggauagagagccagaagaauggcuccuggaaacuagagaaggccucuuuuaucgaagugaagacaugcaccuggccuaaaucgcauacucuguggagcaacgguguacucgaguccgacaugauuaucccaaagucacuggcaggcccgauuagucagcacaaucauaggcccggguaccacacccaaacagcgggaccuuggcaccuuggcaaauuggaacuggauuucaacuauugcgaggggacuaccgucgugaucgccgagaauuguggaacacguggcccaucuuuacggacgaccacugugagcgguaagcucauacaugaauggugcugucgauccugcacacugcccccucuuagauacaugggggaggacggauguugguauggcauggaaauuaggccaaucaacgagaaagaagagaauauggucaagucacugguuagcgcugguucuggcaagguggauaacuuuaccauggggguauugugccucgccauccuguucgaggaagugaugcgcggaaaauucggcaagaaacacaugauugcagggguccuauuuacuuucgugcugcuccuguccggacagaucacauggcgggacauggcucauacccuuauuaugauaggcaguaaugccagcgauagaauggguauggggguuacguacuuggcacugaucgccacuuuuaagauucagcccuucuuagcucucggauuuuuccugaggaaacuuaccucucgcgagaaccugcuacucggcgugggccuggcgauggccacaaccuugcaacugccggaagacaucgagcagauggcaaaugggauugcuuuaggacucaugacucugaaacuuaucacacaguuugaaaccuaucagcuguggacagccuuggucucccucacuuguucaaacaccauauucacgcugacaguggccuggcgaaccgcuacucuaauccuggcggguguuagucuucucccucugugccaaagcucguccaugcggaagaccgauugguugccaaugacaguggccgcgaugggcguacccccucugcccuuauuuauuuucucucucaaagacacuccaaagcguaaaagcuggccucugaaugaggggguaauggcugugggacuuguuucaauccuggccaguuccuugcucagaaacgaugugcccauggcaggcccacuggucgccggugggcuacugauugcuuguuacgugaucaccggaacgucugcagaccuuacaguagagaaggccgcggacgugaccugggaagaggaagcugagcagacuggcgucagccacaaccucaugauaacaguugaugacgauggcaccaugaggauuaaagacgaugaaacugagaauauccugacaguguuguuaaagaccgcccugcucaucguguccgggauuuuuccguauucaauaccugcaacgcugcuugucuggcauacuuggcagaaacagacccaacgcagcggagugcugugggacguucccaguccacccgagacacagaaggccgaauuggaggaagguguauaccggaucaagcagcagggcauuuucgggaaaacccaagugggagucggcgugcagaaggaggguguuuuucacacaauguggcacgugacuagaggggcuguccuaacccauaacggaaaaaggcuggagccuaauugggccucugugaagaaagaucucaucuccuacggcggcggguggcgacugagcgcacaguggcaaaagggagaagagguacaggucauugcuguggaaccagguaagaaccccaaaaauuuccagacgaugccuggcaucuuccagacaacuaccggggagauaggagccaucgcgcuugacuuuaagccgggcacaucggguucaccaauuaucaaccgcgaagggaaaguugugggauuauauggcaauggcgucgugaccaagaacgggggauacguuucugguauugcccaaacuaaugcagagcccgauggcccuaccccagagcuggaagaggaaauguucaaaaagcggaaccucacaaucauggacuugcaccccgggaguggaaagacgagaaaauaucugccugcuauagugagggaggccauuaagcgucgccuccggacucugauccuugcuccgaccagagucguggcagccgaaauggaggaggcccugaaaggcuugcccaucagguaccagacaaccgcuacuaaguccgaacauacaggucgagagauuguagaucuaaugugccacgcgaccuuuacgaugcggcugcucagcccagugcgcguuccuaauuauaacuuagucaucauggacgaagcacauuucacugaucccgccucuauagcugccagaggguacauuagcacaagggugggaaugggcgaggcagccgcuaucuuuaugaccgcgaccccaccuggcacugccgaagcauucccccaguccaaugcuccaauucaggacgaggagcgggacaucccggaacgaucauggaacagugggaaugaguggauaacagauuuugugggaaaaaccgucugguucguaccuagcauuaaggccgguaacgacaucgcaaacugucugagaaagaauggcaaaaaggugauccaacuuucucgcaaaacauuugauacugaauaucagaagacgaggcugaacgacugggauuucguugugaccacagacauuuccgagaugggggccaauuuuaaagcugaucgugucaucgacccccggagaugccucaagccagugauuuugacugauggacccgagaggguuauacuggccggcccuaugccagugaccgcggcaucagccgcucagcgccgagguagagucgggcggaacccccagaaggaaaaugaccaauacaucuucacaggccagccucucaacaaugaugaggaccacgcccacuggaccgaagcuaaaaugcugcuugacaacauuaauacuccggagggaaucaucccagcacuauucgaacccgagagggagaagagugccgcuauugauggcgaauaccgccugaaaggggagagccguaagacguuuguggaauugaugagacggggagacuuaccuguauggcuggcccauaaaguggcauccgaggguauaaaguauaccgauaggaaauggugcuucgacggcgaacgcaacaaucagauccucgaggagaacauggauguugaaauuuggacaaaggagggggaacgaaagaaacugagaccccgguggcuugacgcgaggacuuacucugauccacuggcccucaaggaguuuaaagacuucgcugccggacgcaagucgaucgcauuggaucuggucaccgaaauuggcagagugccuagccaccuagcucauaggacacggaaugcccuggacaaccucgugaugcuucacaccucagagcacggugggcgugcauaucgccaugccgucgaggaacugcccgagacuauggaaacauuauugcugcucggccugaugauccuucugacgggaggcgcuaugcucuuuuugauauccgggaaaggaaucgguaagaccaguauuggccugaucuguguuauugugucuagcgggauguuauggauggcggauguaccacuacaguggaucgccuccgcaauagugcuggaguucuuuaugaugguccuccuuauuccugagccggaaaagcaacgaacuccccaggacaaucagcuggcuuacgugguuaucggaauuuugacacuggccgccaucguggcagcuaacgagaugggccuccuggaaaccaccaaaagagaucuugguaugucaaaggagccaggggucguaucuccuacaagcuaucucgacguggaccugcaccccgccagugcguggacuuuguacgcuguugccacgaccgugauaacaccaaugcugaggcauacuaucgaaaauuccaccgcaaacgucagcuuagccgcuauugcaaaccaagccgugguccuaaugggccuggauaaaggauggccuaucucuaagauggaccucggcgugccccuucuggcguuggggugcuauucacagguuaauccgcugacacucaccgcugccgugcugcuuuuaguaacucacuacgcaauuaucggaccaggccugcaggccaaagcuacgcgggaggcccagaagcgcacagcagcugguauaaugaagaacccuaccguggaugggauuaugacuaucgaccucgaucccgucaucuacgacuccaaauucgagaagcaauugggacagguuaugcugcuagugcugugugccguccagcuccuucugaugagaaccaguugggcguugugcgaagcccugacacucgcaacuggcccaauuaccacacugugggaggguagccccggcaaauuuuggaauacgaccaucgcugugucgauggccaacauauucagggggucuuauuuagcaggagcuggccuugccuuuuccauuaugaaaagcguagggacuggacggcgaggcacagguucacagggggaaacccugggagagaaauggaagaagaaacucaaucaacuaaguagaaaggaguucgaucuguacaaaaagucuggcaucacugagguggaccgcacagaggccaaagaagguuugaagaggggcgagaccacgcaucacgcgguuucccgggggagcgcuaaacugcagugguuuguggaacguaacauggucauuccugagggaagagugaucgaucucggcugugggaggggaggcuggucauauuacugcgcaggucuuaagaaggucaccgaagugcgcggguauacaaaaggaggcccgggccacgaggagcccguuccaaugaguacuuacggguggaauauaguaaagcugaugagcggaaaagacguguucuauuugccucccgaaaagugugauacccugcucugcgacaucggugaguccucuccuagcccaacagucgaagagucccggacuauucgaguguuaaaaaugguugagcccuggcugagaaacaaucaguucuguaucaaggugcuuaacccuuacaugccaaaugucauugaacaucuggagaggcuacagcgcaaguacggcgggaugcucgugcggaacccccugucaagaaauucuacccacgaaauguauuggaucaguaacggaacaggcaauauuguaucgagcgugaacaugguuucccguuugcugcucaacagguuuaccaugacucaucggcgcccgacgaucgagaaagaugucgaccuuggugccgggacacgacacgugaaugcugaaccugagaccccaaacauggacgugauaggagagagaauuaagaggaucaaagaagaacacucuucaacuuggcauuacgaugacgaaaaucccuauaagaccugggccuaccacggcagcuaugaggucaaagcaacaggcuccgccaguucuaugaucaacgggguugugaagcuguuaacgaagccuugggauguagugccaauggucacccaaauggcuaugacugacacaacccccuucggacagcagcggguguuuaaagaaaagguugauacucgcacaccgagaccuaugcccgguaccaggaaagugauggagauuacagcggaguggcuguggcgaacuuugggccggaauaagaaaccacgucucugcaccagagaagaguucacgaagaagguccgcaccaacgccgcaaugggggcuguguuuacagaagagaaucaaugggacagcgccagggcagccguagaagaugaggaguucuggaaacugguugacaaggaacgggagcuacauaaacuuggaaaguguggcucaugcguguacaacaugauggguaaaagagaaaagaaacugggggaguuuggaaaggcuaagggcucccgcgccauaugguauauguggcucggcgcgagguuccuggaguuugaagcauugggguuccugaaugaggaucacugguuuagucgagaaaacagcuacucuggagucgagggugaaggccuccauaaacuuggguacauccugcgggacauuuccaagaucccuggaggcgccauguaugcugaugacacugccgguugggacaccagaauuacagaggaugacuuacacaaugaggagaagaucacucagcagauggaucccgagcacaggcagcuggcaaacgcuauauucaaguugaccuaccaaaauaaaguggugaagguccagcgcccaacgcccaaggggacaguuauggacaucauuucacguaaagaucagcggggaagcggccaggugggcaccuaugggcucaacacuuuuacaaauauggaagcccaacugguaagacagauggagggagaaggugugcuaucggaggcugaccuugagaacccucaucugcucgaaaagaaaaucacccaguggcuggagacuaagggcgucgaaagguugaaacgcauggccauuucuggggaugacugcgugguuaagccaaucgaugaccgauucgcaaacgcguuacuggcccucaaugauaugggaaaggugcggaaagacauaccgcaguggcaacccaguaagggcuggcacgauuggcagcaggucccuuucuguucccaucacuuucacgagcuuauuaugaaagacgguagaaagcuggugguaccaugcaggccccaggacgaacuaaucgggcgcgcuagaaucagccaaggagccggcuggucacugaaagagaccgcaugucucggcaaggcuuacgcccagaugugguccuugauguauuuccaucggagggaucugcgucuugcaucuaacgccauuugcagcgcgguuccugugcacuggauaccaacaagucgaacgaccugguccauccaugcucaccaucaguggaugacuacagaggacaugcugaccgucuggaaucgcguguggauugaagauaaccccuggaugggggacaagacuccuguuacaaccugggaggaugugccguaccucggaaaaagagaagaccaauggugugguagcuuaaucggccugacgucucgggccacaugggcacagaauauuuugaccgccauccagcaggucaggucacugauaggggaugaggaguuucucgacuauaugccaaguaugaagcgcuucagaaaagaagaggaauccgagggagcuaucugguga

SEQ ID NO: 15205 - RNA, 9873 nt, Artificial Sequence
  derived and/or modified CDS sequence (opt3) from DENV-3__GU131915__SS-prME
accagccugugccucaugaugaugcuucccgccacacuggcuuuccacuugacuuccagagacggcgagccuaggaugaucguggggaagaacgaacggggaaaaucuuuacuguuuaagacggcaucagguauuaauauguguacccuaauagccauggaucucggcgagaugugcgacgauacagucacuuacaaauguccacugaucgcggaagcugagccggaagacauugauugcugguguaaccuuaccaguacauggguuaccuaugggacuugcaaucaggccggagagcaucgccgagacaagcguagcguggcacuggccccccacguaggcauggguuuggauacaagaacccaaacguggauguccgcugagggggcauggaggcagguggaaaaagucgagacuugggcccuccggcauccuggauucaccauccuggcucuguuucucgcccacuacauuggcacaucuuuaacucagaaggugguuaucuucauacugcuuauguuggugaccccaucgaugacaaugcgcugugucggcguggggaacagagacuuuguagaaggacugucaggugcgaccuggguugaugugguccuagagcauggcgggugcgugacgacuauggcaaagagcaaacccacacucgacaucgagcugcagaagaccgaagccacucaacuugcuacacugaggaaauuguguauugagggaaagaucaccaauauuacgaccgauagucggugcccuacacagggcgaagccacucucccagaggaacaggaccagaacuauguguguaaacacaccuacgucgaucgcgguugggggaauggaugcggccuguucggcaagggguccuuaguuacaugcgcaaaguuucaaugucuggagcccaucgagggaaaagugguacagcacgaaaaccucaaguauacugugauaauuaccguccauacaggugaccagcaccaggugggcaaugacacccaagggguuacuguggagaucacgccucaggcuucuacagucgaagccgugcuuccagaguacggaacccugggcuuggaaugcagcccgcgaacuggucuagauuucaacgagaugauucugcucaccaugaaaaauaaggcguggaugguacauagacagugguuuuucgaccugccccuuccuuggacauccggggccaccacugagacaccaacguggaacaggaaagaacuguugguuaccuuuaagaaugcacacgcuaaaaagcaagagguggucgugcucggcucacaggaaggagccaugcacacugcucugacaggcgccaccgagauccagaacagugggggaacaagcaucuucgcaggucauuuaaagugucggcugaaaauggauaagcuagaacucaaaggcaugucuuaugccaugugccugaauacuuuuguccuuaagaaagagguguccgagacccagcacgggacgauuuugauaaagguugaauacaagggagaggacgcucccuguaaaaucccuuucucaaccgaagauggccaagguaaggcgcauagcgggcgucugauuacagcaaacccagugguaacuaaaaaggaggagcccgucaacaucgaagccgagccgccuuucggcgaaaguaauauagugauuggaaucggcgacaaagcucucaagaucaacugguacaagaaagggucuuccauuggaaagauguuugaggccaccgcacgcggugccagaaggauggcuauccugggcgauacagccugggacuucgggagcguuggaggcgugcuuaauucgcuggguaaaaugguccaccagauuuuugggucugcauauacugcguuguucuccggcgugucauggauaaugaagaucggaauuggcguacuccugaccuggaucggguuaaacaguaaaaauacgagcauguccuuuucuugcaucgugauuggaauaaucacacuguaccuaggcgcuguuguccaggccgauauggguugugugauuaacuggaaggggaaggaacucaaaugcggaagcggcaucuucgugaccaaugagguccauacuuggacagagcaguauaaguuucaagcagacucacccaaacggcuggccaccgcuauugccggugcaugggaaaacggcguuugugggauccgaaguacuacccgcauggagaaucuuuuguggaagcagauagcuaacgaacugaauuacauccucugggagaacaauauuaaacugacaguggugguaggagauaucauuggcgucuuagaacaggggaagagaacgcugaccccacagccuauggagcuuaaauauuccuggaagacuuggggaaaggccaaaaucgugacagcggagacccaaaacagcucuuucauaauugacggccccaauacaccagaaugccccucagccaguagggcuuggaacguuugggagguggaagacuacgguuuuggggucuucacuaccaacaucugguugaagcuccgggagguguauacgcagagcugugaucaccgccugauguccgcagccauuaaagacgaaagagcuguucacgccgauaugggauacuggaucgagucucagaagaauggcucguggaaacuagagaaggcaagcuuuauagaagugaagacaugcaccuggccuaaaucccauacucuguggucaaacgguguacucgagagugacaugaucauuccaaagucucuggcgggcccgaucagccagcacaaucauaggcccggguaccacacccaaacagccggaccuuggcaccuuggcaaauuggaacuggauuucaacuauugcgaggggacuaccgucgugauuacagagaauuguggaacgcguggcccauccuuacggaccacuacagugucagguaagcucauccaugaauggugcugucgaagcugcacccugcccccucuuagauacaugggggaggacggauguugguauggcauggaaauaaggccaauuaacgagaaagaagagaauauggucaagucucugguuuccgcugguaguggcaagguggauaacuuuacuauggggguauugugccucgccauccuguucgaggaagugaugcgcggaaaauucggcaagaaacacaugaucgcagggguccuauuuacauucgugcugcuccugagcggacagauuaccuggcgggacauggcucauacgcuuaucaugauuggcucuaaugccuccgauagaauggguauggggguuacuuacuuggcacugauagccaccuuuaagauccagcccuucuuagcucucggauuuuuccugaggaaacuuacaucacgcgagaaccugcuacucggcgugggccuggcgauggccaccacuuugcaacugccggaagacauugagcagauggcaaaugggaucgcuuuaggacucaugacacugaagcuuauuacccaguuugaaacauaucagcuguggacugccuuggucagucucaccuguagcaacacgaucuucacacugaccguggccuggcgaacugcuacccuaauacuggcagguguuucgcuucucccucugugccaauccucuagcaugcggaagacagauugguugccaaugacuguggccgcgaugggcguccccccucugcccuuauuuaucuucucacucaaagacaccccaaagcguagaaguuggccucugaaugaggggguaauggcugugggacuuguuuccauucuggccucuagcuugcucaggaacgaugugcccauggcaggcccacuggucgccggugggcuacugaucgcuuguuacgugauuacgggaacauccgcagaccuuaccguagagaaagccgcggacgugacuugggaagaggaagcugagcagacaggcgucucacacaaucucaugaucaccguugaugacgauggcacuaugcgcauaaaggacgaugaaacagagaacauucugaccguguuguuaaaaacggcccugcucaucgugagcgggaucuuuccguauaguauuccugcaacucugcuugucuggcauaccuggcagaagcagacacaacggucuggagugcugugggacguucccuccccacccgagacccagaaagccgaauuggaggaagguguauacagaauaaagcagcagggcaucuucgggaagacacaagugggagucggcgugcagaaagaggguguuuuucacacuauguggcacgugaccaggggggcuguccuaacgcauaacggaaagcgacuggagccuaauugggccagcgugaaaaaggaucucauuucguacggcggcggguggcgccugaacgcacaguggcaaaaaggagaagagguacaggucaucgcuguggaaccagguaagaaucccaagaacuuccagacaaugccuggcauuuuccagacuaccacaggggagaucggagccauagcgcuugacuuuaaaccgggcaccucagguucuccaaucauuaaucgggaagggaagguugugggauuauauggcaacggcgucgugacuaaaaaugggggauacguuagugguaucgcccaaaccaacgcagagcccgauggcccuacaccagagcuggaagaggaaauguucaagaaaagaaaucucacgauuauggacuugcaccccggguccggaaagacuaggaaguaucugccugcuaucgugcgugaggccauaaaacgccggcucagaacccugauucuugcuccgacaagggucguggcagccgaaauggaggaggcccugaagggcuugcccauccgauaccagaccacugcuacaaaaagcgaacauaccggucgggagaucguagaucuaaugugccacgcgacguuuacuaugcgccugcucucuccagugagaguuccuaacuauaauuuagucauuauggacgaagcacauuucacagaucccgccagcaucgcugccaggggguacauauccacccgggugggaaugggcgaggcagccgcuauuuuuaugaccgcgacuccaccuggcacagccgaagcauucccccagucaaacgcuccaauccaggacgaggagcgagacauuccggaaagaaguuggaauagcgggaacgaguggaucaccgauuuugugggaaagacagucugguucguaccuucuauaaaagccgguaaugacauugcaaacugucugcgcaagaacggcaagaaagugauccaacuuuccaggaagacuuuugauacggaauaucagaaaacccgucugaaugacugggauuucguugugacaacugacaucucagagaugggggccaacuuuaaggcugaucgggucauugaccccagaaggugccucaaaccagugaucuugaccgauggacccgagcgcguuauucuggccggcccuaugccagugacagcggcaagugccgcucagcgaagaggucgggucgggaggaauccccagaaggaaaacgaccaauacauauucaccggccagccucucaauaacgaugaggaccacgcccacuggacugaagcuaagaugcugcuugacaauaucaacacgccggagggaauuaucccagcacuauucgaacccgagcgcgagaaaagcgccgcuaucgauggcgaauaccgucugaagggggaguccagaaaaaccuuuguggaauugaugcggaggggagacuuaccuguauggcuggcccauaagguggcaucugaggguauuaaauauacagaucgcaaguggugcuucgacggcgaacgaaauaaccagauacucgaggagaauauggauguugaaaucuggacuaaagagggggaaagaaagaagcugcggcccagguggcuugacgcgcgcaccuacucggauccacuggcccucaaagaguuuaaggacuucgcugccggaagaaaaagcauugcauuggaucuggucacagaaaucggcagggugccuucacaccuagcucaucggacccguaacgcccuggacaaucucgugaugcuucacacuuccgagcacggugggcgcgcauaucgacaugccgucgaggaacugcccgagacaauggaaacguuauugcugcucggccugaugauucuucugaccggaggcgcuaugcucuuuuugaucagugggaagggaauagguaaaacuucuaucggccugauuuguguuaucgugagcuccgggauguuauggauggcggauguaccacuacaguggauugccucagcaaucgugcuggaguucuuuaugaugguccuccuuauaccugagccggaaaagcaaagaacaccccaggacaaccagcuggcuuacgugguuauuggaaucuugacccuggccgccauuguggcagcuaaugagaugggccuccuggaaaccacaaagagggaucuugguaugucuaaagagccaggggucguaagcccuacuaguuaucucgacguggaccugcaccccgccuccgcguggacguuguacgcuguugccaccacagugaucacuccaaugcugcggcauaccauagaaaacagcacagcaaaugucucuuuagccgcuaucgcaaaccaagccgugguccuaaugggccuggauaagggauggccuauuucaaaaauggaccucggcgugccccuucuggcguuggggugcuauucccagguuaacccgcugacccucacugcugccgugcugcuuuuaguaacgcacuacgcaaucauuggaccaggccugcaggccaaggcuacacgcgaggcccagaaaagaaccgcagcugguaucaugaagaauccuacuguggaugggauaaugaccauugaccucgaucccgucaucuacgacaguaaguucgagaaacaauugggacagguuaugcugcuagugcugugugccguccagcuccuucugaugaggacaagcugggcguugugcgaagcccugacucucgcaaccggcccaaucacaacgcugugggaggguucgcccggcaaguuuuggaacaccacuauugcugugucuauggccaauaucuuccggggguccuauuuagcaggagcuggccuugccuuuagcauaaugaaaucaguagggacaggacgaagaggcaccgguagucagggggaaacucugggagagaaguggaaaaagaagcucaaccaacuaucucgcaaagaauucgaucuguacaagaaauccggcauuacagagguggacaggaccgaggccaaggaagguuugaaacggggcgagacgacccaucacgcgguuagccgugggucagcuaagcugcagugguuuguggaaagaaauauggucaucccugagggaagggugauugaucucggcugugggcgcggaggcuggaguuauuacugcgcaggucuuaaaaaggucacagaagugcggggguauacuaagggaggcccgggccacgaggagcccguuccaaugagcaccuacggguggaacaucguaaaacugauguccggaaaggacguguucuauuugccucccgaaaaaugugauacacugcucugcgacauaggugagucuagcccuuccccaacugucgaagagucacgaaccaucagaguguuaaagaugguugagcccuggcugaggaauaaccaguucuguauuaaagugcuuaauccuuacaugccaacagucaucgaacaucuggagcgccuacagcggaaguacggcgggaugcucgugagaaacccccugucucguaauaguacccacgaaauguauuggauuucgaacggaacuggcaauaucguaagcuccgugaacaugguuucuagguugcugcucaaucgguuuacgaugacacaucgccgaccgaccauugagaaggaugucgaccuuggugccgggacuagacacgugaacgcugaaccugagaccccaaacauggacgugaucggagagaggauaaaacggauuaaggaagagcacucaagcacauggcauuacgaugacgaaaaucccuauaaaacgugggccuaccacggcuccuaugaggucaaggcaaccggcagugccucuagcaugaucaacgggguugugaaacuguuaacuaagccuugggauguagugccaauggucacacaaauggcuaugaccgacacuacacccuucggacagcagcgcguguuuaaggaaaaaguugauaccagaacaccgaggccuaugcccgguacucgaaaggugauggagaucaccgcggaguggcuguggcggacguugggccguaauaaaaagccaagacucugcacccgcgaagaguucacaaaaaaggucaggacuaacgccgcaaugggggcuguguuuaccgaagagaaucaaugggacucagcccgggcagccguagaagaugaggaguucuggaagcugguugacagagaacgcgagcuacauaaacuuggaaaguguggcuccugcguguacaacaugauggguaaaagggaaaagaaacugggggaguuuggaaaggcuaaaggcagucgagccauuugguauauguggcucggcgcgcgguaccuggaguucgaagcauugggguuucugaaugaggaucacugguucagcagagaaaacucuuacuccggagucgagggugaaggccuccauaagcuuggguauauacugagggacaucucaaagauuccuggaggcgccauguacgcugaugacacagccgguugggacacucgcaucaccgaggaugacuuacacaaugaggaaaaaauuacgcagcagauggaucccgagcaccgucagcuggcaaacgcuaucuuuaaguugacauaucaaaauaaaguggugaagguccagcggccaacccccaaagggacuguuauggacauaaucagcagaaaggaucagaggggaucgggccaggugggcacauacgggcucaacaccuucacuaauauggaagcccaacugguacgccagauggagggagaaggugugcuaucuaaggcugaccuugagaacccucaucugcucgagaaaaagauuacccaguggcuggaaacaaaaggcgucgagcgauugaagcggauggccaucaguggggaugacugcgugguuaaaccaauugaugacagauuugcaaaugcguuacuggcccucaacgauaugggaaaggugaggaaggacaucccgcaguggcaacccuccaaaggcuggcacgauuggcagcaggucccuuucuguagccaucacuuccacgaacuuauaaugaaggacggucgcaaacuggugguaccaugcagaccccaggacgagcuaauugggcgggcuaggaucucacaaggagccggcuggucccugaaggaaacggcaugucucggcaaagcuuaugcccagauguggucuuugauguacuuucaucgucgagaucugcgccuugcaagcaacgccaucugcagugcgguuccugugcacuggauuccaaccuccagaacuacauggagcauacaugcucaccaucaguggaugaccacugaggacaugcugacagucuggaaucggguguggaucgaggauaaccccuggauggaagacaagaccccuguuacgacaugggaggaugugccguaucucgggaagagggaagaccaaugguguggaucuuuaauuggucugaccucacgcgccacuugggcacagaauaucuugaccgccauucagcaggucagaagucugaucggcgaugaggaguuccucgacuacaugccauccaugaaacgguuuaggaaggaagaggaaagcgagggggcuauaugguga

SEQ ID NO: 15206 - RNA, 9873 nt, Artificial Sequence
  derived and/or modified CDS sequence (opt3) from DENV-3__GU131916__SS-prME
acaagccugugccucaugaugaugcuuccagccacacuggcuuuccacuugacuuccagagacggcgaaccuaggaugaucguggggaagaacgaacggggaaaaucuuuacuguuuaagacggcaucagguauuaauauguguacccuaauagccauggaucucggcgagaugugcgacgauacaguaacuuacaaauguccacugaucgcggaaguugagccggaagacauugauugcugguguaaccuuaccaguacaugggugaccuaugggacuugcaaucaggcuggagagcaccgccgagacaagcguagcguagcccuggcaccccacgugggcauggguuuggauacaagaacccaaacguggauguccgccgagggggcuuggaggcaggucgaaaaaguggagacuugggcacuccggcauccuggauucaccauccuggcccuguuucucgcucacuacauuggcacaucuuuaacucagaagguugugaucuucauacugcuuauguuggucaccccaucgaugacaaugcgcugugugggcguagggaacagagacuuuguugaaggacugucaggugccaccuggguggaugucgugcuagagcauggcgggugcgugacgacuauggcaaagagcaaacccacacucgacaucgagcugcagaagaccgaagcaacucaacuugccacacugaggaaauuguguauugagggaaagaucaccaauauuacgaccgauagucggugcccuacacagggcgaagcuacucucccagaggaacaggaccagaacuaugucuguaaacacaccuacguugaucgcgguugggggaauggaugcggccuguucggcaagggguccuuagugacaugcgccaaguuucaaugucuggagcccaucgagggaaaaguagugcaguaugaaaaccucaaguacacugucauaauuaccgugcacacaggugaccagcaucagguuggcaaugacacccaaggggugacugucgagaucacgccucaggcaucuacaguggaagcuguacuuccagaguauggaacccugggcuuggaaugcagcccgcgaacuggucuagauuucaacgagaugauucugcucaccaugaaaaauaaggccuggaugguucacagacagugguuuuucgaccugccccuuccuuggacauccggggcgaccacugagacaccaacguggaacaggaaagaacuguuggugaccuuuaagaaugcccaugccaagaagcaagaggucgugguccucggcucacaggaaggagcuaugcacacugcccugacaggcgcuaccgagauccagaacagugggggaacaagcaucuucgccggucacuuaaagugucggcugaaaauggauaagcuagaacucaaaggcaugucuuacgcaaugugccugaauacuuuugugcuuaagaaagagguuuccgagacccagcaugggacgauuuugauaaagguggaauacaagggagaggacgcccccuguaaaaucccuuucucaaccgaagauggccaagguaaggcucacaacgggcgucugauuacagcgaacccaguagucacuaaaaaggaggagcccgugaauaucgaagcagagccgccuuucggcgaaagcaacauaguuauuggaaucggcgacaaagcccucaagaucaauugguauaagaaagggaguucuauuggaaagauguuugaggcuaccgcccgcggugcaagaaggauggccauccugggcgauacagcuugggacuucggguccgugggaggcguccuuaacagccuggguaaaauggugcaucagauuuuugggucggccuacacugcauuguucucuggcguauccuggauaaugaagaucggaauuggcgugcuccugaccuggaucggguuaaauucaaagaacacgaguaugagcuuuuccugcaucguuauuggaauaaucacacuguaucuaggcgcggucgugcaggcugauauggguugugugauuaauuggaaggggaaggaacucaaaugcggaucuggcaucuucgucaccaacgagguucacacuuggacagagcaguacaaguuucaagccgacagccccaaacggcuggcaaccgccauugcuggugccugggaaaauggcgugugugggauccgaucaacuacccgcauggagaaccuuuuguggaagcagauagcaaaugaacugaacuauauccucugggagaauaacauuaaacugacagugguagucggagauaucauuggcguguuagaacaggggaagagaacgcugaccccacagccuauggagcuuaaauacaguuggaagacuuggggaaaggcuaaaaucguuacagccgagacccaaaauuccagcuucauaauugacggccccaacacaccagaaugccccucugcgucaagggccuggaacgugugggaggucgaagacuaugguuuugggguguucacuaccaauaucugguugaagcuccgggagguuuacacgcagaguugugaucaucgccugaugagcgcugcaauuaaagacgaaagagccgugcacgcugauaugggauacuggaucgagucccagaagaacggcucuuggaaacuagagaaggccucguuuauagaaguaaagacaugcaccuggccuaaaagccacacucugugguccaaugguguccucgagucagacaugaucauuccaaagagucuggcaggcccgaucucucagcauaaccacaggcccggguaucauacccaaacagcgggaccuuggcaccuuggcaaauuggaacuggauuucaauuacugcgaggggacuaccguggugauuacagagaacuguggaacgcguggccccagcuuacggaccacuacagucuccgguaagcucauccacgaauggugcugucgaucaugcacccugcccccucuuagauauaugggggaggacggauguugguacggcauggaaauaaggccaauuaaugagaaagaagagaacaugguuaagagccuggugucugccgguuccggcaagguagauaauuuuacuauggggguguugugccucgcuauccuguucgaggaagucaugcgcggaaaauucggcaagaaacauaugaucgccggggugcuauuuacauucguucugcuccugaguggacagauuaccuggcgggacauggcacacacgcuuaucaugauuggcagcaacgcuucugauagaauggguaugggggugacuuauuuggcccugauagcaaccuuuaagauccagcccuucuuagcccucggauuuuuccugaggaaacuuacaucccgcgagaaucugcuacucggcgucggccuggcuauggcgaccacuuugcaacugccggaagacauugagcagauggccaacgggaucgcauuaggacucaugacacugaaacuuauuacccaguuugaaacauaccagcuguggacugcuuuggugucacucaccuguaguaauacgaucuucacacugaccguugccuggcgaacugccacccuaauacuggcuggugugagccuucucccucugugccaaucguccucuaugcggaagacagauugguugccaaugacugucgcagccaugggcguacccccucugcccuuauuuaucuucagccucaaagacaccccaaagcguagaucauggccucugaacgagggggugauggcgguuggacuugugaguauucuggcuuccucuuugcucaggaaugauguccccauggccggcccacugguggcgggugggcuacugaucgccuguuauguaauuacgggaacaagcgcugaccuuaccguggagaaagcagccgacgucacuugggaagaggaagcggagcagacaggcguuucccauaaccucaugaucaccguggaugacgauggcacuaugcgcauaaaggacgaugaaacagagaacauucugaccguguuguuaaaaacggcucugcucaucgucucagggaucuuuccguacagcauuccugccacucugcuuguguggcacaccuggcagaagcagacacaacggaguggaguucugugggacguacccucuccacccgagacccagaaagcagaauuggaggaagguguguacagaauaaagcagcagggcaucuucgggaagacacaagucggagugggcguucagaaagaggguguguuucauacuauguggcacgucacccgaggggcagugcuaacgcacaauggaaagaggcuggagccuaacugggcuuccgucaagaaggaucucauuagcuauggcggcggguggcgccugucggcccaguggcaaaaaggagaagagguccaggugaucgcaguugaaccagguaagaaucccaagaacuuccagacaaugccuggcauuuuccagacuaccacaggggagaucggagcuauagcccuugacuuuaaaccgggcaccucagguucuccaaucauuaaucgggaagggaagguggucggauuauacggcaacggcgugaucacuaaaaaugggggauauguuagugguauugcgcaaaccaacgccgagcccgauggcccuacaccagagcuggaagaggaaauguucaagaaaagaaaucucacgaucauggacuugcaucccggguccggaaagacuaggaaguaccugccugcaauagugcgugaggcuauuaaacgccggcucagaacccugauccuugccccgacaagggucguggcugcagaaauggaggaggcccugaagggcuugcccauccgauaucagaccacugccacaaaaagcgaacacaccggucgggagauuguagaucuaaugugccaugcuacguuuacuaugcgccugcucucuccagugagaguuccuaacuacaauuuagucaucauggacgaagcgcacuucacagaucccgcaagcauagccgcuaggggguauauuuccacccgggugggaaugggcgaggccgcagccaucuuuaugaccgcuacuccaccuggcacagcggaagccuucccccagucaaacgcaccaauucaggacgaggagcgagacaucccggaaagaaguuggaauagcgggaacgaguggauaaccgauuuugugggaaagacagucugguucguaccuucuauuaaagcugguaaugacaucgccaacugucugcgcaagaacggcaagaaagugauccaacuuuccaggaagacuuuugauacggaauaccagaaaacccgucugaaugacugggauuucguugugacaacugacauuucagagaugggggcaaacuuuaaggccgaucgggucaucgaccccagaaggugccucaaaccagugauuuugaccgauggacccgagcgcguuauacuggcuggcccuaugccagugacagccgcgagugcagcccagcgaagaggucgggucgggaggaauccccagaaggaaaacgaccaauacaucuucaccggccagccucucaauaacgaugaggaccaugcucacuggacugaagccaagaugcugcuugacaauauuaacacgccggagggaaucaucccagcucuauucgaacccgagcgcgagaaaagcgcagccauugauggcgaauaucgucugaagggggaguccagaaaaaccuuuguggaauugaugcggaggggagacuuaccuguauggcuggcucacaagguggccucugaggguauaaaauacacagaucgcaaguggugcuucgacggcgaacgaaauaaccagauccucgaggagaauauggauguugaaauuuggacuaaagagggggaaagaaagaagcugcggcccagguggcuugacgcacgcaccuauucggauccacuggcgcucaaagaguuuaaggacuucgccgcuggaagaaaaagcaucgccuuggaucuggucacagaaauuggcagggugccuucacaucuagcacaccggacccguaacgcucuggacaaucucgugaugcuucauacuuccgagcacggugggcgcgccuaccgacacgcagucgaggaacugcccgagacaauggaaacguuauugcugcucggccugaugauccuucugaccaguggagccaugcucuuuuugauaucuggcaaggggaucggaaaaacuagcauuggucugaucuguguuauuguguccucaggcauguuauggauggcugauguaccacuacaguggaucgcgucugccauagugcuggaguucuuuaugaugguccuccuuauuccugagccggaaaagcaaagaacaccccaggacaaccagcuggcauaugugguuaucgggauuuugacccuggcugccaucguggccgcaaaugagaugggacuccuggaaaccacaaagagggaucuuggcaugagcaaagagccaggugucguaaguccuacuuccuaccucgacguggaccugcaucccgcuagcgccuggacguuguaugcgguugcuaccacagugauaacuccaaugcugcggcacaccaucgaaaacucuacagccaaugucucauuagcagccauugcuaaccaagcagugguccuaauggggcuggauaagggcuggccuaucuccaaaauggaccucggagugccccuucuggccuugggcugcuacagucagguuaacccgcugacccucacugcggcugugcugcuuuuaguaacgcauuacgccauuaucgggccaggacugcaggcaaaggccacacgcgaggcucagaaaagaaccgccgcaggcauaaugaagaauccuacuguggaugguauuaugaccaucgaccucgaucccgucaucuaugacagcaaguucgagaaacaauuggggcagguuaugcugcuagugcugugugcuguccagcuccuucugaugaggacaucgugggccuugugcgaagcgcugacucucgccaccggaccaauuacaacgcugugggagggcucucccgguaaguuuuggaacaccacuaucgcaguguccauggcuaauauauuccggggcagcuacuuagccggggcaggacuugcuuuuucaauuaugaaaaguguaggcacagggcgaagaggaaccggcucucagggugaaacucugggggagaaguggaaaaagaagcucaaccaacuaucccgcaaagaguucgaucuguauaagaaaagcggaaucacagagguggacaggaccgaggccaaggaaggcuugaaacggggugagacgacccaccaugccguuucacguggcagugcgaagcugcagugguuuguggaaagaaauauggucauuccugaggggagggugaucgaucucggauguggccgcgggggauggagcuacuauugcgcuggccuuaaaaaggucacagaagugcgggguuacacuaaagggggaccgggccacgaggagcccguuccaauguccaccuauggcuggaacauaguaaaacugaugucugggaaggacguguucuacuugccucccgaaaaaugugauacacugcucugcgacaucggagagagcuccccuucaccaacugucgaagagucucgaaccauuagaguguuaaagaugguugagcccuggcugaggaauaaccaguucuguaucaaagugcuuaauccuuacaugccaacagucauugaacaccuggagcgccuacagcggaaguaugguggcaugcucgugagaaacccccugagucguaauucgacccaugaaauguacuggaucagcaacgggacuggaaauauuguauccucugugaacaugguuucaagguugcugcucaaucgguuuacgaugacacaccgccgaccgaccaucgagaaggaugucgaccuuggcgcagguacuagacaugugaacgccgaaccugagaccccaaacauggacgugauaggggagaggauuaaacggaucaaggaagaacacagcuccacauggcacuaugaugacgaaaaucccuacaaaacgugggcuuaucauggaaguuacgaggucaaggccaccggcucugcaagcucaaugaucaacggcguugugaaacuguuaacuaagccuugggauguagugccaauggucacacaaauggccaugaccgacacuacacccuucgggcagcagcgcguguuuaaggaaaaaguugauaccagaacaccgaggccuaugcccggaacucgaaaggugauggagauuaccgcugaguggcuguggcggacguugggucguaauaaaaagccaagacucugcacccgcgaagaguucaccaaaaaggucaggacuaacgcggccaugggcgcaguguuuaccgaagagaaucaaugggacuccgcucgggccgcaguagaagaugaggaguucuggaagcugguugacagagaacgcgagcuacacaaacuugggaaguguggaaguugcguguauaacaugaugggcaaaagggaaaagaaacugggugaguuugggaaggccaaaggaagccgagcuauaugguacauguggcucggcgcccgguaccuggaguucgaagcguugggcuuucugaaugaggaucauugguucucuagagaaaacuccuauucaggggucgagggagaaggucuccacaaacuuggcuacauccugagggacauuagcaagaucccugggggagcaauguaugccgaugacacagcuggcugggacacucgcauuaccgaggaugacuuacauaaugaggagaaaaucacgcagcagauggaucccgagcaccgucagcuggccaacgcaauauuuaaguugacauaccaaaauaaaguggugaagguccagcggccaacccccaaagguacuguuauggacaucauuucgagaaaggaucagagggggucuggacaggugggcacauauggccucaacaccuucacuaauauggaagcucaacugguacgccagauggagggggaagacgugcuaaguaaggccgaucuugagaacccucaucugcucgagaaaaagaucacccaguggcuggaaacaaaaggagucgagcgauugaagcggauggcuauuuccggugacgauugcgugguuaaaccaaucgacgauagauuugccaaugcauuacuggcgcucaacgacaugggcaaggugaggaaggauauaccgcaguggcaacccagcaaaggguggcaugacuggcagcaggucccuuucuguucacaccauuuccacgaacuuauuaugaaggacggacgcaaacuggugguaccaugcagaccccaggaugagcuaaucggccgggccaggaucucccaaggugcuggguggucucugaaggaaacggccugucucggaaaagcauacgcucagauguggagcuugauguauuuucaccgucgagaccugcgccuugccaguaacgcaauuugcuccgccguuccugugcauuggauaccaaccagcagaacuacauggucuauccacgcgcaucaccaguggaugaccacugaggauaugcugacagucuggaaucggguguggauugaggacaaccccuggauggaagauaagaccccuguuacgacaugggaggacgugccguaccucggcaagagggaagaucaaugguguggcucauuaaucgggcugaccagucgcgcuacuugggcccagaauauuuugaccgcaauccagcaggucagaucccugauaggagacgaggaguucagcgauuacaugccaucuaugaaacgguuuaggaaggaagaggaaucggagggugccaucugguga

SEQ ID NO: 15207 - RNA, 9873 nt, Artificial Sequence
  derived and/or modified CDS sequence (opt3) from DENV-3__GU131917__SS-prME
accagccugugccucaugaugaugcuucccgcaacucuggcuuuccacuugacuuccagggacggcgaaccuaggaugaucguggggaagaacgaacggggaaaaucuuuacuguuuaagacggcaucagguauuaauauguguacccuaauagccauggaucucggcgagaugugcgacgauacaguaacuuacaaauguccacugaucgcggaaguugagccggaagacauugauugcugguguaaccuuaccaguacaugggugaccuaugggacuugcaaucaggcuggagagcaccgccgagacaagcguagcguagcccuggcaccccacgugggcauggguuuggauacaagaacccagacguggauguccgccgagggggcuuggaggcaggucgaaaaaguggagacuugggcacuccggcauccuggauucaccauccuggcccuguuucucgcucacuacauuggcacaucuuuaacucagaagguugugaucuucacccugcuuauguuggucacaccaucgaugaccaugcgcugugugggcguagggaacagagacuuuguugaaggacugucaggugccacguggguggaugucgugcuagagcauggcgggugcgugacuacaauggcaaagagcaaacccacccucgacauagagcugcagaagacugaagcaacacagcuugccacccugaggaaauuguguaucgagggaaagauuacgaauaucaccacagauagucggugcccuacucagggcgaagcuacccucccagaggaacaggaccagaacuaugucuguaaacacacauacguugaucgcgguugggggaauggaugcggccuguucggcaagggguccuuagugacuugcgccaaguuucaaugucuggagcccauugagggaaaaguagugcaguaugaaaaccucaaguacaccgucaucauaacagugcacaccggugaccagcaucagguuggcaaugacacucaaggggugacggucgagauuacaccucaggcaucuaccguggaagcuguacuuccagaguauggaacucugggcuuggaaugcagcccgcgaaccggucuagauuucaacgagaugauccugcucacaaugaaaaauaaggccuggaugguucacagacagugguuuuucgaccugccccuuccuuggaccuccggggcgacuacagagacgccaaccuggaacaggaaagaacuguuggugacuuuuaagaaugcccaugccaagaagcaagaggucgugguccucggcucacaggaaggagcuaugcacacagcccugaccggcgcuacagagauucagaacagugggggaacuagcaucuucgccggucacuuaaagugucggcugaaaauggauaagcuagaacucaaaggcaugucuuacgcaaugugccugaauaccuuugugcuuaagaaagagguuuccgagacgcagcaugggaccaucuugauuaagguggaauacaagggagaggacgcccccuguaaaauaccuuucucaacagaagauggccaagguaaggcucacaacgggcgucugaucacugcgaacccaguagucaccaaaaaggaggagcccgugaauauugaagcagagccgccuuucggcgaaagcaacaucguuauaggaauuggcgacaaagcccucaagaucaauugguauaagaaagggaguucuaucggaaagauguuugaggcuacagcccgcggugcaagaaggauggccauucugggcgauacugcuugggacuucggguccgugggaggcguccuuaacagccuggguaaaauggugcaucagaucuuugggucggccuacaccgcauuguucucuggcguauccuggauuaugaagauaggaaucggcgugcuccugacguggauuggguuaaauaguaaaaacacaucaaugagcuuuuccugcaucguuaucggaauuauaacccuguaucuaggcgcggucgugcaggcugauauggguugugugaucaauuggaaggggaaggaacucaaaugcggaaacggcauuuucgucacuaaugagguucacacauggaccgagcaguacaaguuucaagccgacucucccaaacggcuggcaacugccaucgcuggugccugggaaaacggcgugugugggauucgaagcaccacacgcauggagaaucuuuuguggaagcagaucgcaaacgaacugaauuauauacucugggagaacaauaucaaacugacggugguagucggagauauuaucggcguguuagaacaggggaagagaacccugacuccacagccuauggagcuuaaauacucauggaagacauggggaaaggcuaaaauuguuaccgccgagacacaaaacaguuccuucaucauagacggccccaacacuccagaaugccccagcgcgucuagggccuggaaugugugggaggucgaagacuaugguuuugggguguucaccacgaacauuugguugaagcuccgggagguuuacacacagucaugugaucaucgccugaugagugcugcaaucaaagacgaaagagccgugcacgcugauaugggauacuggauugagagccagaagaauggcuccuggaaacuagagaaggccucuuuuaucgaaguaaagaccugcacuuggccuaaaucgcacacccuguggagcaacgguguccucgaguccgacaugauaaucccaaagucacuggcaggcccgauuagucagcauaaucacaggcccggguaucauacacaaacugcgggaccuuggcaccuuggcaaauuggaacuggauuucaacuacugcgaggggaccacaguggugaucgccgagaauuguggaacgcguggcccaucuuuacggaccacuacagucagcgguaagcucauucacgaauggugcugucgauccugcacccugcccccucuuagauauaugggggaggacggauguugguacggcauggaaaucaggccaauaaacgagaaagaagagaauaugguuaagucacuggugagcgcugguucuggcaagguagauaacuuuacuauggggguguugugccucgccauucuguucgaggaagucaugcgcggaaaauucggcaagaaacauaugaucgcaggggugcuauuuacauucguucugcuccuguccggacagaucaccuggcgggacauggcucacacgcuuauuaugaucggcaguaaugccagcgauagaauggguaugggggugacuuauuuggcacugauugccaccuuuaagauacagcccuucuuagcucucggauuuuuccugaggaaacuuacaucucgcgagaaccugcuacucggcgucggccuggcgauggccaccacuuugcaacugccggaagacaucgagcagauggcaaaugggauugcuuuaggacucaugacacugaaacuuaucacccaguuugaaacauaccagcuguggacugccuuggugucccucaccuguucaaacacgauuuucacacugaccguugccuggcgaacugcuacccuaauccuggcgggugugagucuucucccucugugccaaagcucguccaugcggaagacagauugguugccaaugacugucgccgcgaugggcguacccccucugcccuuauuuauauucucucucaaagacaccccaaagcguagaagcuggccucugaaugagggggugauggcuguuggacuugugucaauccuggccaguuccuugcucaggaacgauguccccauggcaggcccacugguggccggugggcuacugauugcuuguuauguaaucacgggaacaucugcagaccuuaccguggagaaagccgcggacgucacuugggaagaggaagcugagcagacaggcguuagccauaaccucaugauuaccguggaugacgauggcacuaugcgcaucaaggacgaugaaacagagaauauacugaccguguuguuaaaaacggcccugcucauugucuccgggaucuuuccguacucaaucccugcaacucugcuuguguggcacaccuggcagaagcagacacaacggagcggaguucugugggacguacccaguccacccgagacccagaaagccgaauuggaggaagguguguacagaauuaagcagcagggcauauucgggaagacacaagucggagugggcguucagaaagaggguguguuucauacuauguggcacgucaccagaggggcugugcuaacgcacaacggaaagcgacuggagccuaauugggccucugucaaaaaggaucucaucuccuauggcggcggguggcgccugagcgcacaguggcaaaaaggagaagagguccaggugauugcuguugaaccagguaagaaccccaagaauuuccagacaaugccuggcaucuuccagacuaccacaggggagauuggagccaucgcgcuugacuuuaaaccgggcaccucggguucaccaauaaucaaccgggaagggaagguggucggauuauacggcaauggcgugguuacuaaaaacgggggauaugugucugguauugcccaaaccaaugcagagcccgauggcccuacaccagagcuggaagaggaaauguucaagaaaagaaaccucacgaucauggacuugcaucccgggaguggaaagacuaggaaguaccugccugcuauuguccgugaggccaucaaacgccggcucagaacccugauacuugcuccgacaagggugguagcagccgaaauggaggaggcccugaagggcuugcccauucgauaucagaccacugcuacaaaauccgaacacaccggucgggagaucguggaucuaaugugccaugcgacguuuacuaugcgccugcucagcccaguuagagucccuaauuacaacuuagugaucauggacgaagcacacuucacagaucccgccucuauugcugccaggggguauaucagcacccgggugggaaugggcgaggcagccgcuauauuuaugaccgcgacuccaccuggcacagccgaagcauucccccaguccaaugcuccaauucaggacgaggagcgagacaucccggaaagaucauggaacagugggaaugaguggauuaccgauuuugucggaaagacaguaugguucgugccuagcaucaaagccgguaacgacauagcaaacugucugcgcaagaauggcaagaaaguuauucaacuuucuaggaagacuuuugauacggaauaccagaaaacccgucugaacgacugggauuucguggucacaacugacaucuccgagaugggggccaauuuuaaggcugaucgggugaucgaccccagaaggugccucaaaccaguuauuuugaccgauggacccgagcgcgugauccuggccggcccuaugccagucacagcggcaucagccgcucagcgaagaggucggguggggaggaacccccagaaggaaaaugaccaauacauuuucaccggccagccucucaacaaugaugaggaccaugcccacuggacugaagcuaagaugcugcuugacaacauaaauacgccggagggaaucauuccagcacuauucgaacccgagcgcgagaaaagugccgcuaucgauggcgaauaucgucugaagggggagagcagaaaaaccuuuguagaauugaugcggaggggagacuuaccuguguggcuggcccacaagguugcauccgaggguaucaaauacacagaucgcaaguggugcuucgacggcgaacgaaacaaucagauucucgaggagaacauggaugucgaaauauggacuaaagagggggaaagaaagaagcugcggcccagguggcuugacgcgcgcaccuauucugauccacuggcccucaaagaguuuaaggacuucgcugccggaagaaaaucgaucgcauuggaucuggugacagaaauuggcagggugccuagccaucuagcucaccggacccguaaugcccuggacaaccucgucaugcuucauacuucagagcacggugggcgcgcauaccgacacgccguugaggaacugcccgagacaauggaaacguuauugcugcucggccugaugauccuucugaccggaggcgcuaugcucuuuuugauuuccgggaagggaaucgguaaaacaaguauaggccugaucugugugauuguaucuagcgggauguuauggauggcggaugugccacuacaguggaucgccuccgcaauuguccuggaguucuuuaugauggugcuccuuaucccugagccggaaaagcaaagaacaccccaggacaaucagcuggcuuauguugugauaggaauuuugacccuggccgccaucgucgcagcuaacgagaugggccuccuggaaaccacaaagagggaucuugguaugucaaaagagccagggguagugucuccuacuagcuaccucgacguugaccugcaucccgccagugcguggacguuguaugcuguggccaccacagucauuacuccaaugcugcggcacaccaucgaaaauuccacagcaaacgugagcuuagccgcuauagcaaaccaagccgucgugcuaaugggccuggauaagggauggccuaucucuaaaauggaccucggcguuccccuucuggcguuggggugcuacucacaggugaauccgcugacccucacugcugccguacugcuuuuagugacgcauuacgcaauuaucggaccaggccugcaggccaaggcuacacgcgaggcccagaaaagaaccgcagcugguauuaugaagaacccuacugucgaugggaucaugaccauagaccucgaucccguuauuuaugacuccaaguucgagaaacaauugggacaggugaugcugcuaguccugugugccgugcagcuccuucugaugaggacaaguugggcguugugcgaagcccugacucucgcaaccggcccaaucacaacgcugugggaggguagccccggcaaguuuuggaauaccacuaucgcuguaucgauggccaacauuuuccgggggucuuacuuagcaggagcuggccuugccuuuuccaucaugaaaagcguggggacaggaaagcgaggcaccgguucacagggggaaacucugggagagaaauggaagaagaaacucaaucaacuaaguagaaaggaguucgaucuguauaaaaagucuggcauaacagagguugaccgcuccgaggccaaagaagguuugaagaggggcgagaccacgcaccaugcggugagccgggggucagcuaaacugcagugguuugucgaacguaacauggugauuccugagggaagagucaucgaucucggcugugggaggggaggcuggaguuacuauugcgcaggucuuaagaaggugaccgaaguucgcggguacacaaaaggaggcccgggccacgaggagcccguaccaaugagcacuuauggguggaauauugugaagcugauguccggaaaagacgucuucuacuugccucccgaaaagugugauacccugcucugcgacaucggugagucuagcccuuccccaacaguggaagagucacggacuauacgaguuuuaaaaaugguggagcccuggcugagaaacaaucaguucuguaucaagguccuuaacccuuacaugccaaccgugauugaacaccuggagaggcuacagcgcaaguauggcgggaugcucguacggaauccccugucuagaaacaguacacaugaaauguacuggaucucgaauggaaccggcaacauugugagcuccguuaauauggucucucguuugcugcucaacagguuuacuaugacgcaccggcgcccgacaaucgagaaagauguggaccuuggugccgggacccgacaugugaacgcugaaccugagacuccaaauauggacgucauuggagagagaaucaagaggauaaaagaagaacacucaagcaccuggcacuaugaugacgaaaaccccuacaagacaugggccuaucauggcuccuacgagguuaaagcaacgggcagugccucuagcaugauuaauggggugguaaagcuguuaaccaagccuugggauguggucccaauggugacucaaauggcuaugacagacaccacucccuucggacagcagcggguuuuuaaagaaaagguggauacacgcaccccgagaccuaugcccgguacaaggaaagucauggagaucacugcggaguggcuguggcgaaccuugggccggaacaagaaaccacgucucugcacgagagaagaguucaccaagaaggugcgcacaaaugccgcaaugggggcuguauuuacugaagagaaccaaugggacucagccagggcagccguugaagaugaggaguucuggaaacugguggacaaggaacgggagcuacacaaacuuggaaaguguggcuccugcgucuauaauaugauggguaaaagagaaaagaaacugggggaguuuggaaaggcuaagggcagucgcgccaucugguacauguggcucggcgcgagguaccuggaguucgaagcauugggguuucugaacgaggaucauugguucagccgagaaaauucuuauuccggaguggagggugaaggccuccacaaacuuggguacauucugcgggacauaucaaagaucccuggaggcgccauguaugcugaugacaccgccgguugggacacaagaauuacugaggaugacuuacauaacgaggagaaaaucacccagcagauggaucccgagcacaggcagcuggcaaaugcuauuuuuaaguugacguaccaaaacaaaguggucaagguucagcgcccaacacccaaggggaccgugauggacaucauaagccguaaagaucagcggggaucgggccagguaggcacuuaugggcucaauacauucaccaacauggaagcccaacuggugagacagauggagggagaagguguccuaucuaaggcugaccuugagaauccucaucugcucgagaaaaagaucauucaguggcuggaaacuaaaggcguggagagguugaagcgcauggccaucaguggggaugacugcguugugaagccaauugaugaccgauuugcaaacgcguuacuggcccucaacgauaugggaaaaguccggaaggacaucccgcaguggcaacccuccaaaggcuggcaugauuggcaacaggugccuuucuguagccaccauuuccacgaacuuauaaugaaggacgguagaaaacugguaguuccaugcaggccccaggacgagcuaauugggcgcgcuagaaucucacaaggagccggcuggucccugaaggaaaccgcaugucucggcaaggcuuacgcccagauguggucuuugauguauuuucaccggagggaucugcgucuugcaagcaaugccaucugcagugcggugccuguccauuggauuccaacaucccgaacgaccuggagcauacacgcucaucaccaguggaugacuacagaggacaugcugucuguguggaaccgcguuuggaucgaggauaaucccuggauggaagacaaaaccccugugacuacaugggaggaugucccguaccucgggaagagagaagaccaaugguguggaucauuaauuggucugaccagucgggccacgugggcacagaacaucuugacagccauucaacaggugaggucccugaucggcgaugaggaguuccucgacuacaugccaagcaugaaacgcuuuagaaaggaagaggaaucugagggggcuauaugguga

SEQ ID NO: 15208 - RNA, 9873 nt, Artificial Sequence
  derived and/or modified CDS sequence (opt3) from DENV-3__GU131918__SS-prME
accagccugugccucaugaugaugcuucccgccacucuggcuuuccacuugacuuccagagacggcgaaccuaggaugaucguggggaagaacgaacggggaaaaucuuuacuguuuaagacggcaucagguauuaauauguguacccuaauagccauggaucucggcgagaugugcgacgauacaguaacuuacaaauguccacugaucgcggaaguugagccggaagacauugauugcugguguaaccuuaccaguacaugggugaccuaugggacuugcaaucaggcuggagagcaccgccgagacaagcguagcguagcccuggcaccccacgugggcauggguuuggauacaagaacccagacguggauguccgccgagggggcuuggaggcaggucgaaaaaguggagacuugggcacuccggcauccuggauucaccauccuggcccuguuucucgcucacuacauuggcacaucuuuaacucagaagguugugaucuucauacugcuuauguuggucaccccaucgaugacaaugcgcugugugggcguagggaacagagacuuuguugaaggacugucaggugccaccuggguggaugucgugcuagagcauggcgggugcgugacgacuauggcaaagagcaaacccacacucgacaucgagcugcagaagaccgaagcaacucagcuugccacacugaggaaauuguguauugagggaaagaucaccaauauuacgaccgauagucggugcccuacacagggcgaagcuacucucccagaggaacaggaccagaacuaugucuguaaacacaccuacguugaucgcgguugggggaauggaugcggccuguucggcaagggguccuuagugacaugcgccaaguuucaaugucuggagcccaucgagggaaaaguagugcaguaugaaaaccucaaguacacugucauaauuaccgugcacacaggugaccagcaucagguuggcaaugacacccaaggggugacugucgagaucacgccucaggcaucuacaguggaagcuguacuuccagaguauggaacccugggcuuggaaugcagcccgcgaacuggucuagauuucaacgagaugauucugcucaccaugaaaaauaaggccuggaugguucacagacagugguuuuucgaccugccccuuccuuggacauccggggcgaccacugagacaccaacguggaacaggaaagaacuguuggugaccuuuaagaaugcccaugccaagaagcaagaggucgugguccucggcucacaggaaggagcuaugcacacugcccugacaggcgcuaccgagauccagaacagugggggaacaagcaucuucgccggucacuuaaagugucggcugaaaauggauaagcuagaacucaaaggcaugucuuacgcaaugugccugaauacuuuugugcuuaagaaagagguuuccgagacccagcaugggacgauuuugauaaagguggaauacaagggagaggacgcccccuguaaaaucccuuucucaaccgaagauggccaagguaaggcucacaacgggcgucugauuacagcgaacccaguagucacuaaaaaggaggagcccgugaauaucgaagcagagccgccuuucggcgaaagcaacauaguuauuggaaucggcgacaaagcccucaagaucaauugguauaagaaagggaguucuauuggaaagauguuugaggcuaccgcccgcggugcaagaaggauggccauccugggcgauacagcuugggacuucggguccgugggaggcguccuuaacagccuggguaaaauggugcaucagauuuuugggucggccuacacugcauuguucucuggcguauccuggauaaugaagaucggaauuggcgugcuccugaccuggaucggguuaaauaguaaaaacacgucaaugagcuuuuccugcaucguuauuggaauaaucacacuguaucuaggcgcggucgugcaggcugauauggguugugugauuaauuggaaggggaaggaacucaaaugcggaaacggcaucuucgucaccaaugagguucacacuuggacagagcaguacaaguuucaagccgacucucccaaacggcuggcaaccgccauugcuggugccugggaaaacggcgugugugggauccgaagcacuacccgcauggagaaucuuuuguggaagcagauagcaaacgaacugaauuauauccucugggagaacaauauuaaacugacagugguagucggagauaucauuggcguguuagaacaggggaagagaacgcugaccccacagccuauggagcuuaaauacucauggaagacuuggggaaaggcuaaaaucguuacagccgagacccaaaacaguuccuucauaauugacggccccaacacaccagaaugccccagcgcgucuagggccuggaaugugugggaggucgaagacuaugguuuugggguguucacuaccaacaucugguugaagcuccgggagguuuacacgcagucaugugaucaucgccugaugagugcugcaauuaaagacgaaagagccgugcacgcugauaugggauacuggaucgagagccagaagaauggcuccuggaaacuagagaaggccucuuuuauagaaguaaagacaugcaccuggccuaaaucgcacacucuguggagcaacgguguccucgaguccgacaugaucauuccaaagucacuggcaggcccgaucagucagcauaaucacaggcccggguaucauacccaaacagcgggaccuuggcaccuuggcaaauuggaacuggauuucaacuacugcgaggggacuaccguggugauuacagagaauuguggaacgcguggcccaucuuuacggaccacuacagucagcgguaagcucauccacgaauggugcugucgauccugcacccugcccccucuuagauauaugggggaggacggauguugguacggcauggaaauaaggccaauuaacgagaaagaagagaauaugguuaagucacuggugagcgccgguucuggcaagguagauaacuuuacuauggggguguugugccucgcuauccuguucgaggaagucaugcgcggaaaauucggcaagaaacauaugaucgccggggugcuauuuacauucguucugcuccuguccggacagauuaccuggcgggacauggcacacacgcuuaucaugauuggcaguaaugcuagcgauagaauggguaugggggugacuuauuuggcccugauagcaaccuuuaagauccagcccuucuuagcccucggauuuuuccugaggaaacuuacaucucgcgagaaccugcuacucggcgucggccuggcuauggcgaccacuuugcaacugccggaagacauugagcagauggccaaugggaucgcauuaggacucaugacacugaaacuuauuacccaguuugaaacauaccagcuguggacugcuuuggugucccucaccuguucaaacacgaucuucacacugaccguugccuggcgaacugccacccuaauacuggcuggugugagucuucucccucugugccaaagcucguccaugcggaagacagauugguugccaaugacugucgcagccaugggcguacccccucugcccuuauuuaucuucucucucaaagacaccccaaagcguagaagcuggccucugaaugagggggugauggcgguuggacuugugucaauucuggcuaguuccuugcucaggaacgauguccccauggccggcccacugguggcgggugggcuacugaucgccuguuauguaauuacgggaacaucugcugaccuuaccguggagaaagcagccgacgucacuugggaagaggaagcggagcagacaggcguuagccauaaccucaugaucaccguggaugacgauggcacuaugcgcauaaaggacgaugaaacagagaauauucugaccguguuguuaaaaacggcucugcucaucgucuccgggaucuuuccguacucaauuccugccacucugcuuguguggcacaccuggcagaagcagacacaacggagcggaguucugugggacguacccaguccacccgagacccagaaagcagaauuggaggaagguguguacagaauaaagcagcagggcaucuucgggaagacacaagucggagugggcguucagaaagaggguguguuucauacuauguggcacgucacccgaggggcagugcuaacgcacaacggaaagaggcuggagccuaauugggcuucugucaaaaaggaucucauuuccuauggcggcggguggcgccugagcgcccaguggcaaaaaggagaagagguccaggugaucgcaguugaaccagguaagaaccccaagaauuuccagacaaugccuggcauuuuccagacuaccacaggggagaucggagcuauagcccuugacuuuaaaccgggcaccucggguucaccaaucauuaaccgggaagggaagguggucggauuauacggcaauggcgugguuacuaaaaacgggggauaugugucugguaucgcgcaaaccaaugccgagcccgauggcccuacaccagagcuggaagaggaaauguucaagaaaagaaaccucacgauuauggacuugcaucccgggaguggaaagacuaggaaguaccugccugcaaucguccgugaggcuauaaaacgccggcucagaacccugauucuugccccgacaagggugguagcugcagaaauggaggaggcccugaagggcuugcccauccgauaucagaccacugccacaaaauccgaacacaccggucgggagaucguggaucuaaugugccaugcuacguuuacuaugcgccugcucagcccaguuagagucccuaauuacaacuuagugauuauggacgaagcgcacuucacagaucccgcaucuaucgccgcuaggggguauauaagcacccgggugggaaugggcgaggccgcagccauuuuuaugaccgcuacuccaccuggcacagcggaagccuucccccaguccaaugcaccaauccaggacgaggagcgagacauuccggaaagaucauggaacagugggaaugaguggaucaccgauuuugucggaaagacaguaugguucgugccuagcauaaaagcugguaacgacauugccaacugucugcgcaagaauggcaagaaaguuauccaacuuucuaggaagacuuuugauacggaauaccagaaaacccgucugaacgacugggauuucguggucacaacugacaucuccgagaugggggcaaauuuuaaggccgaucgggugauugaccccagaaggugccucaaaccaguuaucuugaccgauggacccgagcgcgugauucuggcuggcccuaugccagucacagccgcgucagcagcccagcgaagaggucggguggggaggaacccccagaaggaaaaugaccaauacauauucaccggccagccucucaacaaugaugaggaccaugcucacuggacugaagccaagaugcugcuugacaacaucaauacgccggagggaauuaucccagcucuauucgaacccgagcgcgagaaaagugcagccaucgauggcgaauaucgucugaagggggagagcagaaaaaccuuuguagaauugaugcggaggggagacuuaccuguguggcuggcucacaagguugccuccgaggguauuaaauacacagaucgcaaguggugcuucgacggcgaacgaaacaaucagauacucgaggagaacauggaugucgaaaucuggacuaaagagggggaaagaaagaagcugcggcccagguggcuugacgcacgcaccuauucugauccacuggcgcucaaagaguuuaaggacuucgccgcuggaagaaaaucgauugccuuggaucuggugacagaaaucggcagggugccuagccaucuagcacaccggacccguaaugcucuggacaaccucgucaugcuucauacuucagagcacggugggcgcgccuaccgacacgcaguugaggaacugcccgagacaauggaaacguuauugcugcucggccugaugauucuucugaccggaggcgccaugcucuuuuugaucuccgggaagggaauagguaaaacaaguaucggccugauuugugugaucguaucuagcgggauguuauggauggcugaugugccacuacaguggauugcguccgccaucguccuggaguucuuuaugauggugcuccuuauaccugagccggaaaagcaaagaacaccccaggacaaucagcuggcauauguugugauuggaaucuugacccuggcugccauugucgccgcaaacgagaugggccuccuggaaaccacaaagagggaucuugguaugucaaaagagccagggguagugucuccuacuagcuaccucgacguugaccugcaucccgcuagugccuggacguuguaugcgguggcuaccacagucaucacuccaaugcugcggcacaccauagaaaauuccacagccaacgugagcuuagcagccaucgcuaaccaagcagucgugcuaaugggccuggauaagggauggccuauuucuaaaauggaccucggcguuccccuucuggccuuggggugcuacucacaggugaauccgcugacccucacugcggcuguacugcuuuuagugacgcauuacgccaucauuggaccaggccugcaggcaaaggccacacgcgaggcucagaaaagaaccgccgcagguaucaugaagaacccuacugucgaugggauaaugaccauugaccucgaucccguuaucuaugacuccaaguucgagaaacaauugggacaggugaugcugcuaguccugugugcugugcagcuccuucugaugaggacaaguugggccuugugcgaagcgcugacucucgccaccggcccaaucacaacgcugugggaggguagccccggcaaguuuuggaauaccacuauugcaguaucgauggcuaacaucuuccgggggucuuacuuagccggagcaggccuugcuuuuuccauaaugaaaagcguggggacaggaaagcgaggcaccgguucacagggggaaacucugggagagaaauggaagaagaaacucaaucaacuaaguagaaaggaguucgaucuguauaaaaagucuggcauuacagagguugaccgcuccgaggccaaagaagguuugaagaggggcgagaccacgcaccaugccgugagccgggggucagcgaaacugcagugguuugucgaacguaacauggugaucccugagggaagagucauugaucucggcugugggaggggaggcuggaguuacuauugcgcuggucuuaagaaggugaccgaaguucgcggguacacaaaaggaggcccgggccacgaggagcccguaccaaugagcacuuauggguggaauaucgugaagcugauguccggaaaagacgucuucuacuugccucccgaaaagugugauacccugcucugcgacauaggugagucuagcccuuccccaacaguggaagagucacggacuauccgaguuuuaaaaaugguggagcccuggcugagaaacaaucaguucuguauuaagguccuuaacccuuacaugccaaccgugaucgaacaccuggagaggcuacagcgcaaguauggcgggaugcucguacggaauccccugucuagaaacaguacacaugaaauguacuggauuucgaauggaaccggcaacaucgugagcuccguuaauauggucucucguuugcugcucaacagguuuacuaugacgcaccggcgcccgacaauugagaaagauguggaccuuggugcagggacccgacaugugaacgccgaaccugagacuccaaauauggacgucaucggagagagaauaaagaggauuaaagaagaacacucaagcaccuggcacuaugaugacgaaaaccccuacaagacaugggcuuaucauggcuccuacgagguuaaagccacgggcagugcaucuagcaugaucaauggggugguaaagcuguuaaccaagccuugggauguggucccaauggugacucaaauggccaugacagacaccacucccuucggacagcagcggguuuuuaaagaaaagguggauacacgcaccccgagaccuaugcccgguacaaggaaagucauggagaucacugcugaguggcuguggcgaaccuugggccggaacaagaaaccacgucucugcacgagagaagaguucaccaagaaggugcgcacaaaugcggccaugggggcaguauuuacugaagagaaccaaugggacucagcuagggccgcaguugaagaugaggaguucuggaaacugguggacaaggaacgggagcuacacaaacuuggaaaguguggcuccugcgucuauaauaugauggguaaaagagaaaagaaacugggggaguuuggaaaggccaagggcagucgcgcuauuugguacauguggcucggcgccagguaccuggaguucgaagcguugggguuucugaacgaggaucauugguucagccgagaaaauucuuauuccggaguggagggugaaggccuccacaaacuuggguacauacugcgggacaucucaaagauuccuggaggcgcaauguaugccgaugacaccgcugguugggacacaagaaucacugaggaugacuuacauaacgaggagaaaauuacccagcagauggaucccgagcacaggcagcuggccaaugcaaucuuuaaguugacguaccaaaacaaaguggucaagguucagcgcccaacacccaaggggaccgugauggacauaaucagccguaaagaucagcggggaucgggccagguaggcacuuaugggcucaauacauucaccaacauggaagcucaacuggugagacagauggagggagaagguguccuaucuaaggccgaccuugagaauccucaucugcucgagaaaaagauuauccaguggcuggaaacuaaaggcguggagagguugaagcgcauggcuauuaguggggaugacugcguugugaagccaaucgaugaccgauuugccaacgcauuacuggcgcucaacgauaugggaaaaguccggaaggacauaccgcaguggcaacccuccaaaggcuggcaugauuggcaacaggugccuuucuguagccaccauuuccacgaacuuauuaugaaggacgguagaaaacugguaguuccaugcaggccccaggacgagcuaaucgggcgcgccagaaucucacaaggagcuggcuggucccugaaggaaaccgccugucucggcaaggcauacgcucagauguggucuuugauguauuuucaccggagggaucugcgucuugccagcaaugcaauuugcagugccgugccuguccauuggauaccaacaucccgaacgaccuggagcauccacgcgcaucaccaguggaugacuacagaggacaugcugucuguguggaaccgcguuuggauugaggauaaucccuggauggaagacaaaaccccugugacuacaugggaggaugucccguaccucgggaagagagaagaccaaugguguggaucauuaaucggucugaccagucgggcuacgugggcccagaacauuuugacagcaauccaacaggugaggucccugauaggcgaugaggaguuccucgacuacaugccaagcaugaaacgcuuuagaaaggaagaggaaucugagggggccaucugguga

SEQ ID NO: 15209 - RNA, 9873 nt, Artificial Sequence
  derived and/or modified CDS sequence (opt3) from DENV-3__GU131933__SS-prME
accagccugugccucaugaugaugcuucccgccacacuggcuuuccacuugacuuccagagacggcgaaccuaggaugaucguggggaagaacgaacggggaaaaucuuuacuguuuaagacggcaucagguauuaauauguguacccuaauagccauggaucucggcgagaugugcgacgauacaguaacuuacaaauguccacugaucgcggaaguugagccggaagacauugauugcugguguaaccuuaccaguacaugggugaccuaugggacuugcaaucaggcuggagagcaccgccgagacaagcguagcguagcccuggcaccccacgugggcauggguuuggauacaagaacccaaacguggauguccgccgagggggcuuggaggcaggucgaaaaaguggagacuugggcacuccggcauccuggauucaccauccuggcccuguuucucgcucacuacauuggcacaucuuuaacucagaagguugugaucuucauacugcuuauguuggucaccccaucgaugacaaugcgcugugugggcguagggaacagagacuuuguugaaggacugucaggugccaccuggguggaugucgugcuagagcauggcgggugcgugacgacuauggcaaagagcaaacccacacucgacaucgagcugcagaagaccgaagcaacucaacuugccacacugaggaaauuguguauugagggaaagaucaccaauauuacgaccgauagucggugcccuacacagggcgaagcuacucucccagaggaacaggaccagaacuaugucuguaaacacaccuacguugaucgcgguugggggaauggaugcggccuguucggcaagggguccuuagugacaugcgccaaguuucaaugucuggagcccaucgagggaaaaguagugcaguaugaaaaccucaaguacacugucauaauuaccgugcacacaggugaccagcaucagguuggcaaugacacccaaggggugacugucgagaucacgccucaggcaucuacaguggaagcuguacuuccagaguauggaacccugggcuuggaaugcagcccgcgaacuggucuagauuucaacgagaugauucugcucaccaugaaaaauaaggccuggaugguucacagacagugguuuuucgaccugccccuuccuuggacauccggggcgaccacugagacaccaacguggaacaggaaagaacuguuggugaccuuuaagaaugcccaugccaagaagcaagaggucgugguccucggcucacaggaaggagcuaugcacacugcccugacaggcgcuaccgagauccagaacagugggggaacaagcaucuucgccggucacuuaaagugucggcugaaaauggauaagcuagaacucaaaggcaugucuuacgcaaugugccugaauacuuuugugcuuaagaaagagguuuccgagacccagcaugggacgauuuugauaaagguggaauacaagggagaggacgcccccuguaaaaucccuuucucaaccgaagauggccaagguaaggcucacaacgggcgucugauuacagcgaacccaguagucacuaaaaaggaggagcccgugaauaucgaagcagagccgccuuucggcgaaagcaacauaguuauuggaaucggcgacaaagcccucaagaucaauugguauaagaaagggaguucuauuggaaagauguuugaggcuaccgcccgcggugcaagaaggauggccauccugggcgauacagcuugggacuucggguccgugggaggcguccuuaacagccuggguaaaauggugcaucagauuuuugggucggccuacacugcauuguucucuggcguauccuggauaaugaagaucggaauuggcgugcuccugaccuggaucggguuaaauaguaaaaacacgucaaugagcuuuuccugcaucguuauuggaauaaucacacuguaucuaggcgcggucgugcaggcugauauggguugugugauuaauuggaaggggaaggaacucaaaugcggaucuggcaucuucgucaccaacgagguucacacuuggacagagcaguacaaguuucaagccgacagccccaaacggcuggcaaccgccauugcuggugccugggaaaauggcgugugugggauccgaucaacuacccgcauggagaaccuuuuguggaagcagauagcaaaugaacugaacuauauccucugggagaauaguauuaaacugacagugguagucggagauaucauuggcguguuagaacaggggaagagaacgcugaccccacagccuauggagcuuaaauacuccuggaagacuuggggaaaggcuaaaaucguuacagccgagacccaaaacagcucuuucauaauugacggccccaauacaccagaaugccccucagcgaguagggccuggaacgugugggaggucgaagacuaugguuuugggguguucacuaccaacaucugguugaagcuccgggagguuuacacgcagagcugugaucaucgccugauguccgcugcaauuaaagacgaaagagccgugcacgcugauaugggauacuggaucgagucucagaagaauggcucguggaaacuagagaaggccagcuuuauagaaguaaagacaugcaccuggccuaaaucccacacucuguggucaaacgguguccucgagagugacaugaucauuccaaagucucuggcaggcccgaucagccagcauaaucacaggcccggguaucauacccaaacagcgggaccuuggcaccuuggcaaauuggaacuggauuucaacuacugcgaggggacuaccguggugauuacagagaauuguggaacgcguggcccauccuuacggaccacuacagucucagguaagcucauccacgaauggugcugucgaagcugcacccugcccccucuuagauauaugggggaggacggauguugguacggcauggaaauaaggccaauuaacgagaaagaagagaauaugguuaagucucugguguccgccgguaguggcaagguagauaacuuuacuauggggguguugugccucgcuauccuguucgaggaagucaugcgcggaaaauucggcaagaaacauaugaucgccggggugcuauuuacauucguucugcuccugagcggacagauuaccuggcgggacauggcacacacgcuuaucaugauuggcucuaaugcuuccgauagaauggguaugggggugacuuauuuggcccugauagcaaccuuuaagauccagcccuucuuagcccucggauuuuuccugaggaaacuuacaucacgcgagaaccugcuacucggcgucggccuggcuauggcgaccacuuugcaacugccggaagacauugagcagauggccaaugggaucgcauuaggacucaugacacugaaacuuauuacccaguuugaaacauaccagcuguggacugcuuuggugagucucaccuguagcaacacgaucuucacacugaccguugccuggcgaacugccacccuaauacuggcuggugugucgcuucucccucugugccaauccucuagcaugcggaagacagauugguugccaaugacugucgcagccaugggcguacccccucugcccuuauuuaucuucucacucaaagacaccccaaagcguagaaguuggccucugaaugagggggugauggcgguuggacuuguguccauucuggcuucuagcuugcucaggaacgauguccccauggccggcccacugguggcgggugggcuacugaucgccuguuauguaauuacgggaacauccgcugaccuuaccguggagaaagcagccgacgucacuugggaagaggaagcggagcagacaggcguuucacauaaucucaugaucaccguggaugacgauggcacuaugcgcauaaaggacgaugaaacagagaacauucugaccguguuguuaaaaacggcucugcucaucgucagcgggaucuuuccguacaguauuccugccacucugcuuguguggcacaccuggcagaagcagacacaacggucuggaguucugugggacguacccuccccacccgagacccagaaagcagaauuggaggaagguguguacagaauaaagcagcagggcaucuucgggaagacacaagucggagugggcguucagaaagaggguguguuucauacuauguggcacgucacccgaggggcagugcuaacgcacaacggaaagaggcuggagccuaauugggcuagcgucaagaaggaucucauuucguauggcggcggguggcgccugucagcccaguggcaaaaaggagaagagguccaggugaucgcaguugaaccagguaagaaccccaagaauuuccagacaaugccuggcauuuuccagacuaccaugggggagaucggagcuauagcccuugacuuuaaaccgggcacaucugguaguccaaucauuaaccgggaagggaagguggucggauuauacggcaauggcgugguuaccaaaaacgggggauauguguccgguaucgcgcaaacuaaugccgagcccgauggcccuaccccagagcuggaagaggaaauguucaagaaaagaaaccucacaauuauggacuugcaucccgggagcggaaagacgaggaaguaccugccugcaaucguccgugaggcuauaaaacgccggcucagaacucugauucuugccccgaccagggugguagcugcagaaauggaggaggcccugaagggcuugcccauccgauaucagacaaccgccacuaaaucugaacacacaggucgggagaucguggaucuaaugugccaugcuaccuuuacgaugcgccugcucagcccaguuagagucccuaauuacaacuuagugauuauggacgaagcgcacuucacugaucccgcauccaucgccgcuaggggguauauaucaacacgggugggaaugggcgaggccgcagccauuuuuaugaccgcuaccccaccuggcacugcggaagccuucccccagaguaaugcaccaauccaggacgaggagcgagacauuccggaaagaagcuggaacucugggaaugaguggaucacagauuuugucggaaagaccguaugguucgugccuuccauaaaagcugguaacgacauugccaauugucugcgcaagaacggcaagaaaguuauccaacuuucaaggaagacauuugauacugaauaccagaaaacgcgucugaacgacugggauuucguggucaccacagacaucagugagaugggggcaaauuuuaaggccgaucgggugauugaccccagaaggugccucaaaccaguuaucuugacugauggacccgagcgcgugauucuggcuggcccuaugccagucaccgccgcgagcgcagcccagcgaagaggucggguggggaggaacccccagaaggaaaaugaccaauacauauucacaggccagccucucaacaaugaugaggaccaugcucacuggaccgaagccaagaugcugcuugacaacaucaauacuccggagggaauuaucccagcucuauucgaacccgagcgcgagaaauccgcagccaucgauggcgaauaucgucugaagggggagucuagaaaaacguuuguagaauugaugcggaggggagacuuaccuguguggcuggcucacaagguugccucggaggguauuaaauacaccgaucgcaaguggugcuucgacggcgaacgaaacaaucagauacucgaggagaacauggaugucgaaaucuggacaaaagagggggaaagaaagaagcugcggcccagguggcuugacgcacgcacuuauagcgauccacuggcgcucaaagaguuuaaggacuucgccgcuggaagaaaaucaauugccuuggaucuggugaccgaaaucggcagggugccuucccaucuagcacaccggacacguaaugcucuggacaaccucgucaugcuucauaccagugagcacggugggcgcgccuaccgacacgcaguugaggaacugcccgagacuauggaaacauuauugcugcucggccugaugauucuucugacgggaggcgccaugcucuuuuugaucucugggaagggaauagguaaaaccagcaucggccugauuugugugaucgcuuccucagggauguuauggauggcggauguaccacuacaguggauugccucugcaaucgugcuggaguucuuuaugaugguccuccuuauaccugagccggaaaagcaaagaacuccccaggacaaucagcuggcuuaugugguuauuggaaucuugacacuggccgccauuguggcagcuaacgagaugggccuccuggaaaccaccaagagggaucuugguaugagcaaagagccaggggucguaaguccuacauccuaccucgacguggaccugcaucccgccagcgcguggacuuuguaugcuguugccacgaccgugaucacaccaaugcugcggcacacuauagaaaauucuaccgcaaacgucucauuagccgcuaucgcaaaucaagccgugguccuaaugggccuggauaagggauggccuauuuccaaaauggaccucggcgugccccuucuggcguuggggugcuacagucagguuaacccgcugacacucaccgcugccgugcugcuuuuaguaacucauuacgcaaucauuggaccaggccugcaggccaaggcuacgcgcgaggcccagaaaagaacagcagcugguaucaugaagaacccuaccguggaugggauaaugacuauugaccucgaucccgucaucuaugacagcaaguucgagaaacaauugggacagguuaugcugcuagugcugugugccguccagcuccuucugaugaggaccucgugggcguugugcgaagcccugacacucgcaacuggcccaaucaccacacugugggaggguucucccggcaaguuuuggaauacgaccauugcuguguccauggccaacaucuuccgggggagcuacuuagcaggagcuggccuugccuuuucaauaaugaaaaguguagggacuggacgaagaggcacagguucucagggggaaacccugggagagaaguggaaaaagaagcucaaucaacuaucccgcaaagaguucgaucuguauaagaaaagcggcauuacugagguggacaggacagaggccaaggaagguuugaaacggggcgagaccacgcaccaugcgguuucacgugggagugcuaagcugcagugguuuguggaaagaaacauggucaucccugagggaagggugauugaucucggcugugggcgcggaggcuggagcuacuauugcgcaggucuuaaaaaggucaccgaagugcggggguacacaaagggaggcccgggccacgaggagcccguuccaauguccacuuauggguggaauaucguaaaacugaugucuggaaaggacguguucuacuugccucccgaaaaaugugauacccugcucugcgacauaggugagagcuccccuucaccaacagucgaagagucucgaacuaucagaguguuaaagaugguugagcccuggcugaggaacaaucaguucuguauuaaagugcuuaacccuuacaugccaaccgucaucgaacaccuggagcgccuacagcggaaguauggcgggaugcucgugagaaauccccugagucguaacucgacacaugaaauguacuggauuagcaauggaaccggcaacaucguauccucugugaauaugguuucaagguugcugcucaaccgguuuacuaugacgcaccgccgaccgacaauugagaaggaugucgaccuuggugccgggaccagacaugugaaugcugaaccugagacuccaaacauggacgugaucggagagaggauaaaacggauuaaggaagaacacagcuccaccuggcacuaugaugacgaaaaccccuacaaaacaugggccuaucauggcaguuacgaggucaaggcaacgggcucugccagcucaaugaucaaugggguugugaaacuguuaaccaagccuugggauguagugccaauggucacucaaauggcuaugacagacaccacucccuucggacagcagcgcguguuuaaggaaaaaguugauacaagaaccccgaggccuauggcggguacacgaaaggugauggagaucacugccgaguggcuguggcggaccuugggccguaacaaaaagcccagacucugcacgcgcgaagaguucaccaaaaaggucaggacaaaugcagcuaugggggccguguuuacugaagagaaccaaugggacuccgcacgggccgcuguagaagaugaggaguucuggaagcugguugacagagaacgcgagcuacacaaacuuggaaaguguggcaguugcguguauaauaugauggguaaaagggaaaagaaacugggggaguuuggaaaggccaaaggcagccgagcgauuugguacauguggcucggcgcacgguaccuggaguucgaagccuugggguuucugaacgaggaucauugguucucuagagaaaauuccuauucaggagucgagggugaaggccuccacaaacuuggguacauacugagggacaucagcaagauuccaggaggcgcuauguaugccgaugacaccgcagguugggacacacgcaucacugaggaugacuuacauaacgaggagaaaauuacccagcagauggauccugagcaccgucagcuggcuaaugccaucuuuaaguugacguaccaaaacaaaguggugaagguccagcggcccacaccaaaagggaccguuauggacauaaucucgagaaaggaucagaggggaucuggccaggugggcacuuaugggcucaauacauucaccaacauggaagcucaacugguacgccagauggagggagaaggugugcuaaguaaggccgaccuugagaauccccaucugcucgagaaaaagauuacucaguggcuggaaaccaaaggcgucgagcgauugaagcggauggcaaucuccggggaugacugcgugguuaaaccuauugaugacagauuugcgaacgccuuacuggcucucaaugauaugggaaaggugaggaaggacaucccacaguggcaaccgagcaaaggcuggcaugauuggcagcagguccccuucuguucacaccauuuccacgaacuuauaaugaaggacggucgcaaacuggugguaccuugcagaccacaggacgagcuaauugggcgggccaggaucucccaaggagcaggcuggucucugaaggaaacagcuugucucggcaaagccuacgcacagauguggagcuugauguauuuucaccgucgagaucugcgccuugccaguaacgcgaucugcuccgcuguucccgugcauuggauuccuacgagcagaaccacuuggucuauacacgcccaucaccaguggaugacaaccgaggacaugcugacugucuggaaccggguguggaucgaggauaauccauggauggaagacaagacacccguuaccacgugggaggaugugccuuaccucgggaagagggaagaccaaugguguggaucauuaauuggucugacaagucgcgcaaccugggcccagaacaucuugacugcuauucagcaggucagaucccugaucggcgaugaggaguuccucgacuacaugccgagcaugaaacgguuuaggaaggaagaggaaucugagggggccauaugguga

SEQ ID NO: 15210 - RNA, 9873 nt, Artificial Sequence
  derived and/or modified CDS sequence (opt3) from DENV-3__GU131934__SS-prME
accagccugugccucaugaugaugcuucccgcaacccuggcuuuccacuugacuuccagggacggagaaccuaggaugaucguggggaagaacgaacggggaaaaucuuuacuguuuaagacggcaucagguauuaauauguguacccuaauagccauggaucucggcgagaugugcgacgauacaguaacuuacaaauguccacugaucgcggaaguugagccggaagacauugauugcugguguaaccuuaccaguacaugggugaccuaugggacuugcaaucaggcuggagagcaccgccgagacaagcguagcguagcccuggcaccccacgugggcauggguuuggauacaagaacccagacguggauguccgccgagggggcuuggaggcaggucgaaaaaguggagacuugggcacuccggcauccuggauucaccauccuggcccuguuucucgcucacuacauuggcacaucuuuaacucagaagguugugaucuucauacugcuuauguuggucaccccaucgaugacaaugcgcugugugggcguagggaacagagacuuuguugaaggacugucaggugccaccuggaucgaugugguccuagagcauggcgggugcgugacgacuauggcaaagagcaaacccacacucgacauugagcugcagaagaccgaagcaacucagcuugccacacugaggaaauuguguaucgagggaaagauuaccaauaucacgaccgauagucggugcccuacacagggcgaagcuacucucccagaggaacaggaccagaacuauguguguaaacacaccuacgucgaucgcgguugggggaauggaugcggccuguucggcaagggguccuuaguuacaugcgccaaguuucaaugucuggagcccauagagggaaaagugguacaguaugaaaaccucaaguacacugugauuaucaccguccacacaggugaccagcaucaggugggcaaugacacccaagggguuacuguggagauuacgccucaggcaucuacagucgaagcugugcuuccagaguauggaacccugggcuuggaaugcagcccgcgaacuggucuagauuucaacgagaugauccugcucaccaugaaaaauaaggccuggaugguacacagacagugguuuuucgaccugccccuuccuuggacauccggggcgaccacugagacaccaacguggaacaggaaagaacuguugguuaccuuuaagaaugcccaugccaagaagcaagagguggucgugcucggcucacaggaaggagcuaugcacacugcccugacaggcgcuaccgagauccagaacagugggggaacaagcauuuucgccggucacuuaaagugucggcugaaaauggauaagcuagaacucaaaggcaugucuuacgcaaugugccugaauacuuuuguccuuaagaaagagguguccgagacccagcaugggacgauauugaucaagguugaauacaagggagaggacgcccccuguaaaauuccuuucucaaccgaagauggccaagguaaggcucacaacgggcgucugaucacagcgaacccagugguaacuaaaaaggaggagcccgucaauauagaagcagagccgccuuucggcgaaagcaacauugugaucggaaucggcgacaaagcccucaagauuaauugguauaagaaagggaguucuaucggaaagauguuugaggcuaccgcccgcggugcaagaaggauggccauucugggcgauacagcuugggacuucggguccguuggaggcgugcuuaacagccuggguaaaaugguccaucagauauuugggucggccuacacugcauuguucucuggcguguccuggaucaugaagauuggaaucggcguacuccugaccuggaucggguuaaauaguaaaaacacgucaaugagcuuuuccugcauugugauaggaguuaucacacuguaucuaggcgcggucgugcaggcugauauggguugugugauuaauuggaaggggaaggaacucaaaugcggaaacggcaucuucgucaccaaugagguucacacuuggacagagcaguacaaguuucaagccgacucucccaaacggcuggcaaccgccauugcuggugccugggaaaacggcgugugugggauccgaagcacuacccgcauggagaaucuuuuguggaagcagauagcaaacgaacugaauuauauccucugggagaacaauauuaaacugacagugguagucggagauaucauuggcguguuagaacaggggaagagaacgcugaccccacagccuauggagcuuaaauacucauggaagacuuggggaaaggcuaaaaucguuacagccgagaaccaaaacaguuccuucauaauugacggccccaauaccccagaaugccccagcgcgucuagggccuggaacgugugggaggucgaagacuaugguuuugggguguucacaacuaauaucugguugaagcuccgggagguuuacacccagucaugugaucaucgccugaugagugcugcaauuaaagacgaaagagccgugcacgcugauaugggauacuggaucgagagccagaagaacggcuccuggaaacuagagaaggccucuuuuauagaaguaaagacgugcacauggccuaaaucgcacacccuguggagcaaugguguccucgaguccgacaugaucauuccaaagucacuggcaggcccgaucagucagcauaaccacaggcccggguaucauacucaaaccgcgggaccuuggcaccuuggcaaauuggaacuggauuucaauuacugcgaggggacaacuguggugauugccgagaacuguggaacccguggcccaucuuuacggacaacgaccgucagcgguaagcucauccacgaauggugcugucgauccugcacucugcccccucuuagauauaugggggaggacggauguugguacggcauggaaauaaggccaauuaaugagaaagaagagaacaugguuaagucacuggugagcgcugguucuggcaagguagauaauuuuacaauggggguguugugccucgccauccuguucgaggaagucaugcgcggaaaauucggcaagaaacauaugaucgcaggggugcuauuuaccuucguucugcuccuguccggacagauuacuuggcgggacauggcucacacacuuaucaugauuggcaguaacgccagcgauagaauggguaugggggugaccuauuuggcacugauagccacguuuaagauccagcccuucuuagcucucggauuuuuccugaggaaacuuacuucucgcgagaaucugcuacucggcgucggccuggcgauggccaccacauugcaacugccggaagacauugagcagauggcaaacgggaucgcuuuaggacucaugacccugaaacuuauuacucaguuugaaacauaccagcuguggaccgccuuggugucccucacauguucaaauacuaucuucacccugacgguugccuggcgaacagcuacccuaauacuggcgggugugagucuucucccucugugccaaagcucguccaugcggaagacugauugguugccaaugaccgucgccgcgaugggcguacccccucugcccuuauuuaucuucucucucaaagacacaccaaagcguagaagcuggccucugaacgagggggugauggcuguuggacuugugucaauucuggccaguuccuugcucaggaacgauguccccauggcaggcccacugguggccggugggcuacugaucgcuuguuauguaauuacuggaaccucugcagaccuuacgguggagaaagccgcggacgucacaugggaagaggaagcugagcagaccggcguuagccauaaucucaugaucacuguggaugacgauggcacaaugcgcauaaaggacgaugaaaccgagaacauucugacuguguuguuaaaaacagcccugcucaucgucuccgggaucuuuccguacucaauuccugcaacccugcuuguguggcacacguggcagaagcagacucaacggagcggaguucugugggacguacccaguccacccgagacccagaaagccgaauuggaggaagguguguacagaauaaagcagcagggcaucuucgggaagacacaagucggagugggcguucagaaagaggguguguuucauaccauguggcacgucacaagaggggcugugcuaacucacaauggaaagcgacuggagccuaacugggccucugucaagaaggaucucauuuccuauggcggcggguggcgccugagcgcacaguggcaaaaaggagaagagguccaggugaucgcuguugaaccagguaagaaucccaagaacuuccagaccauuccuggcaucuuccagacgacaacuggggagauaggagccaucgcgcuugacuuuaaaccgggcaccucggguucaccaauuaucaaucgggaagggaagguggucggauuauacggcaacggcgugguuacuaagaaugggggauaugugucugguauugcccaaaccaacgcagagcccgauggcccuacuccagagcuggaagaggaaauguucaagaaaagaaaucucaccaucauggacuugcaucccgggaguggaaagacaaggaaguaccugccugcuauaguccgugaggccauuaaacgccggcucagaacgcugauccuugcuccgacuagggugguagcagccgaaauggaggaggcccugaagggcuugcccauccgauaucagaccacagcuaccaaauccgaacacacuggucgggagauuguggaucuaaugugccaugcgacauuuaccaugcgccugcucagcccaguuagagucccuaacuacaauuuagugaucauggacgaagcacacuucacggaucccgccucuauagcugccaggggguauauuagcacucgggugggaaugggcgaggcagccgcuaucuuuaugacagcgaccccaccuggcaccgccgaagcauucccccaguccaacgcuccaauucaggacgaggagcgagacaucccggaaagaucauggaauagugggaacgaguggauaacugauuuugucggaaagacaguaugguucgugccuagcauuaaagccgguaacgacaucgcaaauugucugcgcaagaacggcaagaaaguuauccaacuuucuaggaagaccuuugauacagaauaccagaaaacucgucugaaugacugggauuucguggucacgaccgacauuuccgagaugggggccaacuuuaaggcugaucgggugaucgaccccagaaggugccucaaaccaguuauuuugacagauggacccgagcgcgugauacuggccggcccuaugccagucacugcggcaucagccgcucagcgaagaggucggguggggaggaauccccagaaggaaaacgaccaauacaucuucaccggccagccucucaauaacgaugaggaccaugcccacuggacagaagcuaagaugcugcuugacaauauuaacaccccggagggaaucaucccagcacuauucgaacccgagcgcgagaaaagugccgcuauugauggcgaauaucgucugaagggggagagcagaaaaacuuuuguagaauugaugcggaggggagacuuaccuguguggcuggcccacaagguugcauccgaggguauaaaauacacggaucgcaaguggugcuucgacggcgaacgaaauaaccagauccucgaggagaauauggaugucgaaauuuggaccaaagagggggaaagaaagaagcugcggcccagguggcuugacgcgcgcacauauucugauccacuggcccucaaagaguuuaaggacuucgcugccggaagaaaaucgaucgcauuggaucuggugacugaaauuggcagggugccuagccaucuagcucaccggacccguaacgcccuggacaaucucgucaugcuucauacaucagagcacggugggcgcgcauaccgacacgccguugaggaacugcccgagaccauggaaacuuuauugcugcucggccugaugauccuucugacaggaggcgcuaugcucuuuuugauauccgggaagggaaucgguaaaacgaguauuggccugaucugugugauuguaucuagcgggauguuauggauggcggaugugccacuacaguggaucgccuccgcaauaguccuggaguucuuuaugauggugcuccuuauuccugagccggaaaagcaaagaacaccccaggacaaccagcuggcuuauguugugaucggaauuuugacucuggccgccaucgucgcagcuaaugagaugggccuccuggaaacaaccaagagggaucuugguaugucaaaagagccagggguagugucuccuaccagcuaccucgacguugaccugcaucccgccagugcguggacauuguaugcuguggccacuacggucauaaccccaaugcugcggcacacaaucgaaaacuccacugcaaacgugagcuuagccgcuauugcaaaucaagccgucgugcuaaugggccuggauaagggauggccuaucucuaaaauggaccucggcguuccccuucuggcguuggggugcuacucacaggugaacccgcugacccucacagcugccguacugcuuuuagugacccauuacgcaauuaucggaccaggccugcaggccaaggcuacucgcgaggcccagaaaagaacggcagcugguauaaugaagaauccuacagucgaugggauuaugaccaucgaccucgaucccguuaucuaugacuccaaguucgagaaacaauugggacaggugaugcugcuaguccugugugccgugcagcuccuucugaugaggacaaguugggcguugugcgaagcccugacccucgcaacaggcccaauuacuacccugugggaggguagccccggcaaguuuuggaacacaacgaucgcuguaucgauggccaauauauuccgggggucuuacuuagcaggagcuggccuugccuuuuccauuaugaaaagcguggggaccggacgaagaggcacugguucacagggggaaacacugggagagaaguggaaaaagaagcucaaccaacuaagucgcaaagaguucgaucuguauaagaaaucuggcaucaccgagguugacaggacugaggccaaggaagguuugaaacggggcgagacaacccaccaugcggugucccgugggagcgcuaagcugcagugguuugucgaaagaaauauggugauuccugagggaagggucaucgaucucggcugugggcgcggaggcuggucauacuauugcgcaggucuuaaaaaggugacggaaguucggggguacaccaagggaggcccgggccacgaggagcccguaccaaugaguacauauggguggaacauagugaaacugaugagcggaaaggacgucuucuacuugccucccgaaaaaugugauacucugcucugcgacaucggugaguccucuccuagcccaaccguggaagagucccgaacaauuagaguuuuaaagaugguggagcccuggcugaggaauaaccaguucuguaucaaaguccuuaauccuuacaugccaacugugauugaacaccuggagcgccuacagcggaaguauggcgggaugcucguaagaaacccccugucacguaauucuacccaugaaauguacuggaucaguaacggaacaggcaauauugugucgagcguuaacauggucuccagguugcugcucaaccgguuuaccaugacucaccgccgaccgacgaucgagaaggauguggaccuuggugccgggacaagacaugugaaugcugaaccugagaccccaaacauggacgucauaggagagaggauuaaacggaucaaggaagaacacucuucaacuuggcacuaugaugacgaaaaucccuacaaaaccugggccuaucauggcagcuacgagguuaaggcaacaggcuccgccaguucuaugaucaacggggugguaaaacuguuaacgaagccuugggauguggucccaauggugacccaaauggcuaugacugacacaacccccuucggacagcagcgcguuuuuaaggaaaaaguggauacuagaacaccgaggccuaugcccgguacccgaaaggucauggagauuacagcggaguggcuguggcggacuuugggccguaauaaaaagccaagacucugcacccgcgaagaguucacgaaaaaggugaggaccaacgccgcaaugggggcuguauuuacagaagagaaucaaugggacagcgcccgggcagccguugaagaugaggaguucuggaagcugguggacaaagaaagagagcuacacaaacuuggaaaauguggcucaugcgucuauaacaugauggguaagcgcgagaaaaagcugggggaguuuggaaaagcuaagggcuccagggccauaugguacauguggcucggcgcgcgauaccuggaguucgaagcauugggguuucugaaugaggaucauugguucagucgggaaaacagcuauucuggaguggagggugaaggccuccacaaacuuggguacauccugagagacauuuccaaaaucccuggaggcgccauguaugcugaugacacugccgguugggacaccaggauuacagaggaugacuuacauaaugaggaaaagaucacucagcagauggaucccgagcaccgccagcuggcaaacgcuauauuuaaauugaccuaccaaaauaagguggucaaaguucagcguccaacgcccaaggggacagugauggacaucauuucacggaaggaucagagaggaagcggccagguaggcaccuaugggcucaacacuuucacaaauauggaagcccaacuggugaggcagauggagggagaagguguccuaucgaaagcugaccuugagaacccucaucugcucgagaagaaaaucacccaguggcuggaaacuaagggcguggagcgcuugaaacgaauggccauuucuggggaugacugcguugugaagccaaucgaugaccgguuugcaaacgcguuacuggcccucaaugauaugggaaaggucagaaaagacauaccgcaguggcaacccaguaagggcuggcaugauuggcaacaggugccuuucuguucccaccauuuccacgaacuuauuaugaaagacgguaggaagcugguaguuccaugccgcccccaggacgagcuaaucgggagagcucggaucagccaaggagccggcuggucacugaaagaaaccgcaugucucggcaaggcuuacgcccagaugugguccuugauguauuuucacaggcgugaucugcgacuugcaucuaacgccauuugcagcgcggugccuguccauuggauaccaacaagucgcacgaccugguccauccacgcucaucaccaguggaugacuacagaggacaugcugaccguguggaauagaguuuggauugaggauaaccccuggauggaagacaagacuccugugacaaccugggaggaugucccguaccucgggaaacgggaagaccaaugguguggcagcuuaaucggucugacgucuagggccacaugggcacagaauauuuugaccgccauccaacaggugcgcucacugauaggcgaugaggaguuccucgacuacaugccaaguaugaagagauuucggaaagaagaggaaacugagggggcuaucugguga

SEQ ID NO: 15211 - RNA, 9873 nt, Artificial Sequence
  derived and/or modified CDS sequence (opt3) from DENV-3__GU131935__SS-prME
accagccugugccucaugaugaugcuucccgcaacucuggcuuuccacuugacuuccagggacggagaaccuaggaugaucguggggaagaacgaacggggaaaaucuuuacuguuuaagacggcaucagguauuaauauguguacccuaauagccauggaucucggcgagaugugcgacgauacugucacuuacaaauguccacugaucgcggaaguugagccggaagacauugauugcugguguaaccuuaccaguacuugggugaccuaugggacuugcaaucaggcuggagagcaccgccgagacaagcguagcgucgcccuggcaccccacgugggcauggguuuggauacaagaacccagacguggauguccgccgagggggcuuggaggcaggucgaaaaaguggagacuugggcacuccggcauccuggauucaccauccuggcccuguuucucgcucacuacauuggcacaucuuuaacucagaagguugugaucuucauacugcuuauguuggucaccccaucgaugacaaugcgcugugugggcguagggaacagagacuuuguugaaggacugucaggugccaccuggguggaugucgugcuagagcauggcgggugcgugacgacuauggcaaagagcaaacccacacucgacaucgagcugcagaagaccgaagcaacucagcuugccacacugaggaaauuguguauugagggaaagaucaccaauauuacgaccgauagucggugcccuacacagggcgaagcuacucucccagaggaacaggaccagaacuaugucuguaaacacaccuacguugaucgcgguugggggaauggaugcggccuguucggcaagggguccuuagugacaugcgccaaguuucaaugucuggagcccaucgagggaaaaguagugcaguaugaaaaccucaaguacacugucauaauuaccgugcacacaggugaccagcaucagguuggcaaugacacccaaggggugacugucgagaucacgccucaggcaucuacaguggaagcuguacuuccagaguauggaacccugggcuuggaaugcagcccgcgaacuggucuagauuucaacgagaugauucugcucaccaugaaaaauaaggccuggaugguucacagacagugguuuuucgaccugccccuuccuuggacauccggggcgaccacugagacaccaacguggaacaggaaagaacuguuggugaccuuuaagaaugcccaugccaagaagcaagaggucgugguccucggcucacaggaaggagcuaugcacacugcccugacaggcgcuaccgagauccagaacagugggggaacaagcaucuucgccggucacuuaaagugucggcugaaaauggauaagcuagaacucaaaggcaugucuuacgcaaugugccugaauacuuuugugcuuaagaaagagguuuccgagacccagcaugggacgauuuugauaaagguggaauacaagggagaggacgcccccuguaaaaucccuuucucaaccgaagauggccaagguaaggcucacaacgggcgucugauuacagcgaacccaguagucacuaaaaaggaggagcccgugaauaucgaagcagagccgccuuucggcgaaagcaacauaguuauuggaaucggcgacaaagcccucaagaucaauugguauaagaaagggaguucuauuggaaagauguuugaggcuaccgcccgcggugcaagaaggauggccauccugggcgauacagcuugggacuucggguccgugggaggcguccuuaacagccuggguaaaauggugcaucagauuuuugggucggccuacacugcauuguucucuggcguauccuggauaaugaagaucggaauuggcgugcuccugaccuggaucggguuaaauucaaagaacacgaguaugagcuuuuccugcaucguuauuggaauaaucacacuguaucuaggcgcggucgugcaggcugauauggguugugccauuaauuggaaggggaaggaacucaaaugcggaucuggcaucuucgugaccaacgagguccacacuuggacagagcaguacaaguuucaagcagacagccccaaacggcuggccaccgcuauugccggugcaugggaaaauggcguuugugggauccgaucaacuacccgcauggagaaccuuuuguggaagcagauagcuaaugaacugaacuauauccucugggagaauaacauuaaacugacaguggugguaggagauaucauuggcgucuuagaacaggggaagagaacgcugaccccacagccuauggagcuuaaauacaguuggaagacuuggggaaaggccaaaaucgugacagcggagacccaaaauuccagcuucauaauugacggccccaacacaccagaaugccccucugccucaagggcuuggaacguuugggagguggaagacuaugguuuuggggucuucacuaccaauaucugguugaagcuccgggagguguacacgcagaguugugaucaucgccugaugagcgcagccauuaaagacgaaagagcuguucacgccgauaugggauacuggaucgagucccagaagaacggcucuuggaaacuagagaaggcaucguuuauagaagugaagacaugcaccuggccuaaaagccacacucugugguccaaugguguacucgagucagacaugaucauuccaaagagucuggcgggcccgaucucucagcauaaccacaggcccggguaucauacccaaacagccggaccuuggcaccuuggcaaauuggaacuggauuucaauuacugcgaggggacuaccgucgugauuacagagaacuguggaacgcguggccccagcuuacggaccacuacaguguccgguaagcucauccacgaauggugcugucgaucaugcacccugcccccucuuagauauaugggggaggacggauguugguacggcauggaaauaaggccaauuaaugagaaagaagagaacauggucaagagccugguuucugcugguuccggcaagguggauaauuuuacuauggggguauugugccucgccauccuguucgaggaagugaugcgcggaaaauucggcaagaaacauaugaucgcagggguccuauuuacauucgugcugcuccugaguggacagauuaccuggcgggacauggcucacacgcuuaucaugauuggcagcaacgccucugauagaauggguauggggguuacuuauuuggcacugauagccaccuuuaagauccagcccuucuuagcucucggauuuuuccugaggaaacuuacaucccgcgagaaucugcuacucggcgugggccuggcgauggccaccacuuugcaacugccggaagacauugagcagauggcaaacgggaucgcuuuaggacucaugacacugaaacuuauuacccaguuugaaacauaccagcuguggacugccuuggucucacucaccuguaguaauacgaucuucacacugaccguggccuggcgaacugcuacccuaauacuggcggguguuagccuucucccucugugccaaucguccucuaugcggaagacagauugguugccaaugacuguggccgcgaugggcguaccaccucugcccuuauuuaucuucagccucaaagacaccccaaagcguagaucauggccucugaacgaggggguaauggcugugggacuuguuaguauucuggccuccucuuugcucaggaaugaugugcccauggcaggcccacuggucgccggugggcuacugaucgcuuguuaugugauuacgggaacaagcgcagaccuuaccguagagaaagccgcggacgugacuugggaagaggaagcugagcagacaggcgucucccauaaccucaugaucaccguugaugacgauggcacuaugcgcauaaaggacgaugaaacagagaacauucugaccguguuguuaaaaacggcccugcucaucgugucagggaucuuuccguacagcauuccugcaacucugcuugucuggcacaccuggcagaagcagacacaacggaguggagugcugugggacguucccucuccacccgagacccagaaagccgaauuggaggaagguguauacagaauaaagcagcagggcaucuucgggaagacacaagugggagucggcgugcagaaagaggguguuuuucauacuauguggcacgugaccagaggggcuguccuaacgcacaauggaaagcgacuggagccuaacugggccuccgugaaaaaggaucucauuagcuauggcggcggguggcgccugaaugcacaguggcaaaaaggagaagagguacaggucaucgcuguggaaccagguaagaaccccaagaauuuccagacaaugccuggcauuuuccagacuaccacaggggagaucggagccauagcgcuugacuuuaaaccgggcaccucggguucaccaaucauuaaccgggaagggaagguugugggauuauacggcaauggcgucgugacuaaaaacgggggauauguuucugguaucgcccaaaccaaugcagagcccgauggcccuacaccagagcuggaagaggaaauguucaagaaaagaaaccucacgauuauggacuugcaucccgggaguggaaagacuaggaaguaccugccugcuaucgugcgugaggccauaaaacgccggcucagaacccugauucuugcuccgacaagggucguggcagccgaaauggaggaggcccugaagggcuugcccauccgauaucagaccacugcuacaaaauccgaacacaccggucgggagaucguagaucuaaugugccaugcgacguuuacuaugcgccugcucagcccagugagaguuccuaauuacaacuuagucauuauggacgaagcacacuucacagaucccgccucuaucgcugccaggggguauauaagcacccgggugggaaugggcgaggcagccgcuauuuuuaugaccgcgacuccaccuggcacagccgaagcauucccccaguccaaugcuccaauccaggacgaggagcgagacauuccggaaagaucauggaacagugggaaugaguggaucaccgauuuugugggaaagacagucugguucguaccuagcauaaaagccgguaacgacauugcaaacugucugcgcaagaauggcaagaaagugauccaacuuucuaggaagacuuuugauacggaauaccagaaaacccgucugaacgacugggauuucguugugacaacugacaucuccgagaugggggccaauuuuaaggcugaucgggucauugaccccagaaggugccucaaaccagugaucuugaccgauggacccgagcgcguuauucuggccggcccuaugccagugacagcggcaucagccgcucagcgaagaggucgggucgggaggaacccccagaaggaaaaugaccaauacauauucaccggccagccucucaacaaugaugaggaccaugcccacuggacugaagcuaagaugcugcuugacaacaucaauacgccggagggaauuaucccagcacuauucgaacccgagcgcgagaaaagugccgcuaucgauggcgaauaucgucugaagggggagagcagaaaaaccuuuguggaauugaugcggaggggagacuuaccuguauggcuggcccacaagguggcauccgaggguauuaaauacacagaucgcaaguggugcuucgacggcgaacgaaacaaucagauacucgaggagaacauggauguugaaaucuggacuaaagagggggaaagaaagaagcugcggcccagguggcuugacgcgcgcaccuauucugauccacuggcccucaaagaguuuaaggacuucgcugccggaagaaaaucgauugcauuggaucuggucacagaaaucggcagggugccuagccaucuagcucaccggacccguaaugcccuggacaaccucgugaugcuucauacuucagagcacggugggcgcgcauaccgacacgccgucgaggaacugcccgagacaauggaaacguuauugcugcucggccugaugauucuucugaccggaggcguuaugcucuuuuugaucuccgggaagggaauagguaaaacaaguaucggccugauuugugugaucguaucuagcgggauguuauggauggcugaugugccacuacaguggauugcguccgccaucguccuggaguucuuuaugauggugcuccuuauaccugagccggaaaagcaaagaacaccccaggacaaucagcuggcauauguugugauuggaaucuugacccuggcugccauugucgccgcaaacgagaugggccuccuggaaaccacaaagagggaucuugguaugucaaaagagccagggguagugucuccuacuagcuaccucgacguugaccugcaucccgcuagugccuggacguuguaugcgguggcuaccacagucaucacuccaaugcugcggcacaccauagaaaauuccacagccaacgugagcuuagcagccaucgcuaaccaagcagucgugcuaaugggccuggauaagggauggccuauuucuaaaauggaccucggcguuccccuucuggccuuggggugcuacucacaggugaauccgcugacccucacugcggcuguacugcuuuuagugacgcauuacgccaucauuggaccaggccugcaggcaaaggccacacgcgaggcucagaaaagaaccgccgcagguaucaugaagaacccuacugucgaugggauaaugaccauugaccucgaucccguuaucuaugacuccaaguucgagaaacaauugggacaggugaugcugcuaguccuguguacagugcagcuccuucugaugaggacaaguugggcuuugugcgaagcccugacccucgcgacaggcccaaucacgacccugugggaggguagccccggcaaguuuuggaauacuacaauugccguaucgauggcaaacaucuuccgggggucuuacuuagcuggagccggccuugcauuuuccauaaugaaaagcguggggaccggacgaagaggcacugguucacagggggaaacacugggagagaaguggaaaaagaagcucaaucaacuaagucgcaaagaguucgaucuguauaagaaaucuggcauuaccgagguugacaggacggaggcuaaggaagguuugaaacggggcgagaccacacaccaugccgugucccgugggagcgccaagcugcagugguuugucgaaagaaacauggugaucccugagggaagggucauugaucucggcugugggcgcggaggcuggucauacuauugcgcgggucuuaaaaaggugacugaaguucggggguacaccaagggaggcccgggccacgaggagcccguaccaaugaguacauauggguggaauaucgugaaacugaugagcggaaaggacgucuucuacuugccucccgaaaaaugugauacucugcucugcgacauaggugaguccucuccuagcccaaccguggaagagucccgaacaaucagaguuuuaaagaugguggagcccuggcugaggaacaaucaguucuguauuaaaguccuuaacccuuacaugccaaccgugaucgaacaccuggagcgccuacagcggaaguauggcgggaugcucguaagaaauccccugucacguaacucuacucaugaaauguacuggauuaguaauggaacgggcaacaucgugucgagcguuaauauggucuccagguugcugcucaaccgguuuacaaugacccaccgccgaccgacuauugagaaggauguggaccuuggugcugggaccagacaugugaacgcagaaccugagacaccaaauauggacgucaucggagagaggauaaaacggauuaaggaagaacacucuucaacguggcacuaugaugacgaaaaccccuacaaaaccugggccuaucauggcagcuacgagguuaaggcuacuggcuccgccaguucuaugaucaauggggugguaaaacuguuaacaaagccuugggauguggucccaauggugacccaaauggcaaugacugacacaacccccuucggacagcagcgcguuuuuaaggaaaaaguggauacaagaacuccgaggccuaugcccgguacccgaaaggucauggagaucacggccgaguggcuguggcggaccuugggccguaacaaaaagccaagacucugcacacgcgaagaguucacuaaaaaggugaggaccaaugcugcgaugggggccguauuuacagaagagaaccaaugggacagcgcacgggcugccguugaagaugaggaguucuggaagcugguggacagagaacgcgagcuacacaaacuuggaaaguguggcucaugcgucuauaauaugauggguaaaagggaaaagaaacugggggaguuuggaaaggcaaaaggcucccgagccauuugguacauguggcucggcgcucgguaccuggaguucgaagccuugggguuucugaacgaggaucauugguucaguagagaaaauagcuauucuggaguggagggugaaggccuccacaaacuuggguacauacugagggacaucuccaagauuccuggaggcgcgauguaugcagaugacacugccgguugggacacccgcaucacggaggaugacuuacauaacgaggagaaaauuacacagcagauggaucccgagcaccgucagcuggcuaaugccaucuuuaaguugaccuaccaaaacaaaguggucaagguucagcggccaacucccaaagggacagugauggacauaaucucaagaaaggaucagaggggaagcggccagguaggcaccuaugggcucaauacuuucaccaacauggaagcacaacuggugcgccagauggagggagaagguguccuaucgaaggcugaccuugagaauccucaucugcucgagaaaaagauuacacaguggcuggaaacgaaaggcguggagcgauugaagcggauggccaucucuggggaugacugcguugugaaaccaauugaugacagauuugcuaacgccuuacuggcacucaacgauaugggaaaggucaggaaggacaucccgcaguggcaacccaguaaaggcuggcaugauuggcaacaggugccuuucuguucccaccauuuccacgaacuuauaaugaaggacggucgcaaacugguaguuccaugcagaccccaggacgagcuaauugggcgggcgaggaucagccaaggagccggcuggucacugaaggaaaccgcuugucucggcaaagccuacgcacagaugugguccuugauguauuuucaccgucgagaucugcgccuugcuucuaaugccaucugcagcgcagugccuguccauuggauuccaacaaguagaacaaccugguccauacacgcccaucaccaguggaugacuacagaggacaugcugaccguguggaaccggguuuggaucgaggauaaucccuggauggaagacaagacgccugugacaaccugggaggaugucccguaccucgggaagagggaagaccaaugguguggcagcuuaauuggucugacuucucgcgcgaccugggcucagaacaucuugacagccauucaacaggugagaucacugaucggcaaugaggaguuccucgauuacaugccaaguaugaaacgguuuaggaaggaagaggaauccgagggggcaauaugguga

SEQ ID NO: 15212 - RNA, 9873 nt, Artificial Sequence
  derived and/or modified CDS sequence (opt3) from DENV-3__GU131936__SS-prME
accagccugugccucaugaugaugcuucccgccacacuggcuuuccacuugacuuccagagacggcgagccuaggaugaucguggggaagaacgaacggggaaaaucuuuacuguuuaagacggcaucagguauuaauauguguacccuaauagccauggaucucggcgagaugugcgacgauacagucacuuacaaauguccacugaucgcggaaguugagccggaagacauugauugcugguguaaccuuaccaguacaugggugaccuaugggacuugcaaucaggcuggagagcaucgccgagacaagcguagcguagcccuggcaccccacgugggcauggguuuggauacaagaacccaaacguggauguccgccgagggggcuuggaggcaggucgaaaaaguggagacuugggcacuccggcauccuggauucaccauccuggcccuguuucucgcucacuacauuggcacaucuuuaacucagaagguugugaucuucauacugcuuauguuggucaccccaucgaugacaaugcgcugugugggcguagggaacagagacuuuguugaaggacugucaggugccaccuggguggaugucgugcuagagcauggcgggugcgugacgacuauggcgaagagcaaacccacacucgacaucgagcugcagaagaccgaagcaacucaacuugccacacugaggaaauuguguauugagggaaagaucaccaauauuacgaccgauagucggugcccuacacagggcgaagcuacucucccagaggaacaggaccagaacuaugucuguaaacacaccuacguugaucgcgguugggggaauggaugcggccuguucggcaagggguccuuagugacaugcgccaaguuucaaugucuggagucuaucgagggaaaaguagugcaguaugaaaaccucaaguacacugucauaauuaccgugcacacaggugaccagcaucagguuggcaaugacacccaaggggugacugucgagaucacgccccaggcaagcacaguggaagcuguacuuccugaguauggaacccugggcuuggaaugcuccccacgaacuggucuagauuucaacgagaugauucugcucaccaugaaaaauaaggccuggaugguucacagacagugguuuuucgaccugccgcuucccuggacaucaggggcgaccacugagacaccuacguggaacaggaaagaacuguuggugaccuuuaagaaugcccaugcaaaaaagcaagaggucgugguccucggcagucaggaaggagcuaugcacacugcccugacaggcgcuaccgagauccagaacagcgggggaacaucuaucuucgccggucacuuaaagugucggcugaaaauggauaagcuagaacucaaaggcauguccuacgcaaugugccugaauacuuuugugcuuaagaaagagguuucagagacccagcaugggacgauuuugauaaagguggaauacaagggagaggacgccccauguaaaauccccuucagcaccgaagauggccaagguaaggcucacaacgggcgucugauuacagcgaacccuguagucacuaaaaaggaggagccagugaauaucgaagcagagcccccguucggcgaaaguaacauaguuauuggaaucggcgacaaagcccucaagaucaauugguauaagaaagggucuuccauuggaaagauguuugaggcuaccgcccgcggugcaagaaggauggccauccugggcgauacagcuugggacuucgggagcgugggaggcguccuuaacucgcuggguaaaauggugcaucagauuuuugggucugccuacacugcauuguucuccggcguaucauggauaaugaagaucggaauuggcgugcuccugaccuggaucggguuaaauaguaaaaacacgagcauguccuuuucuugcaucguuauuggaauaaucacacuguaucuaggcgcggucgugcaggcugauauggguugugugauuaauuggaaggggaaggaacucaaaugcggaaacggcaucuucgucaccaaugagguucacacuuggacagagcaguacaaguuucaagccgacagcccuaaacggcuggcaaccgccauugcuggugccugggaaaacggcgugugugggauccgaucaacuacccgcauggagaaucuuuuguggaagcagauagcaaacgaacugaauuauauccucugggagaacaauauuaaacugacagugguagucggagauaucauuggcguguuagaacaggggaagagagcucugacgccccagccaauggagcuuaaauacaguuggaagaccuggggaaaggccaaaaucguuacugcggagacacaaaacuccagcuucauaauugacggcccuaacacccccgaaugcccaucugccucaagggcuuggaaugugugggaggucgaagacuaugguuuugggguguucacaacuaacaucugguugaagcuccgggagguuuacacccagaguugugaucaucgccugaugagcgcagccauuaaagacgaaagagcugugcacgccgauaugggauacuggaucgagucccagaagaauggcucuuggaaacuagagaaggcaucguuuauagaaguaaagacgugcacauggcccaaaagccacacccugugguccaacgguguccucgagucagacaugaucauuccuaagagucuggcgggcccaaucucucagcauaaucacaggccgggguaucauacucaaaccgccggacccuggcaccuuggcaaauuggaacuggauuucaacuacugcgaggggacaacuguggugauugcugagaauuguggaacccguggcccuagcuuacggacaacgaccgucuccgguaagcucauccacgaauggugcugucgaucaugcacucugccaccccuuagauauaugggggaggacggauguugguacggcauggaaauaaggccuauuaacgagaaagaagagaauaugguuaagagccuggugucugccgguuccggcaagguagauaacuuuacaauggggguguugugccucgcaauccuguucgaggaagucaugcgcggaaaauucggcaagaaacauaugaucgcuggggugcuauuuaccuucguucugcuccugaguggacagauuacuuggcgggacauggcccacacacuuaucaugauuggcagcaaugcaucugauagaauggguaugggggugaccuauuuggcccugauagcuacguuuaagauccagccauucuuagcgcucggauuuuuccugaggaaacuuacuucccgcgagaaccugcuacucggcgucggccuggccauggcaaccacauugcaacugcccgaagacauugagcagauggcuaaugggaucgccuuaggacucaugacccugaagcuuauuacucaguuugaaacauaccagcuguggaccgccuuggugucacucacauguaguaacacuaucuucacccugacgguugcuuggcgaacagcaacccuaauacuggccggugugagccuucucccgcugugccaaucguccucuaugcggaagacugauugguugccuaugaccgucgcggcuaugggcguaccaccccugccuuuauuuaucuucagccucaaagacacacccaagcguagaucauggccacugaaugagggggugauggccguuggacuugugaguauucuggcauccucuuugcucaggaacgaugucccuauggccggcccccugguggcuggugggcuacugaucgcauguuauguaauuacuggaaccagcgccgaccuuacgguggagaaagcggcugacgucacaugggaagaggaagccgagcagaccggcguuucccauaaccucaugaucacuguggaugacgauggcacaaugaagauaaaagacgaugaaaccgagaauauucugacuguguuguuaaagacagcacugcucaucgucucagggaucuuuccauacagcauuccggccacccugcuuguguggcacacguggcagaaacagacucaacgcaguggaguucugugggacguaccuucucccccagagacccagaaggcugaauuggaggaagguguguaccggauaaagcagcagggcaucuucgggaaaacacaagucggagugggcguucagaaggaggguguguuucauaccauguggcacgucacaagaggggccgugcuaacucacaacggaaaaaggcuggagcccaauugggcauccguaaagaaagaucucauuagcuauggcggcggguggcgacugucggcucaguggcaaaagggagaagagguccaggugaucgccguugaaccugguaagaacccaaaaaauuuccagaccaugcccggcauuuuccagacgacaacuggggagaucggagcgauagcccuugacuuuaagccuggcaccucagguucuccgaucauuaaccgcgaagggaaaguggucggauuauacggcaauggcgugguuacaaagaacgggggauaugugagugguaucgcacaaaccaaugcugagccagauggccccacuccugagcuggaagaggaaauguucaaaaagcggaaccucaccauuauggacuugcauccaggguccggaaagacaagaaaauaccugcccgccaucgucagggaggcuauaaagcgucgccuccggacgcugauucuugcaccuacuagagugguagccgccgaaauggaggaggcucugaaaggcuugccgaucagguaucagaccacagcgaccaagagcgaacacacuggucgagagaucguggaucuaaugugccaugcaacauuuaccaugcggcugcucucucccguucgcgucccaaauuacaacuuagugauuauggacgaagcccacuucacggauccugcuagcaucgccgcaagaggguauauauccacuagggugggaaugggcgaggccgcugcgauuuuuaugacagccacccccccaggcaccgcagaagcuuucccucagucaaaugcccccauccaggacgaggagcgggacauuccagaacgaaguuggaacagcgggaaugaguggaucacugauuuugucggaaaaacaguaugguucgugccgucuauaaaggcagguaacgacauugccaacugucugagaaagaauggcaaaaagguuauccaacuuucccgcaaaaccuuugauacagaauaccagaagacuaggcugaacgacugggauuucguggucacgaccgacaucucagagaugggggcuaauuuuaaagccgaucgugugauugacccucggagaugccucaagcccguuaucuugacagauggaccagagagggugauucuggcgggccccaugccugucacugcagccagugcugcccagcgccgagguagaguggggcggaacccacagaaggaaaaugaccaauacauauucaugggccagccccucaacaaugaugaggaccaugcucacuggaccgaagcaaaaaugcugcuugacaacaucaauacaccugagggaauuaucccggcccuauucgaaccagagagggagaagagcgcugccaucgauggcgaauaucgccugaaaggggagucccguaagaccuuuguagaauugaugagacggggagacuuacccguguggcuggcacacaaaguugcgucugaggguauuaaguacacugauaggaaauggugcuucgacggcgaacgcaacaaucagauacucgaggagaacauggaugucgaaaucuggacgaaggagggggaacgaaagaaacugagaccucgguggcuugacgccaggaccuauucggauccccuggcucucaaggaguuuaaagacuucgccgcaggacgcaagagcauugcuuuggaucuggugacagaaaucggcagagugccaucacaucuagcccacaggacucggaaugcacuggacaaccucgucaugcuucauaccuccgagcacggugggcgugccuaccgccacgcuguugaggaacugccugagacaauggaaaccuuauugcugcucggccugaugauucuucugacuggaggcgcgaugcucuuuuugaucagugggaaaggaauagguaagacaucuaucggccugauuugugugaucguaagcuccgggauguuauggauggccgaugugccccuacaguggauugcaucagcuaucguccuggaguucuuuaugauggugcuccuuauaccagagccugaaaagcaacgaacgccgcaggacaaucagcuggccuauguugugauuggaaucuugacccuggccgcaauugucgcugccaacgagaugggccuccuggaaacuacaaaaagagaucuugguaugucuaaggagcccgggguagugagcccaaccaguuaccucgacguugaccugcauccugcguccgcuuggaccuuguaugccguggcaacaacugucaucacgcccaugcugaggcacaccauagaaaauagcacagccaacgugucuuuagcugcaaucgccaaccaagcggucgugcuaaugggccuggauaaaggauggccaauuucaaagauggaccucggcguuccucuucuggcuuuggggugcuacucccaggugaauccccugacucucaccgccgcaguacugcuuuuagugacacauuacgccaucauuggaccgggccugcaggcuaaagccacccgggaggcacagaagcgcacugcugccgguaucaugaagaacccaacggucgaugggauaaugacaauugaccucgauccuguuaucuaugacaguaaauucgagaagcaauugggacaggugaugcugcuaguccugugugcggugcagcuccuucugaugagaaccagcugggccuugugcgaagcacugacucucgcuaccggccccaucacaacucugugggaggguucgccaggcaaauuuuggaauaccacaauugccguaucuauggcaaacaucuucaggggguccuacuuagcuggagccggccuugccuuuagcauaaugaagucaguggggacgggacggcgaggcaccgguagucagggggaaacucugggagagaaauggaagaagaaacucaaucaacuaucuagaaaggaauucgaucuguauaaaaaguccggcauuacagagguugaccgcaccgaggcgaaagaagguuugaagaggggcgagacuacacaccaugcugugagccgggggucagcaaaacugcagugguuugucgaacguaacauggugauccccgagggaagagucauugaucucggcugugggaggggaggcuggaguuacuauugcgccggucuuaagaaggugaccgaaguucgcggguacacgaaaggaggcccuggccacgaggagccgguacccaugagcaccuauggguggaauaucgugaagcugauguccggaaaagacgucuucuacuugccaccugaaaagugugauacacugcucugcgacauaggugagucuagccccuccccuacuguggaagagucacggaccauccgaguuuuaaaaaugguggagccauggcugagaucuaaccaguucuguauuaagguccuuaaucccuacaugccuacagugaucgaacaccuggagaggcuacagcgcaaguauggcgggaugcucguacggaacccacugaguagaaauucgacucaugaaauguacuggauuagcaacggaaccggcaauaucguguccucuguuaacauggucucacguuugcugcucaauagguuuacaaugacccaccggcgccccacuauugagaaagauguggaccuuggugcugggacgcgacaugugaacgccgaaccggagacaccuaacauggacgucaucggagagagaauaaagaggauuaaagaagagcacagcuccaccuggcacuaugaugacgaaaauccauacaagacuugggcauaucauggcaguuacgagguuaaagccaccggcucugcuagcucaaugaucaacggggugguaaagcuguuaacaaagcccugggauguggucccuauggugacgcaaauggcgaugaccgacacuacaccauucggacagcagcggguuuuuaaagaaaagguggauacccgcacucccagaccgaugccugguacaaggaaagucauggagaucaccgccgaguggcuguggcgaacauugggccggaauaagaaaccccgucucugcacuagagaagaguucaccaagaaggugcgcacgaacgcagcuaugggggccguauuuaccgaagagaaucaaugggacuccgcaagggccgcuguugaagaugaggaguucuggaaacugguggacaaggaacgggagcuacacaaacuuggaaaguguggcaguugcgucuauaacaugauggguaaaagagaaaagaaacugggggaguuuggaaaggccaagggcagccgcgcgauuugguacauguggcucggcgcaagguaccuggaguucgaagccuugggguuucugaaugaggaucauugguucucucgagaaaacuccuauucaggaguggagggugaaggccuccacaaacuuggguacauacugcgggacaucagcaagauuccaggaggcgcuauguaugccgaugacacagcagguugggacacuagaaucaccgaggaugacuuacauaaugaggaaaaaauuacacagcagauggauccugagcacaggcagcuggcuaacgccaucuuuaaguugacuuaccaaaauaaaguggucaagguucagcgccccaccccaaaggggacggugauggacauaaucucgcguaaagaucagcggggaucuggccagguaggcacauaugggcucaacaccuucacuaauauggaagcucaacuggugagacagauggagggagaagguguccuaaguaaggccgaccuugagaacccccaccugcucgagaaaaagauuacacaguggcuggaaaccaaaggcguggagagguugaagcgcauggcaaucuccggggaugacugcguugugaagccuauugaugaccgauuugcgaaugccuuacuggcucucaacgauaugggaaaaguccggaaggacaucccacaguggcaaccgagcaaaggcuggcaugauuggcagcaggugcccuucuguucacaccauuuccacgaacuuauaaugaaggacgguagaaaacugguaguuccuugcaggccacaggacgagcuaauugggcgcgccagaaucucccaaggagcaggcuggucucugaaggaaacugcuugucucggcaaggccuacgcacagauguggagcuugauguauuuucaccggagggaucugcgucuugccaguaacgcgaucugcuccgcugugcccguccauuggauuccuaccagccgaacaacguggucuauacacgcccaucaccaguggaugaccacugaggacaugcugacaguguggaaucgcguuuggaucgaggauaacccauggauggaagacaaaacccccgugacuacaugggaggaugucccuuaccucgggaagagagaagaccaaugguguggaucauuaauuggucugaccagucgggcaacgugggcccagaauaucuugacagcuauucagcaggugaggucccugaucggcgaugaggaguuccucgacuacaugccgagcaugaaacgcuuuagaaaggaagaggaaaccgagggggccauaugguga

SEQ ID NO: 15213 - RNA, 9873 nt, Artificial Sequence
  derived and/or modified CDS sequence (opt3) from DENV-3__GU131937__SS-prME
accagccugugccucaugaugaugcuucccgcaacucuggcuuuccacuugacuuccagggacggagaaccuaggaugaucguggggaagaacgaacggggaaaaucuuuacuguuuaagacggcaucagguauuaauauguguacccuaauagccauggaucucggcgagaugugcgacgauaccgucacuuacaaauguccacugaucgcggaaguugagccggaagacauugauugcugguguaaccuuaccaguacaugggugaccuaugggacuugcaaucaggcuggagagcaucgccgagacaagcguagcguagcccuggcaccccacgugggcauggguuuggauacaagaacccagacguggauguccgccgagggggcuuggaggcaggucgaaaaaguggagacuugggcacuccggcauccuggauucaccauccuggcccuguuucucgcucacuacauuggcacaucuuuaacucagaagguugugaucuucauacugcuuauguuggucaccccaucgaugacaaugcgcugugugggcguagggaacagagacuuuguugaaggacugucaggugccaccuggguggaugucgugcuagagcauggcgggugcgugacgacuauggcaaagagcaaacccacacucgacaucgagcugcagaagaccgaagcaacucagcuugccacacugaggaaauuguguauugagggaaagaucaccaauauuacgaccgauagucggugcccuacacagggcgaagcuacucucccagaggaacaggaccagaacuaugucuguaaacacaccuacguugaucgcgguugggggaauggaugcggccuguucggcaagggguccuuagugacaugcgccaaguuucaaugucuggagcccaucgagggaaaaguagugcaguaugaaaaccucaaguacacugucauaauuaccgugcacacaggugaccagcaucagguuggcaaugacacccaaggggugacugucgagaucacgccucaggcaucuacaguggaagcuguacuuccagaguauggaacccugggcuuggaaugcagcccgcgaacuggucuagauuucaacgagaugauucugcucaccaugaaaaauaaggccuggaugguucacagacagugguuuuucgaccugccccuuccuuggacauccggggcgaccacugagacaccaacguggaacaggaaagaacuguuggugaccuuuaagaaugcccaugccaagaagcaagaggucgugguccucggcucacaggaaggagcuaugcacacugcccugacaggcgcuaccgagauccagaacagugggggaacaagcaucuucgccggucacuuaaagugucggcugaaaauggauaagcuagaacucaaaggcaugucuuacgcaaugugccugaauacuuuugugcuuaagaaagagguuuccgagacccagcaugggacgauuuugauaaagguggaauacaagggagaggacgcccccuguaaaaucccuuucucaaccgaagauggccaagguaaggcucacaacgggcgucugauuacagcgaacccaguagucacuaaaaaggaggagcccgugaauaucgaagcagagccgccuuucggcgaaagcaacauaguuauuggaaucggcgacaaagcccucaagaucaauugguauaagaaagggaguucuauuggaaagauguuugaggcuaccgcccgcggugcaagaaggauggccauccugggcgauacagcuugggacuucggguccgugggaggcguccuuaacagccuggguaaaauggugcaucagauuuuugggucggccuacacugcauuguucucuggcguauccuggauaaugaagaucggaauuggcgugcuccugaccuggaucggguuaaauaguaaaaacacgucaaugagcuuuuccugcaucguuauuggaauaaucacacuguaucuaggcgcggucgugcaggcugauauggguugugugauuaauuggaaggggaaggaacucaaaugcggaucuggcaucuucgucaccaacgagguucacacuuggacagagcaguacaaguuucaagccgacagccccaaacggcuggcaaccgccauugcuggugccugggaaaauggcgugugugggauccgaucaacuacccgcauggagaaccuuuuguggaagcagauagcaaaugaacugaacuauauccucugggagaauaacauuaaacugacagugguagucggagauaucauuggcguguuagaacaggggaagagaacgcugaccccacagccuauggagcuuaaauacaguuggaagacuuggggaaaggcuaaaaucguuacagccgagacccaaaauuccagcuucauaauugacggccccaacacaccagaaugccccucuacuuugagggcguggaacgugugggaggucgaagacuaugguuuugggguguucaccacgaauaucuggcucaagcugcgggagguuuacacacagucaugugaucaucgccuaaugagugccgcuauuaaagacgaaagagcagugcacgccgauaugggauacuggaucgagagccagaagaacggcuccuggaaacuggagaaggcuucuuuuauagaaguaaagaccugcacuuggccuaaaucgcacacccucuggagcaaugguguccuggaguccgacaugaucauuccaaagucacuugccggcccgaucagucagcauaacuauaggcccggguaccacacacaaacugcaggaccuuggcauuugggcaaacuggaauuagauuucaauuauugcgaggggaccacaguggugauuacggagaacuguggaacccguggcccaucucuccggacuacaaccgucagcgguaagcugauccacgaauggugcugucgauccugcacucuucccccucugagauacaugggggaggacggauguugguauggcauggaaauaaggccaauuaaugagaaagaagagaacaugguuaagucauuggugagcgcggguucuggcaagguagauaauuuuacaaugggggugcucugccuggccauccuauucgaggaagucaugcgcggaaaauucggcaagaaacacaugaucgcuggggugcuguuuaccuucguucuccugcuuuccggacagauuacguggcgggacauggcccauacuuugaucaugauuggcaguaacgcaagcgauagaauggguaugggggugaccuaccuggcuuuaauagccacauuuaagauccagcccuuccucgcacugggauuuuuccuuaggaaacugaccucucgcgagaaucuacuccugggcgucggcuuggccauggcuacuacacugcaauuaccggaagacauugagcagauggcgaacgggaucgcccucggacugaugacccuuaagcugauuacacaguuugaaacuuaucaguuguggaccgcacucgugucccugacguguucaaauacaaucuucacccuaacuguugcuuggcgaaccgccacacugauacuugccggugugagucuccugccuuugugccaaagcucguccaugcggaagacugauuggcugccaaugaccgucgcugcaaugggcguacccccuuuaccccucuuuaucuucucucugaaagacacgccaaagcguagaagcuggccucuuaacgagggggugauggccguuggacuggugucaauuuuggcgaguucccuccugaggaaugauguccccauggcuggcccgcuaguagccggugggcugcuuaucgcauguuacguaauuacaggaaccucugccgaccucacuguggagaaagcugcagacgucacaugggaagaggaagccgagcagaccggcguuagccacaaccugaugaucacuguggaugacgauggcacaaugcgcauaaaggacgaugaaaccgagaacauuuugacgguguuacugaaaacugcgcuccugaucgucuccgggaucuuuccauacucaauuccugcuacccuucugguguggcauacauggcagaagcagacccaacggagcggaguuuugugggacguacccaguccacccgagacacagaaagccgaacuagaggaagguguguauagaauaaagcagcagggcaucuucgggaagacucaagucggagugggcguucagaaagaggguguguuucacaccauguggcaugucacgagaggggcggugcugacacacaauggaaagcgacucgagccuaacugggccucugugaagaaggaucugauuuccuacggcggcggguggcgccuuagcgcucaguggcaaaaaggagaagagguccaggugaucgccguugaaccagguaagaaucccaagaacuuccagacuaugccuggcauuuuccagaccacaaccggggagaucggagcaauagcuuuagacuuuaaaccgggcacuucggguucaccaaucauuaaucgggaagggaagguggucggacuguauggcaacggcgugguuaccaaaaaugggggauacgugucugguaucgcccaaacaaacgcggagcccgauggcccuacgccagagcucgaagaggaaauguucaagaaaagaaauuugacuauuauggaccugcaccccgggaguggaaagaccaggaaguaucucccugccaucguccgugaggcaauaaaacgccggcugagaacacuuauucuggcuccgaccagggugguagccgcugaaauggaggaggcauugaagggccuacccauccgauaccagacuacagccaccaaauccgaacauacgggucgggagaucguggaucugaugugccacgccacuuuuacaaugcgccucuuaagcccaguuagagucccuaacuauaaucuggugauuauggacgaagcucauuucaccgaucccgcgucuaucgcagccaggggguacauaagcacccgggugggaaugggcgaggcugccgcaauuuuuaugacugccacaccaccuggcaccgcugaagcguucccccaguccaacgccccaauccaggacgaggagcgagacauuccggaaagaucauggaauagugggaacgaguggaucacagauuuugucggaaagacuguaugguucgugccuagcauaaaagcagguaaugacauugcuaacugucuucgcaagaacggcaagaaaguuauccaacugucuaggaagacguuugauaccgaauaccagaaaacacgucucaaugacugggauuucguggucacuaccgacaucuccgagaugggggccaacuuuaaggcagaucgggugauugaccccagaaggugcuugaaaccaguuauccugacagauggacccgagcgcgugauucucgccggcccuaugccagucaccgcugccucagcggcacagcgaagaggucggguggggaggaauccccagaaggaaaacgaccaauauauauucacuggccagccucugaauaacgaugaggaccacgcccauuggacggaagcuaagaugcuucuagacaauaucaacaccccggagggaauuaucccagcccuguucgaacccgagcgcgagaaaagugcugcaaucgauggcgaauaccguuugaagggggagagcagaaaaacauuuguagaauuaaugcggaggggagaccugccuguguggcucgcccacaagguugcuuccgaggguauuaaauauacugaucgcaaguggugcuucgacggcgaacgaaauaaccagauacuggaggagaauauggaugucgaaaucuggaccaaagagggggaaagaaagaaacuucggcccagguggcuggacgcccgcacauacucugauccacucgcauugaaagaguuuaaggacuucgcggccggaagaaaaucgauugcucuggaucuagugaccgaaaucggcagggugccuagccaccuggcccaucggacucguaacgcacucgacaaucuugucaugcugcacacaucagagcauggugggcgcgcuuaucgacacgccguugaggaauuacccgagacgauggaaaccuugcugcuccugggccuuaugauuucccugacuggaggcgcaaugcucuuuuugaucagugggaagggaauagguaaaacaucuaucggccugauuugugugaucguaagcuccgggauguuauggauggccgaugugccacuacaguggauugcuucagcgaucguccuggaguucuuuaugauggugcuccuuauaccugagccggaaaagcaaagaacaccccaggacaaccagcuggccuacguugugauuggaaucuugacccuggcagcuauugucgccgccaaugagaugggccuccuggaaacaacuaagagggaucuugguaugucuaaagagccagggguagugagcccuacgaguuaucucgacguugaccugcaccccgcauccgcuuggaccuuguacgccguggcgacaacugucaucaccccaaugcugcggcauacaauagaaaacagcaccgcuaaugugucuuuagccgcaaucgccaaccaagcugucgugcuaaugggccuggauaagggauggccuauuucaaaaauggaccucggcguuccccuucuggcauuggggugcuacucccaggugaacccgcugacucucacggccgcgguacugcuuuuagugacacacuaugcuaucauuggaccaggccugcaggccaaggcaacccgcgaggcccagaaaagaacugcugccgguaucaugaagaauccuaccgucgaugggauaaugacaauugaccucgaucccguuaucuacgacaguaaguucgagaaacaauugggacaggugaugcugcuaguccugugugcagugcagcuccuucugaugaggacuagcugggcuuugugcgaagcccugacccucgcgacaggcccaaucacgacccugugggaggguucgcccggcaaguuuuggaacacuacaauugccguaucuauggcaaauaucuuccggggguccuauuuagcuggagccggccuugcauuuagcauaaugaaaucaguggggaccggacgaagaggcacugguagucagggggaaacacugggagagaaguggaaaaagaagcucaaccaacuaucucgcaaagaguucgaucuguacaagaaauccggcauuaccgagguugacaggacggaggcuaaggaagguuugaaacggggcgagaccacacaucacgccgugagccgugggucagccaagcugcagugguuugucgaaagaaauauggugaucccugagggaagggucauugaucucggcugugggcgcggaggcuggaguuauuacugcgcgggucuuaaaaaggugacugaaguucggggguauaccaagggaggcccgggccaugaggagcccguaccaaugagcacauacggguggaacaucgugaaacugauguccggaaaggacgucuucuacuugccucccgaaaaaugugauacucugcucugcgacauaggugagucuagcccuuccccaaccguggaagagaaucgaacaaucagaguuuuaaagaugguggagcccuggcugaggaacaaucaguucuguauuaaaguccuuaacccuuauaugccaaccgugaucgaacaccuggagcgccuacagcggaaguacggcgggaugcucguaagaaauccccugucacguaacucuacucacgaaauguauuggauuaguaauggaacgggcaacaucgugucgagcguuaauauggucuccagguugcugcucaaccgguuuacaaugacccaucgccgaccgacuauugagaaggauguggaccuuggugcugggaccagacacgugaacgcagaaccugagacaccaaauauggacgucaucggagagaggauaaaacggauuaaggaagaacacucuucaacguggcacuacgaugacgaaaaccccuauaaaaccugggccuaccacggcagcuaugagguuaaggcuacuggcuccgccaguucuaugaucaauggggugguaaaacuguuaacaaagccuugggauguggucccaauggugacccaaauggcaaugacugacacaacccccuucggacagcagcgcguuuuuaaggaaaaaguggauacaagaacuccgaggccuaugcccgguacccgaaaggucauggagaucacggccgaguggcuguggcggaccuugggccguaacaaaaagccaagacucugcacacgcgaagaguucacuaaaaaggugaggaccaaugcugcgaugggggccguauuuacagaagagaaccaaugggacagcgcacgggcugccguugaagaugaggaguucuggaagcugguggacagagaacgcgagcuacauaaacuuggaaaguguggcucaugcgucuacaauaugauggguaaaagggaaaagaaacugggggaguuuggaaaggcaaaaggcucccgagccauuugguacauguggcucggcgcucgguaucuggaguucgaagccuugggguuucugaacgaggaucacugguucaguagagaaaauagcuacucuggaguggagggugaaggccuccauaaacuuggguauauacugagggacaucuccaagauuccuggaggcgcgauguacgcagaugacacugccgguugggacacccgcaucacggaggaugacuuacacaacgaggagaaaauuacacagcagauggaucccgagcaucgucagcuggcuaaugccaucuuuaaguugaccuaucaaaacaaaguggucaagguucagcggccaacucccaaagggacagugauggacauaaucucaagaaaggaucagaggggaagcggccagguaggcaccuacgggcucaauacuuucaccaacauggaagcacaacuggugcgccagauggagggagaagguguccuaucgaaggcugaccuugagaauccucaucugcucgagaaaaagauuacacaguggcuggaaacgaaaggcguggagcgauugaagcggauggccaucucuggggaugacugcguugugaaaccaauugaugacagauuugcuaacgccuuacuggcacucaacgauaugggaaaggucaggaaggacaucccgcaguggcaacccaguaaaggcuggcacgauuggcaacaggugccuuucuguucccaucacuuccaugaacuuauaaugaaggacggucgcaaacugguaguuccaugcagaccccaggacgagcuaauugggcgggcgaggaucagccaaggagccggcuggucacugaaggaaaccgcuugucucggcaaagccuaugcacagaugugguccuugauguacuuucaccgucgagaucugcgccuugcuucuaaugccaucugcagcgcagugccuguccacuggauuccaacaaguagaacaaccugguccauacaugcccaccaucaguggaugacuacagaggacaugcugaccguguggaaccggguuuggaucgaggauaaucccuggauggaagacaagacgccugugacaaccugggaggaugucccguaccucgggaagagggaagaccaaugguguggcagcuuaauuggucugacuucucgcgcgaccugggcucagaacaucuugacagccauucaacaggugagaucacugaucggcgaugaggaguuccucgacuauaugccaaguaugaaacgguuuaggaaggaagaggaauccgagggggcaauaugguga

SEQ ID NO: 15214 - RNA, 9873 nt, Artificial Sequence
  derived and/or modified CDS sequence (opt3) from DENV-3__GU131938__SS-prME
accagccugugccucaugaugaugcuucccgcaacccuggcuuuccacuugacuucccgggacggcgaaccuaggaugaucguggggaagaacgaacggggaaaaucuuuacuguuuaagacggcgucagguauuaauauguguacccuaauagccauggaucucggcgaaaugugcgacgauacagucacuuacaaauguccacugaucgcggaaguugagccggaagacauugauugcugguguaaccuuaccaguacaugggugaccuaugggacuugcaaucaggcuggagagcaccgccgagacaagcguagcguagcccuggcaccccacgugggcauggguuuggauacaagaacccagacguggauguccgccgagggggcuuggaggcaggucgaaaaaguggagacuugggcacuccggcauccuggauucaccauccuggcccuguuucucgcucacuacauuggcacaucuuuaacucagaagguugugaucuucauacugcuuauguuggucaccccaucgaugacaaugcgcugugugggcguagggaacagggacuuuguugaaggacugucaggugccaccuggguggaugucgugcuagagcauggcgggugcgugacgacuauggcaaagagcaaacccacacucgacaucgagcugcagaagaccgaagcaacucagcuugccacacugaggaaauuguguauugagggaaagaucaccaauauuacgaccgauagucggugcccuacacagggcgaagcuacucucccagaggaacaggaccagaacuaugucuguaaacacaccuacguugaucgcgguugggggaauggaugcggccuguucggcaagggguccuuagugacaugcgccaaguuucaaugucuggagucuaucgagggaaaaguagugcaguaugaaaaccucaaguacacugucauaauuaccgugcacacaggugaccagcaucagguuggcaaugacacccaaggggugacugucgagaucacgccccaggcaagcacaguggaagcuguacuuccugaguauggaacccugggcuuggaaugcuccccacgaacuggucuagauuucaacgagaugauucugcucaccaugaaaaauaaggccuggaugguucacagacagugguuuuucgaccugccgcuucccuggacaucaggggcgaccacugagacaccuacguggaacaggaaagaacuguuggugaccuuuaagaaugcccaugccaagaagcaagaggucgugguccucggcagucaggaaggagcuaugcacacugcccugacaggcgcuaccgagauccagaacagcgggggaacaucuaucuucgccggucacuuaaagugucggcugaaaauggauaagcuagaacucaaaggcauguccuacgcaaugugccugaauacuuuugugcuuaagaaagagguuucagagacccagcaugggacgauuuugauaaagguggaauacaagggagaggacgccccauguaaaauccccuucagcaccgaagauggccaagguaaggcucacaacgggcgucugauuacagcgaacccuguagucacuaaaaaggaggagccagugaauaucgaagcagagcccccguucggcgaaaguaacauaguuauuggaaucggcgacaaagcccucaagaucaauugguauaagaaagggucuuccauuggaaagauguuugaggcuaccgcccgcggugcaagaaggauggccauccugggcgauacagcuugggacuucgggagcgugggaggcguccuuaacucgcuggguaaaauggugcaucagauuuuugggucugccuacacugcauuguucuccggcguaucauggauaaugaagaucggaauuggcgugcuccugaccuggaucggguuaaauaguaaaaacacgagcauguccuuuucuugcaucguuauuggaauaaucacacuguaucuaggcgcggucgugcaggcugauauggguugugugauuaauuggaaggggaaggaacucaaaugcggaaacggcaucuucgucaccaaugagguucacacuuggacagagcaguacaaguuucaagccgacagcccuaaacggcuggcaaccgccauugcuggugccugggaaaacggcgugugugggauccgaucaacuacccgcauggagaaucuuuuguggaagcagauagcaaacgaacugaauuauauccucugggagaacaauauuaaacugacagugguagucggagauaucauuggcguguuagaacaggggaagagagcucugacgccccagccaauggagcuuaaauacaguuggaagaccuggggaaaggccaaaaucguuacugcggagacacaaaacuccagcuucauaauugacggcccuaacacccccgaaugcccaucugccucaagggcuuggaaugugugggaggucgaagacuaugguuuugggguguucacaacuaacaucugguugaagcuccgggagguuuacacccagaguugugaucaucgccugaugagcgcagccauuaaagacgaaagagcugugcacgccgauaugggauacuggaucgagucccagaagaauggcucuuggaaacuagagaaggcaucguuuauagaaguaaagacgugcacauggcccaaaagccacacccugugguccaacgguguccucgagucagacaugaucauuccuaagagucuggcgggcccaaucucucagcauaaucacaggccgggguaucauacucaaaccgccggacccuggcaccuuggcaaauuggaacuggauuucaacuacugcgaggggacaacuguggugauugcugagaauuguggaacccguggcccuagcuuacggacaacgaccgucuccgguaagcucauccacgaauggugcugucgaucaugcacucugccaccccuuagauauaugggggaggacggauguugguacggcauggaaauaaggccuauuaacgagaaagaagagaauaugguuaagagccuggugucugccgguuccggcaagguagauaacuuuacaauggggguguugugccucgcaauccuguucgaggaagucaugcgcggaaaauucggcaagaaacauaugaucgcuggggugcuauuuaccuucguucugcuccugaguggacagauuacuuggcgggacauggcccacacacuuaucaugauuggcagcaaugcaucugauagaauggguaugggggugaccuauuuggcccugauagcuacguuuaagauccagccauucuuagcgcucggauuuuuccugaggaaacuuacuucccgcgagaaccugcuacucggcgucggccuggccauggcaaccacauugcaacugcccgaagacauugagcagauggcuaaugggaucgccuuaggacucaugacccugaaacuuauuacucaguuugaaacauaccagcuguggaccgccuuggugucacucacauguaguaacacuaucuucacccugacgguugcuuggcgaacagcaacccuaauacuggccggugugagccuucucccgcugugccaaucguccucuaugcggaagacugauugguugccuaugaccgucgcggcuaugggcguaccaccccugccuuuauuuaucuucagccucaaagacacacccaagcguagaucauggccacugaaugagggggugauggccguuggacuugugaguauucuggcauccucuuugcucaggaacgaugucccuauggccggcccccugguggcuggugggcuacugaucgcauguuauguaauuacuggaaccagcgccgaccuuacgguggagaaagcggcugacgucacaugggaagaggaagccgagcagaccggcguuucccauaaccucaugaucacuguggaugacgauggcacaaugaagauaaaagacgaugaaaccgagaauauucugacuguguuguuaaagacagcacugcucaucgucucagggaucuuuccauacagcauuccggccacccugcuuguguggcacacguggcagaaacagacucaacgcaguggaguucugugggacguaccuucucccccagagacccagaaggcugaauuggaggaagguguguaccggauaaagcagcagggcaucuucgggaaaacacaagucggagugggcguucagaaggaggguguguuucauaccauguggcacgucacaagaggggccgugcuaacucacaacggaaaaaggcuggagcccaauugggcauccguaaagaaagaucucauuagcuauggcggcggguggcgacugucggcucaguggcaaaagggagaagagguccaggugaucgccguugaaccugguaagaaccccaaaaauuuccagaccaugcccggcauuuuccagacgacaacuggggagaucggagcgauagcccuugacuuuaagccuggcaccucagguucuccgaucauuaaccgcgaagggaaaguggucggauuauacggcaauggcgugguuacaaagaacgggggauaugugagugguaucgcacaaaccaaugcugagccagauggccccacuccugagcuggaagaggaaauguucaaaaagcggaaccucaccauuauggacuugcauccaggguccggaaagacaagaaaauaccugcccgccaucgucagggaggcuauaaagcgucgccuccggacgcugauucuugcaccuacuagagugguagccgccgaaauggaggaggcucugaaaggcuugccgaucagguaucagaccacagcgaccaagagcgaacacacuggucgagagaucguggaucuaaugugccaugcaacauuuaccaugcggcugcucucucccguucgcgucccaaauuacaacuuagugauuauggacgaagcccacuucacggauccugcuagcaucgccgcaagaggguauauauccacuagggugggaaugggcgaggccgcugcgauuuuuaugacagccacaccaccaggcaccgcagaggcuuucccucagucaaaugcccccauccaggacgaggagcgggacauuccagaacgaaguuggaacagcgggaaugaguggaucacugauuuugucggaaaaacaguaugguucgugccgucuauaaaggcagguaacgacauugccaacugucugagaaagaauggcaaaaagguuauccaacuuucccgcaaaaccuuugauacagaauaccagaagacuaggcugaacgacugggauuucguggucacgaccgacaucucagagaugggggcuaauuuuaaagccgaucgugugauugacccucggagaugccucaagcccguuaucuugacagauggaccagagagggugauucuggcgggccccaugccugucacugcagccagugcugcccagcgccgagguagaguggggcggaacccacagaaggaaaaugaccaauacauauucaugggccagccccucaacaaugaugaggaccaugcucacuggaccgaagcaaaaaugcugcuugacaacaucaauacaccugaggccauuaucccggcucuauucgaaccagagagggaaaagagcgccgcaaucgauggagaauaucgccugaaaggcgagucccguaagaccuuuguagaauugaugagaagaggggacuuacccguguggcuggcgcacaaaguugccucugagggaauuaaguacacugauaggaaauggugcuucgacggugaacgcaacaaucagauacucgaggagaacauggaugucgaaaucuggacgaaggagggcgaacgaaagaaacugagaccucgguggcuugacgcuaggaccuauucggauccccuggcccucaaggaguuuaaagacuucgcagcugggcgcaagagcauugccuuggaucuggugacagaaaucggaagagugccaucacaucuagcacacaggacucggaaugcccuggacaaccucgucaugcuucauaccuccgagcacggcggucgugcuuaccgccacgcgguugaggaacugccugagacaauggaaaccuuauugcugcucgggcugaugauucuucugacuggcggagccaugcucuuuuugaucaguggcaaagggauaggaaagacaucuaucggucugauuugugugaucguaagcuccggcauguuauggauggcagaugugccccuacaguggauugcuucagccaucguccuggaguucuuuaugauggugcuccuuauaccagagccugaaaagcaacgaacgccgcaggacaaucagcuggccuauguugugauugggaucuugacccuggcagcuauugucgccgcgaacgagaugggacuccuggaaacuacaaaaagagaucuuggcaugucuaaggagcccgguguagugagcccaaccaguuaccucgacguugaccugcauccugcuuccgccuggaccuuguaugcaguggccacaacugucaucacgcccaugcugaggcacaccauagaaaauagcacagcuaacgugucuuuagcagccaucgcgaaccaagcugucgugcuaauggggcuggauaaaggcuggccaauuucaaagauggaccucggaguuccucuucuggccuugggcugcuacucccaggugaauccccugacucucaccgcagccguacugcuuuuagugacacauuacgcuaucauugggccgggacugcaggccaaagcaacccgggaggcucagaagcgcacugccgcgggcaucaugaagaacccaacggucgaugguauaaugacaauugaccucgauccuguuaucuaugacaguaaauucgagaagcaauugggacaggugaugcugcuaguccugugugccgugcagcuccuucugaugagaaccagcugggcauugugcgaagcucugacucucgccaccggacccaucacaacucugugggagggcucgccagguaaauuuuggaauaccacaauugcaguaucuauggcuaacaucuucaggggcuccuacuuagccggggccggacuugcguuuagcauaaugaagucagugggcacggggcggcgaggaaccggcagucagggugaaacucugggggagaaauggaagaagaaacucaaucaacuaucuagaaaggaguucgaucuguauaaaaaguccggaauuacagagguugaccgcaccgaggcuaaagaaggcuugaagaggggugagacuacacaccaugcagugagccggggcucagccaaacugcagugguuugucgaacguaacauggugauccccgaggggagagucauugaucucggauguggcagaggcggguggaguuacuauugcgcugggcuuaagaaggugaccgaaguucgcgguuacacgaaagggggaccuggccacgaggagccgguacccaugagcaccuauggcuggaauaucgugaagcugauguccgggaaagacgucuucuacuugccaccugaaaagugugauacacugcucugcgacauaggagagucuagccccuccccuacuguggaagagucacggaccauccgaguuuuaaaaaugguggagccauggcugagaucuaaccaguucuguauuaagguccuuaaucccuacaugccuacagugaucgaacaccuggagaggcuacagcgcaaguaugguggcaugcucguacggaacccacugaguagaaauucgacucaugaaauguacuggauuagcaacgggaccggaaauaucguguccucuguuaacauggucucacguuugcugcucaauagguuuacaaugacccaccggcgccccacuauugagaaagauguggaccuuggcgccgguacgcgacaugugaacgcagaaccggagacaccuaacauggacgucaucggggagagaauaaagaggauuaaagaagaacacagcuccaccuggcacuaugaugacgaaaauccauacaagacuugggccuaucauggaaguuacgagguuaaagcuaccggcucugcgagcucaaugaucaacggcgugguaaagcuguuaacaaagcccugggauguggucccuauggugacgcaaauggccaugaccgacacuacaccauucgggcagcagcggguuuuuaaagaaaagguggauacccgcacucccagaccgaugccuggaacaaggaaagucauggagaucaccgcagaguggcuguggcgaacauugggucggaauaagaaaccccgucucugcacuagagaagaguucaccaagaaggugcgcacgaacgcugccaugggcgcaguauuuaccgaagagaaucaaugggacuccgccagggcugccguugaagaugaggaguucuggaaacugguggacaaggaacgggagcuacacaaacuugggaaguguggaaguugcgucuauaacaugaugggcaaaagagaaaagaaacugggugaguuugggaaggcgaagggaagccgcgcaauuugguacauguggcucggcgccagguaccuggaguucgaggcuuugggcuuucugaaugaggaucauugguucucucgagaaaacuccuauucagggguggagggagaaggucuccacaaacuuggcuacauacugcgggacaucagcaagauuccagggggagccauguaugcagaugacacagcuggcugggacacuagaaucaccgaggaugacuuacauaaugaggagaaaauuacacagcagauggauccugagcacaggcagcuggccaacgcuaucuuuaaguugacuuaccaaaauaaaguggucaagguucagcgccccaccccaaaggguacggugauggacauaaucucgcguaaagaucagcgggggucuggacagguaggcacauauggccucaacaccuucacuaauauggaagcccaacuggugagacagauggagggggaaggaguccuaaguaaggcagaccuugagaacccccaucugcucgagaaaaagauuacacaguggcuggaaaccaaagguguggagagguugaagcgcauggcgaucuccggcgaugacugcguugugaagccuauugaugaccgauuugccaaugcuuuacuggcccucaacgauauggggaaaguccggaaggacaucccacaguggcaaccgagcaaaggauggcaugauuggcaacaggugcccuucuguucacaccauuuccacgaacuuauaaugaaggacggcagaaaacugguaguuccuugcaggccacaggacgagcuaauuggucgcgcaagaaucucccaaggggcuggauggucucugaaggaaacugccugucucggcaaggcauacgcccagauguggagcuugauguauuuucaccggagggaucugcgucuugcgaguaacgcuaucugcuccgccgugcccguccauuggauuccuaccagccgaacaacguggucuauacacgcacaucaccaguggaugaccacugaggacaugcugacaguguggaaucgcguuuggaucgaggauaacccauggauggaagacaaaacccccgugacuacaugggaggaugucccuuaccucggcaagagagaagaccaauggugugggucauuaauuggacugaccagucgggccacgugggcucagaauaucuugacagccauucaacaggugaggucccugaucggugaugaggaguuccucgacuacaugccgagcaugaaacgcuuuagaaaggaagaggaaaccgagggcgcaauaugguga

SEQ ID NO: 15215 - RNA, 9873 nt, Artificial Sequence
  derived and/or modified CDS sequence (opt3) from DENV-3__GU131939__SS-prME
accagccugugccucaugaugaugcuucccgcaacacuggcuuuccacuugacuuccagagacggagaaccuaggaugaucguggggaagaacgaacggggaaaaucuuuacuguuuaagacggcaucagguauuaauauguguacccuaauagcaauggaucucggcgaaaugugcgacgauacagucacuuacaaauguccacugaucgcggaaguugaaccggaagacauugauugcugguguaaccuuaccaguacaugggugaccuaugggacuugcaaucaggcuggagagcaccgccgagacaagcguagcgucgcccuggcaccccacgugggcauggguuuggauacaagaacccagacguggauguccgccgagggggcuuggaggcaggucgaaaaaguggagacuugggcacuccggcauccuggauucaccauccuggcccuguuucucgcucacuacauuggcacaucuuuaacucagaagguugugaucuucauacugcuuauguuggucaccccaucgaugacaaugcgcugugugggcguagggaacagagacuuuguugaaggacugucaggugccaccuggguggaugucgugcuagagcauggcgggugcgugacgacuauggcgaaaagcaaacccacacucgacaucgagcugcagaagaccgaagcaacucagcuugccacacugaggaaauuguguauugagggaaagaucaccaauauuacgaccgauagucggugcccuacacagggcgaagcuacucucccagaggaacaggaccagaacuaugucuguaaacacaccuacguugaucgcgguugggggaauggaugcggccuguucggcaagggguccuuagugacaugcgccaaguuucaaugucuggagcccaucgagggaaaaguagugcaguaugaaaaccucaaguacacugucauaauuaccgugcacacaggugaccagcaucagguuggcaaugacacccaaggggugacugucgagaucacgccucaggcaucuacaguggaagcuguacuuccagaguauggaacccugggcuuggaaugcagcccgcgaacuggucuagauuucaacgagaugauucugcucaccaugaaaaauaaggccuggaugguucacagacagugguuuuucgaccugccccuuccuuggacauccggggcgaccacugagacaccaacguggaacaggaaagaacuguuggugaccuuuaagaaugcccaugccaagaagcaagaggucgugguccucggcucacaggaaggagcuaugcacacugcccugacaggcgcuaccgagauccagaacagugggggaacaagcaucuucgccggucacuuaaagugucggcugaaaauggauaagcuagaacucaaaggcaugucuuacgcaaugugccugaauacuuuugugcuuaagaaagagguuuccgagacccagcaugggacgauuuugauaaagguggaauacaagggagaggacgcccccuguaaaaucccuuucucaaccgaagauggccaagguaaggcucacaacgggcgucugauuacagcgaacccaguagucacuaaaaaggaggagcccaucaauauagaagcagagccgccuuucggcgaaagcaacauugugaucggaaucggcgacaaagcccucaagauuaauugguauaagaaagggaguucuaucggaaagauguuugaggcuaccgcccgcggugcaagaaggauggccauucugggcgauacagcuugggacuucggguccguuggaggcgugcuuaacagccuggguaaaaugguccaucagauauuugggucggccuacacugcauuguucucuggcguguccuggaucaugaagauuggaaucggcguacuccugaccuggaucggguuaaauaguaaaaacacgucaaugagcuuuuccugcauugugauaggaaucauuacacuguaucuaggcgcgguuguccaggcugauauggguugugugaucaauuggaaggggaaggaacucaaaugcggaaacggcauuuucgugaccaaugagguccacacuuggacagagcaguacaaguuucaagccgacucucccaaacggcuggcaaccgccaucgcuggugccugggaaaacggcguuugugggauacgaagcacuacccgcauggagaaucuuuuguggaagcagaucgcaaacgaacugaauuauauucucugggagaacaauaucaaacugacaguggugguaggagauauuaucggcgucuuagaacaggggaagagaacgcugaccccacagccuauggagcuuaaauacucauggaagacuuggggaaaggcuaaaauagugacagccgagacccaaaacaguuccuucauuaucgacggccccaacacaccagaaugccccagcgcgucuagggccuggaauguuugggagguggaagacuaugguuuuggggucuucacuaccaacauuugguugaagcuccgggagguguacacgcagucaugugaucaucgccugaugagugcugcaaucaaagacgaaagagccguucacgcugauaugggauacuggauagagagccagaagaauggcuccuggaaacuagagaaggccucuuuuaucgaagugaagacaugcaccuggccuaaaucgcacacucuguggagcaacgguguacucgaguccgacaugauuaucccaaagucacuggcaggcccgauuagucagcauaaucacaggcccggguaucauacccaaacagcgggaccuuggcaccuuggcaaauuggaacuggauuucaacuacugcgaggggacuaccgucgugaucgccgagaauuguggaacacguggcccaucuuuacggacgaccacugugagcgguaagcucauacacgaauggugcugucgauccugcacacugcccccucuuagauauaugggggaggacggauguugguacggcauggaaauuaggccaaucaacgagaaagaagagaauauggucaagucacugguuagcgcugguucuggcaagguggauaacuuuaccauggggguauugugccucgccauccuguucgaggaagugaugcgcggaaaauucggcaagaaacauaugauugcagggguccuauuuacuuucgugcugcuccuguccggacagaucacauggcgggacauggcucacacccuuauuaugauaggcaguaaugccagcgauagaauggguauggggguuacguauuuggcacugaucgccacuuuuaagauucagcccuucuuagcucucggauuuuuccugaggaaacuuaccucucgcgagaaccugcuacucggcgugggccuggcgauggccacaaccuugcaacugccggaagacaucgagcagauggcaaaugggauugcuuuaggacucaugacucugaaacuuaucacacaguuugaaaccuaccagcuguggacagccuuggucucccucacuuguucaaacaccauauucacgcugacaguggccuggcgaaccgcuacucuaauccuggccgguguuagucuucucccucugugccaaagcucguccaugcggaagaccgauugguugccaaugacaguggccgcgaugggcguacccccucugcccuuauuuauuuucucucucaaagacacuccaaagcguaaaagcuggccucugaaugaggggguaauggcugugggacuuguuucaauccuggccaguuccuugcucagaaacgaugugcccauggcaggcccacuggucgccggugggcuacugauugcuuguuaugugaucaccggaacgucugcagaccuuacaguagagaaggccgcggacgugaccugggaagaggaagcugagcagacuggcgucagccauaaccucaugauaacaguugaugacgauggcaccaugaggauuaaagacgaugaaacugagaauauccugacaguguuguuaaagaccgcccugcucaucguguccgggauuuuuccguacucaauaccugcaacgcugcuugucuggcacacuuggcagaaacagacccaacgcagcggagugcugugggacguucccaguccacccgagacacagaaggccgaauuggaggaagguguauaccggaucaagcagcagggcauuuucgggaaaacccaagugggagucggcgugcagaaggaggguguuuuucauacaauguggcacgugacuagaggggcuguccuaacccacaacggaaaaaggcuggagccuaauugggccucugugaagaaagaucucaucuccuauggcggcggguggcgacugagcgcacaguggcaaaagggagaagagguacaggucauugcuguggaaccagguaagaaccccaaaaauuuccagacgaugccuggcaucuuccagacaacuaccggggagauaggagccaucgcgcuugacuuuaagccgggcacaucggguucaccaauuaucaaccgcgaagggaaaguugugggauuauacggcaauggcgucgugaccaagaacgggggauauguuucugguauugcccaaacuaaugcagagcccgauggcccuaccccagagcuggaagaggaaauguucaaaaagcggaaccucacaaucauggacuugcaucccgggaguggaaagacgagaaaauaccugccugcuauagugagggaggccauuaagcgucgccuccggacucugauccuugcuccgaccagagucguggcagccgaaauggaggaggcccugaaaggcuugcccaucagguaucagacaaccgcuacuaaguccgaacacacaggucgagagauuguagaucuaaugugccaugcgaccuuuacgaugcggcugcucagcccagugcgcguuccuaauuacaacuuaaucauaauggacgaagcacacuucacugaucccgccucuauugcugccagaggguauaucagcacaagggucggaaugggcgaggcagccgcuauuuuuaugaccgcgaccccaccuggcacugccgaagcauucccccaguccaaugcuccaauccaggacgaggagcgggacauaccggaacgaucauggaacagugggaaugaguggauuacagauuuugugggaaaaaccgugugguucgucccuagcaucaaggccgguaacgacaucgcaaacugucugagaaagaauggcaaacgcguaauucaacuuucuaggaagacauuugauacugaauaccagaaaacgcgucugaacgacugggauuucgugguuaccacagacaucuccgagaugggggccaauuuuaaggcugaucgggugauugaccccagaaggugccucaaaccagucauauugacugauggacccgagcgcgugauccuggccggcccuaugccaguuaccgcggcaucagccgcucagcgaagaggucggguggggaggaacccccagaaggaaaaugaccaauacauuuucacaggccagccucucaacaaugaugaggaccaugcccacuggaccgaagcuaagaugcugcuugacaacaucaauacuccggagggaaucauuccagcacuauucgaacccgagcgcgagaaaagugccgcuauagauggcgaauaucgucugaagggggagagcagaaaaacguuugucgaauugaugcggaggggagacuuaccuguguggcuggcccacaagguagcauccgaggguaucaaauacaccgaucgcaaguggugcuucgacggcgaacgaaacaaucagauucucgaggagaacauggauguggaaaucuggacaaaagagggggaaagaaagaagcugcggcccagguggcuugacgcgcgcacuuauucugauccacuggcccucaaagaguuuaaggacuucgcugccggaagaaaaucgauugcauuggaucugguuaccgaaaucggcagggucccuagccaucuagcucaccggacacguaaugcccuggacaaccucgugaugcuucauaccucagagcacggugggcgcgcauaccgacacgccguggaggaacugcccgagacuauggaaacauuauugcugcucggccugaugauacuucugacgggaggcgcuaugcucuuuuugaucuccgggaagggaauugguaaaaccaguaucggccugauuugugucaucguuucuagcgggauguuauggauggcggaugugccacuacaguggauagccuccgcaauuguacuggaguucuuuaugauggugcuccuuaucccugagccggaaaagcaaagaacuccccaggacaaucagcuggcuuaugucgugauuggaaucuugacacuggccgccauaguugcagcuaacgagaugggccuccuggaaaccaccaagagggaucuugguaugucaaaagagccagggguggucucuccuacaagcuaccucgacguagaccugcaucccgccagugcguggacuuuguaugcuguggccacgaccguuaucacaccaaugcugcggcacacuauugaaaauuccaccgcaaacgugagcuuagccgcuaucgcaaaccaagccgucgugcuaaugggccuggauaagggauggccuauuucuaaaauggaccucggcgucccccuucuggcguuggggugcuacucacaggugaauccgcugacacucaccgcugccguucugcuuuuagugacucauuacgcaaucauaggaccaggccugcaggccaaggcuacgcgcgaggcccagaaaagaacagcagcugguauuaugaagaacccuaccguagaugggaucaugacuaucgaccucgaucccgugauuuaugacuccaaguucgagaaacaauugggacaggucaugcugcuaguucugugugccgugcagcuccuucugaugaggaccaguugggcguugugcgaagcccugacacucgcaacuggcccaaucaccacacugugggaggguagccccggcaaguuuuggaauacgaccauagcugucucgauggccaacauuuuccgggggucuuacuuagcaggagcuggccuugccuuuuccaucaugaaaagcguggggacuggacgaagaggcacagguucacagggggaaacccugggagagaaguggaaaaagaagcucaaucaacuaagucgcaaagaguucgaucuguauaagaaaucuggcauuacugagguagacaggacagaggccaaggaagguuugaaacggggcgagaccacgcaccaugcggugucccgugggagcgcuaagcugcagugguuuguugaaagaaacauggugaucccugagggaagggucauagaucucggcugugggcgcggaggcuggucauacuauugcgcaggucuuaaaaaggugaccgaaguccggggguacacaaagggaggcccgggccacgaggagcccgugccaaugaguacuuauggguggaauaucguuaaacugaugagcggaaaggacguauucuacuugccucccgaaaaaugugauacccugcucugcgacauuggugaguccucuccuagcccaacaguggaagagucccgaacuaucagagucuuaaagaugguggagcccuggcugaggaacaaucaguucuguauuaaaguucuuaacccuuacaugccaaaugugaucgaacaccuggagcgccuacagcggaaguauggcgggaugcucgucagaaacccccugucacguaauucuacccaugaaauguacuggauuaguaacggaacaggcaauaucgugucgagcguaaacaugguguccagguugcugcucaaccgguuuaccaugacucaccgccgaccgacgauagagaaggauguugaccuuggugccgggacaagacaugucaaugcugaaccugagaccccaaacauggacgugauuggagagaggaucaaacggaucaaggaagaacacucuucaacuuggcacuaugaugacgaaaaucccuacaaaaccugggccuaucauggcagcuacgaggugaaggcaacaggcuccgccaguucuaugauuaacggggucguuaaacuguuaacgaagccuugggaugugguaccaauggugacccaaauggcuaugacugacacaacccccuucggacagcagcgcgucuuuaaggaaaaaguggauacuagaacaccgaggccuaugcccgguacccgaaagguuauggagauaacagcggaguggcuguggcggacuuugggccguaauaaaaagccaagacucugcacccgcgaagaguucacgaaaaaggugaggaccaacgccgcaaugggggcugucuuuacagaagagaaucaaugggacagcgcccgggcagccguggaagaugaggaguucuggaagcugguagacaaagaaagagagcuacacaaacuuggaaaauguggcucaugcguuuauaacaugauggguaagcgcgagaagaagcugggggaguuuggaaaagcuaagggcuccagggccaucugguacauguggcucggcgcgcgauaccuggaguucgaagcauugggguuucugaaugaggaucauugguucagucgggaaaacagcuauucuggaguggagggugaaggccuccacaaacuuggguacauucugagagacaucuccaaaauuccuggaggcgccauguaugcugaugacacugccgguugggacaccaggaucacagaggaugacuuacauaaugaggaaaagauaacucagcagauggaucccgagcaccgccagcuggcaaacgcuaucuuuaaauugaccuaccaaaauaaggucgugaaagugcagcguccaacgcccaaggggacagucauggacauuaucucacggaaggaucagagaggaagcggccagguuggcaccuaugggcucaacacuuucacaaauauggaagcccaacuggugaggcagauggagggagaagguguacuaucggaggcugaccuugagaacccucaucugcucgagaagaagauuacccaguggcuggagacuaaaggcguggaacgcuugaagcgaauggccaucucuggggaugacugcgucgugaaaccaauagaugaccgguuugcaaacgcguuacuggcccucaaugauaugggaaagguuagaaaggacauuccgcaguggcaacccaguaaaggcuggcaugauuggcaacaggugccuuucuguucccaccauuuccacgagcuuaucaugaaggacgguaggaaacuggucgugccaugccgcccccaggacgaacuaaucgggagagcucggauuagccaaggagccggcuggucacugaaggagaccgcaugucucggcaaggcuuacgcccagaugugguccuugauguauuuucacaggcgugaucugcgacuugcaucuaacgccauaugcagcgcgguaccuguucauuggaucccaacaagucgcacgaccugguccauucacgcucaucaccaguggaugacuacagaggacaugcugaccguguggaauagagucuggaucgaagauaaccccuggauggaggacaagacuccugugacaaccugggaagauguuccguaccucgggaagcgggaggaccaaugguguggcagcuuaauuggucugacgucuagggccacaugggcacagaauaucuugaccgccauacaacaggugcgcucacugaucggcgaugaggaguuccucgacuacaugccaaguaugaaaagauuucggaaggaggaagaguccgaaggggcuauuugguga

SEQ ID NO: 15216 - RNA, 9873 nt, Artificial Sequence
  derived and/or modified CDS sequence (opt3) from DENV-3__GU131940__SS-prME
accagccugugccucaugaugaugcuucccgccacucuggcuuuccacuugacuuccagagacggagaaccuaggaugaucguggggaagaacgaacggggaaaaucuuuacuguuuaagacggcaucagguauuaauauguguacccuaauagccauggaucucggcgagaugugcgacgauacugucacuuacaaauguccacugaucgcggaaguugagccggaagacauugauugcugguguaaccuuaccaguaccugggugaccuaugggacuugcaaucaggcuggagagcaucgccgagacaagcguagcgucgcccuggcaccccacgugggcauggguuuggauacaagaacccaaacguggauguccgccgagggggcuuggaggcaggucgaaaaaguggagacuugggcacuccggcauccuggauucaccauccuggcccuguuucucgcucacuacauuggcacaucuuuaacucagaagguugugaucuucauacugcuuauguuggucaccccaucgaugacaaugcgcugugugggcguagggaacagagacuuuguugaaggacugucaggugccaccuggguggaugucgugcuagagcauggcgggugcgugacgacuauggcaaagagcaaacccacacucgacaucgagcugcagaagaccgaagcaacucaacuugccacacugaggaaauuguguauugagggaaagaucaccaauauuacgaccgauagucggugcccuacacagggcgaagcuacucucccagaggaacaggaccagaacuaugucuguaaacacaccuacguugaucgcgguugggggaauggaugcggccuguucggcaagggguccuuagugacaugcgccaaguuucaaugucuggagcccaucgagggaaaaguagugcaguaugaaaaccucaaguacacugucauaauuaccgugcacacaggugaccagcaucagguuggcaaugacacccaaggggugacugucgagaucacgccucaggcaucuacaguggaagcuguacuuccagaguauggaacccugggcuuggaaugcagcccgcgaacuggucuagauuucaacgagaugauucugcucaccaugaaaaauaaggccuggaugguucacagacagugguuuuucgaccugccccuuccuuggacauccggggcgaccacugagacaccaacguggaacaggaaagaacuguuggugaccuuuaagaaugcccaugccaagaagcaagaggucgugguccucggcucacaggaaggagcuaugcacacugcccugacaggcgcuaccgagauccagaacagugggggaacaagcaucuucgccggucacuuaaagugucggcugaaaauggauaagcuagaacucaaaggcaugucuuacgcaaugugccugaauacuuuugugcuuaagaaagagguuuccgagacccagcaugggacgauuuugauaaagguggaauacaagggagaggacgcccccuguaaaaucccuuucucaaccgaagauggccaagguaaggcucacaacgggcgucugauuacagcgaacccaguagucacuaaaaaggaggagcccgugaauaucgaagcagagccgccuuucggcgaaagcaacauaguuauuggaaucggcgacaaagcccucaagaucaauugguauaagaaagggaguucuauuggaaagauguuugaggcuaccgcccgcggugcaagaaggauggccauccugggcgauacagcuugggacuucggguccgugggaggcguccuuaacagccuggguaaaauggugcaucagauuuuugggucggccuacacugcauuguucucuggcguauccuggauaaugaagaucggaauuggcgugcuccugaccuggaucggguuaaauucaaagaacacgaguaugagcuuuuccugcaucguuauuggaauaaucacacuguaucuaggcaccgucgugcaggcggauauggguugugcuauuaauuggaaggggaaggaacucaaaugcggaucuggcaucuucgugacuaacgagguccacacauggaccgagcaguacaaguuucaagccgacagccccaaacggcuggcaacugccauugcuggugccugggaaaauggcguuugugggauccgaucaaccacacgcauggagaaccuuuuguggaagcagauagcaaaugaacugaacuauauccucugggagaauaacauuaaacugacgguggugguaggagauaucauuggcgucuuagaacaggggaagagaacccugacuccacagccuauggagcuuaaauacaguuggaagacauggggaaaggcuaaaaucgugaccgccgagacacaaaauuccagcuucauaauugacggccccaacacuccagaaugccccucugcgucaagggccuggaacguuugggagguggaagacuaugguuuuggggucuucaccacgaauaucugguugaagcuccgggagguguacacacagaguugugaucaucgccugaugagcgcugcaauuaaagacgaaagagccguucacgcugauaugggauacuggaucgagucccagaagaacggcucuuggaaacuagagaaggccucguuuauagaagugaagaccugcacuuggccuaaaagccacacccugugguccaaugguguacucgagucagacaugaucauuccaaagagucuggcaggcccgaucucucagcauaaccacaggcccggguaucauacacaaacugcgggaccuuggcaccuuggcaaauuggaacuggauuucaauuacugcgaggggaccacagucgugauuacggagaacuguggaacccguggccccagcuuacggacuacaaccguguccgguaagcucauccacgaauggugcugucgaucaugcacucugcccccucuuagauauaugggggaggacggauguugguacggcauggaaauaaggccaauuaaugagaaagaagagaacauggucaagagccugguuucugccgguuccggcaagguggauaauuuuacaauggggguauugugccucgcuauccuguucgaggaagugaugcgcggaaaauucggcaagaaacauaugaucgccgggguccuauuuaccuucgugcugcuccugaguggacagauuacguggcgggacauggcacacacucuuaucaugauuggcagcaacgcuucugauagaauggguauggggguuaccuauuuggcccugauagcaacauuuaagauccagcccuucuuagcccucggauuuuuccugaggaaacuuaccucccgcgagaaucugcuacucggcgugggccuggcuauggcgacuacauugcaacugccggaagacauugagcagauggccaacgggaucgcauuaggacucaugacccugaaacuuauuacacaguuugaaacuuaccagcuguggaccgcuuuggucucacucacguguaguaauacaaucuucacccugacuguggccuggcgaaccgccacacuaauacuggcugguguuagccuucucccucugugccaaucguccucuaugcggaagacugauugguugccaaugaccguggcagccaugggcguaccaccucugcccuuauuuaucuucagccucaaagacacgccaaagcguagaucauggccucugaacgaggggguaauggcggugggacuuguuaguauucuggcuuccucuuugcucaggaaugaugugcccauggccggcccacuggucgcgggugggcuacugaucgccuguuaugugauuacaggaaccagcgcugaccuuacuguagagaaagcagccgacgugacaugggaagaggaagcggagcagaccggcgucucccauaaccucaugaucacuguugaugacgauggcacaaugcgcauaaaggacgaugaaaccgagaacauucugacgguguuguuaaaaacugcucugcucaucgugucagggaucuuuccguacagcauuccugccacccugcuugucuggcacacauggcagaagcagacccaacggaguggagugcugugggacguucccucuccacccgagacacagaaagcagaauuggaggaagguguauacagaauaaagcagcagggcaucuucgggaagacucaagugggagucggcgugcagaaagaggguguuuuucauaccauguggcacgugacgcgaggggcaguccuaacacacaauggaaagaggcuggagccuaacugggcuuccgugaaaaaggaucucauuagcuauggcggcggguggcgccugaaugcccaguggcaaaaaggagaagagguacaggucaucgcaguggaaccagguaagaaccccaagaauuuccagacuaugccuggcauuuuccagaccacaaccggggagaucggagcuauagcccuugacuuuaaaccgggcacuucggguucaccaaucauuaaccgggaagggaagguugugggauuauacggcaauggcgucgugaccaaaaacgggggauauguuucugguaucgcgcaaacaaaugccgagcccgauggcccuacgccagagcuggaagaggaaauguucaagaaaagaaaccucacuauuauggacuugcaucccgggaguggaaagaccaggaaguaccugccugcaaucgugcgugaggcuauaaaacgccggcucagaacacugauucuugccccgaccagggucguggcugcagaaauggaggaggcccugaagggcuugcccauccgauaucagacuacagccaccaaauccgaacacacgggucgggagaucguagaucuaaugugccaugcuacuuuuacaaugcgccugcucagcccagugagaguuccuaauuacaacuuagucauuauggacgaagcgcacuucaccgaucccgcaucuaucgccgcuaggggguauauaagcacccgggugggaaugggcgaggccgcagccauuuuuaugacugcuacaccaccuggcaccgcggaagccuucccccaguccaaugcaccaauccaggacgaggagcgagacauuccggaaagaucauggaacagugggaaugaguggaucacagauuuugugggaaagacugucugguucguaccuagcauaaaagcugguaacgacauugccaacugucugcgcaagaauggcaagaaagugauccaacuuucuaggaagacguuugauaccgaauaccagaaaacacgucugaacgacugggauuucguugugacuaccgacaucuccgagaugggggcaaauuuuaaggccgaucgggucauugaccccagaaggugccucaaaccagugaucuugacagauggacccgagcgcguuauucuggcuggcccuaugccagugaccgccgcgucagcagcccagcgaagaggucgggucgggaggaacccccagaaggaaaaugaccaauacauauucacuggccagccucucaacaaugaugaggaccaugcucacuggacggaagccaagaugcugcuugacaacaucaauaccccggagggaauuaucccagcucuauucgaacccgagcgcgagaaaagugcagccaucgauggcgaauaucgucugaagggggagagcagaaaaacauuuguggaauugaugcggaggggagacuuaccuguauggcuggcuuacaagguggccuccgaggguauuaaauauacugaucgcaaguggugcuucgacggcgaacgaaacaaucagauacucgaggagaacauggauguugaaaucuggaccaaagagggggaaagaaagaagcugcggcccagguggcuugacgcacgcacauacucugauccacuggcgcucaaagaguuuaaggacuucgccgcuggaagaaaaucgauugccuuggaucuggucaccgaaaucggcagggugccuagccaccuagcacaucggacucguaaugcucuggacaaccucgugaugcuucacacaucagagcauggugggcgcgccuaucgacacgcagucgaggaacugcccgagacgauggaaaccuuauugcugcucggccugaugauucuucugacuggaggcgccaugcucuuuuugaucuccgggaagggaauagguaaaacaaguaucggccugauuuguguuaucgugucuagcgggauguuauggauggcugauguaccacuacaguggauugcguccgccaucgugcuggaguucuuuaugaugguccuccuuauaccugagccggaaaagcaaagaacaccccaggacaaucagcuggcauacgugguuauuggaaucuugacccuggcugccauuguggccgcaaacgagaugggccuccuggaaacaacuaagagggaucuugguaugucaaaagagccaggggucguaucuccuacgagcuaucucgacguggaccugcaccccgcuagugccuggaccuuguacgcgguugcuacaacugugaucaccccaaugcugcggcauacaauagaaaauuccaccgccaacgucagcuuagcagccaucgcuaaccaagcagugguccuaaugggccuggauaagggauggccuauuucuaaaauggaccucggcgugccccuucuggccuuggggugcuacucacagguuaauccgcugacucucacggcggcugugcugcuuuuaguaacacacuaugccaucauuggaccaggccugcaggcaaaggccacccgcgaggcucagaaaagaacugccgcagguaucaugaagaacccuaccguggaugggauaaugacaauugaccucgaucccgucaucuacgacuccaaguucgagaaacaauugggacagguuaugcugcuagugcugugugcuguccagcuccuucugaugaggacaaguugggccuugugcgaagcgcugacccucgccacaggcccaaucacgacccugugggaggguagccccggcaaguuuuggaauacuacaauugcagugucgauggcuaacaucuuccgggggucuuauuuagccggagcaggccuugcuuuuuccauaaugaaaagcguagggaccggacgaagaggcacugguucacagggggaaacacugggagagaaguggaaaaagaagcucaaucaacuaagucgcaaagaguucgaucuguacaagaaaucuggcauuaccgagguggacaggacggaggccaaggaagguuugaaacggggcgagaccacacaucacgccguuucccgugggagcgcgaagcugcagugguuuguggaaagaaacauggucaucccugagggaagggugauugaucucggcugugggcgcggaggcuggucauauuacugcgcuggucuuaaaaaggucacugaagugcggggguauaccaagggaggcccgggccaugaggagcccguuccaaugaguacauacggguggaauaucguaaaacugaugagcggaaaggacguguucuacuugccucccgaaaaaugugauacucugcucugcgacauaggugaguccucuccuagcccaaccgucgaagagucccgaacaaucagaguguuaaagaugguugagcccuggcugaggaacaaucaguucuguauuaaagugcuuaacccuuauaugccaaccgucaucgaacaccuggagcgccuacagcggaaguacggcgggaugcucgugagaaauccccugucacguaacucuacucacgaaauguauuggauuaguaauggaacgggcaacaucguaucgagcgugaauaugguuuccagguugcugcucaaccgguuuacaaugacccaucgccgaccgacuauugagaaggaugucgaccuuggugcagggaccagacacgugaacgccgaaccugagacaccaaauauggacgugaucggagagaggauaaaacggauuaaggaagaacacucuucaacguggcacuacgaugacgaaaaccccuauaaaaccugggcuuaccacggcagcuaugaggucaaggccacuggcuccgcaaguucuaugaucaaugggguugugaaacuguuaacaaagccuugggauguagugccaauggucacccaaauggccaugacugacacaacccccuucggacagcagcgcguguuuaaggaaaaaguugauacaagaacuccgaggccuaugcccgguacccgaaaggugauggagaucacggcugaguggcuguggcggaccuugggccguaacaaaaagccaagacucugcacacgcgaagaguucacuaaaaaggucaggaccaaugcggccaugggggcaguguuuacagaagagaaccaaugggacagcgcucgggccgcaguagaagaugaggaguucuggaagcugguugacagagaacgcgagcuacauaaacuuggaaaguguggcucaugcguguacaauaugauggguaaaagggaaaagaaacugggggaguuuggaaaggccaaaggcucccgagcuauuugguacauguggcucggcgcccgguaucuggaguucgaagcguugggguuucugaacgaggaucacugguucaguagagaaaauagcuacucuggagucgagggugaaggccuccauaaacuuggguauauacugagggacaucuccaagauuccuggaggcgcaauguacgccgaugacacugcugguugggacacccgcaucacggaggaugacuuacacaacgaggagaaaauuacacagcagauggaucccgagcaucgucagcuggccaaugcaaucuuuaaguugaccuaucaaaacaaaguggugaagguccagcggccaacucccaaagggacaguuauggacauaaucucaagaaaggaucagaggggaagcggccaggugggcaccuacgggcucaauacuuucaccaacauggaagcucaacugguacgccagauggagggagaaggugugcuaucgaaggccgaccuugagaauccucaucugcucgagaaaaagauuacacaguggcuggaaacgaaaggcgucgagcgauugaagcggauggcuaucucuggggaugacugcgugguuaaaccaauugaugacagauuugccaacgcauuacuggcgcucaacgauaugggaaaggugaggaaggacaucccgcaguggcaacccaguaaaggcuggcacgauuggcagcaggucccuuucuguucccaucacuuccaugaacuuauaaugaaggacggucgcaaacuggugguaccaugcagaccccaggacgagcuaauugggcgggccaggaucagccaaggagcuggcuggucacugaaggaaaccgccugucucggcaaagcauaugcucagaugugguccuugauguacuuucaccgucgagaucugcgccuugccucuaaugcaaucugcagcgccguuccugugcacuggauuccaacaaguagaacaaccugguccauacaugcgcaccaucaguggaugacuacagaggacaugcugaccgucuggaaccggguguggaucgaggauaaucccuggauggaagacaagacgccuguuacaaccugggaggaugugccguaccucgggaagagggaagaccaaugguguggcagcuuaauuggucugacuucucgcgcuaccugggcccagaacaucuugacagcaauucagcaggucagaucacugaucggcgaugaggaguuccucgacuauaugccaaguaugaaacgguuuaggaaggaagaggaauccgagggggccauaugguga

SEQ ID NO: 15217 - RNA, 9873 nt, Artificial Sequence
  derived and/or modified CDS sequence (opt3) from DENV-3__GU131942__SS-prME
accagccugugccucaugaugauguuccccgcaacucuugcuuuucaccugacuuccagagacggcgagccuaggaugaucguggggaagaacgaacggggaaaaucuuuguuauucaagacggcaucagguauuaauauguguacccugauagccauggaucucggcgagaugugcgacgauacagucacuuacaaauguccacucaucgcggaaguugagccggaagacauugauugcugguguaaccugaccaguacaugggugaccuaugggacuugcaaucaggcuggagagcaucgccgagacaagcguagcguagcccuugcaccccacgugggcaugggucuggauacaagaacccagacguggauguccgccgagggggcuuggaggcaggucgaaaaaguggagacuugggcauugcggcauccuggauuuaccauccucgcccuguuccuggcucacuacauuggcacaucucucacucagaagguugugaucuuuauauuacugaugcuugucaccccaucgaugacaaugcgcugugugggcguagggaacagagacuucguugaaggauugucaggugccaccuggguggaugucgugcuggagcauggcgggugcgugacgacuauggcgaaaagcaaacccacacuggacaucgagcuccagaagaccgaagcaacucaacuggccacacuuaggaaacuguguauugagggaaagaucaccaauauuacgaccgauagucggugcccuacacagggcgaagcuacuuugccagaggaacaggaccagaacuaugucuguaaacacaccuacguugaucgcgguugggggaauggaugcggccucuuuggcaaggggucccuggugacaugcgccaaguuccaauguuuagagcccaucgagggaaaaguagugcaguaugaaaaccugaaguacacugucauaauuaccgugcacacaggugaccagcaucagguuggcaaugacacccaaggggugacugucgagaucacgccucaggcaucuacaguggaagcuguacucccagaguauggaacccuuggccuggaaugcagcccgcgaacugguuuggauuuuaacgagaugauucuacugaccaugaaaaauaaggccuggaugguucacagacagugguucuuugaccucccccugccuuggacauccggggcgaccacugagacaccaacguggaacaggaaagaacuucuggugaccuucaagaaugcccaugccaaaaagcaagaggucguggucuugggcucacaggaaggagcuaugcacacugcccucacaggcgcuaccgagauccagaacagugggggaacaagcaucuuugccggucaccugaagugucgguuaaaaauggauaagcuggaacuaaaaggcaugucuuacgcaaugugccucaauacuuucgugcugaagaaagagguuuccgagacccagcaugggacgauucuuauaaagguggaauacaagggagaggacgcccccuguaaaaucccuuucucaaccgaagauggccaagguaaggcucacagcgggcguuugauuacagcgaacccaguagucacuaaaaaggaggagcccgugaacaucgaagcagagccgccuuuuggcgaaaguaauauaguuauuggaaucggcgacaaagcccugaagaucaacugguauaagaaagggucuuccauuggaaagauguucgaggcuaccgcccgcggugcaagaaggauggccauccucggcgauacagcuugggacuuugggagcgugggaggcguccuaaauucgcuugguaaaauggugcaucagauuuucgggucugccuacacugcacuguuuuccggcguaucaugggugaugaagauaggaaucggcguuuugcucaccuggauugggcugaacaguaaaaauacgagcauguccuucucuugcaucgucaucggaauuauaacauuauaucugggcgcgguggugcaggcugauauggguugugucaucaacuggaaggggaaggaacuaaaaugcggaagcggcauuuuuguuaccaaugaggugcacacuuggacagagcaguacaaguuccaagccgacucacccaaacggcucgcaaccgccaucgcuggugccugggaaaacggcgugugugggauucgaaguacuacccgcauggagaaucugcuuuggaagcagaucgcaaacgaauugaauuauauacugugggagaacaauaucaaacucacaguagucgugggagauauuaucggcguucuggaacaggggaagagaacguuaaccccacagccuauggagcugaaauacuccuggaagacuuggggaaaggcuaaaauugugacagccgagacccaaaacagcucuuuuaucauagacggccccaauacaccagaaugccccucagcgaguagggccuggaacgucugggagguggaagacuaugguuucgggguuuuuacuaccaacauuuggcuuaaguugcgggagguguacacgcagagcugugaucaucgccucauguccgcugcaaucaaagacgaaagagccguacacgcugauaugggauacuggauugagucucagaagaauggcucguggaaacuggagaaggccagcuucaucgaagucaagacaugcaccuggccuaaaucccacacucuauggucaaacggugugcuggagagugacaugauaaucccaaagucucucgcaggcccgauuagccagcauaaucacaggcccggguaucauacccaaacagcgggaccuuggcaccugggcaaacuugaauuggauuuuaacuacugcgaggggacuaccguggucaucacagagaauuguggaacgcguggcccaucccugcggaccacuacaguuucagguaaguuaauucacgaauggugcugucgaagcugcacccuacccccucugagauauaugggggaggacggauguugguacggcauggaaaucaggccaauaaacgagaaagaagagaauauggugaagucucuuguauccgccgguaguggcaagguggauaacuucacuauggggguccugugcuuggcuauucucuucgaggaagugaugcgcggaaaauuuggcaagaaacauaugaucgccgggguucuguucacauuugugcuacugcucagcggacagaucaccuggcgggacauggcacacacgcugauuaugaucggcucuaaugcuuccgauagaauggguaugggggucacuuaucuugccuugauugcaaccuucaagauacagcccuuucuggccuuaggauucuuucucaggaaacugacaucacgcgagaaccuucugcuaggcgugggccucgcuauggcgaccacucugcaauugccggaagacaucgagcagauggccaaugggauugcacugggauuaaugacacucaagcugaucacccaguucgaaacauaccagcuuuggacugcucugguuaguuugaccuguagcaacacgguguuuacacucaccgucgccuggcgaacugccacccugauucuagcugguguaucgcugcuuccucucugccaauccucuagcaugcggaagacagauuggcugccaaugacuguggcagccaugggcguucccccuuugccccuguucaucuuuucauuaaaagacaccccaaagcguagaaguuggccucucaaugagggggugauggcggucggacugguguccauacuugcuucuagccuguugaggaacgauguacccauggccggcccacucguggccggugggcugcuaaucgccuguuaugucauuacgggaacauccgcugaccugaccguugagaaagcagccgacgugacuugggaagaggaagcggagcagacaggcgugucacauaaucuuaugaucaccgucgaugacgauggcacuaugcgcauuaaggacgaugaaacagagaacauccucaccgugcuguugaaaacggcuuuacugauaguuagcgggauuuucccguacaguaucccugccacucuccugguauggcacaccuggcagaagcagacacaacggucuggagugcuuugggacguccccuccccacccgagacccagaaagcagaacuggaggaagguguguacagaaucaagcagcagggcauuuuugggaagacacaaguuggagugggcguccagaaagaggguguguuccauacuauguggcacguaacccgaggggcagucuugacgcacaacggaaagaggcuagagccuaauugggcuagcgugaaaaaggaucugauaucguauggcggcggguggcgccucaacgcccaguggcaaaaaggagaagagguucaggugaucgcagucgaaccagguaagaaucccaagaacuuccagacaaugccuggcauuuuucagacuaccacaggggagaucggagcuauugcccuggacuucaaaccgggcaccucagguucuccaaucauaaaucgggaagggaaggugguuggacuuuacggcaacggcguggucacuaaaaaugggggauaugugagugguaucgcgcaaaccaacgccgagcccgauggcccuacaccagaguuagaagaggaaauguuuaagaaaagaaaucugacgauuauggaccuccaucccggguccggaaagacuaggaaguacuugccugcaaucguacgugaggcuauuaaacgccggcugagaacccucauccuggccccgacaagggugguugcugcagaaauggaggaggcccuuaagggccugcccauacgauaucagaccacugccacaaaaagcgaacacaccggucgggagauugucgauuugaugugccaugcuacguucacuaugcgccuacugucuccagugagagugccuaacuacaaucucgucaucauggacgaagcgcacuuuacagaucccgcaagcaucgccgcuaggggguauauuuccacccggguaggaaugggcgaggccgcagccaucuucaugaccgcuacuccaccuggcacagcggaagccuuuccccagucaaacgcaccaauacaggacgaggagcgagacauuccggaaagaaguuggaauagcgggaacgaguggaucaccgauuucgugggaaagacaguuugguuugugccuucuauuaaagcugguaaugacaucgccaacuguuuacgcaagaacggcaagaaagucauacaacuguccaggaagacuuucgauacggaauaccagaaaacccgucuuaaugacugggauuuugugguuacaacugacauuucagagaugggggcaaacuucaaggccgaucgggugaucgaccccagaaggugccugaaaccagucauccucaccgauggacccgagcgcgugauuuuggcuggcccuaugccaguaacagccgcgagugcagcccagcgaagaggucggguggggaggaauccccagaaggaaaacgaccaauacaucuucaccggccagccucugaauaacgaugaggaccaugcucacuggacugaagccaagaugcuccuggacaauauuaacacgccggagggaauaaucccagcucuuuuugaacccgagcgcgagaaaagcgcagccauugauggcgaauaucgucuaaagggggaguccagaaaaaccuucguugaacugaugcggaggggagacuugccugucugguuagcucacaagguggccucugaggguaucaaauacacagaucgcaaguggugcuuugacggcgaacgaaauaaccagauccuggaggagaauauggauguggaaauuuggacuaaagagggggaaagaaagaagcuccggcccagguggcuggacgcacgcaccuauucggauccacuugcgcugaaagaguucaaggacuuugccgcuggaagaaaaagcauagcccucgauuuggucacagaaaucggcaggguuccuucacaucuggcacaccggacccguaacgcucuagacaaucuggugaugcuccauacuuccgagcacggugggcgcgccuaccgacacgcaguagaggaacuucccgagacaauggaaacgcuguuauugcugggccucaugauucugcuuaccggaggcgccaugcuguuccucaucagugggaagggaauugguaaaacuucuaucggcuugauaugugugaucgucagcuccgggaugcuguggauggcugaugugccauuacaguggauugcgucagccaucguucuagaguuuuucaugauggugcugcucauuccugagccggaaaagcaaagaacaccccaggacaaccagcuugcauaugucguaaucggaauacugaccuuggcugccauuguggccgcaaaugagaugggccugcucgaaaccacaaagagggaucuggguaugucuaaagagccagggguugugagcccuacaaguuaccuugacgucgaccuccaucccgcuuccgccuggacgcuguaugcgguggcuaccacagucaucacuccaauguugcggcacaccauugaaaacagcacagccaaugugucucuggcagccaucgcuaaccaagcaguuguguuaaugggccuagauaagggauggccuauaucaaaaauggaccugggcguaccccuccuugcccuggggugcuacucccaggugaacccguugacccugacugcggcuguccuccugcuuguuacgcauuacgccaucauuggaccaggcuuacaggcaaaggccacacgcgaggcucagaaaagaaccgccgcagguaucaugaagaauccuacuguggaugggauuaugaccaucgaccuggaucccgucauauaugacaguaaguuugagaaacaacucggacaggugauguugcugguacuaugugcugugcagcugcuccuuaugaggacaagcugggcccugugcgaagcguugacucuggccaccggcccaauuacaacgcucugggaggguucgcccggcaaguucuggaacaccacuaucgcaguuucuauggcuaauaucuuucggggguccuaccuggccggagcaggcuuagcuuucagcauuaugaaaucagugggggccggacgaagaggcacagguagucagggggaaacccuuggagagaaguggaaaaagaagcugaaccaacucucucgcaaagaauuugaucuauauaagaaauccggcaucacugaggucgacaggacagaggccaaggaaggucugaaacggggcgagaccacgcaccaugcggugagccgugggucagcuaaguugcagugguucgucgaaagaaauauggugauaccugagggaaggguuauugaucugggcugugggcgcggaggcuggaguuacuauugcgcaggucucaaaaagguaaccgaagugcggggguacacaaagggaggcccgggccacgaggagcccgucccaaugagcacuuauggguggaacaucgugaaacuuauguccggaaaggacguuuucuaccugccucccgaaaaaugugauaccuugcugugcgacauuggugagucuagcccuuccccaacaguggaagagucacgaacuaucagaguccucaagaugguggagcccugguuaaggaauaaccaguuuuguauaaaaguacugaauccuuacaugccaaccgugaucgaacaccuugagcgccugcagcggaaguauggcgggaugcuaguuagaaacccccucucucguaauaguacacaugaaauguacuggauuucgaacggaaccggcaauaucgucagcuccgugaacauggugucuaggcuguugcugaaucgguucacuaugacgcaccgccgaccgacaauugagaaggaugucgaccucggugccgggaccagacauguuaacgcugaaccugagacuccaaacauggacgugaucggagagaggauuaaacggaucaaggaagaacacucaagcaccuggcacuaugaugacgaaaaucccuacaaaacaugggccuaucauggcuccuacgagguaaaggcaacgggcagugccucuagcaugauaaacgggguggucaaacuucugaccaagccuugggaugugguuccaauggugacucaaauggcuaugacagacaccacucccuuuggacagcagcgcgucuucaaggaaaaaguggauacaagaaccccgaggccuaugcccgguacacgaaagguaauggagauuacugcggagugguuauggcggacccugggccguaauaaaaagccaagauugugcacgcgcgaagaguuuaccaaaaagguuaggacaaacgccgcaaugggggcuguguucacugaagagaaucaaugggacucagcccgggcagccgucgaagaugaggaguuuuggaagcucguggacagagaacgcgagcugcacaaacuaggaaaguguggcuccugcguguauaacaugauggguaaaagggaaaagaaacuuggggaguucggaaaggcuaaaggcagucgagccaucugguacauguggcugggcgcgcgguaccucgaguuugaagcacugggguucuugaaugaggaucauugguuuagcagagaaaacucuuauuccggagucgagggugaaggccugcacaagcucggguacauccuuagggacauuucaaagauaccuggaggcgccauguaugcugaugacaccgccgguugggacacacgcaucacugaggaugaccugcauaaugaggagaaaauuacccagcagauggaucccgagcaccgucaguuagcaaacgcuaucuucaagcugacguaccaaaauaaaguugugaagguacagcggccaacacccaaagggaccgugauggacauuaucagcagaaaggaucagaggggaucgggccaggucggcacuuauggguugaacacauuuaccaauauggaagcccaacucgugcgccagauggagggagaagguguucugucuaaggcugaccuagagaacccucaccuucuggagaaaaagauaacucaguggcucgaaaccaaaggcguggagcgacugaagcggauggccaucaguggggaugacugcgucgugaaaccaauugaugacagauucgcaaaugcguuguuagcccugaacgauaugggaaagguaaggaaggacaucccgcaguggcaacccuccaaaggcuggcaugauuggcagcagguuccuuucuguagccaccauuuucacgaacucauuaugaaggacggucgcaaacuuguggucccaugcagaccccaggacgagcugaucgggcgggcuaggauaucacaaggagccggcuggucccuaaaggaaacagcaugucugggcaaggcuuacgcccagauguggucucucauguauuuccaccgucgagauuugcgccuggcaagcaacgccauuugcagugcggugccuguucauuggaucccaacguccagaaccacuuggagcauccacgcucaucaccaguggaugacaaccgaggacaugcuuacuguguggaaucgggucuggauugaggauaaccccuggauggaagacaagacaccugugaccacgugggaggauguaccguaccuggggaagagggaagaccaaugguguggaucucucauagguuuaacaucacgcgccaccugggcacagaauauccugacugccauucaacaggugagaaguuugaucggcgaugaggaguuucuggacuacaugccauccaugaaacgguucaggaaggaagaggaaagcgagggggcuauuugguga

SEQ ID NO: 15218 - RNA, 9873 nt, Artificial Sequence
  derived and/or modified CDS sequence (opt3) from DENV-3__GU131943__SS-prME
accagccugugccucaugaugaugcuucccgccacacuggcuuuccacuugacuuccagagacggagaaccuaggaugaucguggggaagaacgaacggggaaaaucuuuacuguuuaagacggcgucagguauuaauauguguacccuaauagccauggaucucggcgaaaugugcgacgauacagucacuuacaaauguccacugaucgcggaaguugagccggaagacauugauugcugguguaaccuuaccaguacaugggugaccuaugggacuugcaaucaggcuggagagcaccgccgagacaagcguagcgucgcccuggcaccccacgugggcauggguuuggauacaagaacccaaacguggauguccgccgagggggcuuggaggcaggucgaaaaaguggagacuugggcacuccggcauccuggauucaccauccuggcccuguuucucgcucacuacauuggcacaucuuuaacucagaagguugugaucuucauacugcuuauguuggucaccccaucgaugacaaugcgcugugugggcguagggaacagagacuuuguugaaggacugucaggugccaccuggguggaugucgugcuagagcauggcgggugcgugacgacuauggcaaagagcaaacccacacucgacaucgagcugcagaagaccgaagcaacucaacuugccacacugaggaaauuguguauugagggaaagaucaccaauauuacgaccgauagucggugcccuacacagggcgaagcuacucucccagaggaacaggaccagaacuaugucuguaaacacaccuacguugaucgcgguugggggaauggaugcggccuguucggcaagggguccuuagugacaugcgccaaguuucaaugucuggagcccaucgagggaaaaguagugcaguaugaaaaccucaaguacacugucauaauuaccgugcacacaggugaccagcaucagguuggcaaugacacccaaggggugacugucgagaucacgccucaggcaucuacaguggaagcuguacuuccagaguauggaacccugggcuuggaaugcagcccgcgaacuggucuagauuucaacgagaugauucugcucaccaugaaaaauaaggccuggaugguucacagacagugguuuuucgaccugccccuuccuuggacauccggggcgaccacugagacaccaaucuggaacaggaaagaacuguuggugacguuuaagaaugcccaugccaagaagcaagaggucgugguccucggcucacaggaaggagcuaugcacaccgcccugacuggcgcuacagagauccagaacagugggggaaccagcauuuucgccggucacuuaaagugucggcugaaaauggauaagcuagaacucaaaggcaugucuuacgcaaugugccugaauacauuugugcuuaagaaagagguuuccgagacucagcaugggaccauauugaucaagguggaauacaagggagaggacgcccccuguaaaauuccuuucucaacggaagauggccaagguaaggcucacaacgggcgucugaucaccgcgaacccaguagucacuaaaaaggaggagcccgugaauauagaagcagagccgccuuucggcgaaagcaacauuguuaucggaaucggcgacaaagcccucaagauuaauugguauaagaaagggaguucuaucggaaagauguuugaggcuacugcccgcggugcaagaaggauggccauucugggcgauaccgcuugggacuucggguccgugggaggcguccuuaacagccuggguaaaauggugcaucagauauuugggucggccuacacagcauuguucucuggcguauccuggaucaugaagauuggaaucggcgugcuccugacuuggaucggguuaaauucaaagaacaccaguaugagcuuuuccugcauuguuauaggaaucauuacgcuguaucuaggcgcggucgugcaggcugauauggguugugccaucaauuggaaggggaaggaacucaaaugcggaucuggcauuuucgugacaaacgagguccacaccuggacugagcaguacaaguuucaagcagacagccccaaacggcuggccacagcuaucgccggugcaugggaaaauggcguuugugggauacgaucaaccacucgcauggagaaccuuuuguggaagcagaucgcuaaugaacugaacuauauucucugggagaauaacaucaaacugaccguggugguaggagauauuaucggcgucuuagaacaggggaagagaacacugacgccacagccuauggagcuuaaauacaguuggaagaccuggggaaaggccaaaauagugacugcggagacacaaaauuccagcuucauuaucgacggccccaacaccccagaaugccccucugccucaagggcuuggaacguuugggagguggaagacuaugguuuuggggucuucacaacuaauauuugguugaagcuccgggagguguacacccagaguugugaucaucgccugaugagcgcagccaucaaagacgaaagagcuguucacgccgauaugggauacuggauagagucccagaagaacggcucuuggaaacuagagaaggcaucguuuaucgaagugaagacgugcacauggccuaaaagccacacccugugguccaaugguguacucgagucagacaugauuaucccaaagagucuggcgggcccgauuucucagcauaaccacaggcccggguaucauacucaaaccgccggaccuuggcaccuuggcaaauuggaacuggauuucaauuacugcgaggggacaacugucgugaucaccgagaacuguggaacacguggccccagcuuacggacgaccacuguguccgguaagcucauacacgaauggugcugucgaucaugcacacugcccccucuuagauauaugggggaggacggauguugguacggcauggaaauuaggccaaucaaugagaaagaagagaacauggucaagagccugguuucugcugguuccggcaagguggauaauuuuaccauggggguauugugccucgccauccuguucgaggaagugaugcgcggaaaauucggcaagaaacauaugauugcagggguccuauuuacuuucgugcugcuccugaguggacagaucacauggcgggacauggcucacacccuuauuaugauaggcagcaacgccucugauagaauggguauggggguuacguauuuggcacugaucgccacuuuuaagauucagcccuucuuagcucucggauuuuuccugaggaaacuuaccucccgcgagaaucugcuacucggcgugggccuggcgauggccacaaccuugcaacugccggaagacaucgagcagauggcaaacgggauugcuuuaggacucaugacucugaaacuuaucacacaguuugaaaccuaccagcugugggccgccuuggucucacucacauguaguaauacuauauucacccugacgguggcuuggcgaacagcaacccuaauccuggccgguguuagccuucucccucugugccaaucguccucuaugcggaagacugauugguugccaaugaccguggcggcuaugggcguaccaccucugcccuuauuuauuuucagccucaaagacacaccaaagcguagaucauggccucugaacgaggggguaauggccgugggacuuguuaguauccuggcauccucuuugcucaggaaugaugugcccauggccggcccacuggucgcuggugggcuacugauugcauguuaugugaucacuggaaccagcgccgaccuuacgguagagaaagcggcugacgugacaugggaagaggaagccgagcagaccggcgucucccauaaccucaugauaacuguugaugacgauggcacaaugcgcauuaaggacgaugaaaccgagaacauccugacuguguuguuaaaaacagcacugcucaucgugucagggauuuuuccguacagcauaccugccacccugcuugucuggcacacguggcagaagcagacucaacggaguggagugcugugggacguucccucuccacccgagacccagaaagcugaauuggaggaagguguauacagaaucaagcagcagggcauuuucgggaagacacaagugggagucggcgugcagaaagaggguguuuuucauaccauguggcacgugacacgaggggcaguccuaacucacaauggaaagaggcuggagccuaacugggcauccgugaaaaaggaucucaucagcuauggcggcggguggcgccugaaugcucaguggcaaaaaggagaagagguacaggucauugccguggaaccagguaagaaccccaagaauuuccagaccaugccuggcaucuuccagacgacaacuggggagauaggagcgaucgcccuugacuuuaaaccgggcaccucggguucaccaauuaucaaccgggaagggaagguugugggauuauacggcaauggcgucgugaccaaaaacgggggauauguuucugguauugcacaaaccaaugcugagcccgauggcccuacuccagagcuggaagaggaaauguucaagaaaagaaaccucaccaucauggacuugcaucccgggaguggaaagacaaggaaguaccugccugccauagugcgugaggcuauuaaacgccggcucagaacgcugauccuugcaccgacuagggucguggccgccgaaauggaggaggcucugaagggcuugcccauccgauaucagaccacagcgaccaaauccgaacacacuggucgggagauuguagaucuaaugugccaugcaacauuuaccaugcgccugcucagcccagugagaguuccuaauuacaacuuagucaucauggacgaagcccacuucacggaucccgcuucuauagccgcaaggggguauauuagcacucgggugggaaugggcgaggccgcugcgaucuuuaugacagccaccccaccuggcaccgcagaggcuuucccccaguccaaugccccaauucaggacgaggagcgagacaucccggaaagaucauggaacagugggaaugaguggauaacugauuuugugggaaagacagucugguucguaccuagcauuaaagcagguaacgacaucgccaacugucugcgcaagaauggcaagaaagugauccaacuuucuaggaagaccuuugauacagaauaccagaaaacucgucugaacgacugggauuucguugugacgaccgacauuuccgagaugggggcuaauuuuaaggccgaucgggucaucgaccccagaaggugccucaaaccagugauuuugacagauggacccgagcgcguuauacuggcgggcccuaugccagugacugcagccucagcugcccagcgaagaggucgggucgggaggaacccccagaaggaaaaugaccaauacaucuucaccggccagccucucaacaaugaugaggaccaugcucacuggacagaagcaaagaugcugcuugacaacauuaauaccccggagggaaucaucccagcccuauucgaacccgagcgcgagaaaagugcugccauugauggcgaauaucgucugaagggggagagcagaaaaacuuuuguggaauugaugcggaggggagacuuaccuguauggcuggcacacaagguggcguccgaggguauaaaauacacggaucgcaaguggugcuucgacggcgaacgaaacaaucagauccucgaggagaacauggauguugaaauuuggaccaaagagggggaaagaaagaagcugcggcccagguggcuugacgcccgcacauauucugauccacuggcucucaaagaguuuaaggacuucgccgcaggaagaaaaucgaucgcuuuggaucuggucacugaaauuggcagggugccuagccaucuagcccaccggacccguaaugcacuggacaaccucgugaugcuucauacaucagagcacggugggcgcgccuaccgacacgcugucgaggaacugcccgagaccauggaaacuuuauugcugcucggccugaugauccuucugacaggaggcgcgaugcucuuuuugauauccgggaagggaaucgguaaaacgaguauuggccugaucuguguuauugugucuagcgggauguuauggauggccgauguaccacuacaguggaucgcauccgcuauagugcuggaguucuuuaugaugguccuccuuauuccugagccggaaaagcaaagaacaccccaggacaaucagcuggccuaugugguuaucggaauuuugacucuggccgcaaucguggcugccaacgagaugggccuccuggaaacaaccaagagggaucuugguaugucaaaagagccaggggucguaucuccuaccagcuaccucgacguggaccugcaucccgcgagugcuuggacauuguaugccguugcaacuacggugauaaccccaaugcugcggcacacaaucgaaaauuccacugccaacgucagcuuagcugcaauugccaaccaagcggugguccuaaugggccuggauaagggauggccuaucucuaaaauggaccucggcgugccccuucuggcuuuggggugcuacucacagguuaauccgcugacccucacagccgcagugcugcuuuuaguaacccauuacgccauuaucggaccaggccugcaggcuaaggccacucgcgaggcacagaaaagaacggcugccgguauaaugaagaacccuacaguggaugggauuaugaccaucgaccucgaucccgucaucuaugacuccaaguucgagaaacaauugggacagguuaugcugcuagugcugugugcgguccagcuccuucugaugaggacaaguugggccuugugcgaagcacugacccucgcuacaggcccaauuacuacccugugggaggguagccccggcaaguuuuggaauacaacgaucgccgugucgauggcaaacauauuccgggggucuuacuuagcuggagccggccuugccuuuuccauuaugaaaagcguagggaccggacgaagaggcacugguucacagggggaaacacugggagagaaguggaaaaagaagcucaaucaacuaagucgcaaagaguucgaucuguauaagaaaucuggcaucaccgagguggacaggacugaggcgaaggaagguuugaaacggggcgagacaacccaccaugcuguuucccgugggagcgcaaagcugcagugguuuguggaaagaaacauggucauuccugagggaagggugaucgaucucggcugugggcgcggaggcuggucauacuauugcgccggucuuaaaaaggucacggaagugcggggguacaccaagggaggcccgggccacgaggagcccguuccaaugaguacauauggguggaauauaguaaaacugaugagcggaaaggacguguucuacuugccucccgaaaaaugugauacucugcucugcgacaucggugaguccucuccuagcccaaccgucgaagagucccgaacaauuagaguguuaaagaugguugagcccuggcugaggaacaaucaguucuguaucaaagugcuuaacccuuacaugccaacugucauugaacaccuggagcgccuacagcggaaguauggcgggaugcucgugagaaauccccugucacguaacucuacccaugaaauguacuggaucaguaauggaacaggcaacauuguaucgagcgugaauaugguuuccagguugcugcucaaccgguuuaccaugacucaccgccgaccgacgaucgagaaggaugucgaccuuggugcugggacaagacaugugaacgccgaaccugagaccccaaauauggacgugauaggagagaggauuaaacggaucaaggaagaacacucuucaacuuggcacuaugaugacgaaaaccccuacaaaaccugggcauaucauggcagcuacgaggucaaggccacaggcuccgcuaguucuaugaucaaugggguugugaaacuguuaacgaagccuugggauguagugccaauggucacccaaauggcgaugacugacacaacccccuucggacagcagcgcguguuuaaggaaaaaguugauacuagaacaccgaggccuaugcccgguacccgaaaggugauggagauuacagccgaguggcuguggcggacuuugggccguaacaaaaagccaagacucugcacccgcgaagaguucacgaaaaaggucaggaccaaugcagcuaugggggccguguuuacagaagagaaccaaugggacagcgcacgggccgcuguagaagaugaggaguucuggaagcugguugacagagaacgcgagcuacacaaacuuggaaaguguggcucaugcguguauaauaugauggguaaaagggaaaagaaacugggggaguuuggaaaggccaaaggcucccgagcgauaugguacauguggcucggcgcacgguaccuggaguucgaagccuugggguuucugaacgaggaucauugguucaguagagaaaauagcuauucuggagucgagggugaaggccuccacaaacuuggguacauccugagggacauuuccaagaucccuggaggcgcuauguaugccgaugacacugcagguugggacacccgcauuacagaggaugacuuacauaacgaggagaaaaucacucagcagauggaucccgagcaccgucagcuggcuaaugccauauuuaaguugaccuaccaaaacaaaguggugaagguccagcggccaacgcccaaagggacaguuauggacaucauuucaagaaaggaucagaggggaagcggccaggugggcaccuaugggcucaauacuuucacaaacauggaagcucaacugguacgccagauggagggagaaggugugcuaucgaaggccgaccuugagaauccucaucugcucgagaaaaagaucacccaguggcuggaaacuaaaggcgucgagcgauugaagcggauggcaauuucuggggaugacugcgugguuaaaccaaucgaugacagauuugcgaacgccuuacuggcucucaacgauaugggaaaggugaggaaggacauaccgcaguggcaacccaguaaaggcuggcaugauuggcagcaggucccuuucuguucccaccauuuccacgaacuuauuaugaaggacggucgcaaacuggugguaccaugcagaccccaggacgagcuaaucgggcgggccaggaucagccaaggagcaggcuggucacugaaggaaaccgcuugucucggcaaagccuacgcacagaugugguccuugauguauuuucaccgucgagaucugcgccuugccucuaaugcgauuugcagcgcuguuccugugcauuggauaccaacaaguagaacgaccugguccauccacgcccaucaccaguggaugacuacagaggacaugcugaccgucuggaaccggguguggauugaggauaaucccuggauggaagacaagacuccuguuacaaccugggaggaugugccguaccucgggaagagggaagaccaaugguguggcagcuuaaucggucugacgucucgcgcaacaugggcccagaacauuuugaccgcuauccagcaggucagaucacugauaggcgaugaggaguuccucgacuacaugccaaguaugaaacgguuuaggaaggaagaggaauccgagggggccaucugguga

SEQ ID NO: 15219 - RNA, 9873 nt, Artificial Sequence
  derived and/or modified CDS sequence (opt3) from DENV-3__GU131945__SS-prME
accagccugugccucaugaugaugcuucccgccacacuggcuuuccacuugacuuccagagacggcgagccuaggaugaucguggggaagaacgaacggggaaaaucuuuacuguuuaagacggcaucagguauuaauauguguacccuaauagccauggaucucggcgagaugugcgacgauacagucacuuacaaauguccacugaucgcggaaguugagccggaagacauugauugcugguguaaccuuaccaguacaugggugaccuaugggacuugcaaucaggcuggagagcaucgccgagacaagcguagcguagcccuggcaccccacgugggcauggguuuggauacaagaacccaaacguggauguccgccgagggggcuuggaggcaggucgaaaaaguggagacuugggcacuccggcauccuggauucaccauccuggcccuguuucucgcucacuacauuggcacaucuuuaacucagaagguugugaucuucauacugcuuauguuggucaccccaucgaugacaaugcgcugugugggcguagggaacagagacuuuguugaaggacugucaggugccaccuggguggaugucgugcuagagcauggcgggugcgugacgacuauggcgaagagcaaacccacacucgacaucgagcugcagaagaccgaagcaacucaacuugccacacugaggaaauuguguauugagggaaagaucaccaauauuacgaccgauagucggugcccuacacagggcgaagcuacucucccagaggaacaggaccagaacuaugucuguaaacacaccuacguugaucgcgguugggggaauggaugcggccuguucggcaagggguccuuagugacaugcgccaaguuucaaugucuggagucuaucgagggaaaaguagugcaguaugaaaaccucaaguacacugucauaauuaccgugcacacaggugaccagcaucagguuggcaaugacacccaaggggugacugucgagaucacgccccaggcaagcacaguggaagcuguacuuccugaguauggaacccugggcuuggaaugcuccccacgaacuggucuagauuucaacgagaugauucugcucaccaugaaaaauaaggccuggaugguucacagacagugguuuuucgaccugccgcuucccuggacaucaggggcgaccacugagacaccuacguggaacaggaaagaacuguuggugaccuuuaagaaugcccaugcaaaaaagcaagaggucgugguccucggcagucaggaaggagcuaugcacacugcccugacaggcgcuaccgagauccagaacagcgggggaacaucuaucuucgccggucacuuaaagugucggcugaaaauggauaagcuagaacucaaaggcauguccuacgcaaugugccugaauacuuuugugcuuaagaaagagguuucagagacccagcaugggacgauuuugauaaagguggaauacaagggagaggacgccccauguaaaauccccuucagcaccgaagauggccaagguaaggcucacaacgggcgucugauuacagcgaacccuguagucacuaaaaaggaggagccagugaauaucgaagcagagcccccguucggcgaaaguaacauaguuauuggaaucggcgacaaagcccucaagaucaauugguauaagaaagggucuuccauuggaaagauguuugaggcuaccgcccgcggugcaagaaggauggccauccugggcgauacagcuugggacuucgggagcgugggaggcguccuuaacucgcuggguaaaauggugcaucagauuuuugggucugccuacacugcauuguucuccggcguaucauggauaaugaagaucggaauuggcgugcuccugaccuggaucggguuaaauaguaaaaacacgagcauguccuuuucuugcaucguuauuggaauaaucacacuguaucuaggcgcggucgugcaggcugauauggguugugugauuaauuggaaggggaaggaacucaaaugcggaaacggcaucuucgucaccaaugagguucacacuuggacagagcaguacaaguuucaagccgacagcccuaaacggcuggcaaccgccauugcuggugccugggaaaacggcgugugugggauccgaucaacuacccgcauggagaaucuuuuguggaagcagauagcaaacgaacugaauuauauccucugggagaacaauauuaaacugacagugguagucggagauaucauuggcguguuagaacaggggaagagagcucugacgccccagccaauggagcuuaaauacaguuggaagaccuggggaaaggccaaaaucguuacugcggagacacaaaacuccagcuucauaauugacggcccuaacacccccgaaugcccaucugccucaagggcuuggaaugugugggaggucgaagacuaugguuuugggguguucacaacuaacaucugguugaagcuccgggagguuuacacccagaguugugaucaucgccugaugagcgcagccauuaaagacgaaagagcugugcacgccgauaugggauacuggaucgagucccagaagaauggcucuuggaaacuagagaaggcaucguuuauagaaguaaagacgugcacauggcccaaaagccacacccugugguccaacgguguccucgagucagacaugaucauuccuaagagucuggcgggcccaaucucucagcauaaucacaggccgggguaucauacucaaaccgccggacccuggcaccuuggcaaauuggaacuggauuucaacuacugcgaggggacaacuguggugauugcugagaauuguggaacccguggcccuagcuuacggacaacgaccgucuccgguaagcucauccacgaauggugcugucgaucaugcacucugccaccccuuagauauaugggggaggacggauguugguacggcauggaaauaaggccuauuaacgagaaagaagagaauaugguuaagagccuggugucugccgguuccggcaagguagauaacuuuacaauggggguguugugccucgcaauccuguucgaggaagucaugcgcggaaaauucggcaagaaacauaugaucgcuggggugcuauuuaccuucguucugcuccugaguggacagauuacuuggcgggacauggcccacacacuuaucaugauuggcagcaaugcaucugauagaauggguaugggggugaccuauuuggcccugauagcuacguuuaagauccagccauucuuagcgcucggauuuuuccugaggaaacuuacuucccgcgagaaccugcuacucggcgucggccuggccauggcaaccacauugcaacugcccgaagacauugagcagauggcuaaugggaucgccuuaggacucaugacccugaagcuuauuacucaguuugaaacauaccagcuguggaccgccuuggugucacucacauguaguaacacuaucuucacccugacgguugcuuggcgaacagcaacccuaauacuggccggugugagccuucucccgcugugccaaucguccucuaugcggaagacugauugguugccuaugaccgucgcggcuaugggcguaccaccccugccuuuauuuaucuucagccucaaagacacacccaagcguagaucauggccacugaaugagggggugauggccguuggacuugugaguauucuggcauccucuuugcucaggaacgaugucccuauggccggcccccugguggcuggugggcuacugaucgcauguuauguaauuacuggaaccagcgccgaccuuacgguggagaaagcggcugacgucacaugggaagaggaagccgagcagaccggcguuucccauaaccucaugaucacuguggaugacgauggcacaaugaagauaaaagacgaugaaaccgagaauauucugacuguguuguuaaagacagcacugcucaucgucucagggaucuuuccauacagcauuccggccacccugcuuguguggcacacguggcagaaacagacucaacgcaguggaguucugugggacguaccuucucccccagagacccagaaggcugaauuggaggaagguguguaccggauaaagcagcagggcaucuucgggaaaacacaagucggagugggcguucagaaggaggguguguuucauaccauguggcacgucacaagaggggccgugcuaacucacaacggaaaaaggcuggagcccaauugggcauccguaaagaaagaucucauuagcuauggcggcggguggcgacugucggcucaguggcaaaagggagaagagguccaggugaucgccguugaaccugguaagaacccaaaaaauuuccagaccaugcccggcauuuuccagacgacaacuggggagaucggagcgauagcccuugacuuuaagccuggcaccucagguucuccgaucauuaaccgcgaagggaaaguggucggauuauacggcaauggcgugguuacaaagaacgggggauaugugagugguaucgcacaaaccaaugcugagccagauggccccacuccugagcuggaagaggaaauguucaaaaagcggaaccucaccauuauggacuugcauccaggguccggaaagacaagaaaauaccugcccgccaucgucagggaggcuauaaagcgucgccuccggacgcugauucuugcaccuacuagagugguagccgccgaaauggaggaggcucugaaaggcuugccgaucagguaucagaccacagcgaccaagagcgaacacacuggucgagagaucguggaucuaaugugccaugcaacauuuaccaugcggcugcucucucccguucgcgucccaaauuacaacuuagugauuauggacgaagcccacuucacggauccugcuagcaucgccgcaagaggguauauauccacuagggugggaaugggcgaggccgcugcgauuuuuaugacagccacccccccaggcaccgcagaagcuuucccucagucaaaugcccccauccaggacgaggagcgggacauuccagaacgaaguuggaacagcgggaaugaguggaucacugauuuugucggaaaaacaguaugguucgugccgucuauaaaggcagguaacgacauugccaacugucugagaaagaauggcaaaaagguuauccaacuuucccgcaaaaccuuugauacagaauaccagaagacuaggcugaacgacugggauuucguggucacgaccgacaucucagagaugggggcuaauuuuaaagccgaucgugugauugacccucggagaugccucaagcccguuaucuugacagauggaccagagagggugauucuggcgggccccaugccugucacugcagccagugcugcccagcgccgagguagaguggggcggaacccacagaaggaaaaugaccaauacauauucaugggccagccccucaacaaugaugaggaccaugcucacuggaccgaagcaaaaaugcugcuugacaacaucaauacaccugagggaauuaucccggcccuauucgaaccagagagggagaagagcgcugccaucgauggcgaauaucgccugaaaggggagucccguaagaccuuuguagaauugaugagacggggagacuuacccguguggcuggcacacaaaguugcgucugaggguauuaaguacacugauaggaaauggugcuucgacggcgaacgcaacaaucagauacucgaggagaacauggaugucgaaaucuggacgaaggagggggaacgaaagaaacugagaccucgguggcuugacgccaggaccuauucggauccccuggcucucaaggaguuuaaagacuucgccgcaggacgcaagagcauugcuuuggaucuggugacagaaaucggcagagugccaucacaucuagcccacaggacucggaaugcacuggacaaccucgucaugcuucauaccuccgagcacggugggcgugccuaccgccacgcuguugaggaacugccugagacaauggaaaccuuauugcugcucggccugaugauucuucugacuggaggcgcgaugcucuuuuugaucagugggaaaggaauagguaagacaucuaucggccugauuugugugaucguaagcuccgggauguuauggauggccgaugugccccuacaguggauugcaucagcuaucguccuggaguucuuuaugauggugcuccuuauaccagagccugaaaagcaacgaacgccgcaggacaaucagcuggccuauguugugauuggaaucuugacccuggccgcaauugucgcugccaacgagaugggccuccuggaaacuacaaaaagagaucuugguaugucuaaggagcccgggguagugagcccaaccaguuaccucgacguugaccugcauccugcguccgcuuggaccuuguaugccguggcaacaacugucaucacgcccaugcugaggcacaccauagaaaauagcacagccaacgugucuuuagcugcaaucgccaaccaagcggucgugcuaaugggccuggauaaaggauggccaauuucaaagauggaccucggcguuccucuucuggcuuuggggugcuacucccaggugaauccccugacucucaccgccgcaguacugcuuuuagugacacauuacgccaucauuggaccgggccugcaggcuaaagccacccgggaggcacagaagcgcacugcugccgguaucaugaagaacccaacggucgaugggauaaugacaauugaccucgauccuguuaucuaugacaguaaauucgagaagcaauugggacaggugaugcugcuaguccugugugcggugcagcuccuucugaugagaaccagcugggccuugugcgaagcacugacucucgcuaccggccccaucacaacucugugggaggguucgccaggcaaauuuuggaauaccacaauugccguaucuauggcaaacaucuucaggggguccuacuuagcuggagccggccuugccuuuagcauaaugaagucaguggggacgggacggcgaggcaccgguagucagggggaaacucugggagagaaauggaagaagaaacucaaucaacuaucuagaaaggaauucgaucuguauaaaaaguccggcauuacagagguugaccgcaccgaggcgaaagaagguuugaagaggggcgagacuacacaccaugcugugagccgggggucagcaaaacugcagugguuugucgaacguaacauggugauccccgagggaagagucauugaucucggcugugggaggggaggcuggaguuacuauugcgccggucuuaagaaggugaccgaaguucgcggguacacgaaaggaggcccuggccacgaggagccgguacccaugagcaccuauggguggaauaucgugaagcugauguccggaaaagacgucuucuacuugccaccugaaaagugugauacacugcucugcgacauaggugagucuagccccuccccuacuguggaagagucacggaccauccgaguuuuaaaaaugguggagccauggcugagaucuaaccaguucuguauuaagguccuuaaucccuacaugccuacagugaucgaauaucuggagaggcuacagcgcaaguacggcgggaugcucguacggaacccacugaguagaaauucgacucacgaaauguauuggauuagcaacggaaccggcaauaucguguccucuguuaacauggucucacguuugcugcucaauagguuuacaaugacccaucggcgccccacuauugagaaagauguggaccuuggugcugggacgcgacacgugaacgccgaaccggagacaccuaacauggacgucaucggagagagaauaaagaggauuaaagaagagcauagcuccaccuggcacuacgaugacgaaaauccauauaagacuugggcauaccacggcaguuaugagguuaaagccaccggcucugcuagcucaaugaucaacggggugguaaagcuguuaacaaagcccugggauguggucccuauggugacgcaaauggcgaugaccgacacuacaccauucggacagcagcggguuuuuaaagaaaagguggauacccgcacucccagaccgaugccugguacaaggaaagucauggagaucaccgccgaguggcuguggcgaacauugggccggaauaagaaaccccgucucugcacuagagaagaguucaccaagaaggugcgcacgaacgcagcuaugggggccguauuuaccgaagagaaucaaugggacuccgcaagggccgcuguugaagaugaggaguucuggaaacugguggacaaggaacgggagcuacauaaacuuggaaaguguggcaguugcgucuacaacaugauggguaaaagagaaaagaaacugggggaguuuggaaaggccaagggcagccgcgcgauuugguacauguggcucggcgcaagguaucuggaguucgaagccuugggguuucugaaugaggaucacugguucucucgagaaaacuccuacucaggaguggagggugaaggccuccauaaacuuggguauauacugcgggacaucagcaagauuccaggaggcgcuauguacgccgaugacacagcagguugggacacuagaaucaccgaggaugacuuacacaaugaggaaaaaauuacacagcagauggauccugagcauaggcagcuggcuaacgccaucuuuaaguugacuuaucaaaauaaaguggucaagguucagcgccccaccccaaaggggacggugauggacauaaucucgcguaaagaucagcggggaucuggccagguaggcacauacgggcucaacaccuucacuaauauggaagcucaacuggugagacagauggagggagaagguguccuaaguaaggccgaccuugagaacccccaccugcucgagaaaaagauuacacaguggcuggaaaccaaaggcguggagagguugaagcgcauggcaaucuccggggaugacugcguugugaagccuauugaugaccgauuugcgaaugccuuacuggcucucaacgauaugggaaaaguccggaaggacaucccacaguggcaaccgagcaaaggcuggcacgauuggcagcaggugcccuucuguucacaucacuuccaugaacuuauaaugaaggacgguagaaaacugguaguuccuugcaggccacaggacgagcuaauugggcgcgccagaaucucccaaggagcaggcuggucucugaaggaaacugcuugucucggcaaggccuaugcacagauguggagcuugauguacuuucaccggagggaucugcgucuugccaguaacgcgaucugcuccgcugugcccguccacuggauuccuaccagccgaacaacguggucuauacaugcccaccaucaguggaugaccacugaggacaugcugacaguguggaaucgcguuuggaucgaggauaacccauggauggaagacaaaacccccgugacuacaugggaggaugucccuuaccucgggaagagagaagaccaaugguguggaucauuaauuggucugaccagucgggcaacgugggcccagaauaucuugacagcuauucagcaggugaggucccugaucggcgaugaggaguuccucgacuauaugccgagcaugaaacgcuuuagaaaggaagaggaaaccgagggggccauaugguga

SEQ ID NO: 15220 - RNA, 9873 nt, Artificial Sequence
  derived and/or modified CDS sequence (opt3) from DENV-3__GU131946__SS-prME
accagccugugccucaugaugaugcuucccgcaacucuggcuuuccacuugacuuccagggacggagagccuaggaugaucguggggaagaacgaacggggaaaaucuuuacuguuuaagacggcaucagguauuaauauguguacccuaauagccauggaucucggcgagaugugcgacgauacagucacuuacaaauguccacugaucgcggaaguugagccggaagacauugauugcugguguaaccuuaccaguacaugggugaccuaugggacuugcaaucaagcuggagagcaucgccgagacaagcguagcgucgcccuggcaccccacgugggcauggguuuggauacaagaacccaaacguggauguccgccgagggggcuuggaggcaggucgaaaaaguggagacuugggcacuccggcauccuggauucaccauccuggcccuguuucucgcucacuacauuggcacaucuuuaacucagaagguugugaucuucauacugcuuauguuggucaccccaucgaugacaaugcgcugugugggcguagggaacagagacuuuguugaaggacugucaggugccaccuggguggaugucgugcuagagcauggcgggugcgugacgacuauggcaaagagcaaacccacacucgacaucgagcugcagaagaccgaagcaacucaacuugccacacugaggaaauuguguauugagggaaagaucaccaauauuacgaccgauagucggugcccuacacagggcgaagcuacucucccagaggaacaggaccagaacuaugucuguaaacacaccuacguugaucgcgguugggggaauggaugcggccuguucggcaagggguccuuagugacaugcgccaaguuucaaugucuggagcccaucgagggaaaaguagugcaguaugaaaaccucaaguacacugucauaauuaccgugcacacaggugaccagcaucagguuggcaaugacacccaaggggugacugucgagaucacgccucaggcaucuacaguggaagcuguacuuccagaguauggaacccugggcuuggaaugcagcccgcgaacuggucuagauuucaacgagaugauucugcucaccaugaaaaauaaggccuggaugguucacagacagugguuuuucgaccugccccuuccuuggacauccggggcgaccacugagacaccaacguggaacaggaaagaacuguuggugaccuuuaagaaugcccaugccaagaagcaagaggucgugguccucggcucacaggaaggagcuaugcacacugcccugacaggcgcuaccgagauccagaacagugggggaacaagcaucuucgccggucacuuaaagugucggcugaaaauggauaagcuagaacucaaaggcaugucuuacgcaaugugccugaauacuuuugugcuuaagaaagagguuuccgagacccagcaugggacgauuuugauaaagguggaauacaagggagaggacgcccccuguaaaaucccuuucucaaccgaagauggccaagguaaggcucacaacgggcgucugauuacagcgaacccaguagucacuaaaaaggaggagcccgugaauaucgaagcagagccgccuuucggcgaaagcaacauaguuauuggaaucggcgacaaagcccucaagaucaauugguauaagaaagggaguucuauuggaaagauguuugaggcuaccgcccgcggugcaagaaggauggccauccugggcgauacagcuugggacuucggguccgugggaggcauucuuaacagccuggguaaaaugguccaucagauauuugggucggccuacacugcauuguucucuggcguguccuggaucaugaagauuggaaucggcguacuccugaccuggaucggguuaaauaguaaaaacacgucaaugagcuuuuccugcauugugauaggaaucauuacacuguaucuaggcgcgguuguccaggcugauauggguugugugaucaauuggaaggggaaggaacucaaaugcggaucuggcauuuucgugaccaacgagguccacacuuggacagagcaguacaaguuucaagccgacagccccaaacggcuggcaaccgccaucgcuggugccugggaaaauggcguuugugggauacgaucaacuacccgcauggagaaccuuuuguggaagcagaucgcaaaugaacugaacuauauucucugggagaauaacaucaaacugacaguggugguaggagauauuaucggcgucuuagaacaggggaagagaacgcugaccccacagccuauggagcuuaaauacaguuggaagacuuggggaaaggcuaggauagugacagccgagacccaaaauuccagcuucauuaucgacggccccaacacaccagaaugccccucugcgucacgggccuggaacguuugggagguggaagacuaugguuuuggggucuucacuaccaauauuugguugaaacuccgcgagguguacacgcagaguugugaucauagacugaugagcgcugcaaucaaggacgaaagggccguucacgcugauaugggauacuggauagagucccagaaaaacggcucuuggaagcuagagaaagccucguuuaucgaagugaagacaugcaccuggccuaagagccacacucugugguccaaugguguacucgagucagacaugauuaucccaaaaagucuggcaggcccgauuucucagcauaaccaccgucccggguaucauacccaaacagcgggaccuuggcaccuuggcaaguuggaacuggauuucaauuacugcgaggggacuaccgucgugaucacagagaacuguggaacgcggggccccagcuuacgaaccacuacaguguccgguaaacucauacacgaauggugcuguagaucaugcacccugcccccucuuagguauaugggggaggacggauguugguacggcauggaaauucgcccaaucaaugagaaggaagagaacauggucaaaagccugguuucugccgguuccggcaagguggauaauuuuacuauggggguauugugccucgcuauccuguucgaggaagugaugcggggaaaguucggcaaaaagcauaugauugccgggguccuauuuacauucgugcugcuccugaguggacagaucaccuggagagacauggcacacacgcuuauuaugauaggcagcaacgcuucugauaggauggguauggggguuacuuauuuggcccugaucgcaaccuuuaaaauucagcccuucuuagcccucggauuuuuccugcgcaaacuuacaucccgagagaaucugcuacucggcgugggccuggcuauggcgaccacuuugcaacugccggaagacaucgagcagauggccaacgggauugcauuaggacucaugacacugaaacuuaucacccaguuugaaacauaccagcuguggacugcuuuggucucacucaccuguaguaauacgauauucacacugaccguggccuggcggacugccacccuaauccuggcugguguuagccuucucccucugugccaaucguccucuaugcguaagacagauugguugccaaugacuguggcagccaugggcguaccaccucugcccuuauuuauuuucagccucaaggacaccccaaaaagaaggucauggccucugaacgaggggguaauggcggugggacuuguuaguauccuggcuuccucuuugcuccgcaaugaugugcccauggccggcccacuggucgcgggugggcuacugauugccuguuaugugaucacgggaacaagcgcugaccuuaccguagagaaggcagccgacgugacuugggaagaggaagcggagcagacaggcgucucccauaaccucaugauaaccguugaugacgauggcacuaugcggauuaaagacgaugaaacagagaacauccugaccguguuguuaaagacggcucugcucaucgugucagggauuuuuccguacagcauaccugccacucugcuugucuggcacaccuggcagaaacagacacaaagaaguggagugcugugggacguucccucuccacccgagacccagaaggcagaauuggaggaagguguauacaggaucaaacagcagggcauuuucgggaagacacaagugggagucggcgugcagaaggaggguguuuuucauacuauguggcacgugacccgaggggccguccuaacgcacaauggaaaacgccuggagccuaacugggcuuccgugaagaaagaucucaucagcuauggcggcggguggcggcugucggcccaguggcaaaagggagaagagguacaggucauugcaguggaaccagguaaaaaucccaagaacuuccagacaaugccuggcaucuuccagacuaccacaggggagauaggagcuaucgcccuugacuuuaagccgggcaccucagguucuccaauuaucaauagagaagggaaaguugugggauuauacggcaacggcgucgugacuaagaaugggggauauguuagugguauugcgcaaaccaacgccgagcccgauggcccuacaccagagcuggaagaggaaauguucaaaaagaggaaucucacgaucauggacuugcaucccggguccggaaaaacucguaaguaccugccugcaauagugcgcgaggcuauuaagcggagacucaggacccugauccuugccccgacacgagucguggcugcagaaauggaggaggcccugaaaggcuugcccauccgguaucagaccacugccacaaagagcgaacacaccggucgcgagauuguagaucuaaugugccaugcuacguuuacuaugagacugcucucuccagugaggguuccuaacuacaauuuagucaucauggacgaagcgcacuucacagaucccgcaagcauagccgcucggggguauauuuccacccgagugggaaugggcgaggccgcagccaucuuuaugaccgcuacuccaccuggcacagcggaagccuucccccagucaaacgcaccaauucaggacgaggagagagacaucccggaacgcaguuggaauagcgggaacgaguggauaaccgauuuugugggaaaaacagucugguucguaccuucuauuaaggcugguaaugacaucgccaacugucugaggaaaaacggcaagaaggugauccaacuuucccguaaaacuuuugauacggaauaccagaagacccggcugaaugacugggauuucguugugacaacugacauuucagagaugggggcaaacuuuaaagccgauagagucaucgaccccaggcgcugccucaagccagugauuuugaccgauggacccgagcgaguuauacuggcuggcccuaugccagugacagccgcgagugcagcccagagacgggguagggucgggcgcaauccccagaaagaaaacgaccaauacaucuucaccggccagccucucaauaacgaugaggaccaugcucacuggacugaagccaagaugcugcuugacaauauuaacacgccggagggaaucaucccagcucuauucgaacccgagcgugaaaagagcgcagccauugauggcgaauauagacugaaaggggagucccggaagaccuuuuuggaauuaaugaggcgcggagaccugccuguguggcucgcucacaaaguagccucugaggguauaaaguacacagaucgaaaauggugcuucgacggcgaaagaaauaaccagauccuggaggagaauauggauguggaaauuuggacuaaggagggggaacggaagaaacuuaggccccgcuggcuggacgcaagaaccuauucggauccacucgcguugaaagaguuuaaagacuucgccgcuggaagaaagagcaucgcccuggaucuaguuacagaaauuggccgggucccuucacaucuggcacaccguacccgcuccgcucucgacaaccuugugaugcugcauacaagugagcacggugggcgagccuacagacacgcaguggaggaauuacccgagacaauggaaacguugcugcuccugggccuuaugauccugcucaccggaggcgccauguuguuucugauaucugggaaaggaaucgguaagacuagcauuggcuuaaucugugucauuguuuccucagggaugcuauggauggcugaugugccacugcaguggaucgcgucugccauaguacucgaguucuuuaugauggugcuucugauuccugagccggaaaaacaaaggacaccccaggacaaucaguuggcauaugucgugaucggcauucugacccucgcugccaucguugccgcaaacgagaugggccugcuugaaaccacaaagcgggaucucgguaugagcaaggagccagggguggucaguccuacuuccuaccuggacguagacuugcaucccgcuagcgccuggacgcuguaugcgguggcuaccacaguuauaacuccaauguuacgccacaccaucgaaaauucuacagccaacgugucacuagcagccauugcuaaucaagcagucgugcugaugggccucgauaaaggauggccuaucuccaagauggaccuuggcgucccccuguuggcccuggggugcuacagucaggugaacccgcucacccugacugcggcuguucuuuuacuggugacgcauuacgccauuaucggaccaggccuccaggcaaaagccacaagagaggcucagaagaggaccgccgcagguauaaugaaaaacccuacuguagaugggauuaugaccaucgacuuggaucccgugaucuaugacagcaaguucgagaagcaacugggacaggucaugcuacugguucucugugcugugcagcuucuguugaugcggacaucgugggcccugugcgaagcgcucacucuggccaccggcccaauuacaacguuaugggaggguucucccggcaaauuuuggaauaccacuaucgcagucuccauggcuaacauauuccgagggagcuaccuugccggagcaggccuggcuuuuucaauuaugaagaguguggggacaggaagacgcggcaccgguucucagggggaaacucucggagagaaauggaagaaaaagcuaaaucaacuguccaggaaggaguucgauuuguauaaaaagagcggcaucacagagguagaccggaccgaggccaaagaaggucugaagcguggcgagacgacccaccaugccgugucaagagggagugcgaaacuccagugguuuguugaaaggaacauggugauuccugagggacgcgucaucgaucuuggcugugggcggggaggcuggagcuacuauugcgcuggucugaagaaagugacagaaguccgaggguacacuaagggaggcccgggccacgaggagcccgugccaauguccaccuauggguggaauauaguuaaguugaugucuggaaaagacguauucuaccugccucccgaaaagugugauacacucuuaugcgacaucggugagagcuccccuucaccaacuguggaagagucuagaaccauuaggguccugaaaaugguggagcccuggcuucgcaacaaucaguucuguaucaagguucugaacccuuacaugccaacagugauugaacaccuagagcggcuccagagaaaauauggcgggaugcugguccguaaucccuugaguaggaacucgacccaugaaauguacuggaucagcaauggaacuggcaacauuguguccucuguaaauauggugucacggcugcuccuuaaccgcuuuacgaugacacaccgaagaccgaccaucgagaaggauguugaccugggugcagggacuaggcaugucaaugccgaaccugagaccccaaacauggacgugauaggagagcggauuaagcgcaucaaagaagaacacagcuccacauggcacuaugaugacgaaaaccccuacaagacgugggcuuaucauggcaguuacgaggugaaagccaccggcucugcaagcucaaugaucaauggggucguuaaguuacugacuaaaccuugggaugugguaccaauggugacacaaauggccaugaccgacacuacacccuucggacagcagagagucuuuaaggaaaagguggauaccaggacaccgcgaccuaugcccgguacucggaaaguuauggagauuaccgcugagugguuguggcguacgcucggcagaaacaagaaaccacgccugugcaccagggaagaguucacaaagaaagugcggacuaaugcggccaugggggcagucuuuaccgaagagaaccaaugggacaaugcuagagccgcaguggaagaugaggaguucuggaagcuaguagaccgcgaaagggagcuucacaagcugggaaaauguggcuccugcauauauaacaugauggguaagcgagagaagaagcucggggaguuuggaaaagccaagggcagucgggcuaucugguacauguggcugggcgccagauacuuggaguucgaagcgcugggguuucucaaugaggaucauugguucagcagggaaaacucuuauuccggaguugagggugaaggccuucacaaacugggguacauuuuacgcgacaucucaaagauuccuggaggcgcaauguaugccgaugacacagcugguugggacacucguaucaccgaggaugaccugcauaaugaggaaaagauaacgcagcagauggaucccgagcaccggcaguuggccaacgcaaucuuuaaacucacauaccaaaauaagguggucaaagugcagagaccaacccccaaggggacugugauggacauuaucagcaggaaagaucagcgcggaucgggccaggucggcacauaugggcugaacaccuucacuaauauggaagcucagcuaguucgacagauggagggagaaggugugcuuucuaaggccgaccuggagaacccucaccuccuggagaagaaaauuacccagugguuggaaacaaagggcguagaucgguuaaaaagaauggcuaucaguggggacgauugcguggucaagccaauagacgauagguuugccaaugcacugcucgcgcuuaacgacaugggaaaagugcgcaaggauauuccgcaguggcaacccuccaagggcuggcaugacuggcagcagguuccuuucuguagccaccauuuccacgagcugaucaugaaagacgguagaaagcuaguggucccaugccggccccaggaugaacugaucgggagggcccguauuucacaaggagcuggcuggucccucaaagagacggccuguuugggcaaggcauacgcucagauguggucucugauguauuuucaccgacgcgaccuuagacuggccagcaacgcaauaugcagugccgugccuguacauuggaucccaaccucccggacuacauggagcauucacgcgcaucaccaguggaugaccacugaagauaugcucacaguuuggaauaggguguggaucgaggacaaccccuggauggaggauaaaaccccugucacgacaugggaagacgugccguacuuagggaagcgcgaggaucaaugguguggaucucugauugguuugaccucaagagcuacuugggcccagaauauccugaccgcaauacagcagguucggagucucaucggcgacgaagaguuccuugauuacaugccauccaugaagagguuucgaaaagaggaagagagcgaaggggccauuugguga

SEQ ID NO: 15221 - RNA, 9873 nt, Artificial Sequence
  derived and/or modified CDS sequence (opt3) from DENV-3__FJ639712__SS-prME
accagccugugccucaugaugauguuccccgcaacacuugcuuuucaccugacuuccagagacggagaaccuaggaugaucguggggaagaacgaacggggaaaaucuuuguuauucaagacggcaucagguauuaauauguguacccugauagccauggaucucggcgaaaugugcgacgauacagucacuuacaaauguccacucaucgcggaaguugagccggaagacauugauugcugguguaaccugaccaguacaugggugaccuaugggacuugcaaucaggcuggagagcaucgccgagacaagcguagcguagcccuugcaccccacgugggcaugggucuggauacaagaacccaaacguggauguccgccgagggggcuuggaggcaggucgaaaaaguggagacuugggcauugcggcauccuggauuuaccauccucgcccuguuccuggcucacuacauuggcacaucucucacucagaagguugugaucuuuauauuacugaugcuugucaccccaucgaugacaaugcgcugugugggcguagggaacagagacuucguugaaggauugucaggugccaccuggguggaugucgugcuggagcauggcgggugcgugacgacuauggcgaaaagcaaacccacacuggacaucgagcuccagaagaccgaagcaacucaacuggccacacuuaggaaacuguguauugagggaaagaucaccaauauuacgaccgauagucggugcccuacacagggcgaagcuacuuugccagaggaacaggaccagaacuaugucuguaaacacaccuacguugaucgcgguugggggaauggaugcggccucuuuggcaaggggucccuggugacaugcgccaaguuccaauguuuagagcccaucgagggaaaaguagugcaguaugaaaaccugaaguacacugucauaauuaccgugcacacaggugaccagcaucagguuggcaaugacacccaaggggugacugucgagaucacgccucaggcaucuacaguggaagcuguacucccagaguauggaacccuuggccuggaaugcagcccgcgaacugguuuggauuuuaacgagaugauucuacugaccaugaaaaauaaggccuggaugguucacagacagugguucuuugaccucccccugccuuggacauccggggcgaccacugagacaccaacguggaacaggaaagaacuucuggugaccuucaagaaugcccaugccaaaaagcaagaggucguggucuugggcucacaggaaggagcuaugcacacugcccucacaggcgcuaccgagauccagaacagugggggaacaagcaucuuugccggucaccugaagugucgguuaaaaauggauaagcuggaacuaaaaggcaugucuuacgcaaugugccucaauacuuucgugcugaagaaagagguuuccgagacccagcaugggacgauucuuauaaagguggaauacaagggagaggacgcccccuguaaaaucccuuucucaaccgaagauggccaagguaaggcucacagcgggcguuugauuacagcgaacccaguagucacuaaaaaggaggagcccgugaacaucgaagcagagccgccuuuuggcgaaaguaauauaguuauuggaaucggcgacaaagcccugaagaucaacugguauaagaaagggucuuccauuggaaagauguucgaggcuaccgcccgcggugcaagaaggauggccauccucggcgauacagcuugggacuuugggagcgugggaggcguccuaaauucgcuugguaaaauggugcaucagauuuucgggucugccuacacugcacuguuuuccggcguaucaugggugaugaagauaggaaucggcguuuugcucaccuggauugggcugaacaguaaaaauacgagcauguccuucucuugcaucgucaucggaauuauaacauuauaucugggcgcgguggugcaggcugauauggguugugucaucaacuggaaggggaaggaacuaaaaugcggaagcggcauuuuuguuaccaaugaggugcacacuuggacagagcaguacaaguuccaagccgacucacccaaacggcucgcaaccgccaucgcuggugccugggaaaacggcgugugugggauucgaaguacuacccgcauggagaaucugcuuuggaagcagaucgcaaacgaauugaauuauauacugugggagaacaauaucaaacucacaguagucgugggagauauuaucggcguucuggaacaggggaagagaacguuaaccccacagccuauggagcugaaauacuccuggaagacuuggggaaaggcuaaaauugugacagccgagacccaaaacagcucuuuuaucauagacggccccaauacaccagaaugccccucagcgaguagggccuggaacgucugggagguggaagacuaugguuucgggguuuuuacuaccaacauuuggcuuaaguugcgggagguguacacgcagagcugugaucaucgccucauguccgcugcaaucaaagacgaaagagccguacacgcugauaugggauacuggauugagucucagaagaauggcucguggaaacuggagaaggccagcuucaucgaagucaagacaugcaccuggccuaaaucccacacucuauggucaaacggugugcuggagagugacaugauaaucccaaagucucucgcaggcccgauuagccagcauaaucacaggcccggguaucauacccaaacagcgggaccuuggcaccugggcaaacuugaauuggauuuuaacuacugcgaggggacuaccguggucaucacagagaauuguggaacgcguggcccaucccugcggaccacuacaguuucagguaaguuaauucacgaauggugcugucgaagcugcacccuacccccucugagauauaugggggaggacggauguugguacggcauggaaaucaggccaauaaacgagaaagaagagaauauggugaagucucuuguauccgccgguaguggcaagguggauaacuucacuauggggguccugugcuuggcuauucucuucgaggaagugaugcgcggaaaauuuggcaagaaacauaugaucgccgggguucuguucacauuugugcuacugcucagcggacagaucaccuggcgggacauggcacacacgcugauuaugaucggcucuaaugcuuccgauagaauggguaugggggucacuuaucuugccuugauugcaaccuucaagauacagcccuuucuggccuuaggauucuuucucaggaaacugacaucacgcgagaaccuucugcuaggcgugggccucgcuauggcgaccacucugcaauugccggaagacaucgagcagauggccaaugggauugcacugggauuaaugacacucaagcugaucacccaguucgaaacauaccagcuuuggacugcucugguuaguuugaccuguagcaacacgauuuuuacacucaccguggccuggcgaacugccacccugauccuagcuggugucucgcugcuuccucucugccaauccucuagcaugcggaagacagauuggcugccaaugacuguagcagccaugggcgugcccccuuugccccuguucauauuuucauuaaaagacaccccaaagcguagaaguuggccucucaaugaggggguuauggcggugggacuggucuccauccuugcuucuagccuguugaggaacgaugugcccauggccggcccacucguagccggugggcugcuaauugccuguuaugugaucacgggaacauccgcugaccugaccgucgagaaagcagccgacguuacuugggaagaggaagcggagcagacaggcgugucacauaaucuuaugauuaccguggaugacgauggcacuaugcgcaucaaggacgaugaaacagagaacauacucaccguccuguugaaaacggcuuuacugauugugagcgggaucuucccguacaguaucccugccacucuccugguuuggcacaccuggcagaagcagacacaacggucuggaguacuuugggacgugcccuccccacccgagacccagaaagcagaacuggaggaaggugucuacagaauuaagcagcagggcauauuugggaagacacaagugggaguuggcgugcagaaagagggugucuuccauacuauguggcacgugacccgaggggcaguauugacgcacaacggaaagaggcuagagccuaauugggcuagcgucaaaaaggaucugaucucguauggcggcggguggcgccucaacgcccaguggcaaaaaggagaagaggugcagguuauugcaguggaaccagguaagaaucccaagaacuuccagacaaugccuggcaucuuucagacuaccacaggggagauuggagcuaucgcccuggacuucaaaccgggcaccucagguucuccaauaaucaaucgggaagggaaggucgugggacuuuacggcaacggcguugugacuaaaaaugggggauaugucagugguauugcgcaaaccaacgccgagcccgauggcccuacaccagaguuagaagaggaaauguuuaagaaaagaaaucugacgaucauggaccuccaucccggguccggaaagacuaggaaguacuugccugcaauugugcgugaggcuaucaaacgccggcugagaacccucauacuggccccgacaaggguaguggcugcagaaauggaggaggcccuuaagggccugcccauucgauaucagaccacugccacaaaaagcgaacacaccggucgggagaucguugauuugaugugccaugcuacguucacuaugcgccuacugucuccagucagagugccuaacuacaaucucgugaucauggacgaagcgcacuuuacagaucccgcaagcauugccgcuaggggguauaucuccacccgggucggaaugggcgaggccgcagccauauucaugaccgcuacuccaccuggcacagcggaagccuuuccccagucaaacgcaccaauucaggacgaggagcgagacaucccggaaagaaguuggaauagcgggaacgaguggauuaccgauuucguaggaaagacagugugguuuguuccuucuaucaaagcugguaaugacauagccaacuguuuacgcaagaacggcaagaaagugauucaacuguccaggaagacuuucgauacggaauaccagaaaacccgucuuaaugagugggacuuugucgugacaacugauaucucagagaugggggcaaacuucaaggccgaccggguuaucgaucccagaaggugccugaaaccagugauucucaccgacggacccgaacgcgucaucuuggcuggcccuaugccagugacagccgcgagugcagcccagcgaagaggucggguagggaggaauccccagaaggagaacgaucaauacauuuucaccggccagccucugaauaacgacgaagaucaugcucacuggacugaggccaagaugcuccuggacaauauaaacacgccggaaggaaucauuccagcucuuuuugagcccgagcgcgagaaaagcgcagccaucgacggcgaguaucgucuaaagggggaauccagaaaaaccuucguggagcugaugcggaggggagauuugccuguuugguuagcucacaaggucgccucugaagguaucaaauacgcagaccgcaaguggugcuuugauggcgagcgaaauaaccagauucuggaggaaaauauggacguggagauauggacaaaagaaggggagagaaagaagcuccggcccagguggcuggaugcgcgcacuuauucggacccacuugcccugaaagaguucaaggauuuugcugccggaagaaaaagcaucgcacucgacuuggugaccgagauuggcagggucccuucacaucuggcucaccggacacguaacgcccuagauaaucugguuaugcuccauaccuccgagcacggugggcgcgcauaccgacacgccguggaagaacuucccgaaacuauggagacacuguuauugcugggccucaugauccugcuuacgggaggcgcuaugcuguuccucauuagugggaagggaaucgguaaaaccucuauaggcuugaucuguguaauugugagcuccgggaugcuguggauggcggacgucccauuacaguggaucgccucagcaauugugcuagaguuuuucaugaugguucugcucaucccugaaccggagaagcaaagaacuccccaggauaaccagcuugcuuauguggucauaggcauucugacauuggccgccaucguagcagcuaaugaaaugggccugcucgagaccaccaagagggaccuggguaugucuaaagaaccaggggugguuagcccuacaaguuaccuugauguggaccuccaucccgccuccgcguggacucuguaugcugucgccacgaccgugauuacaccaauguugcggcacacuaucgagaacagcaccgcaaaugucucucuggccgcuauagcaaaccaagccgugguuuuaaugggccuagacaagggauggccuaucucaaaaauggaucugggcgugccccuccuugcgcuggggugcuacucccagguaaacccguugacacugaccgcugccgugcuccugcuugucacucauuacgcaauuaucggaccaggcuuacaggccaaggcuacgcgcgaggcccagaaaagaacagcagcugguauuaugaagaauccuaccguugacgggaucaugacuauagaucuggaccccgugauuuaugauaguaaguuugaaaaacaacucggacaggucauguugcuggugcuaugugccguacagcugcuccuuaugaggaccagcugggcgcugugcgaggccuugacacuggcaacuggcccaaucaccacacucugggaagguucgcccggcaaguucuggaacacgaccaucgcugugucuauggccaauauuuuucggggguccuaccuggcaggagcuggcuuagccuucagcaucaugaaaucaguugggacuggacgaagaggcacagguagucagggggagacccuuggagaaaaguggaaaaagaagcugaaccaacucucucgcaaagaguuugaccuauauaagaaauccggcauaacugagguggauaggacagaagccaaggagggucugaaacggggcgaaaccacgcaccaugcggucagccgugggucagcuaaguugcagugguucguggagagaaauauggucauuccugaaggaagggugaucgaccugggcugugggcgcggaggcuggaguuacuauugcgcaggucucaaaaagguuaccgagguacggggguacacaaagggaggcccgggccacgaggaacccgugccaaugagcacuuauggguggaacauugucaaacuuauguccggaaaggauguguucuaccugccucccgagaaaugugacaccuugcugugcgauaucggugaaucuagcccuuccccaacaguugaggagucacgaacuauaagagugcucaagauggucgaacccugguuaaggaauaaccaguuuuguaucaaagugcugaauccuuacaugccaaccguaauugagcaccuugaacgccugcagcggaaguauggcgggaugcuagugagaaacccccucucucguaauaguacacaugagauguacuggaucucgaacggaaccggcaauauuguuagcuccgucaacauggugucuaggcuguugcugaaucgguucacuaugacgcaccgccgaccgacaaucgaaaaggacguggaucucggugccgggaccagacaugucaacgcugagccugagacuccaaacauggacguuauuggagaaaggaucaaacggauaaaggaggaacacucaagcaccuggcacuaugacgaugagaaucccuacaaaacaugggccuaucauggcuccuacgaagugaaggcaacgggcagugccucuagcaugauuaacgggguagugaaacuucugaccaagccuugggacgucgugccaaugguuacucaaauggcuaugacagauaccacucccuuuggacagcagcgcguguucaaggagaaagucgacacaagaaccccgaggccuaugcccgguacacgaaaggugauggagaucacugcggaaugguuauggcggacccugggccguaauaaaaagccaagauugugcacgcgcgaggaauuuaccaaaaagguaaggacaaacgccgcaaugggggcuguuuucacugaggaaaaucaaugggauucagcccgggcagccguggaggacgaggaauuuuggaagcucgucgauagagagcgcgaacugcacaaacuaggaaaguguggcuccugcguguauaacaugauggguaaaagggagaagaaacuuggggaguucggaaaggcuaaaggcagucgagccaucugguacauguggcugggcgcgcgguaccucgaauuugaggcacugggguucuugaaugaagaccauugguuuagcagagagaacucuuauuccggaguggaaggugagggccugcacaagcucggguacauucuuagggauauaucaaagaucccuggaggcgccauguaugcugacgauaccgccgguugggacacacgcauuacugaggacgaucugcauaaugaagagaaaaucacccagcagauggaccccgaacaccgucaguuagcaaacgcuauuuucaagcugacguaccaaaauaaagucguuaaggugcagcggccaacacccaaagggaccguaauggauaucauaagcagaaaggaccagaggggaucgggccaggugggcacuuauggguugaacacauuuaccaauauggaggcccaacucguccgccagauggaaggagagggugugcugucuaaggcugaucuagagaacccucaccuucuggagaaaaagaucacucaguggcucgagaccaaaggcguugaacgacugaagcggauggccauuaguggggacgauugcguggucaaaccaaucgacgauagauucgcaaaugcguuguuagcccugaacgacaugggaaaggugaggaaggauauuccgcaguggcaacccuccaaaggcuggcaugacuggcagcagguaccuuucuguagccaccauuuucacgagcucaucaugaaggauggucgcaaacuuguugugccaugcagaccccaggacgaacugauagggcgggcuaggauuucacaaggagccggcuggucccuaaaggagacagcaugucugggcaaggcuuacgcccagauguggucucucauguauuuccaccgucgagacuugcgccuggcaagcaacgccaucugcagugcggucccugugcauuggaucccaacguccagaaccacuuggagcauucacgcucaucaccaguggaugacaaccgaggauaugcuuacuguuuggaaucggguguggauagaagacaaccccuggauggaggauaagacaccugucaccacgugggaagacgugccguaccuggggaagagggaggaucaaugguguggaucucucaucgguuuaacaucacgcgccaccugggcacagaauauucugacugccauccagcagguaagaaguuugauuggcgacgaggaauuucuggauuacaugccauccaugaaacgguucaggaaggaggaagagagcgaaggggcuaucugguga

SEQ ID NO: 15222 - RNA, 9873 nt, Artificial Sequence
  derived and/or modified CDS sequence (opt3) from DENV-3__FJ639713__SS-prME
accagccugugccucaugaugaugcuucccgcaacacuggcuuuccacuugacuuccagggacggcgaaccuaggaugaucguggggaagaacgaacggggaaaaucuuuacuguuuaagacggcaucagguauuaauauguguacccuaauagccauggaucucggcgagaugugcgacgauacaguaacuuacaaauguccacugaucgcggaaguugagccggaagacauugauugcugguguaaccuuaccaguacaugggugaccuaugggacuugcaaucaggcuggagagcaucgccgagacaagcguagcguagcccuggcaccccacgugggcauggguuuggauacaagaacccagacguggauguccgccgagggggcuuggaggcaggucgaaaaaguggagacuugggcacuccggcauccuggauucaccauccuggcccuguuucucgcucacuacauuggcacaucuuuaacucagaagguugugaucuucauacugcuuauguuggucaccccaucgaugacaaugcgcugugugggcguagggaacagagacuuuguugaaggacugucaggugccaccuggguggaugucgugcuagagcauggcgggugcgugacgacuauggcaaagagcaaacccacacucgacaucgagcugcagaagaccgaagcaacucagcuugccacacugaggaaauuguguauugagggaaagaucaccaauauuacgaccgauagucggugcccuacacagggcgaagcuacucucccagaggaacaggaccagaacuaugucuguaaacacaccuacguugaucgcgguugggggaauggaugcggccuguucggcaagggguccuuagugacaugcgccaaguuucaaugucuggagcccaucgagggaaaaguagugcaguaugaaaaccucaaguacacugucauaauuaccgugcacacaggugaccagcaucagguuggcaaugacacccaaggggugacugucgagaucacgccucaggcaucuacaguggaagcuguacuuccagaguauggaacccugggcuuggaaugcagcccgcgaacuggucuagauuucaacgagaugauucugcucaccaugaaaaauaaggccuggaugguucacagacagugguuuuucgaccugccccuuccuuggacauccggggcgaccacugagacaccaacguggaacaggaaagaacuguuggugaccuuuaagaaugcccaugccaagaagcaagaggucgugguccucggcucacaggaaggagcuaugcacacugcccugacaggcgcuaccgagauccagaacagugggggaacaagcaucuucgccggucacuuaaagugucggcugaaaauggauaagcuagaacucaaaggcaugucuuacgcaaugugccugaauacuuuugugcuuaagaaagagguuuccgagacccagcaugggacgauuuugauaaagguggaauacaagggagaggacgcccccuguaaaaucccuuucucaaccgaagauggccaagguaaggcucacaacgggcgucugauuacagcgaacccaguagucacuaaaaaggaggagcccgugaauaucgaagcagagccgccuuucggcgaaagcaacauaguuauuggaaucggcgacaaagcccucaagaucaauugguauaagaaagggaguucuauuggaaagauguuugaggcuaccgcccgcggugcaagaaggauggccauccugggcgauacagcuugggacuucggguccgugggaggcguccuuaacagccuggguaaaauggugcaucagauuuuugggucggccuacacugcauuguucucuggcguauccuggauaaugaagaucggaauuggcgugcuccugaccuggaucggguuaaauaguaaaaacacgucaaugagcuuuuccugcaucguuauuggaauaaucacacuguaucuaggcgcggucgugcaggcugauauggguugugugauuaauuggaaggggaaggaacucaaaugcggaaacggcaucuucgucaccaaugagguucacacuuggacagagcaguacaaguuucaagccgacucucccaaacggcuggcaaccgccauugcuggugccugggaaaacggcgugugugggauccgaagcacuacccgcauggagaaucuuuuguggaagcagauagcaaacgaacugaauuauauccucugggagaacaauauuaaacugacagugguagucggagauaucauuggcguguuagaacaggggaagagaacgcugaccccacagccuauggagcuuaaauacucauggaagacuuggggaaaggcuaaaaucguuacagccgagacccaaaacaguuccuucauaauugacggccccaacacaccagaaugccccagcgcgucuagggccuggaaugugugggaggucgaagacuaugguuuugggguguucacuaccaacaucugguugaagcuccgggagguuuacacgcagucaugugaucaucgccugaugagugcugcaauuaaagacgaaagagccgugcacgcugauaugggauacuggaucgagagccagaagaauggcuccuggaaacuagagaaggccucuuuuauagaaguaaagacaugcaccuggccuaaaucgcacacucuguggagcaacgguguccucgaguccgacaugaucauuccaaagucacuggcaggcccgaucagucagcauaaucacaggcccggguaucauacccaaacagcgggaccuuggcaccuuggcaaauuggaacuggauuucaacuacugcgaggggacuaccguggugauugccgagaauuguggaacacguggcccaucuuuacggacgaccacugucagcgguaagcucauccacgaauggugcugucgauccugcacacugcccccucuuagauauaugggggaggacggauguugguacggcauggaaauaaggccaauuaacgagaaagaagagaauaugguuaagucacuggugagcgcugguucuggcaagguagauaacuuuaccauggggguguugugccucgccauccuguucgaggaagucaugcgcggaaaauucggcaagaaacauaugaucgcaggggugcuauuuacuuucguucugcuccuguccggacagauuacauggcgggacauggcucacacccuuaucaugauuggcaguaaugccagcgauagaauggguaugggggugacguauuuggcacugauagccacuuuuaagauccagcccuucuuagcucucggauuuuuccugaggaaacuuaccucucgcgagaaccugcuacucggcgucggccuggcgauggccacaaccuugcaacugccggaagacauugagcagauggcaaaugggaucgcuuuaggacucaugacucugaaacuuauuacacaguuugaaaccuaccagcuguggacagccuuggugucccucacuuguucaaacaccaucuucacgcugacaguugccuggcgaaccgcuacucuaauacuggcgggugugagucuucucccucugugccaaagcucguccaugcggaagaccgauugguugccaaugacagucgccgcgaugggcguacccccucugcccuuauuuaucuucucucucaaagacacuccaaagcguagaagcuggccucugaaugagggggugauggcuguuggacuugugucaauucuggccaguuccuugcucaggaacgauguccccauggcaggcccacugguggccggugggcuacugaucgcuuguuauguaauuaccggaacgucugcagaccuuacaguggagaaagccgcggacgucaccugggaagaggaagcugagcagacuggcguuagccauaaccucaugaucacaguggaugacgauggcaccaugcgcauaaaggacgaugaaacugagaauauucugacaguguuguuaaaaaccgcccugcucaucgucuccgggaucuuuccguacucaauuccugcaacgcugcuuguguggcacacuuggcagaagcagacccaacggagcggaguucugugggacguacccaguccacccgagacacagaaagccgaauuggaggaagguguguacagaauaaagcagcagggcaucuucgggaagacccaagucggagugggcguucagaaagaggguguguuucauacaauguggcacgucacuagaggggcugugcuaacccacaacggaaagcgacuggagccuaauugggccucugucaagaaggaucucauuuccuauggcggcggguggcgccugagcgcacaguggcaaaaaggagaagagguccaggugaucgcuguugaaccagguaagaaccccaagaauuuccagacgaugccuggcauuuuccagacaacuaccggggagaucggagccauagcgcuugacuuuaaaccgggcacaucggguucaccaaucauuaaccgggaagggaagguggucggauuauacggcaauggcgugguuaccaaaaacgggggauaugugucugguaucgcccaaacuaaugcagagcccgauggcccuaccccagagcuggaagaggaaauguucaagaaaagaaaccucacaauuauggacuugcaucccgggaguggaaagacgaggaaguaccugccugcuaucguccgugaggccauaaaacgccggcucagaacucugauucuugcuccgaccagggugguagcagccgaaauggaggaggcccugaagggcuugcccauccgauaucagacaaccgcuacuaaauccgaacacacaggucgggagaucguggaucuaaugugccaugcgaccuuuacgaugcgccugcucagcccaguuagagucccuaauuacaacuuagugauuauggacgaagcacacuucacugaucccgccucuaucgcugccaggggguauauaagcacacgggugggaaugggcgaggcagccgcuauuuuuaugaccgcgaccccaccuggcacugccgaagcauucccccaguccaaugcuccaauccaggacgaggagcgagacauuccggaaagaucauggaacagugggaaugaguggaucacagauuuugucggaaagaccguaugguucgugccuagcauaaaagccgguaacgacauugcaaacugucugcgcaagaauggcaagaaaguuauccaacuuucuaggaagacauuugauacugaauaccagaaaacgcgucugaacgacugggauuucguggucaccacagacaucuccgagaugggggccaauuuuaaggcugaucgggugauugaccccagaaggugccucaaaccaguuaucuugacugauggacccgagcgcgugauucuggccggcccuaugccagucaccgcggcaucagccgcucagcgaagaggucggguggggaggaacccccagaaggaaaaugaccaauacauauucacaggccagccucucaacaaugaugaggaccaugcccacuggaccgaagcuaagaugcugcuugacaacaucaauacuccggagggaauuaucccagcacuauucgaacccgagcgcgagaaaagugccgcuaucgauggcgaauaucgucugaagggggagagcagaaaaacguuuguagaauugaugcggaggggagacuuaccuguguggcuggcccacaagguugcauccgaggguauuaaauacaccgaucgcaaguggugcuucgacggcgaacgaaacaaucagauacucgaggagaacauggaugucgaaaucuggacaaaagagggggaaagaaagaagcugcggcccagguggcuugacgcgcgcacuuauucugauccacuggcccucaaagaguuuaaggacuucgcugccggaagaaaaucgauugcauuggaucuggugaccgaaaucggcagggugccuagccaucuagcucaccggacacguaaugcccuggacaaccucgucaugcuucauaccucagagcacggugggcgcgcauaccgacacgccguugaggaacugcccgagacuauggaaacauuauugcugcucggccugaugauucuucugacgggaggcgcuaugcucuuuuugaucuccgggaagggaauagguaaaaccaguaucggccugauuugugugaucguaucuagcgggauguuauggauggcggaugugccacuacaguggauugccuccgcaaucguccuggaguucuuuaugauggugcuccuuauaccugagccggaaaagcaaagaacuccccaggacaaucagcuggcuuauguugugauuggaaucuugacacuggccgccauugucgcagcuaacgagaugggccuccuggaaaccaccaagagggaucuugguaugucaaaagagccagggguagugucuccuacaagcuaccucgacguugaccugcaucccgccagugcguggacuuuguaugcuguggccacgaccgucaucacaccaaugcugcggcacacuauagaaaauuccaccgcaaacgugagcuuagccgcuaucgcaaaccaagccgucgugcuaaugggccuggauaagggauggccuauuucuaaaauggaccucggcguuccccuucuggcguuggggugcuacucacaggugaauccgcugacacucaccgcugccguacugcuuuuagugacucauuacgcaaucauuggaccaggccugcaggccaaggcuacgcgcgaggcccagaaaagaacagcagcugguaucaugaagaacccuaccgucgaugggauaaugacuauugaccucgaucccguuaucuaugacuccaaguucgagaaacaauugggacaggugaugcugcuaguccugugugccgugcagcuccuucugaugaggaccaguugggcguugugcgaagcccugacacucgcaacuggcccaaucaccacacugugggaggguagccccggcaaguuuuggaauacgaccauugcuguaucgauggccaacaucuuccgggggucuuacuuagcaggagcuggccuugccuuuuccauaaugaaaagcguggggacuggacgaagaggcacagguucacagggggaaacccugggagagaaguggaaaaagaagcucaaucaacuaagucgcaaagaguucgaucuguauaagaaaucuggcauuacugagguugacagguccgaggccaaggaagguuugaaacggggcgagacaacccaccaugcggugagccgugggucagcuaagcugcagugguuugucgaaagaaacauggugaucccugagggaagggucauugaucucggcugugggcgcggaggcuggaguuacuauugcgcaggucuuaaaaaggugacggaaguucggggguacaccaagggaggcccgggccacgaggagcccguaccaaugagcacauauggguggaauaucgugaaacugauguccggaaaggacgucuucuacuugccucccgaaaaaugugauacucugcucugcgacauaggugagucuagcccuuccccaaccguggaagagucacgaacaaucagaguuuuaaagaugguggagcccuggcugaggaacaaucaguucuguauuaaaguccuuaacccuuacaugccaacugugaucgaacaccuggagcgccuacagcggaagcauggcgggaugcucguaagaaauccccugucucguaacaguacccacgaaauguauuggauuucgaauggaacaggcaacaucgugagcuccguuaauauggucucuagguugcugcucaaccgguuuaccaugacucaucgccgaccgacgauugagaaggauguggaccuuggugccgggacaagacacgugaacgcugaaccugagaccccaaauauggacgucaucggagagaggauaaaacggauuaaggaagaacacucaagcacuuggcauuacgaugacgaaaaccccuauaaaaccugggccuaccacggcuccuaugagguuaaggcaacaggcagugccucuagcaugaucaauggggugguaaaacuguuaacgaagccuugggauguggucccaauggugacccaaauggcuaugacugacacaacccccuucggacagcagcgcguuuuuaaggaaaaaguggauacuagaacaccgaggccuaugcccgguacccgaaaggucauggagaucacagcggaguggcuguggcggacuuugggccguaacaaaaagccaagacucugcacccgcgaagaguucacgaaaaaggugaggaccaaugccgcaaugggggcuguauuuacagaagagaaccaaugggacucagcccgggcagccguugaagaugaggaguucuggaagcugguggacaaagaaagagagcuacauaaacuuggaaaauguggcuccugcgucuacaauaugauggguaagcgcgagaagaagcugggggaguuuggaaaagcuaagggcaguagggccauuugguauauguggcucggcgcgcgauaccuggaguucgaagcauugggguuucugaacgaggaucacugguucagccgggaaaauucuuacuccggaguggagggugaaggccuccauaaacuuggguauauacugagagacaucucaaaaauuccuggaggcgccauguacgcugaugacacugccgguugggacaccaggaucacagaggaugacuuacacaacgaggaaaagauuacucagcagauggaucccgagcaccgccagcuggcaaaugcuaucuuuaaauugaccuaucaaaacaagguggucaaaguucagcguccaacgcccaaggggacagugauggacauaaucagccggaaggaucagagaggaucgggccagguaggcaccuacgggcucaauacuuucacaaacauggaagcccaacuggugaggcagauggagggagaagguguccuaucuaaagcugaccuugagaauccucaucugcucgagaagaaaauuauccaguggcuggaaaccaagggcguggagcgcuugaaacgaauggccauuaguggggaugacugcguugugaagccaaucgaugaccgguuugcaaacgcguuacuggcccucaacgauaugggaaaggucagaaaagacauaccgcaguggcaacccuccaagggcuggcacgauuggcaacaggugccuuucuguagccaucacuuccacgaacuuauuaugaaagacgguaggaagcugguaguuccaugccgcccccaggacgagcuaaucgggagagcucggaucucacaaggagccggcuggucccugaaagaaacugcaugucucggcaaggcuuaugcccagauguggucuuugauguacuuucauaggcgugaucugcgacuugcaagcaaugccauuugcagugcggugccuguccacuggauaccaaccucccgcacaacguggagcauccaugcucaccaucaguggaugaccacugaggacaugcugucuguguggaacagaguuuggauugaggauaaucccuggauggaagacaagacaccugugaccacuugggaggaugucccguaucucgggaaacgggaagaccaaugguguggaucauuaaucggucugacaaguagggccaccugggcacagaacauuuugacggccauccaacaggugcgcucccugauaggcgaugaggaguuccucgacuacaugccaagcaugaagagauuucggaaagaagaggaaucugagggggcuaucugguga

SEQ ID NO: 15223 - RNA, 9873 nt, Artificial Sequence
  derived and/or modified CDS sequence (opt3) from DENV-3__FJ639714__SS-prME
accagccugugccucaugaugaugcuuccagcaacacuggcuuuccacuugacuuccagagacggcgaaccuaggaugaucguggggaagaacgaacggggaaaaucuuuacuguuuaagacggcaucagguauuaauauguguacccuaauagccauggaucucggcgagaugugcgacgauacaguaacuuacaaauguccacugaucgcggaaguugagccggaagacauugauugcugguguaaccuuaccaguacaugggugaccuaugggacuugcaaucaggcuggagagcaccgccgagacaagcguagcguagcccuggcaccccacgugggcauggguuuggauacaagaacccaaacguggauguccgccgagggggcuuggaggcaggucgaaaaaguggagacuugggcacuccggcauccuggauucaccauccuggcccuguuucucgcucacuacauuggcacaucuuuaacucagaagguugugaucuucauacugcuuauguuggucaccccaucgaugacaaugcgcugugugggcguagggaacagagacuuuguugaaggacugucaggugccaccuggguggaugucgugcuagagcauggcgggugcgugacgacuauggcaaagagcaaacccacacucgacaucgagcugcagaagaccgaagcaacucaacuugccacacugaggaaauuguguauugagggaaagaucaccaauauuacgaccgauagucggugcccuacacagggcgaagcuacucucccagaggaacaggaccagaacuaugucuguaaacacaccuacguugaucgcgguugggggaauggaugcggccuguucggcaagggguccuuagugacaugcgccaaguuucaaugucuggagcccaucgagggaaaaguagugcaguaugaaaaccucaaguacacugucauaauuaccgugcacacaggugaccagcaucagguuggcaaugacacccaaggggugacugucgagaucacgccucaggcaucuacaguggaagcuguacuuccagaguauggaacccugggcuuggaaugcagcccgcgaacuggucuagauuucaacgagaugauucugcucaccaugaaaaauaaggccuggaugguucacagacagugguuuuucgaccugccccuuccuuggacauccggggcgaccacugagacaccaacguggaacaggaaagaacuguuggugaccuuuaagaaugcccaugccaagaagcaagaggucgugguccucggcucacaggaaggagcuaugcacacugcccugacaggcgcuaccgagauccagaacagugggggaacaagcaucuucgccggucacuuaaagugucggcugaaaauggauaagcuagaacucaaaggcaugucuuacgcaaugugccugaauacuuuugugcuuaagaaagagguuuccgagacccagcaugggacgauuuugauaaagguggaauacaagggagaggacgcccccuguaaaaucccuuucucaaccgaagauggccaagguaaggcucacaacgggcgucugauuacagcgaacccaguagucacuaaaaaggaggagcccgugaauaucgaagcagagccgccuuucggcgaaagcaacauaguuauuggaaucggcgacaaagcccucaagaucaauugguauaagaaagggaguucuauuggaaagauguuugaggcuaccgcccgcggugcaagaaggauggccauccugggcgauacagcuugggacuucggguccgugggaggcguccuuaacagccuggguaaaauggugcaucagauuuuugggucggccuacacugcauuguucucuggcguauccuggauaaugaagaucggaauuggcgugcuccugaccuggaucggguuaaauucaaagaacacgaguaugagcuuuuccugcaucguuauuggaauaaucacacuguaucuaggcgcggucgugcaggcugauauggguugugugauuaauuggaaggggaaggaacucaaaugcggaaacggcaucuucgucaccaaugagguucacacuuggacagagcaguacaaguuucaagccgacucucccaaacggcuggcaaccgccauugcuggugccugggaaagcggcgugugugggauccgaucaacuacccgcauggagaaccuuuuguggaagcagauagcaaaugaacugaacuauauccucugggagaauaacauuaaacugacagugguagucggagauaucauuggcguguuagaacaggggaagagaacgcugaccccacagccuauggagcuuaaauacaguuggaagacuuggggaaaggcuaaaaucguuacagccgagacccaaaauuccagcuucauaauugacggccccaacacaccagaaugccccucugcgucaagggccuggaacgugugggaggucgaagacuaugguuuugggguguucacuaccaauaucugguugaagcuccgggagguuuacacgcagaguugugaucaucgccugaugagcgcugcaauuaaagacgaaagagccgugcacgcugauaugggauacuggaucgagucccagaagaacggcucuuggaaacuagagaaggccucguuuauagaaguaaagacaugcaccuggccuaaaagccacacucugugguccaaugguguccucgagucagacaugaucauuccaaagagucuggcaggcccgaucucucagcauaaccacaggcccggguaucauacccaaacagcgggaccuuggcaccuuggcaaauuggaacuggauuucaauuacugcgaggggacuaccguggugauugccgagaacuguggaacacguggccccagcuuacggacgaccacugucuccgguaagcucauccacgaauggugcugucgaucaugcacacugcccccucuuagauauaugggggaggacggauguugguacggcauggaaauaaggccaauuaaugagaaagaagagaacaugguuaagagccuggugucugcugguuccggcaagguagauaauuuuaccauggggguguugugccucgccauccuguucgaggaagucaugcgcggaaaauucggcaagaaacauaugaucgcaggggugcuauuuacuuucguucugcuccugaguggacagauuacauggcgggacauggcucacacccuuaucaugauuggcagcaacgccucugauagaauggguaugggggugacguauuuggcacugauagccacuuuuaagauccagcccuucuuagcucucggauuuuuccugaggaaacuuaccucccgcgagaaucugcuacucggcgucggccuggcgauggccacaaccuugcaacugccggaagacauugagcagauggcaaacgggaucgcuuuaggacucaugacucugaaacuuauuacacaguuugaaaccuaccagcuguggacagccuuggugucacucacuuguaguaauaccaucuucacgcugacaguugccuggcgaaccgcuacucuaauacuggcgggugugagccuucucccucugugccaaucguccucuaugcggaagaccgauugguugccaaugacagucgccgcgaugggcguacccccucugcccuuauuuaucuucagccucaaagacacuccaaagcguagaucauggccucugaacgagggggugauggcuguuggacuugugaguauucuggccuccucuuugcucaggaaugauguccccauggcaggcccacugguggccggugggcuacugaucgcuuguuauguaauuaccggaacgagcgcagaccuuacaguggagaaagccgcggacgucaccugggaagaggaagcugagcagacuggcguuucccauaaccucaugaucacaguggaugacgauggcaccaugcgcauaaaggacgaugaaacugagaacauucugacaguguuguuaaaaaccgcccugcucaucgucucagggaucuuuccguacagcauuccugcaacgcugcuuguguggcacacuuggcagaagcagacccaacggaguggaguucugugggacguacccucuccacccgagacacagaaagccgaauuggaggaagguguguacagaauaaagcagcagggcaucuucgggaagacccaagucggagugggcguucagaaagaggguguguuucauacaauguggcacgucacuagaggggcugugcuaacccacaauggaaagcgacuggagccuaacugggccuccgucaagaaggaucucauuagcuauggcggcggguggcgccugucggcacaguggcaaaaaggagaagagguccaggugaucgcuguugaaccagguaagaaucccaagaacuuccagacgaugccuggcauuuuccagacaacuaccggggagaucggagccauagcgcuugacuuuaaaccgggcacaucagguucuccaaucauuaaucgggaagggaagguggucggauuauacggcaacggcgugguuaccaaaaaugggggauaugugagugguaucgcccaaacuaacgcagagcccgauggcccuaccccagagcuggaagaggaaauguucaagaaaagaaaucucacaauuauggacuugcaucccggguccggaaagacgaggaaguaccugccugcuaucguccgugaggccauaaaacgccggcucagaacucugauucuugcuccgaccagggugguagcagccgaaauggaggaggcccugaagggcuugcccauccgauaucagacaaccgcuacuaaaagcgaacacacaggucgggagaucguggaucuaaugugccaugcgaccuuuacgaugcgccugcucucuccaguuagagucccuaacuacaauuuagugauuauggacgaagcacacuucacugaucccgccagcaucgcugccaggggguauauauccacacgggugggaaugggcgaggcagccgcuauuuuuaugaccgcgaccccaccuggcacugccgaagcauucccccagucaaacgcuccaauccaggacgaggagcgagacauuccggaaagaaguuggaauagcgggaacgaguggaucacagauuuugucggaaagaccguaugguucgugccuucuauaaaagccgguaaugacauugcaaacugucugcgcaagaacggcaagaaaguuauccaacuuuccaggaagacauuugauacugaauaccagaaaacgcgucugaaugacugggauuucguggucaccacagacaucucagagaugggggccaacuuuaaggcugaucgggugauugaccccagaaggugccucaaaccaguuaucuugacugauggacccgagcgcgugauucuggccggcccuaugccagucaccgcggcaagugccgcucagcgaagaggucggguggggaggaauccccagaaggaaaacgaccaauacauauucacaggccagccucucaauaacgaugaggaccaugcccacuggaccgaagcuaagaugcugcuugacaauaucaacacuccggagggaauuaucccagcacuauucgaacccgagcgcgagaaaagcgccgcuaucgauggcgaauaucgucugaagggggaguccagaaaaacguuuguagaauugaugcggaggggagacuuaccuguguggcuggcccacaagguugcaucugaggguauuaaauacaccgaucgcaaguggugcuucgacggcgaacgaaauaaccagauacucgaggagaauauggaugucgaaaucuggacaaaagagggggaaagaaagaagcugcggcccagguggcuugacgcgcgcacuuauucggauccacuggcccucaaagaguuuaaggacuucgcugccggaagaaaaagcauugcauuggaucuggugaccgaaaucggcagggugccuucacaucuagcucaccggacacguaacgcccuggacaaucucgucaugcuucauaccuccgagcacggugggcgcgcauaccgacacgccguugaggaacugcccgagacuauggaaacauuauugcugcucggccugaugauucuucugacgggaggcgcuaugcucuuuuugaucagugggaagggaauagguaaaaccucuaucggccugauuugugugaucguaagcuccgggauguuauggauggcggaugugccacuacaguggauugccucagcaaucguccuggaguucuuuaugauggugcuccuuauaccugagccggaaaagcaaagaacuccccaggacaaccagcuggcuuauguugugauuggaaucuugacacuggccgccauugucgcagcuaaugagaugggccuccuggaaaccaccaagagggaucuugguaugucuaaagagccagggguagugagcccuacaaguuaccucgacguugaccugcaucccgccuccgcguggacuuuguaugcuguggccacgaccaucauaacaccaaugcugcggcacacuaucgaaaacagcaccgcaaaugucucuuuagccgcuauugcaaaccaagccgugguccuaaugggccuggauaagggauggccuaucucaaaaauggaccucggcgugccccuucuggcguuggggugcuacucccagguuaacccgcugacacucaccgcugccgugcugcuuuuaguaacucauuacgcaauuaucggaccaggccugcaggccaaggcuacgcgcgaggcccagaaaagaacagcagcugguauaaugaagaauccuaccguggaugggauuaugacuaucgaccucgaucccgucaucuaugacaguaaguucgagaaacaauugggacagguuaugcugcuagugcugugugccguccagcuccuucugaugaggaccagcugggcguugugcgaagcccugacacucgcaacuggcccaauuaccacacugugggaggguucgcccggcaaguuuuggaacacgaccaucgcugugucuauggccaauauauuccggggguccuacuuagcaggagcuggccuugccuuuagcauuaugaaaucaguagggacuggacgaagaggcacagguagucagggggaaacccugggagagaaguggaaaaagaagcucaaccaacuaucucgcaaagaguucgaucuguauaagaaauccggcaucacugagguggacaggacagaggccaaggaagguuugaaacggggcgagaccacgcaccaugcgguuagccgugggucagcuaagcugcagugguuuguggaaagaaauauggucauuccugagggaagggugaucgaucucggcugugggcgcggaggcuggaguuacuauugcgcaggucuuaaaaaggucaccgaagugcggggguacacaaagggaggcccgggccacgaggagcccguuccaaugagcacuuauggguggaacauaguaaaacugauguccggaaaggacguguucuacuugccucccgaaaaaugugauacccugcucugcgacaucggugagucuagcccuuccccaacagucgaagagucacgaacuauuagaguguuaaagaugguugagcccuggcugaggaauaaccaguucuguaucaaagugcuuaauccuuacaugccaaccgucauugaacaccuggagcgccuacagcggaaguauggcgggaugcucgugagaaacccccugucucguaauaguacacaugaaauguacuggaucucgaacggaaccggcaauauuguaagcuccgugaacaugguuucuagguugcugcucaaucgguuuacuaugacgcaccgccgaccgacaaucgagaaggaugucgaccuuggugccgggaccagacaugugaacgcugaaccugagacuccaaacauggacgugauaggagagaggauuaaacggaucaaggaagaacacucaagcaccuggcacuaugaugacgaaaaucccuacaaaacaugggccuaucauggcuccuacgaggucaaggcaacgggcagugccucuagcaugaucaacgggguugugaaacuguuaaccaagccuugggauguagugccaauggucacucaaauggcuaugacagacaccacucccuucggacagcagcgcguguuuaaggaaaaaguugauacaagaaccccgaggccuaugcccgguacacgaaaggugauggagauuacugcggaguggcuguggcggaccuugggccguaauaaaaagccaagacucugcacgcgcgaagaguucaccaaaaaggucaggacaaacgccgcaaugggggcuguguuuacugaagagaaucaaugggacucagcccgggcagccguagaagaugaggaguucuggaagcugguugacaaagaaagagagcuacacaaacuuggaaaauguggcuccugcguguauaacaugauggguaagcgcgagaaaaagcugggggaguuuggaaaagcuaagggcaguagggccauaugguacauguggcucggcgcgcgauaccuggaguucgaagcauugggguuucugaaugaggaucauugguucagccgggaaaacucuuauuccggagucgagggugaaggccuccacaaacuuggguacauccugagagacauuucaaaaaucccuggaggcgccauguaugcugaugacaccgccgguugggacacaaggauuacugaggaugacuuacauaaugaggaaaagaucacccagcagauggaucccgggcaccgccagcuggcaaacgcuauauuuaaauugacguaccaaaauaagguggugaaaguccagcguccaacacccaagggaaccguuauggacaucauuagccggaaggaucagagaggcucgggccagguggggacuuauggacucaacacauucaccaauauggaggcccaacugguaaggcagauggaaggugagggcgugcuaucuaaagcugaccuugaaaacccucaucugcucgagaagaaaaucacucaguggcuggagaccaagggggucgaacgcuugaaacgaauggccauuaguggagaugacugcgugguuaagccaaucgaugaccgguuugcaaaugcguuacuggcccucaacgauaugggcaaggugagaaaagacauaccgcaguggcaacccuccaaggguuggcaugauuggcagcaggucccuuucuguagccaccauuuccacgagcuuauuaugaaagacgggaggaagcuggugguaccaugccgcccccaggacgaacuaaucggaagggcucggaucucacaaggcgccggcuggucccugaaagagacagcaugucucgggaaggcuuacgcccagauguggucuuugauguauuuucacaggcgugaucugcgacuugcaagcaacgccauuugcagugcgguuccugugcauuggauaccaacgucccgcaccacuuggagcauccacgcucaucaccaguggaugacaaccgaagacaugcugacugucuggaauagaguguggauugaggauaaccccuggauggaggacaagacaccuguuaccacgugggaagaugugccguaccucggaaaacgggaggaccaauggugugguucuuuaaucggccugacaucaagggccaccugggcacagaauauuuugacugccauccagcagguccgcagucugauaggggaugaagaguuccucgacuacaugccauccaugaagagauuucggaaagaggaagagaccgaaggagcuaucugguga

SEQ ID NO: 15224 - RNA, 9873 nt, Artificial Sequence
  derived and/or modified CDS sequence (opt3) from DENV-3__FJ639715__SS-prME
accagccugugccucaugaugaugcuucccgccacacuggcuuuccacuugacuuccagagacggcgagccuaggaugaucguggggaagaacgaacggggaaaaucuuuacuguuuaagacggcaucagguauuaauauguguacccuaauagccauggaucucggcgagaugugcgacgauacagucacuuacaaauguccacugaucgcggaaguugagccggaagacauugauugcugguguaaccuuaccaguacaugggugaccuaugggacuugcaaucaggcuggagagcaucgccgagacaagcguagcguagcccuggcaccccacgugggcauggguuuggauacaagaacccaaacguggauguccgccgagggggcuuggaggcaggucgaaaaaguggagacuugggcacuccggcauccuggauucaccauccuggcccuguuucucgcucacuacauuggcacaucuuuaacucagaagguugugaucuucauacugcuuauguuggucaccccaucgaugacaaugcgcugugugggcguagggaacagagacuuuguugaaggacugucaggugccaccuggguggaugucgugcuagagcauggcgggugcgugacgacuauggcgaagagcaaacccacacucgacaucgagcugcagaagaccgaagcaacucaacuugccacacugaggaaauuguguauugagggaaagaucaccaauauuacgaccgauagucggugcccuacacagggcgaagcuacucucccagaggaacaggaccagaacuaugucuguaaacacaccuacguugaucgcgguugggggaauggaugcggccuguucggcaagggguccuuagugacaugcgccaaguuucaaugucuggagcccaucgagggaaaaguagugcaguaugaaaaccucaaguacacugucauaauuaccgugcacacaggugaccagcaucagguuggcaaugacacccaaggggugacugucgagaucacgccucaggcaucuacaguggaagcuguacuuccagaguauggaacccugggcuuggaaugcagcccgcgaacuggucuagauuucaacgagaugauucugcucaccaugaaaaauaaggccuggaugguucacagacagugguuuuucgaccugccccuuccuuggacauccggggcgaccacugagacaccaacguggaacaggaaagaacuguuggugaccuuuaagaaugcccaugcaaaaaagcaagaggucgugguccucggcucacaggaaggagcuaugcacacugcccugacaggcgcuaccgagauccagaacagugggggaacaaauaucuucgccggucacuuaaagugucggcugaaaauggauaagcuagaacucaaaggcaugagcuacgcaaugugccugaacacuuuugugcuuaagaaagagguuucugagacccagcaugggacgauuuugauaaagguggaauacaagggagaggacgcccccuguaaaaucccuuucuccaccgaagauggccaagguaaggcucacaacgggcgucugauuacagcgaauccaguagucacuaaaaaggaggagcccaucaacauagaagcagagccgccuuucggcgaaucaaauauugugaucggaaucggcgacaaagcccucaagauuaacugguauaagaaagggagcaguaucggaaagauguuugaggcuaccgcccgcggugcaagaaggauggccauucugggcgauacagcuugggacuucgggucuguuggaggcgugcuuaauucccuggguaaaaugguccaucagauauuugggagcgccuacacugcauuguucucgggcgugucuuggaucaugaagauuggaaucggcguacuccugaccuggaucggguuaaacuccaaaaauacgucaaugaguuuuagcugcauugugauaggaaucauuacacuguaucuaggcgcgguuguccaggcugauauggguugugugaucaacuggaaggggaaggaacucaaaugcggaaauggcauuuucgugaccaacgagguccacacuuggacagagcaguacaaguuucaagccgacucccccaaacggcuggcaaccgccaucgcuggugccugggaaaauggcguuugugggauacgaucuacuacccgcauggagaaccuuuuguggaagcagaucgcaaaugaacugaacuauauucucugggagaauaacaucaaacugacaguggugguaggagauauuaucggcgucuuagaacaggggaagagaacgcugaccccacagccuauggagcuuaaauacagcuggaagacuuggggaaaggcuaaaauagugacagccgagacccaaaacucaaguuucauuaucgacggccccaauacaccagaaugccccuccgcgagcagggccuggaacguuugggagguggaagacuaugguuuuggggucuucacuaccaauauuugguugaagcuccgggagguguacacgcagucuugugaucaucgccugaugucagcugcaaucaaagacgaaagagccguucacgcugauaugggauacuggauagagagucagaagaacggcagcuggaaacuagagaaggccuccuuuaucgaagugaagacaugcaccuggccuaaaucucacacucuguggucgaaugguguacucgagagcgacaugauuaucccaaagucccuggcaggcccgauuucacagcauaaccacaggcccggguaucauacccaaacagcgggaccuuggcaccuuggcaaauuggaacuggauuucaauuacugcgaggggacuaccgucgugaucgccgagaacuguggaacacguggcccaaguuuacggacgaccacugugucugguaagcucauacacgaauggugcugucgaagcugcacacugcccccucuuagauauaugggggaggacggauguugguacggcauggaaauuaggccaaucaaugagaaagaagagaacauggucaagucccugguuucagcugguagcggcaagguggauaauuuuaccauggggguauugugccucgccauccuguucgaggaagugaugcgcggaaaauucggcaagaaacauaugauugcagggguccuauuuacuuucgugcugcuccugucuggacagaucacauggcgggacauggcucacacccuuauuaugauaggcuccaacgccagugauagaauggguauggggguuacguauuuggcacugaucgccacuuuuaagauucagcccuucuuagcucucggauuuuuccugaggaaacuuaccagccgcgagaaucugcuacucggcgugggccuggcgauggccacaaccuugcaacugccggaagacaucgagcagauggcaaacgggauugcuuuaggacucaugacucugaagcuuaucacacaguuugaaaccuaccagcuguggacagccuuggucucucucacuuguuccaauaccauauucacgcugacaguggccuggcgaaccgcuacucuaauccuggcagguguuucacuucucccucugugccaaaguagcucgaugcggaagaccgauugguugccaaugacaguggccgcgaugggcguccccccucugcccuuauuuauuuucucccucaaagacacuccaaagcguaaaucuuggccucugaacgaggggguaauggcugugggacuuguuagcauccuggccucaaguuugcucagaaacgaugugcccauggcaggcccacuggucgccggugggcuacugauugcuuguuaugugaucaccggaacguccgcagaccuuacaguagagaaggccgcggacgugaccugggaagaggaagcugagcagacuggcgucucucauaaucucaugauaacaguugaugacgauggcaccaugaggauuaaagacgaugaaacugagaacauccugacaguguuguuaaagaccgcccugcucaucgugagcgggauuuuuccguacuccauaccugcaacgcugcuugucuggcacacuuggcagaaacagacccaacgcucaggagugcugugggacguucccagcccacccgagacacagaaggccgaauuggaggaagguguauaccggaucaagcagcagggcauuuucgggaaaacccaagugggagucggcgugcagaaggaggguguuuuucauacaauguggcacgugacuagaggggcuguccuaacccacaauggaaaaaggcuggagccuaacugggccagugugaagaaagaucucaucucuuauggcggcggguggcgacuguccgcacaguggcaaaagggagaagagguacaggucauugcuguggaaccagguaagaaucccaaaaacuuccagacgaugccuggcaucuuccagacaacuaccggggagauaggagccaucgcgcuugacuuuaagccgggcacaagcgguucgccaauuaucaaucgcgaagggaaaguugugggauuauacggcaacggcgucgugaccaagaaugggggauauguuucagguauugcccaaacuaacgcagagcccgauggcccuaccccagagcuggaagaggaaauguucaaaaagcggaaucucacaaucauggacuugcaucccgggucuggaaagacgagaaaauaccugccugcuauagugagggaggccauuaagcgucgccuccggacucugauccuugcuccgaccagagucguggcagccgaaauggaggaggcccugaaaggcuugcccaucagguaucagacaaccgcuacuaagagugaacacacaggucgagagauuguagaucuaaugugccaugcgaccuuuacgaugcggcugcucuccccagugcgcguuccuaacuacaauuuaaucauaauggacgaagcacacuucacugaucccgccagcauugcugccagaggguauaucucuacaagggucggaaugggcgaggcagccgcuauuuuuaugaccgcgaccccaccuggcacugccgaagcauucccccagagcaacgcuccaauccaggacgaggagcgggacauaccggaacgauccuggaauucagggaacgaguggauuacagauuuugugggaaaaaccgugugguucgucccuaguaucaaggccgguaacgacaucgcaaauugucugagaaagaacggcaaaaagguaauucaacuuagccgcaaaacauuugauacugaauaccagaagacgaggcugaaugacugggauuucgugguuaccacagacaucucugagaugggggccaacuuuaaagcugaucgugugauugacccccggagaugccucaagccagucauauugacugauggacccgagagggugauccuggccggcccuaugccaguuaccgcggcauccgccgcucagcgccgagguagaguggggcggaauccccagaaggaaaacgaccaauacauuuucacaggccagccucucaauaacgaugaggaccaugcccacuggaccgaagcuaaaaugcugcuugacaauaucaacacuccggagggaaucauuccagcacuauucgaacccgagagggagaagucagccgcuauagauggcgaauaucgccugaaaggggagagucguaagacguuugucgaauugaugagacggggagacuuaccuguguggcuggcccacaaaguagcaagcgaggguaucaaguacaccgauaggaaauggugcuucgacggcgaacgcaauaaccagauucucgaggagaauauggauguggaaaucuggacaaaggagggggaacgaaagaaacugagaccccgguggcuugacgcgaggacuuauuccgauccacuggcccucaaggaguuuaaagacuucgcugccggacgcaagucuauugcauuggaucugguuaccgaaaucggcagagucccuucgcaucuagcucacaggacacggaacgcccuggacaaucucgugaugcuucauaccagcgagcacggugggcgugcauaccgccacgccguggaggaacugcccgagacuauggaaacauuauugcugcucggccugaugauacuucugacgggaggcgcuaugcucuuuuugaucucagggaaaggaauugguaagaccuccaucggccugauuugugucaucguuaguucugggauguuauggauggcggaugugccacuacaguggauagccagcgcaauuguacuggaguucuuuaugauggugcuccuuaucccugagccggaaaagcaacgaacuccccaggacaaccagcuggcuuaugucgugauuggaaucuugacacuggccgccauaguugcagcuaaugagaugggccuccuggaaaccaccaaaagagaucuugguauguccaaggagccagggguggucucaccuacaucuuaccucgacguagaccugcaucccgccagcgcguggacuuuguaugcuguggccacgaccguuaucacaccaaugcugaggcacacuauugaaaacaguaccgcaaacguguccuuagccgcuaucgcaaaucaagccgucgugcuaaugggccuggauaaaggauggccuauuagcaagauggaccucggcgucccccuucuggcguuggggugcuacucucaggugaacccgcugacacucaccgcugccguucugcuuuuagugacucauuacgcaaucauaggaccaggccugcaggccaaagcuacgcgggaggcccagaagcgcacagcagcugguauuaugaagaauccuaccguagaugggaucaugacuaucgaccucgaucccgugauuuaugacucaaaauucgagaagcaauugggacaggucaugcugcuaguucugugugccgugcagcuccuucugaugagaaccuccugggcguugugcgaagcccugacacucgcaacuggcccaaucaccacacugugggaggguagucccggcaaauuuuggaacacgaccauagcugucagcauggccaauauuuucagggggucguacuuagcaggagcuggccuugccuuuucuaucaugaaguccguggggacuggacggcgaggcacagguagccagggggaaacccugggagagaaauggaagaagaaacucaaccaacuaucaagaaaggaauucgaucuguauaaaaagaguggcauuacugagguagaccgcacagaggccaaagaagguuugaagaggggcgagaccacgcaccaugcggugucucggggguccgcuaaacugcagugguuuguugaacguaauauggugaucccugagggaagagucauagaucucggcugugggaggggaggcuggagcuacuauugcgcaggucuuaagaaggugaccgaaguccgcggguacacaaaaggaggcccgggccacgaggagcccgugccaaugucaacuuauggguggaacaucguuaagcugaugaguggaaaagacguauucuacuugccucccgaaaagugugauacccugcucugcgacauuggugagagcuccccuucuccaacaguggaagagagccggacuauccgagucuuaaaaaugguggagcccuggcugagaaauaaccaguucuguauuaagguucuuaauccuuacaugccaaacgugaucgaacaccuggagaggcuacagcgcaaguauggcgggaugcucguccggaauccccuguccagaaacucaacccaugaaauguacuggauuucuaauggaacaggcaacaucgugaguucgguaaacauggugagccguuugcugcucaauagguuuaccaugacucaccggcgcccgacgauagagaaagauguugaccuuggugccgggacacgacaugucaacgcugaaccugagaccccaaauauggacgugauuggagagagaaucaagaggaucaaagaagagcacuccucuacuuggcacuaugaugacgaaaaccccuacaagaccugggccuaucauggcucauacgaggugaaagcaacaggcagcgccuccaguaugauuaauggggucguuaagcuguuaacgaagccuugggaugugguaccaauggugacccaaauggcuaugacugacacaacccccuucggacagcagcgggucuuuaaagaaaagguggauacucgcacaccgagaccuaugcccgguaccaggaaaguuauggagauaacagcggaguggcuguggcgaacuuugggccggaacaagaaaccacgucucugcaccagagaagaguucacgaagaaggugcgcaccaaugccgcaaugggggcugucuuuacagaagagaaccaaugggacucugccagggcagccguggaagaugaggaguucuggaaacugguagacaaggaacgggagcuacacaaacuuggaaaguguggcagcugcguuuauaauaugauggguaaaagagaaaagaaacugggggaguuuggaaaggcuaagggcucacgcgccaucugguacauguggcucggcgcgagguaccuggaguucgaagcauugggguuucugaacgaggaucauugguucucccgagaaaauaguuauagcggaguggagggugaaggccuccacaaacuuggguacauucugcgggacaucucuaagauuccuggaggcgccauguaugcugaugacacugccgguugggacaccagaaucacagaggaugacuuacauaacgaggaaaaaauaacucagcagauggaucccgagcacaggcagcuggcaaaugcuaucuuuaaguugaccuaccaaaacaaagucgugaaggugcagcgcccaacgcccaaggggacagucauggacauuaucucccguaaagaucagcggggaucaggccagguuggcaccuaugggcucaauacuuucacaaacauggaagcccaacuggugagacagauggagggagaagguguacuaagcgaggcugaccuugagaacccucaccugcucgaaaagaaaauuacccaguggcuggagacuaagggcguggaaagguugaaacgcauggccaucucgggggaugacugcgucgugaagccaauagaugaccgauuugcaaaugcguuacuggcccucaacgauaugggaaagguucggaaagacauuccgcaguggcaacccucuaagggcuggcaugauuggcagcaggugccuuucuguagucaccauuuccacgagcuuaucaugaaagacgguagaaagcuggucgugccaugcaggccccaggacgaacuaaucgggcgcgcuagaauuucccaaggagccggcuggagccugaaagagaccgcaugucucggcaaggcuuacgcccagauguggucauugauguauuuucaccggagggaucugcgucuugcauccaaugccauaugcucugcgguaccuguucauuggaucccaacaagccgaacgaccuggaguauucacgcucaucaccaguggaugacuacagaggacaugcugaccguguggaaccgcgucuggaucgaagauaaucccuggauggaggacaagacuccugugacaaccugggaagauguuccguaccucgggaaaagagaggaccaaugguguggauccuuaauuggucugacgagccgggccacaugggcacagaacaucuugaccgccauacagcaggugaggucucugaucggcgaugaggaauuccucgacuacaugccaucaaugaagcgcuuuagaaaagaggaagagagugaaggggcuauuugguga

SEQ ID NO: 15225 - RNA, 9873 nt, Artificial Sequence
  derived and/or modified CDS sequence (opt3) from DENV-3__KF955461__SS-prME
accagccugugccucaugaugaugcuucccgccacacuggcuuuccacuugacuuccagagacggcgagccuaggaugaucguggggaagaacgaacggggaaaaucuuuacuguuuaagacggcaucagguauuaauauguguacccuaauagccauggaucucggcgagaugugcgacgauacagucacuuacaaauguccacugaucgcggaaguugagccggaagacauugauugcugguguaaccuuaccaguacaugggugaccuaugggacuugcaaucaggcuggagagcaucgccgagacaagcguagcguagcccuggcaccccacgugggcauggguuuggauacaagaacccaaacguggauguccgccgagggggcuuggaggcaggucgaaaaaguggagacuugggcacuccggcauccuggauucaccauccuggcccuguuucucgcucacuacauuggcacaucuuuaacucagaagguugugaucuucauacugcuuauguuggucaccccaucgaugacaaugcgcugugugggcguagggaacagagacuuuguugaaggacugucaggugccaccuggguggaugucgugcuagagcauggcgggugcgugacgacuauggcgaagaauaaacccacacucgacaucgagcugcagaagaccgaagcaacucaacuugccacacugaggaaauuguguauugagggaaagaucaccaacauuacgaccgauagccggugcccuacacagggcgaagcuacucucccagaggaacaggaccagaauuaugucuguaaacacaccuacguugaucgcgguugggggaacggaugcggccuguucggcaaggggaguuuagugacaugcgccaaguuucaaugucuggagcccaucgagggaaaaguagugcaguaugaaaaucucaaguacacugucauaauuaccgugcacacaggugaccagcaucagguuggcaacgacacccaaggggugacugucgagaucacgccucaggcauccacaguggaagcuguacuuccagaguauggaacccugggcuuggaaugcucuccgcgaacuggucuagauuucaaugagaugauucugcucaccaugaaaaacaaggccuggaugguucacagacagugguuuuucgaccugccccuuccuuggacaagcggggcgaccacugagacaccaacguggaauaggaaagaacuguuggugaccuuuaagaacgcccaugcaaaaaagcaagaggucgugguccucggcucccaggaaggagcuaugcacacugcccugacaggcgcuaccgagauccagaauucagggggaacaaguaucuucgccggucacuuaaagugucggcugaaaauggauaagcuagaacucaaaggcaugagcuacgcaaugugccugaacacuuuugugcuuaagaaagagguuucugagacccagcaugggacgauuuugauaaagguggaauacaagggagaggacgcccccuguaaaaucccuuucuccaccgaagauggccaagguaaggcucacaacgggcgucugauuacagcgaauccaguagucacuaaaaaggaggagcccgugaacaucgaagcagagccgccuuucggcgaaucaaauauaguuauuggaaucggcgacaaagcccucaagaucaacugguauaagaaagggagcaguauuggaaagauguuugaggcuaccgcccgcggugcaagaaggauggccauccugggcgauacagcuugggacuucgggucugugggaggcguccuuaauucccuggguaaaauggugcaucagguauuugggagcgccuacacugcauuguucucgggcgugucuuggauuaugaagauaggaaucggcguucuccugaccuggauuggguuaaacuccaaaaauacgucaaugaguuuuagcugcaucgucaucggaauuauaacacuguaucuaggcgcgguggugcaggcugauauggguugugucaucaacuggaaggggaaggaacucaaaugcggauccggcauuuucguuaccaaugaggugcacacuuggacagagcaguacaaguuucaagccgacucucccaaacggcuggcaaccgccaucgcuggugccugggaaaacggcgugugugggauucgaagcacuacccgcauggagaaucuuuuguggaagcagaucgcaaacgaacugaauuauauacucugggagaacaauaucaaacugacaguagucgugggagauauuaucggcguuuuagaacaggggaagagaacgcugaccccacagccuauggagcuuaaauacucauggaagacuuggggaaaggcuaaaauugugacagccgagacccaaaacaguuccuucaucauagacggccccaacacaccagaaugccccagcgcgucuagggccuggaaugucugggagguggaagacuaugguuuugggguuuucacuaccaacauuugguugaagcuccgggagguguacacgcagucaugugaucaucgccugaugagugcugcaaucaaagacgaaagagccguacacgcugauaugggauacuggauugagagccagaagaauggcuccuggaaacuagagaaggccucuuuuaucgaagucaagacaugcaccuggccuaaaucgcacacucuguggagcaacggugugcucgaguccgacaugauaaucccaaagucacuggcaggcccgauuagucagcauaaucacaggcccggguaucauacccaaacagcgggaccuuggcaccuuggcaaauuggaacuggauuucaacuacugcgaggggacuaccguggccaucacagagaauuguggaacgcguggcccaucuuuacggaccacuacagucagcgguaagcucauucacgaauggugcugucgauccugcacccugcccccucuuagauauaugggggaggacggauguugguacggcauggaaaucaggccaauaaacgagaaagaagagaauaugguuaagucacuggugagcgcugguucuggcaagguagauaacuuuacuauggggguguugugccucgccauucuguucgaggaagucaugcgcggaaaauucggcaagaaacauaugaucgcaggggugcuauuuacauucguucugcuccuguccggacagaucaccuggcgggacauggcucacacgcuuauuaugaucggcaguaaugccagcgauagaauggguaugggggugacuuauuuggcacugauugccaccuuuaagauacagcccuucuuagcucucggauuuuuccugaggaaacuuacaucucgcgagaaccugcuacucggcgucggccuggcgauggccaccacuuugcaacugccggaagacaucgagcagauggcaaaugggauugcuuuaggacucaugacacugaagcuuaucacccaguuugaaacauaccagcuguggacugccuuggugucccucaccuguucaaacacgauuuucacacugaccguugccuggcgaacugcuacccuaauccuggcaggugugagucuucucccucugugccaaagcucguccaugcggaagacagauugguugccaaugacugucgccgcgaugggcguacccccucugcccuuauuuauauucucucucaaagacaccccaaagcguagaagcuggccucugaaugagggggugauggcuguuggacuugugucaauccuggccaguuccuugcucaggaacgauguccccauggcaggcccacugguggccggugggcuacugauugcuuguuauguaaucacgggaacaucugcagaccuuaccguggagaaagccgcggacgucacuugggaagaggaagcugagcagacaggcguuagccauaaccucaugauuaccguggaugacgauggcacuaugcgcaucaaggacgaugaaacagagaauauacugaccguguuguuaaaaacggcccugcucauugucuccgggaucuuuccguacucaaucccugcaacucugcuuguguggcacaccuggcagaagcagacacaacggagcggaguucugugggacguacccaguccacccgagacccagaaagccgaauuggaggaagguguguacagaauuaagcagcagggcauauucgggaagacacaagucggagugggcguucagaaagaggguguguuucauacuauguggcacgucaccaggggggcugugcuaacgcacaacggaaagcgacuggagccuaauugggccucuguaaaaaaggaucucaucuccuauggcggcggguggcgccugagcgcacaguggcaaaaaggagaagagguccaggugauugcuguugaaccagguaagaaccccaagaauuuccagacaaugccuggcaucuuccagacuaccacaggggagauuggagccaucgcgcuugacuuuaaaccgggcaccucggguucaccaauaaucaaccgggaagggaagguggucggauuauacggcaauggcgugguuacuaaaaacgggggauaugugucugguauugcccaaaccaaugcagagcccgauggcccuacaccagagcuggaagaggaaauguucaagaaaagaaaccucacgaucauggacuugcaucccgggaguggaaagacuaggaaguaccugccugcuauuguccgugaggccaucaaacgccggcucagaacccugauacuugcuccgacaagggugguagcagccgaaauggaggaggcccugaagggcuugcccauucgauaucagaccacugcuacaaaauccgaacacaccggucgggagaucguggaucuaaugugccaugcgacguuuacuaugcgccugcucagcccaguuagagucccuaauuacaacuuagugaucauggacgaagcacacuucacagaucccgccucuauugcugccaggggguauaucagcacccgggugggaaugggcgaggcagccgcuauauuuaugaccgcgacuccaccuggcacagccgaagcauucccccaguccaaugcuccaauucaggacgaggagcgagacaucccggaaagaucauggaacagugggaaugaguggauuaccgauuuugucggaaagacaguaugguucgugccuagcaucaaagccgguaacgacauagcaaacugucugcgcaagaauggcaagaaaguuauucaacuuucuaggaagacuuuugauacggaauaccagaaaacccgucugaacgacugggauuucguggucacaacugacaucuccgagaugggggccaauuuuaaggcugaucgggugaucgaccccagaaggugccucaaaccaguuauuuugaccgauggacccgagcgcgugauccuggccggcccuaugccagucacagcggcaucagccgcucagcgaagaggucggguggggaggaacccccagaaggaaaaugaccaauacauuuucaccggccagccucucaacaaugaugaggaccaugcccacuggacugaagcuaagaugcugcuugacaacauaaauacgccggagggaaucauuccagcacuauucgaacccgagcgcgagaaaagugccgcuaucgauggcgaauaucgucugaagggggagagcagaaaaaccuuuguagaauugaugcggaggggagacuuaccuguguggcuggcccacaagguugcauccgaggguaucaaauacacagaucgcaaguggugcuucgacggcgaacgaaacaaucagauucucgaggagaacauggaugucgaaauauggacuaaagagggggaaagaaagaagcugcggcccagguggcuugacgcgcgcaccuauucugauccacuggcccucaaagaguuuaaggacuucgcugccggaagaaaaucgaucgcauuggaucuggugacagaaauuggcagggugccuagccaucuagcucaccggacccguaaugcccuggacaaccucgucaugcuucauacuucagagcacggugggcgcgcauaccgacacgccguugaggaacugcccgagacaauggaaacguuauugcugcucggccugaugauccuucugaccggaggcgcuaugcucuuuuugauuuccgggaagggaaucgguaaaacuaguauaggccugaucugugugauuguaucuagcgggauguuauggauggcggaugugccacuacaguggaucgccuccgcaauuguccuggaguucuuuaugauggugcuccuuaucccugagccggaaaagcaaagaacaccccaggacaaucagcuggcuuauguugugauaggaauuuugacccuggccgccaucgucgcagcuaacgagaugggccuccuggaaaccacaaagagggaucuugguaugucaaaagagccagggguagugucuccuacuagcuaccucgacguugaccugcaucccgccagugcguggacguuguaugcuguggccaccacagucauuacuccaaugcugcggcacaccaucgaaaauuccacagcaaacgugagcuuagccgcuauagcaaaccaagccgucgugcuaaugggccuggauaagggauggccuaucucuaaaauggaccucggcguuccccuucuggcguuggggugcuacucacaggugaauccgcugacccucacugcugccguacugcuuuuagugacgcauuacgcaauuaucggaccaggccugcaggccaaggcuacacgcgaggcccagaaaagaaccgcagcugguauuaugaagaacccuacugucgaugggaucaugaccauagaccucgaucccguuauuuaugacuccaaguucgagaaacaauugggacaggugaugcugcuaguccugugugccgugcagcuccuucugaugaggacaaguugggcguugugcgaagcccugacucucgcaaccggcccaaucacaacgcugugggaggguagccccggcaaguuuuggaauaccacuaucgcuguaucgauggccaacauuuuccgggggucuuacuuagcaggagcuggccuugccuuuuccaucaugaaaagcguggggacaggacgaagaggcaccgguucacagggggaaacucugggagagaaguggaaaaagaagcucaaucaacuaagucgcaaagaauucgaucuguauaagaaaucuggcauaacagagguugacaggaccgaggccaaggaagguuugaaacggggcgagacgacccaccaugcggugucccgugggagcgcuaagcugcagugguuugucgaaagaaacauggugauuccugagggaagggucaucgaucucggcugugggcgcggaggcuggucauacuauugcgcaggucuuaaaaaggugacagaaguucggggguacacuaagggaggcccgggccacgaggagcccguaccaaugaguaccuauggguggaauauugugaaacugaugagcggaaaggacgucuucuacuugccucccgaaaaaugugauacacugcucugcgacaucggugaguccucuccuagcccaacuguggaagagucccgaaccauaagaguuuuaaagaugguggagcccuggcugaaaaacaaucaguucuguaucaagguccuuaacccuuacaugccaacagugauugaacaccuggagaggcuacagcgcaaguauggcgggaugcucguacggaauccccugucaagaaacucuacccaugaaauguacuggaucaguaauggaacuggcaacauugugucgagcguuaauauggucucccguuugcugcucaacagguuuacgaugacacaccggcgcccgaccaucgagaaagauguggaccuuggugccgggacucgacaugugaacgcugaaccugagaccccaaauauggacgucauuggagagagaaucaagaggauaaaagaagagcacucuucaacauggcacuaugaugacgaaaaccccuacaagacgugggccuaucauggcagcuacgagguuaaagcaaccggcuccgccaguucuaugauuaauggggugguaaagcuguuaacuaagccuugggauguggucccaauggugacacaaauggcuaugaccgacacuacacccuucggacagcagcggguuuuuaaagaaaagguggauacccgcacaccgagaccuaugcccgguacuaggaaagucauggagaucaccgcggaguggcuguggcgaacguugggccggaacaagaaaccacgucucugcaccagagaagaguucacaaagaaggugcgcacuaaugccgcaaugggggcuguauuuaccgaagagaaccaaugggacagcgccagggcagccguugaagaugaggaguucuggaaacugguggaccgggaaagagagcuacacaagcuuggaaaauguggcucaugcgucuauaauaugauggguaagcgcgaaaaaaagcugggggaguuuggaaaagcuaagggcuccagggccaucugguacauguggcucggcgcgcgauaccuggaguucgaagcauugggguuucugaacgaggaucauugguucagucgggaaaauagcuauucuggaguggagggugaaggccuccacaagcuuggguacauucugagagacauauccaaaaucccuggaggcgccauguaugcugaugacacagccgguugggacacuaggauuaccgaggaugacuuacauaacgaggaaaagaucacgcagcagauggaucccgagcaccgccagcuggcaaaugcuauuuuuaaauugacauaccaaaacaagguggucaaaguucagcguccaacccccaaggggacugugauggacaucauaucacggaaggaucagagaggaagcggccagguaggcacauaugggcucaauaccuucacuaacauggaagcccaacuggugaggcagauggagggagaagguguccuaucgaaagcugaccuugagaauccucaccagcuggagaagaaaaucacccaguggcucgaaacaaagggcguggagcgccugaaacgaauggccauuucuggggaugacugcguugugaagccaaucgaugaccgguuugcaaacgcguuguuagcccugaacgauaugggaaaggucagaaaagacauuccgcaauggcagcccaguaagggcuggcaugauuggcagcaggugccuuucuguucccaccauuuccacgaacucaucaugaaagacgguaggaagcuuguaguuccaugccgcccccaagacgagcugauagggagagcucggauuagccagggagccggcuggucacuaaaagaaacggcaugucugggcaaggcuuacgcccagauguggucccucauguauuuucacaggcgugauuugcgacuggcaucuaaugccaucugcagcgcggugccuguccauuggaucccaaccagucgcacuacaugguccauucacgcucaucaccaauggaugaccacugaggacaugcuuacaguguggaacagaguuuggauagaggauaaucccuggauggaagacaagaccccugugacgacaugggaggaugucccguaccuggggaaacgggaagaccagugguguggaagccucaucgguuuaaccucuagggccacuugggcacagaacauucugaccgccauccagcaagugcgcucauugauuggcgaugaggaguuccuggacuacaugccaaguaugaagagauuucggaaagaagaggaauccgagggggcuaucugguga

SEQ ID NO: 15226 - RNA, 9873 nt, Artificial Sequence
  derived and/or modified CDS sequence (opt3) from DENV-3__FJ639719__SS-prME
accagccugugccucaugaugaugcuucccgcaacacuggcuuuccacuugacuuccagagacggcgaaccuaggaugaucguggggaagaacgaacggggaaaaucuuuacuguuuaagacggcaaccgguauuaauauguguacacuaauagccauggaucucggcgagaugugcgacgauacuguaaccuacaaauguccacugaucgcggaaguugagccggaagacauugauugcugguguaaccuuacaucaaccugggugacuuaugggacaugcaaucaggcuggagagcaucgccgagacaagcguaguguagcccuggcaccccacgugggcauggguuuggauaccagaacgcagacuuggaugagcgccgagggggcuuggaggcaggucgaaaaaguggagaccugggcacuccggcauccuggauucacaauccuggcccuguuucucgcucacuacauuggcacuuccuuaauccagaagguugugauauucauccugcuuauguuggucaccccaucuaugacaaugcgcugugugggcguagggaacagagacuuuguugaaggacugucgggugccaccuggguggaugucgugcuagagcauggcgggugcgugacgacuauggcgaagaauaaacccacacucgacauugagcugcagaagaccgaagcaacucagcuugccacacugaggaaauuguguaucgagggaaagauuaccaacaucacgaccgauucacggugcccuacacagggcgaagcuauacucccagaggaacaggaccagaauuaugucuguaaacacacuuacguugaucgcgguugggggaacggaugcggccuguucggcaaggggagcuuagugaccugcgccaaguuucaaugucuggagcccauugagggaaaaguagugcaguaugaaaaucucaaguacacagucaucauuacugugcacaccggugaccagcaucagguuggcaacgacacacaaggggugaccgucgagaucacuccucaggcaaguacgguggaagcuguacuuccagaguauggaacacugggcuuggaaugcuccccgcgaaccggucuagauuucaaugagaugauccugcucacuaugaaaaacaaggccuggaugguucacagacagugguuuuucgaccugccccuuccuuggaccucuggggcgacaaccgagacuccaacauggaauaggaaagaacuguuggugacguuuaagaacgcccaugccaagaagcaagaggucgugguccucggcagccaggaaggagcuaugcacaccgcccugacuggcgcuacagagauucaaaauuccgggggaaccucaauauucgccggucacuuaaagugucggcugaaaauggauaagcuagaacucaaaggcaugaguuacgcaaugugccugaacacauuugugcuuaagaaagagguuagcgagacucagcaugggaccaucuugauuaagguggaauacaagggagaggacgcccccuguaaaaucccuuucucuacggaagauggccaagguaaggcucacaacgggcgucugauaaccgcgaauccaguagucaccaagaaggaggagcccgugaacauugaagcagagccgccuuucggcgaauccaauaucguuaucggaauuggcgacaaagcccucaagaucaacugguauaagaaagggucaagcauuggaaagauguuugaggcuacugcccgcggugcaagaaggauggccauacugggcgauaccgcuugggacuucgggagugugggaggcguccuuaauucucuggguaaaauggugcaucagaucuuuggguccgccuacacagcauuguucagcggcguaucguggauuaugaagaucggaaucggcgugcuccugacuuggauuggguuaaacucuaaaaauaccuccaugucauuuaguugcauaguuaucggaauuaucacgcuguaucuaggcgcggucgugcaggcugauauggguugugugauuaacuggaaggggaaggaacucaaaugcggaagcggcaucuucgucacaaaugagguucacaccuggacugagcaguacaaguuucaagccgacucccccaaacggcuggcaacagccauagcuggugccugggaaaacggcgugugugggauccgaucuaccacucgcauggagaaucuuuuguggaagcagauugcaaacgaacugaauuauauccucugggagaacaauauuaaacugaccgugguagucggagauaucauaggcguguuagaacaggggaagagaacacugacgccacagccuauggagcuuaaauacagcuggaagaccuggggaaaggcuaaaauuguuacugccgagacacaaaacucaaguuucaucauugacggccccaacaccccagaaugccccuccgcgagcagggccuggaaugugugggaggucgaagacuaugguuuugggguguucacaacuaacaucugguugaagcuccgggagguuuacacccagucuugugaucaucgccugaugucagcugcaauaaaagacgaaagagccgugcacgcugauaugggauacuggaucgagagucagaagaauggcagcuggaaacuagagaaggccuccuuuauugaaguaaagacgugcacauggccuaaaucucacacccuguggucgaacgguguccucgagagcgacaugaucauuccaaagucccuggcaggcccgaucucacagcauaaucacaggcccggguaucauacucaaaccgcgggaccuuggcaccuuggcaaauuggaacuggauuucaacuacugcgaggggacaacuguggugauaaccgagaauuguggaacacguggcccaaguuuacggacgaccacugucucugguaagcucauucacgaauggugcugucgaagcugcacacugcccccucuuagauauaugggggaggacggauguugguacggcauggaaaucaggccaaucaacgagaaagaagagaauaugguuaagucccuggugucagccgguagcggcaagguagauaacuuuaccauggggguguugugccucgcuauucuguucgaggaagucaugcgcggaaaauucggcaagaaacauaugaucgccggggugcuauuuacuuucguucugcuccugucuggacagauuacauggcgggacauggcacacacccuuauaaugaucggcuccaaugcuagugauagaauggguaugggggugacgcauuuggcccugauugcaacuuuuaagauccagcccuucuuagcccucggauuuuuccugaggaaacuuaccagccgcgagaaccugcuacucggcgucggccuggcuauggcgacaaccuugcaacugccggaagacauugagcagauggccaaugggaucgcauuaggacucaugacucugaaacuuauaacacaguuugaaaccuaucagcuguggacagcuuuggugucucucacuuguuccaacaccaucuucacgcugacaguugccuggcgaaccgccacucuaauucuggcuggugugucacuucucccucugugccaaaguagcucgaugcggaagaccgauugguugccaaugacagucgcagccaugggcguacccccucugcccuuauuuaucuucucccucaaagacacuccaaagcguagaucuuggccucugaaugagggggugauggcgguuggacuugugagcauucuggcuucaaguuugcucaggaacgauguccccauggccggcccacugguggccggugggcuacugaucgccuguuacguaauaaccggaacguccgcugaccuuacaguggagaaagcagccgacgucaccugggaagaggaagcggagcagacuggcguuucucacaaccucaugauuacaguggaugacgauggcaccaugcgcaucaaggacgaugaaacugagaauauccugacaguguuguuaaaaaccgcucugcucauugucagcgggauauuuccguauuccaucccugccacgcugcuuguguggcauacuuggcagaagcagacccaacggucaggaguucugugggacguacccagcccacccgagacacagaaagcagaauuggaggaagguguguacagaauuaagcagcagggcaucuucgggaagacccaagucggagugggcguucagaaagaggguguguuucacacaauguggcacgucacucgaggggcagugcuaacccauaacggaaagaggcuggagccuaauugggcuagugucaagaaggaucucauuucuuacggcggcggguggcgccuguccacgcaguggcaaaaaggagaagagguccaggugaucgccguugaaccagguaagaaccccaagaauuuccagacaaugccuggcauauuccagacuaccacaggggagaucggagcaauugcucuugacuuuaaaccgggcaccagcgguucgccaaucauuaaccgggaagggaagguggucggauuauauggcaauggcgugguuacuaaaaacgggggauacgugucagguaucgcccaaaccaaugcggagcccgauggcccuacaccagagcuggaagaggaaauguucaagaaaagaaaccucacgauaauggacuugcaccccgggucuggaaagacuaggaaguaucugccugccauuguccgugaggcaaucaaacgccggcucagaacccugauccuugcuccgacaagggugguagccgcugaaauggaggaggcacugaagggcuugcccauucgauaccagaccacugccacaaaaagugaacauaccggucgggagaucguggaucuaaugugccacgccacguuuacuaugcgccugcucuccccaguuagagucccuaauuauaacuuaauaauuauggacgaagcucauuucacagaucccgcgagcaucgcagccaggggguacauuucuacccgggugggaaugggcgaggcugccgcaaucuuuaugaccgccacuccaccuggcacagcugaagcguucccccagagcaaugccccaauacaggacgaggagcgagacauuccggaaagauccuggaacucagggaaugaguggaucaccgauuuugugggaaagacagucugguucguaccuaguaucaaagcagguaacgacauugcuaacugucugcgcaagaauggcaagaaagugauccaacuuagcaggaagacuuuugauacggaauaucagaaaacccgucugaacgacugggauuucguugugacaacugacauuucugagaugggggccaauuuuaaggcagaucgggucauagaccccagaaggugccucaaaccagugaucuugaccgauggacccgagcgcguuauucuggccggcccuaugccagugacagcugccuccgcggcacagcgaagaggucgggucgggaggaacccccagaaggaaaaugaccaauacaucuucaccggccagccucucaacaaugaugaggaccacgcccacuggacugaagcuaagaugcugcuugacaacaucaauacgccggagggaauuauaccagcccuauucgaacccgagcgcgagaaaucagcugcaaucgauggcgaauaccgucugaagggggagaguagaaaaaccuuuguggaauugaugcggaggggagacuuaccuguauggcuggcccauaagguggcuagcgaggguauuaaauauacagaucgcaaguggugcuucgacggcgaacgaaacaaucagauccucgaggagaacauggauguugaaauuuggacuaaagagggggaaagaaagaagcugcggcccagguggcuugacgcccgcaccuacuccgauccacuggcacucaaagaguuuaaggacuucgcggccggaagaaaaucuaucgcuuuggaucuggucacagaaauaggcagggugccuucgcaccuagcccaucggacccguaaugcacuggacaaccucgugaugcuucacacuagcgagcacggugggcgcgcuuaucgacaugccgucgaggaacugcccgagacaauggaaacguuauugcugcucggccugaugauccuucugaccggaggcgcaaugcucuuuuugguuucagggaagggaauugguaaaacuacaaucggccugauuugugugaucguauccagugggauguuauggauggccgauauaccacuacaguggauugcuucugcgaucgugcuggaguucuuuaugaugguccuccuuauuccugagccggaaaagcaaagaacaccccaggacaaucagcuggccuacgugguuaucggaauauugacccuggcagcuaucguggccgccaacgagaugggccuccuggaaacaacuaagagggaucuugguaugagcaaagagccaggggucguauccccuacgucauaucucgacguggaccugcaccccgcaucugcuuggaccuuguacgccguugcgacaacugugauuaccccaaugcugcggcauacaaucgaaaauagcaccgcuaacgucaguuuagccgcaauugccaaccaagcugugguccuaaugggccuggauaagggauggccuaucuccaaaauggaccucggcgugccccuucuggcauuggggugcuauagccagguuaauccgcugacucucacggccgcggugcugcuuuuaguaacacacuacgcuauaauuggaccaggccugcaggccaaggcaacccgcgaggcccagaaaagaacugcugccgguaucaugaagaacccuaccguggaugggaucaugacaauugaccucgaucccgucaucuacgacucuaaguucgagaaacaauugggacagguuaugcugcuagugcugugugcaguccagcuccuucugaugaggacuucaugggcuuugugcgaagcccugacccucgcgacaggcccaauaacgacccugugggaggguucccccggcaaguuuuggaauacuacaauugccgugaguauggcaaacaucuuccgggggagcuauuuagcuggagccggccuugcauuuucgauuaugaaaucuguagggaccggacgaagaggcacugguucccagggggaaacacugggagagaaguggaaaaagaagcucaaucaacuaagccgcaaagaguucgaucuguacaagaaaucaggcaucaccgagguggacaggacggaggcuaaggaagguuugaaacggggcgagaccacacaucacgccguuagucgugggucugccaagcugcagugguuuguggaaagaaacauggucauaccugagggaagggugaucgaucucggcugugggcgcggaggcugguccuauuacugcgcgggucuuaaaaaggucacugaagugcggggguauaccaagggaggcccgggccacgaggagcccguuccaaugagcacauacggguggaauauuguaaaacugaugucaggaaaggacguguucuauuugccucccgaaaaaugugauacucugcucugcgacaucggugagaguagcccuuccccaaccgucgaagagucucgaacaauuagaguguuaaagaugguugagcccuggcugaaaaacaaucaguucuguaucaaggugcuuaacccuuacaugccaaccgucauugaacaucuggagaggcuacagcgcaaguacggcgggaugcucgugcggaauccccugagcagaaacuccacucacgaaauguauuggaucucaaauggaacgggcaacauaguaucuagugugaauaugguuucgcguuugcugcucaacagguuuacaaugacccaucggcgcccgacuauugagaaagaugucgaccuuggugcugggacccgacacgugaacgcagaaccugagacaccaaauauggacgugaucggagagagaaucaagaggauuaaagaagaacacagcuccacguggcauuacgaugacgaaaaccccuauaagaccugggccuaccacggcucuuaugaggucaaagcuacuggcucagccagcuccaugauaaaugggguugugaagcuguuaacaaagccuugggauguagugccaauggucacccaaauggcaaugacugacacaacccccuucggacagcagcggguguuuaaagaaaagguugauacacgcacuccgagaccuaugcccgguaccaggaaagugauggagaucacggccgaguggcuguggcgaaccuugggccggaacaagaaaccacgucucugcacaagagaagaguucacuaagaagguccgcaccaaugcugcgaugggggccguguuuacagaagagaaccaaugggacagugcaagggcugccguagaagaugaggaguucuggaaacugguugaccgggaaagagagcuacauaaacuuggaaaauguggcucuugcguguacaauaugauggguaagcgcgagaaaaagcugggggaguuuggaaaagcaaagggcagcagggccauuugguauauguggcucggcgcucgauuccuggaguuugaagccuugggguuccugaacgaggaucacugguuuucacgggaaaauuccuacaguggagucgagggugaaggccuccauaaacuuggguacauccugagagacauuagcaaaaucccuggaggcgcgauguaugcagaugacacugccgguugggacaccaggauaacggaggaugacuuacacaacgaggaaaagaucacacagcagauggaucccgagcaccgccagcuggcuaaugccauuuucaaauugaccuaccaaaacaagguggugaaaguccagcguccaacucccaaggggacaguuauggacaucauuucucggaaggaucagagaggauccggccaggugggcaccuaugggcucaauacuuuuaccaacauggaagcacaacugguaaggcagauggagggagaaggugugcuaucaaaagcugaccuugagaauccucaucugcucgagaagaaaaucacacaguggcuggaaaacaagggcgucgagcgcuugaaacgaauggccauaagcggggaugacugcgugguuaagccaauugaugaccgguucgcuaacgccuuacuggcacucaaugauaugggaaaggugagaaaagacaucccgcaguggcaacccucgaagggcuggcacgauuggcagcaggucccuuucuguucucaucacuuucacgaacuuaucaugaaagacgguaggaagcuggugguaccaugccgcccccaggacgagcuaauugggagagcgcggauaagucaaggagccggcuggucccugaaagaaacggcuugucucggcaaggccuacgcacagauguggagcuugauguauuuccauaggcgugaucugcgacuugcuucaaacgccaucugcuccgcaguuccugugcacugggucccaaccucucgcacuacauggagcauucaugcccaccaucaguggaugaccacugaggacaugcugacaguguggaauagaguuuggaucgaggauaaccccuggauggaagacaagaccccugugacgacaugggaggaugucccguaccucgggaaacgggaagaccaaugguguggaaguuuaauuggucugaccuccagggcgacuugggcucagaauaucuugaccgccauacaacaggugcgcagccugaucggcgaugaggaguuucucgacuauaugccaucuaugaagagauuccggaaagaagaggaaucagagggggcaauuugguga
